United States Patent 6,812,339 (POLYMORPHISMS IN KNOWN GENES ASSOCIATED WITH HUMAN DISEASE, METHODS OF DETECTION AND USES THEREOF) - sequence listing, part 110

SEQ ID NO: 198017 - DNA, 601 bp, Human
tctgttcaggctcttgttctgcctgtgtctcaggttgcattattgcttttattagtttgggtgactgaactcttgaattttgccctatctgtggcatatactctttcctatctgggagcagtcctttatacatcctggtggtccctatagcacaatgcttatgcagaacagatgcttttgcagaggcctaggttagccagagaggcttccagtcctgggagctgtgtgttgttttggagtgtgacagcctctgcctggtcacaggtccttacctggtccagaccacatggttaactacgcyttctctgatagccttaacccaattgtctctcattctccttcaacactcgttttataaatccctgattctagatcaagctcacaacctgcctgcattggttttccagctgctgaggatggtcatgtgtgcatagagctgctgagtgcagtttgggaaaagctttatagcctggtgggttggtgccaccacaaatggatgaaccccagccactccccagactgtcctggctccaccagcccccacacgttcatcagaatatgcatctgtctttaaatccttcccctcagcctcagaggttga

SEQ ID NO: 198018 - DNA, 601 bp, Human
attaaaaaaaagcattatctaaccaattctcaccgtgggttcctgggacttagtcctgccgaggacctctggggaacagtgtagacatgtgcgtcagttatcttaccagaggggtggaggaactgggatatttatacaccagttctcgtcagtcattagtcagccaacgctgcttcaaggatgggggcattcattctttgacacgtctagcttgttaaggagatggcaaagtggactgcagcagcaagataaaagccctcaggaaaagaaaggcaagtgctggcacctggaagtggggctragcacaagagtggtaagggcaaggggttatgggcaaggcaccagtagtgtttgctctaatggttacctgtggccttcatgctgcttttcctaatgagtgctgaacccaatctgtatatcagtggtgctttctgttggatttgttgggctgttctctcattcagtctttaaactctctgttctcttggtttctgtgactctcttcttccttttctctgcaggaactttccttcttcatcttcttgtgagtgcttccttttctgccaattgctcaaccttgaggtcccctagggttccctac

SEQ ID NO: 198019 - DNA, 601 bp, Human
agccaacgctgcttcaaggatgggggcattcattctttgacacgtctagcttgttaaggagatggcaaagtggactgcagcagcaagataaaagccctcaggaaaagaaaggcaagtgctggcacctggaagtggggctgagcacaagagtggtaagggcaaggggttatgggcaaggcaccagtagtgtttgctctaatggttacctgtggccttcatgctgcttttcctaatgagtgctgaacccaatctgtatatcagtggtgctttctgttggatttgttgggctgttctctcattyagtctttaaactctctgttctcttggtttctgtgactctcttcttccttttctctgcaggaactttccttcttcatcttcttgtgagtgcttccttttctgccaattgctcaaccttgaggtcccctagggttccctactgagctctctgcttatatgattttgccttctcttgtggttttaattatgactcacgtgtgatgacttctaaaccttaattcatcattgacattaatatgtgagcctattcactcagcagatcaatttgatgttggaaaacctaatctgtctacacttgatt

SEQ ID NO: 198020 - DNA, 601 bp, Human
ctgcttctcttccaacttgtttgccaaatgccctcacagcaactgttcttaaactttaccatgtgcctccagtgttctgactcctccatttttatctccatctatcagactccactttcctcgctttccaaattagaaatgatatcccaacattttaatgtcgttcacaaataccctagaatcccctgccttctgaatatttgtcttacacccctgggaaaaccccagcctttgatgaacccagctaactggcttcaccatgtttgtttttgggcagctaagcatcactggagaacagcamacagcaggacgatagtagctgggtataagcagaattgtgtttatcctatcactaagcagtttcctttgggcagttatagttcaattgcatgcattcagacaaaaaaggaagcatgtacctcaaaagtgtcatgtatgcatgtgtagtttatatgctcacacacatacttcatatgtatcaggcttactgaagtataatttacatgtggtaaaattaaactcttttggcatacatttctacgcacatagtcctgtgactactgccacaagtaagatatagaatattttcattacccttcaa

SEQ ID NO: 198021 - DNA, 601 bp, Human
aaatgatatcccaacattttaatgtcgttcacaaataccctagaatcccctgccttctgaatatttgtcttacacccctgggaaaaccccagcctttgatgaacccagctaactggcttcaccatgtttgtttttgggcagctaagcatcactggagaacagcacacagcaggacgatagtagctgggtataagcagaattgtgtttatcctatcactaagcagtttcctttgggcagttatagttcaattgcatgcattcagacaaaaaaggaagcatgtacctcaaaagtgtcatgtakgcatgtgtagtttatatgctcacacacatacttcatatgtatcaggcttactgaagtataatttacatgtggtaaaattaaactcttttggcatacatttctacgcacatagtcctgtgactactgccacaagtaagatatagaatattttcattacccttcaaaatttccttatatttcacctatgcagtcaactccccagcccatagtaaccactgacctatcttctgtccctaacttttgccttttctaagattccatataagtggaattatgtaatattatagccttttgagcctg

SEQ ID NO: 198022 - DNA, 601 bp, Human
ccagctaactggcttcaccatgtttgtttttgggcagctaagcatcactggagaacagcacacagcaggacgatagtagctgggtataagcagaattgtgtttatcctatcactaagcagtttcctttgggcagttatagttcaattgcatgcattcagacaaaaaaggaagcatgtacctcaaaagtgtcatgtatgcatgtgtagtttatatgctcacacacatacttcatatgtatcaggcttactgaagtataatttacatgtggtaaaattaaactcttttggcatacatttctaygcacatagtcctgtgactactgccacaagtaagatatagaatattttcattacccttcaaaatttccttatatttcacctatgcagtcaactccccagcccatagtaaccactgacctatcttctgtccctaacttttgccttttctaagattccatataagtggaattatgtaatattatagccttttgagcctggcttcttttacttaacatagtgcttttgaaccatattgttgcattttttttttttttttgagacggagtctcactctgttgcccaggctggagtgcaatggcat

SEQ ID NO: 198023 - DNA, 601 bp, Human
tagtcctgtgactactgccacaagtaagatatagaatattttcattacccttcaaaatttccttatatttcacctatgcagtcaactccccagcccatagtaaccactgacctatcttctgtccctaacttttgccttttctaagattccatataagtggaattatgtaatattatagccttttgagcctggcttcttttacttaacatagtgcttttgaaccatattgttgcattttttttttttttttgagacggagtctcactctgttgcccaggctggagtgcaatggcatgatctyggctcactgcaacctctgccttctgggttcaagtgattctcctgcctcagcctcctgagtagctgggattacaggcatgcgccaccatgcctggctaatttttgtatttttagtagagagggctttcactatgttggtcaggctggtcttgaactcctgacctcatgatctgcccacctcggactttcaaagtgctgggattacaggcataagccaccgcgcctggccccaacattttaatctctttcacaaataccctagaatcccttgccttctgaatatctgtcttatacccctggg

SEQ ID NO: 198024 - DNA, 601 bp, Human
agtgcttttgaaccatattgttgcattttttttttttttttgagacggagtctcactctgttgcccaggctggagtgcaatggcatgatctcggctcactgcaacctctgccttctgggttcaagtgattctcctgcctcagcctcctgagtagctgggattacaggcatgcgccaccatgcctggctaatttttgtatttttagtagagagggctttcactatgttggtcaggctggtcttgaactcctgacctcatgatctgcccacctcggactttcaaagtgctgggattacaggcrtaagccaccgcgcctggccccaacattttaatctctttcacaaataccctagaatcccttgccttctgaatatctgtcttatacccctgggaaaaccccagccttggatgaacacaactatatatacaggcatccctatacagtatatatgtatatagtatatatacatatgcatccatatagtctctctctatatatgtgtatgtttatatgtatgtgcatatatgtatatacatacgtgcacatatgtgtgtgagagtgtttgtgtgtgtgtgtgtatatatatatatatggattcac

SEQ ID NO: 198025 - DNA, 601 bp, Human
gatctcggctcactgcaacctctgccttctgggttcaagtgattctcctgcctcagcctcctgagtagctgggattacaggcatgcgccaccatgcctggctaatttttgtatttttagtagagagggctttcactatgttggtcaggctggtcttgaactcctgacctcatgatctgcccacctcggactttcaaagtgctgggattacaggcataagccaccgcgcctggccccaacattttaatctctttcacaaataccctagaatcccttgccttctgaatatctgtcttataccsctgggaaaaccccagccttggatgaacacaactatatatacaggcatccctatacagtatatatgtatatagtatatatacatatgcatccatatagtctctctctatatatgtgtatgtttatatgtatgtgcatatatgtatatacatacgtgcacatatgtgtgtgagagtgtttgtgtgtgtgtgtgtatatatatatatatggattcacatgccacagtttgctactcaccggttgaaagatgtttgtttccagttttggtgattatgaataaagctgtgaacattatgtgaaca

SEQ ID NO: 198026 - DNA, 601 bp, Human
attctcctgcctcagcctcctgagtagctgggattacaggcatgcgccaccatgcctggctaatttttgtatttttagtagagagggctttcactatgttggtcaggctggtcttgaactcctgacctcatgatctgcccacctcggactttcaaagtgctgggattacaggcataagccaccgcgcctggccccaacattttaatctctttcacaaataccctagaatcccttgccttctgaatatctgtcttatacccctgggaaaaccccagccttggatgaacacaactatatatayaggcatccctatacagtatatatgtatatagtatatatacatatgcatccatatagtctctctctatatatgtgtatgtttatatgtatgtgcatatatgtatatacatacgtgcacatatgtgtgtgagagtgtttgtgtgtgtgtgtgtatatatatatatatggattcacatgccacagtttgctactcaccggttgaaagatgtttgtttccagttttggtgattatgaataaagctgtgaacattatgtgaacataagttttcctttctattgggtaaataattgggactggtaa

SEQ ID NO: 198027 - DNA, 601 bp, Human
ttcaaagtgctgggattacaggcataagccaccgcgcctggccccaacattttaatctctttcacaaataccctagaatcccttgccttctgaatatctgtcttatacccctgggaaaaccccagccttggatgaacacaactatatatacaggcatccctatacagtatatatgtatatagtatatatacatatgcatccatatagtctctctctatatatgtgtatgtttatatgtatgtgcatatatgtatatacatacgtgcacatatgtgtgtgagagtgtttgtgtgtgtgtgtrtatatatatatatatggattcacatgccacagtttgctactcaccggttgaaagatgtttgtttccagttttggtgattatgaataaagctgtgaacattatgtgaacataagttttcctttctattgggtaaataattgggactggtaatgctgggtaatatggtagttatttgtttaaacttctaagaaacagctaaattattttccaaagaagttgtaacatttttcattcctaccagtaacctgggcttattgttaacacttggtactatcagctttaaaaattttattcattctg

SEQ ID NO: 198028 - DNA, 601 bp, Human
caactatatatacaggcatccctatacagtatatatgtatatagtatatatacatatgcatccatatagtctctctctatatatgtgtatgtttatatgtatgtgcatatatgtatatacatacgtgcacatatgtgtgtgagagtgtttgtgtgtgtgtgtgtatatatatatatatggattcacatgccacagtttgctactcaccggttgaaagatgtttgtttccagttttggtgattatgaataaagctgtgaacattatgtgaacataagttttcctttctattgggtaaataaytgggactggtaatgctgggtaatatggtagttatttgtttaaacttctaagaaacagctaaattattttccaaagaagttgtaacatttttcattcctaccagtaacctgggcttattgttaacacttggtactatcagctttaaaaattttattcattctgataggtatgtaatggtattcattgtagttttaattttgcattttcctaatgactagtgaagttgagcatcttttaatgagtataaagataatccactaaagacacttatttggtgaaatctctgcttaaatcttctac

SEQ ID NO: 198029 - DNA, 601 bp, Human
tatatgtatatagtatatatacatatgcatccatatagtctctctctatatatgtgtatgtttatatgtatgtgcatatatgtatatacatacgtgcacatatgtgtgtgagagtgtttgtgtgtgtgtgtgtatatatatatatatggattcacatgccacagtttgctactcaccggttgaaagatgtttgtttccagttttggtgattatgaataaagctgtgaacattatgtgaacataagttttcctttctattgggtaaataattgggactggtaatgctgggtaatatggtagwtatttgtttaaacttctaagaaacagctaaattattttccaaagaagttgtaacatttttcattcctaccagtaacctgggcttattgttaacacttggtactatcagctttaaaaattttattcattctgataggtatgtaatggtattcattgtagttttaattttgcattttcctaatgactagtgaagttgagcatcttttaatgagtataaagataatccactaaagacacttatttggtgaaatctctgcttaaatcttctacatataaaaatcggattgttttattattgtat

SEQ ID NO: 198030 - DNA, 601 bp, Human
gtatatatatatatatggattcacatgccacagtttgctactcaccggttgaaagatgtttgtttccagttttggtgattatgaataaagctgtgaacattatgtgaacataagttttcctttctattgggtaaataattgggactggtaatgctgggtaatatggtagttatttgtttaaacttctaagaaacagctaaattattttccaaagaagttgtaacatttttcattcctaccagtaacctgggcttattgttaacacttggtactatcagctttaaaaattttattcattctrataggtatgtaatggtattcattgtagttttaattttgcattttcctaatgactagtgaagttgagcatcttttaatgagtataaagataatccactaaagacacttatttggtgaaatctctgcttaaatcttctacatataaaaatcggattgttttattattgtattttgaggggtctaaaaatattctagatacaagacatttataaacaatatgttttgcaagcattttctccaggtctgtgacttgcctttttattttattcacagtgttttgtgaagagccaaagttttgaca

SEQ ID NO: 198031 - DNA, 601 bp, Human
tgacaaagtcaaatttatcaaattttactatcacactggtctttaaaaataaaaaattattattttttatttttgataccccagtttcttcacctctctgatgagatacagatgagatactgatgtacaggtctacactgttccccagggacccccagcagggtcatactttttgtgttgtatttaagaaatctttttctaattcaaggtcacaaagatattttcttgtagaaattttaaattctaggttttacttttacagtattatccattttaagttaattttttgtaatggtgtgaygtatgaattgaggttcaatttttttgtatatggtttgcatatggctcaatttttttgtaattatttcaacatcatttgttgaaaagtttctccactgaattacctttgcaatttggccaaaaatcagttgatcatatatttatgggtttatttctagactttctattttttctattaatttatatatctttcctttcaccaaagccatactttattactgtagcttagtagtaagtattgaaatcagttagtgtgaattctccaacattgttcttcatttaaaaaaattgttctggtaaa

SEQ ID NO: 198032 - DNA, 601 bp, Human
cactggtctttaaaaataaaaaattattattttttatttttgataccccagtttcttcacctctctgatgagatacagatgagatactgatgtacaggtctacactgttccccagggacccccagcagggtcatactttttgtgttgtatttaagaaatctttttctaattcaaggtcacaaagatattttcttgtagaaattttaaattctaggttttacttttacagtattatccattttaagttaattttttgtaatggtgtgacgtatgaattgaggttcaatttttttgtatatgrtttgcatatggctcaatttttttgtaattatttcaacatcatttgttgaaaagtttctccactgaattacctttgcaatttggccaaaaatcagttgatcatatatttatgggtttatttctagactttctattttttctattaatttatatatctttcctttcaccaaagccatactttattactgtagcttagtagtaagtattgaaatcagttagtgtgaattctccaacattgttcttcatttaaaaaaattgttctggtaaaaaattattcgagtttttttacttttccatataa

SEQ ID NO: 198033 - DNA, 601 bp, Human
tattacaagggattacagcctgaaggcccaagcctaataacacaagatgcttaggttaggttgttagtttattcctgtgctttctttatatccttatttcaagatatggctcaactttcctcatggcctattgactgatgtactgtatcatcaaaatagaaaattggcacgagcattctttggatgtaaaaaatcacagaggtcctaaatactattagaattactatggtggtaattgttcaaaattgcctaatgtcatcttaatggttatgagagatggttaccaaagctctagggattrgatttacaaggtggattcaatttcagttcacatttggggacaatctcagtcttggagggagttaacatcttgaagaacagtcatgtggtagttgtccatgtgtggaccaaagactatggcactttcttctcaaaccctacatggccctgaattatctgtttcctctattcagctatgtgggcagtctttataatttaacctttcaaagctgtgctacaatacgatgactagagcattttatataggacatgacttttgtgtactagtgacctgttattttcctgttttgggtttgtcagg

SEQ ID NO: 198034 - DNA, 601 bp, Human
ggtgattgatgtggggtattttgtggaagcagagtctaaagagtcatcattattggcagtgataaggggtcctggcatagccctctgacttaagagccttcacacttcttgctgagcagatggtcgccctttctgtgagctcccttgatacttccactgctataatttggacatctttgctgatcatcacttacttgtccatcttccttgctggatggagtgtgcataagtcagggtcagagaatcttacactcatccccccagggcctcactcagggcctggctgatgatgttgactgartgagccctataaatacacttgcagtcagtctggcacagtgagaagggtaagggctctggcatcattccaacaattggaaattaaaatggaaaaaaaaaggcatgaattgaaaaggtttgaatctgagctctgctgcctgtggatttcctgtgtcttaagtacttattctaagtcacatttttcccatctgtaaaatgagggtattatctatttcattagttcatcatattataggactaggtaagtggatattattggaacaattatttaatgaatacattgtgtcacttaaccctatct

SEQ ID NO: 198035 - DNA, 601 bp, Human
tatctgtagcccaaaactcttatggaggactttgatctttagtataggctattggtcagggccataggaactaaccccgatcctcactccaccaggatctaccacatcccctacacacaaacacatgctgtggggagggagttttcccctgggtcaagttgaggatccttagatcaccttgtgctcctgtggactggtgtgtgcgtgtgtgtgtgtgtgtgtgtgtgtgtgtgtgtgtgtgtgtgtatgttgggaaacttagctttcagagaatgtctatgggctctcattttctctctcrcacaaaaatactcgggacttctccaagtccctgaggagcctgaccactgaagctgatcatgagatgactgtatgctgacacacccccttcaggggcctggccttgacttagggctgcactgtatcctcagcaacggccttgcaggagccccttttggactgctttccctattcagcccagagttggggtggtgggagaagaggggttggagtgaatccatctctattcaaattccagctgggattactctaggagtcttcctggcttgttttgggctcaaacttagctacattgtttatt

SEQ ID NO: 198036 - DNA, 601 bp, Human
gcggcagcctagaattttctaaacagagattggtttagagtaccctggggtacttggagatcccactgtatgagataagaggaaggtagagccagcaggactccaggccacaccttcacatcaacaaaagtaatgtttagtgtctatgttgacttctgacttcatatagataaaggattccactggaacaaaaagagtctgactacattttcacgaatgcaacaaatattgatagaatccttgtgttagtggttttctaaatggtttactgaattaaagagtgtactatttgatatcatargtttgagtttaattgactggtatttcagtgactactcatttcctcttaggcaacagtttactaccatcaagttcagtgctttgactttgatcaactgactgggtttatccaaagtacaggtgagcagaagaacacagatgaggaaacagtcctgataattattcctatatttttagttttaaacaaatttatgtaaaagtattatattttacatggcactaaaatcaatttctgttgcataaggtacattgacatataaacgacattggtaaacataaaataggtttgaggagaggggag

SEQ ID NO: 198037 - DNA, 601 bp, Human
gataaagatgggaagttatttacatcgacattaaccaaatctacccttcatgcagaaagaaagagctcttgggccattctctattaatgaaaccataccagggtcaatattacagtgtctctgaaatacactgaaaatacttccctggctcaggtggtggcccatgctacctccaggcagttctacttgattaatgatgcaatggagataatcctattgcatccaccatcaaggagagttgggcagtcattcagagaaagtgggactcaatagacattctgactattaattcaatcatgtwtacatgcagatcaaagggtaaagtttttctttacaccttatatatccttctcttccaaggtggaagtccattcacaaccaattcactgctaggcagacctctttcctaacaagtacagatggatggcatagtggggattagaacacctcagcactcacaggggcatcctatgggagccaggctggcttctaggacctcttatggatggaagttatttagtggatcttcctggatttgattttatttctttgatctcttaagtacatcaatctttgggtttgctacctgtaatttttgtct

SEQ ID NO: 198038 - DNA, 601 bp, Human
tccaggcagttctacttgattaatgatgcaatggagataatcctattgcatccaccatcaaggagagttgggcagtcattcagagaaagtgggactcaatagacattctgactattaattcaatcatgtttacatgcagatcaaagggtaaagtttttctttacaccttatatatccttctcttccaaggtggaagtccattcacaaccaattcactgctaggcagacctctttcctaacaagtacagatggatggcatagtggggattagaacacctcagcactcacaggggcatcctawgggagccaggctggcttctaggacctcttatggatggaagttatttagtggatcttcctggatttgattttatttctttgatctcttaagtacatcaatctttgggtttgctacctgtaatttttgtcttaggaaggcagcatctctattctctccaggaagaaatcttgatgcaggaagaagaaaaagcctggtatcctgccctgtttttgttctcatggagattcaacagatttttacgtaatctctttttactataattcaccctgcgtttcttgaattctttgtgaacatcccttt

SEQ ID NO: 198039 - DNA, 601 bp, Human
ttctttgatctcttaagtacatcaatctttgggtttgctacctgtaatttttgtcttaggaaggcagcatctctattctctccaggaagaaatcttgatgcaggaagaagaaaaagcctggtatcctgccctgtttttgttctcatggagattcaacagatttttacgtaatctctttttactataattcaccctgcgtttcttgaattctttgtgaacatccctttctcctgtagctgacagcttctgttctttctcttggggcttatgagctttctgagtcagatcttttagcaaagcyttagttttctgctcatggagatcattaaggatctctactaccagctgccagattttgcatttattttcaactagagctttggtggctggcagcagttaaaaaatcattttccaagtttaaaatttttttcttccagctgatgccttgctgacacttcattatttggcttagactataaatggcatcttttttttttttttttttccaattcttgttaatgtgggttttggcattgtctgatgaccctaacttttcatctttttaccatggtaatctgccagttgactctttattttcaaa

SEQ ID NO: 198040 - DNA, 601 bp, Human
gatgacacagttacattagattatgttggataagttctatcactgctgaatctgcttccttaacttgtgttcacctacaattttaacttactattgcttgcattgtttttaagtcttcaaaagtcctcagtctacttgaacacagcttctcttgtgacacttttcctcttctggtctaagtttctttttggtgagctcttggggtcctaataagagaatttctgcagtccagagaaggaggagggagcatctggtaccaaagtaccaaatgtgttcatgagtgtgtgtgtgtgtgtgtgtrtgtgtgtgtgtgtgtatgagagagagagagagagagacagagagagagagaagagagagacagaggaaaagagattggtcttccctttttactttttgtagctttcttctttctaccgcttcttgtgttttgggaaaggtgggtttcctcccttcaattccgtatgtctccttgctcaaaaatcatgctgacaggaggtcatggctcctgatacagtaaacctcaggatggtctttgcccatgcaagaggtttggctggcaattcacgttaatttcttctcccttctgacttgaaaaact

SEQ ID NO: 198041 - DNA, 601 bp, Human
ccatttagagcaaaagaaataggcagagtccttcctctgtgaccagtgaattttggatgcactgcagtcttctgccttcattattcagagtatctagaagtagatgacacaatgtcagatcttccacaagaacccttgccactattccacagagtaactctcatgatcaaggtgcctggtcctacttaagctaacaaaaaattgctttcacaaaacaatcaactaatcaaaaatccttggatgttacaaatcatttttcctctgccctgagcaatatttctatgggtatttctatataggmttatctacagttaatatttataaagtaagatttcattggagtatattcgcctctcagtataatctgatacatatcttgattttttcttttataatattgctcttttattattcttgatcattgacattgccatataaatggtagaatcaacttgtaaatttctaccaaaatgccagttggaatttctatcagaattgcattggatctggagatcaatttatgaagaactgactttttaaacataacaactcttctgatccatgacaaggtttatctccccactaatttaattctttcata

SEQ ID NO: 198042 - DNA, 601 bp, Human
aattttggatgcactgcagtcttctgccttcattattcagagtatctagaagtagatgacacaatgtcagatcttccacaagaacccttgccactattccacagagtaactctcatgatcaaggtgcctggtcctacttaagctaacaaaaaattgctttcacaaaacaatcaactaatcaaaaatccttggatgttacaaatcatttttcctctgccctgagcaatatttctatgggtatttctatataggattatctacagttaatatttataaagtaagatttcattggagtatattygcctctcagtataatctgatacatatcttgattttttcttttataatattgctcttttattattcttgatcattgacattgccatataaatggtagaatcaacttgtaaatttctaccaaaatgccagttggaatttctatcagaattgcattggatctggagatcaatttatgaagaactgactttttaaacataacaactcttctgatccatgacaaggtttatctccccactaatttaattctttcataatttcttttttttatttttaaaagaaatcatctgatttgtaaacatac

SEQ ID NO: 198043 - DNA, 601 bp, Human
ctttttaaacataacaactcttctgatccatgacaaggtttatctccccactaatttaattctttcataatttcttttttttatttttaaaagaaatcatctgatttgtaaacatacactcaatttcttgatatttcttcttaacttatggcctaaatcttgattattttgcttaattttaataccttcccataagagcaaatttagtaaattaatacaccttccagttgttggcattttgagagtattggctcaaagaaagtgtcaggaaaatgggcaagaacactgcaatcttggaaargacatggagttatgtaacaaaaactgggctgagacatggttttatttctcactagctgtgtgagtttgggaaagtcatttaacccatctgtgcctcagtttcttaattaatgactgacttgcctcccccacagcgcaattgtacaaaccgagggaaatgaaagttttaatttatccctgcagcatcctgatggctaagaaaaaaattataatctaaaggtttagcacacctagatggaaatatgttttctgagggaatatcataaagagagggaggggctgggattgccacccttcagac

SEQ ID NO: 198044 - DNA, 601 bp, Human
tttggtttcactactaaatatagtactagattgacagcagttacaaaaccagaacagatgcacaaccatgtcaagtgtgtttccaatattgagaagttctccaagaagagtgatggaatgaagacacttaggataattgaaaatatgcataaaagatgggtatacagtagtctcttgatatcgttatctttcatggtgttttcttggatggctagctaacaaaaaacaagaaaagaagagcatatgcaataacgactttttccattgtcttaaatgttttgacccctaaaaataggtcatraagtcaattttctatgagcaatgtatttgtttcaaaacacaaaagatgcagacgtgtagatgcacatacagacttagctttctattctacctttgattttcttaatatggtacaaacatctctcagagcctaaaaagaacaaatttactaatttcttaaatattgtgactggtttctgcaaaagggtcatgtcctaggaccaataaagcaattcatttaaacttttttggccaatatcaaagagatgaaatcaactgtgtggattaaattatctactgcctgttgcaattataaccaaag

SEQ ID NO: 198045 - DNA, 601 bp, Human
tggacattattagtaatagccaagtgaatatctactgcagtgaatattctggaaaattgattctaatatctgaaaattgtttagtcaaggaaggccatgttggaaacaagcattaccacaggcttatattgcaatttctgaaaatcccactaagtggctttcagaaatgcaaaaataataaaaataaactgcaatgtcttattgagtaaggtttaaagatagactgtcacacgtatttattttcaatggtgacataaaacaatgactatataggctcacaatattataatatgctctgaakaagtcataattccataattaatgcaaggcaaggatcaatcaaacattgtgggcagccttccaccaagtaacagcctaccaatttggggggaaaaatatcaggttccctttgctcactataaataagctaataaagacttgatgaatactttattcttccattaaaagaaacactagctccatccaaaaatcagttattgagacataagccttaccttgtgtgataatgaacttcttttagaggatgtatttggtttcactactaaatatagtactagattgacagcagttacaaaaccag

SEQ ID NO: 198046 - DNA, 601 bp, Human
aaattacatgaaaggagaaacaagacataagaaagtagatacagcatttcaaaaatccagttacctaaaagagaaatgaataacctgaagattcaagataatgcttaaaggacaataaattcttccatttcatctacaaacacaacttgttcccataatgtgtaaaacagttcaaatgttcttgggtatactcaaatcagatcacatgtcctgtaccgtcacatacacagccttcgatacagactaaaaaagcctaaaaggcaaataccaccttccgcccatattctacccatccgacctmcatgagtcgaaaagaggttctgtttccatggtaatatagagctatgtcattaatcaatatttatcaaatactgattgacatcagagagctaggatacaaaaaatacagtattatgcgatgatagaggaaatatctgcagaaaataacaatttttttcattttaaaacaaaattcctgggaaaactgcactgaaaaagcaaaatactaaataattcttgaaatcacactcatattacacaacccgtatgaaaaaagacctgaacatctacaaagaaacatgagatcttcttgatttggagc

SEQ ID NO: 198047 - DNA, 601 bp, Human
ggaatctattgacttttgttaagaaaaactccattcaagtactttagaatcacatttataagaactgatatgctaattataacttacacatataatcatagtaagttctttcagaggttctaagggccaaatacttattggtatagtatagtttctctactctcccttctctcaacatgcaattggatactagaaggctaggtaacaagagtatttaataaattaagttattctgctgttttttttaaaaaagaataacactgctaatgatgttggtgtccttacttgatctattaatgaygcacatcatggtttttctctagttgctaagaattagcacacagtttggtaaatgaatgttttaaaatataaatttagggtaaaaatttcaaacttactctatcagtggtgctccatacagaacaaaaattacatgaaaggagaaacaagacataagaaagtagatacagcatttcaaaaatccagttacctaaaagagaaatgaataacctgaagattcaagataatgcttaaaggacaataaattcttccatttcatctacaaacacaacttgttcccataatgtgtaaaacagttcaa

SEQ ID NO: 198048 - DNA, 601 bp, Human
gtgttaaattttacctttaaactataaacaccagcttattcagtatttgaatacaggaatctattgacttttgttaagaaaaactccattcaagtactttagaatcacatttataagaactgatatgctaattataacttacacatataatcatagtaagttctttcagaggttctaagggccaaatacttattggtatagtatagtttctctactctcccttctctcaacatgcaattggatactagaaggctaggtaacaagagtatttaataaattaagttattctgctgtttttttwaaaaaagaataacactgctaatgatgttggtgtccttacttgatctattaatgatgcacatcatggtttttctctagttgctaagaattagcacacagtttggtaaatgaatgttttaaaatataaatttagggtaaaaatttcaaacttactctatcagtggtgctccatacagaacaaaaattacatgaaaggagaaacaagacataagaaagtagatacagcatttcaaaaatccagttacctaaaagagaaatgaataacctgaagattcaagataatgcttaaaggacaataaat

SEQ ID NO: 198049 - DNA, 601 bp, Human
cactcttagccatgctttgaggtttggtcctaacaaacataagcaaggcacagtagtaaaagtagacaaaataactgcaaataaaaatgtttccaacgccaacctagaaaaaaaaaaagattactttttaaaaaagtgttaaaggtaaacatacacatacataatctttattatataaataaaatgtgaaatatcttcctatgctttactttgaaaggtaacatgaatgccaccaaaatgatgactataaataattttaccaccaacatgtagctttaaaaaacaatctagcaagtatttygctttaatgatagatttcagaagtgttaaagaccctaggatccatgctgagactttcactgcaaacacaaacaaacaaacaaaatccatttctagatagttagctttctgctcaatagtctctctggaactttctctacaactagtggttcaatacactattgaaccactattgaaccactattgaatactagttgtagtggttctctacaactagtggttaacatatattggaaacacctggagagctggataaactaaagattggtgggggctctacccctagagtttctgactgaag

SEQ ID NO: 198050 - DNA, 601 bp, Human
tggagggaggggcttgtagttctgcctgccctgtccccagtccctaattgcagtgaccccttaaggcatctctgagcaccatcagcaatgagaagcactcagaataatcagcaaactgccatgaatagaaaaatacttcattaattattttttaatttcaatatcattataatataaaattaaaacttacccatttctactgaacactcttagccatgctttgaggtttggtcctaacaaacataagcaaggcacagtagtaaaagtagacaaaataactgcaaataaaaatgtttccaaygccaacctagaaaaaaaaaaagattactttttaaaaaagtgttaaaggtaaacatacacatacataatctttattatataaataaaatgtgaaatatcttcctatgctttactttgaaaggtaacatgaatgccaccaaaatgatgactataaataattttaccaccaacatgtagctttaaaaaacaatctagcaagtatttcgctttaatgatagatttcagaagtgttaaagaccctaggatccatgctgagactttcactgcaaacacaaacaaacaaacaaaatccatttctaga

SEQ ID NO: 198051 - DNA, 601 bp, Human
atttaaatgactttcaagaagctaaaattttaacttagccatgctgaaaatatatacggccaccaaggaaatgaaatctcataaaacttgagctctggtatcttatcacaaaaaaggctaaacaagaaattatcattgttacacaacacatttttagattgtggaccccacttctaccttataaaatgtatgtaagcaattttatttacagcagtcttatcacagtgccaaattatcccagaaccatggttttcaaggctttcttttaatagtagaatttttttttatttcttcttcttctttttttttttaaacaaacaaaaggctaggtggaattctaccatacagaaaaaaggagagctgatcttgctaacgtggagggaggggcttgtagttctgcctgccctgtccccagtccctaattgcagtgaccccttaaggcatctctgagcaccatcagcaatgagaagcactcagaataatcagcaaactgccatgaatagaaaaatacttcattaattattttttaatttcaatatcattataatataaaattaaaacttacccatttctactgaacactcttagccatgctttgagg

SEQ ID NO: 198052 - DNA, 601 bp, Human
tcagcaaaagaatcctcctaataaggccgggtgtggtggctcatacctgtaatcccagcactttgggaggcgaggcgggcggatcatgaggtcgagatcaagaccatcctggccagtgtggtgaaaccctgtctctactaaaaatagaaaaattagctgggcatggtggcatgcacctgtagtcccagctacttgggaggctgaggcaggagaatcacttgaacctgggagatggaggttgcagtgagccgaaatcatgccactgcactccagcctggcgacagagcgaggttccatctcaaaaaaaaaaaaaaagattcctcctaatacttcagaaaccacacacagcttagcataacacaataacacagagcacagactaagtgctcaagaagttcttgctgctgggtgataaataggaaagaatcaaataaccttctggctttcttagctagatctccactatttctggtgcatatcatttaaatgactttcaagaagctaaaattttaacttagccatgctgaaaatatatacggccaccaaggaaatgaaatctcataaaacttgagctctggtatcttatcacaaaaaaggctaa

SEQ ID NO: 198053 - DNA, 601 bp, Human
tcccttgaacagataagctcctcagcaaaagaatcctcctaataaggccgggtgtggtggctcatacctgtaatcccagcactttgggaggcgaggcgggcggatcatgaggtcgagatcaagaccatcctggccagtgtggtgaaaccctgtctctactaaaaatagaaaaattagctgggcatggtggcatgcacctgtagtcccagctacttgggaggctgaggcaggagaatcacttgaacctgggagatggaggttgcagtgagccgaaatcatgccactgcactccagcctggcracagagcgaggttccatctcaaaaaaaaaaaaaaagattcctcctaatacttcagaaaccacacacagcttagcataacacaataacacagagcacagactaagtgctcaagaagttcttgctgctgggtgataaataggaaagaatcaaataaccttctggctttcttagctagatctccactatttctggtgcatatcatttaaatgactttcaagaagctaaaattttaacttagccatgctgaaaatatatacggccaccaaggaaatgaaatctcataaaacttgagctctggta

SEQ ID NO: 198054 - DNA, 601 bp, Human
gcgtgagccaccacactcgtcccaaacagtactgatttcaaagggaataagtcggtaatttatgaagccaagctactcagcatgcatcttttgctctcattgggctgttacctttcaaatcacacaaaaataccctgttcatttcagtttcaatgcttttatccattctccttgcacgaggtgcctttctcttccttcttggtctcaccaaatcatatactcttgacttaagtccatcatagatcattcccatctccccctccattctttactgatgctctgtccctttgagttcctacascacttattgctggatttacacatttgtaatctgatgttatttgctcatttttgtcccttgaacagataagctcctcagcaaaagaatcctcctaataaggccgggtgtggtggctcatacctgtaatcccagcactttgggaggcgaggcgggcggatcatgaggtcgagatcaagaccatcctggccagtgtggtgaaaccctgtctctactaaaaatagaaaaattagctgggcatggtggcatgcacctgtagtcccagctacttgggaggctgaggcaggagaatcacttgaacct

SEQ ID NO: 198055 - DNA, 601 bp, Human
ttttcctttgcattcacaacttggctatttggcacaaggggcttcacttttagtctgtctcagttcttgacaacttaactttttcattaagcttaatcacttctagcttttgatttaaagtgagagacaagtaaaattttcctttcacttgaacacttaagagaccatagtatggttattaactggcctaaatttgatatttttgtatctcagggaacagggacgggagagagagggagggtggggaagggagagagacagagagaacacgttggtaggtgaagcagtcagaagatgtacracatttattaagatcgtcatcttatatgggtatgagccatggtgccccaaaacaattacaaaaagtaacagcaaagaccacagatcaccataatagatataataataatgaaaaagcttgaaatattgtgagagtttccaatgaagagaacacatgctgttggaaaaacggcgctgatacatttgcttgatgcagggttgccacaaaccttcaatttataaaaaacagtatctgatctgagcaatatctgagaagtacaataaagtgaggaacaataaaatgaggtatgcctgtattttg

SEQ ID NO: 198056 - DNA, 601 bp, Human
taaaatccaagaagtagaattgctgggtcgaagaagtatatttgtaatttttacagatagtaccaaactgcactttacagagtttgaacactggagcttgcttctcaaacccttaacactaccatgtgacccagcaatcccgctccaaggcatacccaagataaataaacacatatgtccataaaaaaacctatacacaaatgtttgatgcagcttattcacaacaaccaaaatgcaaaatgtggaaagaacctagatgtccatcaactgataaatgggtaaacaaaatttgatatatatscatacaatggaatattattcagccacaaaaaggaatgaagtactgaagcatgctacaacatagataaaccttgaaaacattatgctaagtaaaaaaaggcagtcacaaaagatcacataagacccaatttataacaaatttccaggataggcaaatctatagagacagtaagtagattggtggttgcaaaaagtcattgaattgtatattttaaatagatgatgtgtacggtgtgtgaattatatctcaatactgttttaaaaaataaccacctcccagctacctcagtttactacgtgt

SEQ ID NO: 198057 - DNA, 601 bp, Human
taaaatggcttttatccaaaaggcaggcaataacaaatgctggcgaggatgtggagaaagggaactctcacatactgttggtgggaatgtaaatcagtacaaccattatggagatcagttctcaaaaaaacaaaaacagatctaccatatgatccagcaatcacattgctaggtatatacccaaaagaaaggaaatcagtatattgaagagatagctggactcccatgtttattgcatcactaatcacaatagccaagatttggaagcaacctaagtgtctatcaacagactaatggattaaaaaaaaaaagtgatacatacatgcagtggagtaccacttggccattaaaaaaagaatgagttcctgccatttgcaacaatgtggacagaactggaggtcattatgttaaatgaaataagccaggaacagaaaggcaaacttcgcatgttctcacttatttgtggtagttaaaaaaacaattgaactcatggagatagagagtagaaggatggttaccacaggctgggaagggtagtagtgggggtggggggtgcagagaatgtgattaatgggcatgaaaaagatagaatgagtaagat

SEQ ID NO: 198058 - DNA, 601 bp, Human
gacttaaatttaagaccacaaactatgaaactactaaaaggaaacattggggaaactttccaggacactggattgggctaagatttcttgaataataccccacaagcacaggcaaccaaagcataaatggacaaatggaatcacatcaagttaaaaagcttctgtacagcaaaagaaacaatcaagaaagtgaagagacaacccacagaatggaagaaaatatttccaatctatctatctaacaaagggttaataaccagactatatagagagctcaaacaactctacagggaaaaaaaamccctaataatccaatttacaaatgggcaaaagatctgaatagacatttctcaaaaaaagacatacaagtggtaaacaggtatatgaaaaggtgctcaatatcactggtcgtcagagaaatgcaaatcaatactacaatgagattatcatctcaccccagttaaaatggcttttatccaaaaggcaggcaataacaaatgctggcgaggatgtggagaaagggaactctcacatactgttggtgggaatgtaaatcagtacaaccattatggagatcagttctcaaaaaaacaaaaacaga

SEQ ID NO: 198059 - DNA, 601 bp, Human
ataagtggtggcaggaaaactggatatccatacgcagaagaatgaaactagacccctaactctcgccatatacaaaaatcaaaccaagatggattaaagacttaaatttaagaccacaaactatgaaactactaaaaggaaacattggggaaactttccaggacactggattgggctaagatttcttgaataataccccacaagcacaggcaaccaaagcataaatggacaaatggaatcacatcaagttaaaaagcttctgtacagcaaaagaaacaatcaagaaagtgaagagacaacmcacagaatggaagaaaatatttccaatctatctatctaacaaagggttaataaccagactatatagagagctcaaacaactctacagggaaaaaaaacccctaataatccaatttacaaatgggcaaaagatctgaatagacatttctcaaaaaaagacatacaagtggtaaacaggtatatgaaaaggtgctcaatatcactggtcgtcagagaaatgcaaatcaatactacaatgagattatcatctcaccccagttaaaatggcttttatccaaaaggcaggcaataacaaatgctg

SEQ ID NO: 198060 - DNA, 601 bp, Human
aattttaatgccaatgcaataactgaattaaattagtacaaactgagtatattatttaataagtataccaataagaagctggcagaatattttaagaaaccaaatgaccttgtctacttccaagtttctttataatagtattcttttgttttgttttcctggagtaacttaacatttactgtaaggagaaatcctgttaaaatagtgtcttttagttatgtataaaatcccaatagtatcagaattgatccttaacttgtaggatgtagttcctatacagttcacaagctcaaagctttgktgttctctgtcgtcacatgactatcatgtgttcaacataagttttctacaaacatgcaaataaatacattaaaaactagtatataaacttatttcacttaaaaatattatacaacatttatattgattcaacactaattgagatatcatgccaattcaaaattagcctgttcacactgaacatctgaattattcacattttaataatactaaaagggctgtctttaagttaaaaaaaatacacacaaaactctactgtgttttacatattaaaatacaggatgaatgataaaaatattta

SEQ ID NO: 198061 - DNA, 601 bp, Human
ccactgaaatttaataaatggtggttctataattgagacttaaaaattcatggccaaggcttacgcctcctcttagaaatcagatgaagctactatagtgcacagtctgcccccttagcagatccctgtaggtagcagccctggtagattgataagaggtaaagaggcctgatggggagtcagggaaacctacactctattggtaggaatatgtatgggggtatatacatattcttcaaattataactttagtttgacagtgtctgttaacttcctttgatctaggaatgttactcaagtratctagtctacaaaaacctttgcacaagtatacaaaattatatggaacaaagatatacctaacaacattatttattatcatgaaaatttgatattaaaccttaataggaaattagttaaataaatcatggtacatggaatacttgtaatgatgattaattgctcaacattcatctcaaccctgatgatgagactaattaattaactattgatgatcccattctgtttctcaatgattaggaaaactcaaggaagagaaactgctgccatcccactaccagcctgaggataataacaagga

SEQ ID NO: 198062 - DNA, 601 bp, Human
aagtaagtttttaagttatcttctgtctttatatactgcctctatttcccctgagtttcttttttgttgttttcatttctggattttatttgacgtattcctcaaatatctggtgattctttacttctcattctacttaaaacaccatgtatgtaatgtccagactaggcaaatctacagagatagaaaatatattagtgtaagcttctctaacccacggcccataggccacatgtggcccaggatggctttgaatgtggcccaacacaaattcataaactttcttaaaacattatgagattttttttttttttttttttttttagctcatcagctatcgtgagtgttaatgtattgcatgtgtggctcaagacaattctttccttccaatgcggcccagagaagcccaaagattggacactcctgtagtggttgcctgggccatggagagaagagtgggaatagggtatgactgctaatagttatagcttctttttgatgtggtgaaatgtcccaaaattagattgtggcaatggctgtacaactgtgcctatactaaaaaccactgaattatacactttgagtgaattctatggtatac

SEQ ID NO: 198063 - DNA, 601 bp, Human
tcactttgtcatccaggctggagtgcagtggcacgatcttggcttactgcaacgtctgcctcctgggctcaagcgattctcctgcctcagcctgccgagtagctgggattacaggcgcctgccaccatgcccagctatttttgtatttttagtagagatggggtttcaccttgttggccaggctggtctcgaactcctgacctcaaatgatctgcccacctcggcctcccaaagtgctgggattataggcgtgagccacagcgcctggccctgcctcagaatttggaaggcactgctccartgttttctgattcccacttgagaagttcagtgccattctggtttcccgtcctctgtaggtatcatgtttctctcattctctaaaaacttttagaatgatctctttattgctggttatcaaaaatttcacaaaaatgttttttaaagtgttttttcatccactatgctgaaaatatatgggccttcttaatctaaaatctcaggtattctggttcttaaaattgtcttctacttaaagaccttgtttgatcagatcacttaagaatttttcccttactcttgctaggtatactattatttt

SEQ ID NO: 198064 - DNA, 601 bp, Human
ggccaatttttgactacatgtggctgacaatgatgactaagcttcaacttaacacacacctcctctatactgtaatacataaagtgatgtgcctggaaacataaggtgtggtagaggttgagagcagagattactttctgttgggaagaattcactttttctattttatggaacaggaggaagttcagctggattggaaagaataggtagcatcaggtcttaaactggaggactggagaaaagagctgcactgcagacaagagaacacaagtcagattgctagaggccacgtggaagaacragaaataaggctggaaaagtagggcagagttaggattttttttttttttttgagacggagtttcgctgttgttgcccaggctggagtgtaatagagtgatctcggatcactgcaacctccacctcccgggttcaagccattcttctgtctcagactcctgagtagctgggattacaggtgtgtgccatcacaccaggctaatttttgtatttttagtagagatggggtttcaccatgttggccaggctggtctcgaactcctgaccttgtgatccgccggcctcagcctcccaaagtgct

SEQ ID NO: 198065 - DNA, 601 bp, Human
atatacagacgcactaggagtcaaaccatgttaaagagcatttgtagaaacagctaagtcttccacccctatcatcaactcctggttcctttccccacaggcaactgctattatgctaaattattacatattcttccagaaatattttatacaggcacaaatacacacataattttgttttgaaggatatatgtacatttgcataaatacacatgtacatatgtatatttcttcaaaacaaaactcagatgcatcatgttataaaccaagttttgcttgtttttccttgttaacagctgtracagtattccattgtatggatggtgcatcatttattcaaccagtctttctttttttttttttttttcagacggagtctcactctgtgtccaggctggagtgcaatggagcgatctcggctcactgcaacctcagcctcccgggttcaagcgattctcctgcctcagactcctgagtagctgggattacaggtgtgtgccaccatgcccagctaatttttgtacttttagtagagatggggtttcactgtgttggccaggctggtctcgaactcctaaccttgtgatccacccaccttggc

SEQ ID NO: 198066 - DNA, 601 bp, Human
attcaagaagctatagattcaaagattttatcacagcagtgtttattatcacaaaatactggcaataatctaaatgatcaatagtgaatttgttaaataagttataaagtatataatggcatactacaaagtcattaatattaagataaagatacagtcatcactgtaagttcagtgaccttgggaatgttacataccctctaggtgtcagtttcctcatctgtaaaatgggtataaaaagagcacttacctcacagtgctttacctagcatatcagctttatcttattgtgatacaagaygaaaaatctgatgtttgtgagctttcttgataacacaggccgctgctgcaaaaattaccttgctatctgcttctaaaaatttcaagaggaacattcaatttggccatcaatcaagttcagaaaatatgaatataagaccacaagggcaataaatatcaaagttgaaaataggaaatttctgcagctattaacctagtttttaaaaattcctatactggctgggctcggtggcacacacctgtagtcccagccacttgggaggctgaagcaggaagatcgtttaggcccaagcattagagg

SEQ ID NO: 198067 - DNA, 601 bp, Human
tgacctaaatgttctttaataaaaaactggtacaatattttacacaaataatcgaatattacatatatgtaagttttcattgacatagaatgagctccataatatactgctgaggggaaaaagcagattaaaaacaacatgaatattatagttacaggcatggagagagacagctgcaaaaattatcaccaaaagcaaatggaggtttcctctgggtggttggggaggaaagtaatttttactttcttccttagaattactaatattgctttaattttctaaataaatatacattatcttygtgatcagaaaaaaattatcttcatgttggaaaaagaaagcacatttattttttaataccataattctttttgggagtaattactctgtgaacctaattagaaaaattcaagaagctatagattcaaagattttatcacagcagtgtttattatcacaaaatactggcaataatctaaatgatcaatagtgaatttgttaaataagttataaagtatataatggcatactacaaagtcattaatattaagataaagatacagtcatcactgtaagttcagtgaccttgggaatgttacat

SEQ ID NO: 198068 - DNA, 601 bp, Human
ttaaataattaaattccagtcctgggtgtatttaagtatctgttgtacttacttacacagaacatatgctatgcatacagtaataacaacaaatacttattgattagctatttagttacagcagataaagaatcaaattataaaatacaaaggttttctgtagtccaaatatttattttgtcagcaactataagctttctctagaagttgaaaaagcctatctggattatgggaaattcaaatatttgttttcttgctgagattttaaggcaaataaggtagaggcaagaagatgactttmaagtattaaaacaacaacaaagatgaccaacagtataatgggtagctaccctaccatattctctttaaccatatccccttgctgccttctacaaaagaaaggcttcctccaactataaagatgcctaatctttcatcacttgccattatttaaaatcacttaagatttatattaagttaaaaaacttttacattgagatcacatattttcagtgggcctttccagtcatttaatgaagaaattattttaaacataaaaatatgcttgaaacagctcattacagaatccacatcactataa

SEQ ID NO: 198069 - DNA, 601 bp, Human
ttctcatgcttgaaacatacaaaccatattcatataaatgagtattttattttggtctaaaacacagtatcatccctttggtaatggaaataccaattaacgtaaaaacctgcagctcttcaatcaatcaaatccataatcttagttttaatctccctccagcattttgcagtaattcatgtagttataatcctatgattcctagtttcaacttatgaaagaattatctgtggcatctgtgactttaggaaatgaatatacatatttcacaaatactagatttctaacgtggtaaaactgaaaaaaaaaaacccaaaaaatttttaaatacaacaatgcctcatttatctggtgtctgttgagaataagtacaaatattttaaaacaactttaaattgtttcaaagacgatctcaggtgtctaaaattcaaaatctccaaattcagttatttaaaatactttatatcaattttcctttttaccttcgtaagaaataagcatcctagccgagacttgattatttggttcaaatatttttaaagattgtagcactgaagtccatagtttaaaggcatgtgtggatttgttagggacaaaatca

SEQ ID NO: 198070 - DNA, 601 bp, Human
atatgggaggtagaacagagatctccaacgtctctcccatttatcacagtaattttcttattcacagtaatcattgttggatgttaccttttcagcttcacattctcaagatggtaaaaatcatgtatatagattatcagaactctaagcaaagatgactgtcacatctgaagctgaggtgccttaggtactctactgaccttgatgggtttggagttccccattgcttatcaagagctttttaattgctttggttctttagtttttctttttgcaaaaatccttcctgtcactttaactaaaaccaaagatttgttttctattgataagcagactagagaaaaactgccttattttcagaagcatgtcttcattcaaagcttaggcttcaatagaaattcagactaatcactgaaatgactatttcaaactagtgaaatatctgggaaataaactgcttcaaaaatattttactgacatgaattttgctagtgaatacaaatacactgcctcaaataaggccatgtatgaatgaacttacaagatatttgagttaatcagtgtttgcatatagagaattagttctaaagttcttaaaaat

SEQ ID NO: 198071 - DNA, 601 bp, Human
agaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcataygccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtc

SEQ ID NO: 198072 - DNA, 601 bp, Human
tgctaggattacaggggtcagccaccgcgcccggccccacagaaattctttagcttttaaaagccatggaaacattctagataagttgttaaccattaacgggaacaaattctctttacacaaagctcaggcacattcaatcaaggggagccaggcctaagatgcatcacacagatctgaccatgcaactacctttctacaagtgtctgagctccggggtgcccgagtaccgacagccaaagaagcatttacactttgccagataaggaatcggctctgcgaaggtgcgaagaaccaaatsctagcgattaatgtcccaacaacgtgaacacttcctgcaactcgaaatcctcaagggaaactctgtcgaatccccaccaagtgaacgatgacttgtttctacaaaggctactgatttcaggaaactaacgtataactcgtcgccttaaagtgcctctaaaagcatccacgacggttaaagtcgctgctactacgggacgctatttattcagcgccaagacccaagcgccatcgtggatcaccccattcctggccacggcaaccctagggagcgggtcctaggagcctgctggagggcgac

SEQ ID NO: 198073 - DNA, 601 bp, Human
ttgtatttttagtagagaaggggtttcaccatgttggtcaggctggtctcaaacttctgacctcaggtgatccgcctgcctcggcctcccaaagtgctaggattacaggggtcagccaccgcgcccggccccacagaaattctttagcttttaaaagccatggaaacattctagataagttgttaaccattaacgggaacaaattctctttacacaaagctcaggcacattcaatcaaggggagccaggcctaagatgcatcacacagatctgaccatgcaactacctttctacaagtgtstgagctccggggtgcccgagtaccgacagccaaagaagcatttacactttgccagataaggaatcggctctgcgaaggtgcgaagaaccaaatcctagcgattaatgtcccaacaacgtgaacacttcctgcaactcgaaatcctcaagggaaactctgtcgaatccccaccaagtgaacgatgacttgtttctacaaaggctactgatttcaggaaactaacgtataactcgtcgccttaaagtgcctctaaaagcatccacgacggttaaagtcgctgctactacgggacgctattta

SEQ ID NO: 198074 - DNA, 601 bp, Human
tttttcccactgtacttcaataaagctgtcattgcaaacaaaaacataaaagcgtgttggacagatcgtctgctcctgctgtttaatgtcacagaaattcgtttttttttttttttttttttttttgagacggagtcttgctctgtcacccaggctggagtgcagtggcgtgatctcggctcactgcaacctctgcctcctgggttcaagcgattctcttgcctcagcctcccgagtggctgggatgacaggcgcccgccaccacgcccggctaagttttgtatttttagtagagaagggktttcaccatgttggtcaggctggtctcaaacttctgacctcaggtgatccgcctgcctcggcctcccaaagtgctaggattacaggggtcagccaccgcgcccggccccacagaaattctttagcttttaaaagccatggaaacattctagataagttgttaaccattaacgggaacaaattctctttacacaaagctcaggcacattcaatcaaggggagccaggcctaagatgcatcacacagatctgaccatgcaactacctttctacaagtgtctgagctccggggtgcccgagta

SEQ ID NO: 198075 - DNA, 601 bp, Human
cagcctgggtgacagagtgagactccatctcggaaaagtcagtataaataactattgcctggcaaaacttgctgcttgttttcactgctgaagagtagttaccgcagggagtcaagtgtggaccttacttgctggatggggactcatgtggtggggggaggtgctggaggctggatgtctacagtgcagactgtaactaggaatgaggcgcgggagcaaggtcagagtgggcccctgcggtgcccggtgccctctcacgctcaggtagcaggcagtcactgtcccctctgggcatctttcstccctggtaagtggtttgggaggcagccctgctcccccgtggaaaattcatgtacaggtgacttgaatgcagttgtttatagttcctgggtttaactctgtcaagtactgcattcatatcccatagtcggaacagaagtgtttaactctgtcaagtactgcattcacatcccatagtcggaacagaagtgtttaactctgtcaaggttacttaagaatgagaagaataagcaacatctgacattccaaatgaggttcaagtttgtcttcaagaagctcctagaagtttctgacaggattt

SEQ ID NO: 198076 - DNA, 601 bp, Human
ttatttcatgggcactggattgctgtctttttcatatttgcccactgctgagggaatgagtttttgtgaatatgagaaaagtcagggctgagtgcggtgactcacgtctgtaatcctagcactttgggagggcgaggcgagcggactgcctgagctcaggagatcgagacccgcctgggtgacacggtgaaaccttgtctactaaaataaaaaagaaatcagccgtgcgtggcggtgtgcgctggtagtaccagctacttgggaggctgaggcgggagaatcgcttgaacctgagaggccraggttgcagcgagccgacatcgctccactgcactccagcctgggtgacagagtgagactccatctcggaaaagtcagtataaataactattgcctggcaaaacttgctgcttgttttcactgctgaagagtagttaccgcagggagtcaagtgtggaccttacttgctggatggggactcatgtggtggggggaggtgctggaggctggatgtctacagtgcagactgtaactaggaatgaggcgcgggagcaaggtcagagtgggcccctgcggtgcccggtgccctctcacgctcagg

SEQ ID NO: 198077 - DNA, 601 bp, Human
agttttcattgccttcaggttaggaagtcactaagtcaaaaagtgaataatataaatttaatagcttaactgaagtacaaaatttgtggatggactccagctgcaaattttcccctgtaactttcctctgaaagttatttcatgggcactggattgctgtctttttcatatttgcccactgctgagggaatgagtttttgtgaatatgagaaaagtcagggctgagtgcggtgactcacgtctgtaatcctagcactttgggagggcgaggcgagcggactgcctgagctcaggagatcgrgacccgcctgggtgacacggtgaaaccttgtctactaaaataaaaaagaaatcagccgtgcgtggcggtgtgcgctggtagtaccagctacttgggaggctgaggcgggagaatcgcttgaacctgagaggccaaggttgcagcgagccgacatcgctccactgcactccagcctgggtgacagagtgagactccatctcggaaaagtcagtataaataactattgcctggcaaaacttgctgcttgttttcactgctgaagagtagttaccgcagggagtcaagtgtggaccttacttg

SEQ ID NO: 198078 - DNA, 601 bp, Human
ggcaggagggagtaggggcatgggagagctccagggcagccgccgtgcagaggagcagaggacaggcccacatggaggccacagcaagaattctagcctgaaatcatggtgatgaggccagtgagcaagccagcaagtcatctgcgcagaatgtaacagaaagctactccaccgcactagaaatcaacaaggggaaaagggcagaaagggattagagaagcgggttcaagctaatttccatactaacattttatgggtttctgctattaggaataattccttcactacctacgtcaaaggkttataaggataaataagttaataggcgtaagtacttaaaaaaacataaaaagcatgcaaaaagcatgcacaaatgcaaggatttttttaatggaaaataatgaaaagcctttcaaaggaatctaatgttgtcctttgatagacagtctatggtctttcccctttatcaaaaacaattccaataggaagctctctgaatggaacagagccatgagaacaaggcctcatttacacagctgcatggatttagatgctttgtgaaaactgcatcttctatggctgataacctcataaactatgg

SEQ ID NO: 198079 - DNA, 601 bp, Human
tattttcactgagaaggaaagttccttctcaagtcagctgctgatctttctatggaatgagaaggagtgggaaccatgaaagaagagcttgggaggtcaatgggaccgagatagagggtgaagttcagggggaagaactcaaagggggaaccacagcatccctctccccatccccaaggtggcacgtgaatgttctggagatgaacaaagggcaggagggagtaggggcatgggagagctccagggcagccgccgtgcagaggagcagaggacaggcccacatggaggccacagcaagaaytctagcctgaaatcatggtgatgaggccagtgagcaagccagcaagtcatctgcgcagaatgtaacagaaagctactccaccgcactagaaatcaacaaggggaaaagggcagaaagggattagagaagcgggttcaagctaatttccatactaacattttatgggtttctgctattaggaataattccttcactacctacgtcaaagggttataaggataaataagttaataggcgtaagtacttaaaaaaacataaaaagcatgcaaaaagcatgcacaaatgcaaggatttttttaa

SEQ ID NO: 198080 - DNA, 601 bp, Human
ttgctaaaatctgcactatccccccacgccccttgtgactgtacaataaccgtaaagaaggcgaggcagggaccacaacttgccacttaccaacaagatgagggtaacctgctgagccttcctatctgcagcaaaaagtaggccttggagttcagaagtagagcaactgttattttcactgagaaggaaagttccttctcaagtcagctgctgatctttctatggaatgagaaggagtgggaaccatgaaagaagagcttgggaggtcaatgggaccgagatagagggtgaagttcagggrgaagaactcaaagggggaaccacagcatccctctccccatccccaaggtggcacgtgaatgttctggagatgaacaaagggcaggagggagtaggggcatgggagagctccagggcagccgccgtgcagaggagcagaggacaggcccacatggaggccacagcaagaattctagcctgaaatcatggtgatgaggccagtgagcaagccagcaagtcatctgcgcagaatgtaacagaaagctactccaccgcactagaaatcaacaaggggaaaagggcagaaagggattagagaagc

SEQ ID NO: 198081 - DNA, 601 bp, Human
gtagcttctcacagcagccttgctaaaatctgcactatccccccacgccccttgtgactgtacaataaccgtaaagaaggcgaggcagggaccacaacttgccacttaccaacaagatgagggtaacctgctgagccttcctatctgcagcaaaaagtaggccttggagttcagaagtagagcaactgttattttcactgagaaggaaagttccttctcaagtcagctgctgatctttctatggaatgagaaggagtgggaaccatgaaagaagagcttgggaggtcaatgggaccgagayagagggtgaagttcagggggaagaactcaaagggggaaccacagcatccctctccccatccccaaggtggcacgtgaatgttctggagatgaacaaagggcaggagggagtaggggcatgggagagctccagggcagccgccgtgcagaggagcagaggacaggcccacatggaggccacagcaagaattctagcctgaaatcatggtgatgaggccagtgagcaagccagcaagtcatctgcgcagaatgtaacagaaagctactccaccgcactagaaatcaacaaggggaaaagggc

SEQ ID NO: 198082 - DNA, 601 bp, Human
tctgatatagacaccttccgcattctgcacttactcatgcaatttcatttactttttagagagaaaggacattttcaccttggcaggagtctaccaccctctgctcaatgtcctttttggctgcttctgttccagacatggaagagaactattaaaagggctggggccacccctttcattcccaactagactctttgcacagaggcagtagcttctcacagcagccttgctaaaatctgcactatccccccacgccccttgtgactgtacaataaccgtaaagaaggcgaggcagggaccrcaacttgccacttaccaacaagatgagggtaacctgctgagccttcctatctgcagcaaaaagtaggccttggagttcagaagtagagcaactgttattttcactgagaaggaaagttccttctcaagtcagctgctgatctttctatggaatgagaaggagtgggaaccatgaaagaagagcttgggaggtcaatgggaccgagatagagggtgaagttcagggggaagaactcaaagggggaaccacagcatccctctccccatccccaaggtggcacgtgaatgttctggagatgaa

SEQ ID NO: 198083 - DNA, 601 bp, Human
acccccagcagcagtctcagttggctactccatctctttcctgggctgaagccacctggttaggactcatagcccagtaaacacatatggtatcaccttgtacccactctcagagcacagaaaccacctggtacaaaagatgattcctatgacaaacacatgtatatctcaacttacattttgcctgctgagggacaaattcctgtaagaaaactccaagggcccaaccaaattccagcagaaaaatgtcatgacctggaactttaagtagaacctctttgaagaggttgcccttaaagcraaccaggtcacaaaagctctggcctggctttagaatttagaacttttgaatgacacacatgagaataaccaagttagctgtatggatggctatgaggggtgcacacagcccgttcaccaactgaggaatggagaactcgaagggaggaacggagactcggccaagcctcagcactcacagcggcagggtggatgagttctaataagggtagtttcctgtgacagtccggaatctggaactaggcatcaggtgagagtgccctggagtggagtgggctgggggaagaggatggggcttgct

SEQ ID NO: 198084 - DNA, 601 bp, Human
cttactggtcagaagtctataatgggtcagcagagctgtgcttcttcaggatgctctagaggagaatccttttccttgccttttccagcacctagaggctgcccgcattccttggctcatggccacatcactctgacctctgcttccatcatccatctcttcctctcactctgaccttcctgcctcccctttacaaaggtctttgtgattacatgaggcacacccaggtaatccaggatattctctccaccctcaagcccttaacttaatcacatctacaaatcccttttgctacataagkcctggggattaggatgtggacatatttggggggttattactcagctgaccataccatacaacattttctaggaaaaaccataggacatattttttacttagctacaggcaacttcctgaagacccccagcagcagtctcagttggctactccatctctttcctgggctgaagccacctggttaggactcatagcccagtaaacacatatggtatcaccttgtacccactctcagagcacagaaaccacctggtacaaaagatgattcctatgacaaacacatgtatatctcaacttacat

SEQ ID NO: 198085 - DNA, 601 bp, Human
catgcccaattttttttttttaaggcaagaaataaattttattgaaggatttttcaccatccatagagattatcatatgattgtttttcttagaatttttaatgcatacattttttggattttctaacttcaaattccctaatttcttccatttctgaaataaaccgtacttgattaaagtgcatgttttattttttaatttttatttaagttctgggatacatgtgcagaatatgcaggtttgttacataggtatccatgtgtcatgctggtttgctgcacctaccaacccgtcacctasgttttaagccccgcatgcattagctatttgtcctgatgctctccctcccctcgctccccggctctgacaggcgctggtgtgtgatgttcccctccctgtgtccatgtgttctcactattcaactcccacttatgacaacatgcggtgtttggttttctgttgctgtgttagtttgctgaggatgatgccagccaaaattttttatcttactggtcagaagtctataatgggtcagcagagctgtgcttcttcaggatgctctagaggagaatccttttccttgccttttccagcacctag

SEQ ID NO: 198086 - DNA, 601 bp, Human
ggcctcccaaagtgctgagattacaggcacaagccaccatgcccaattttttttttttaaggcaagaaataaattttattgaaggatttttcaccatccatagagattatcatatgattgtttttcttagaatttttaatgcatacattttttggattttctaacttcaaattccctaatttcttccatttctgaaataaaccgtacttgattaaagtgcatgttttattttttaatttttatttaagttctgggatacatgtgcagaatatgcaggtttgttacataggtatccatgtgycatgctggtttgctgcacctaccaacccgtcacctaggttttaagccccgcatgcattagctatttgtcctgatgctctccctcccctcgctccccggctctgacaggcgctggtgtgtgatgttcccctccctgtgtccatgtgttctcactattcaactcccacttatgacaacatgcggtgtttggttttctgttgctgtgttagtttgctgaggatgatgccagccaaaattttttatcttactggtcagaagtctataatgggtcagcagagctgtgcttcttcaggatgctcta

SEQ ID NO: 198087 - DNA, 601 bp, Human
ttaaaacaacactttttttttttgagagtctcgctccgttgtccgggctggagagcagtggtgagatcacagttcactgcagccttgaactcctgggctcaagtgatcctcccacctcagcctcctgagtagctgggactacaggtgtgcgccatcctgtctggctaatttttaaattttttgtagagacaaaggtttcatcatgttgcccaggctgatcttggactcctgggttcaagcaatcctcctgccttggcctcccaaagtgctgagattacaggcacaagccaccatgcccaattttttttttttaaggcaagaaataaattttattgaaggatttttcaccatccatagagattatcatatgattgtttttcttagaatttttaatgcatacattttttggattttctaacttcaaattccctaatttcttccatttctgaaataaaccgtacttgattaaagtgcatgttttattttttaatttttatttaagttctgggatacatgtgcagaatatgcaggtttgttacataggtatccatgtgtcatgctggtttgctgcacctaccaacccgtcacctaggttttaagc

SEQ ID NO: 198088 - DNA, 601 bp, Human
agttacagtccaagggtccctgccttgcacaggattaggatatttctggcctcctaagagttcacgaattaccatattgggtcaaaaccagggctcagtgaaccaactagacattctggtcatccacccaaaagatcaggattatgtctgtaaaatatctataatggtgctatcattgtgactttgctgaaaacaactccaaaacgactcatattttgtttctatcacctcttaatggaacagattccagaagctttctattgctgcttagaacaaacatctctatacactatcaaagggscttgctctaaatttggtcaagttccctgatgagctgatccttgagcaccgtgctcccagccttcatgtgccatcatgggccggcctcctgagtgtgtcctcccctaaggtgacccacatctctgccccccgggtgtccctatccctgctctccagtgtagcctgcccttattttcacagtcagattggccactgtcttagtttcctattgcccttgtgacaagttacacatacttagtggcttaaaacaacactttttttttttgagagtctcgctccgttgtccgggctggagagcagt

SEQ ID NO: 198089 - DNA, 601 bp, Human
gggaataaactggttaaaaatggatgtgtgtgttttttaaacacaatcctattgctctttttcctaaattcttgtttgggcctctgagtctccttcacgaccaaaagcagacaagacagttacagtccaagggtccctgccttgcacaggattaggatatttctggcctcctaagagttcacgaattaccatattgggtcaaaaccagggctcagtgaaccaactagacattctggtcatccacccaaaagatcaggattatgtctgtaaaatatctataatggtgctatcattgtgactytgctgaaaacaactccaaaacgactcatattttgtttctatcacctcttaatggaacagattccagaagctttctattgctgcttagaacaaacatctctatacactatcaaaggggcttgctctaaatttggtcaagttccctgatgagctgatccttgagcaccgtgctcccagccttcatgtgccatcatgggccggcctcctgagtgtgtcctcccctaaggtgacccacatctctgccccccgggtgtccctatccctgctctccagtgtagcctgcccttattttcacagtcag

SEQ ID NO: 198090 - DNA, 601 bp, Human
gtcagggcagcctgacgcatgcccgttatatacggcgtggactttccagctgcccatctggcttctggctcggttcagccaaaggaaaatggaagggggacatcatgtactgactgctctgggccacctctcccctaatgggaggccacgtcaggctggctgtggccacctgcccaagggcactgcttttctcaaggtggacttgtttacccagctccttcctccccaccctttgggctgttgtcgccagccttgtttacagcacgaccccctgtgcgttatctacggcccaggccttgtsaacagcctgcttattaagccctcctcagattatcaccacctgagtgtgtcatctgtttttctgttgggaccaagatgacgcagacatatagaaaaattctcagctttgttattagcgagagccccagttggggaaggatctggataaaggaaaagaaagaaggagccagtataaagggggcagcaaataccacattttcatcagagtactgaccccaaacctacaggctggtctatttaccggcaaatagagcaacattccttcccagtgctctgcccaacaccacccctagtctgggaa

SEQ ID NO: 198091 - DNA, 601 bp, Human
actggagggtcggctctatctgacaacatgaggaagccacgtcagggcagcctgacgcatgcccgttatatacggcgtggactttccagctgcccatctggcttctggctcggttcagccaaaggaaaatggaagggggacatcatgtactgactgctctgggccacctctcccctaatgggaggccacgtcaggctggctgtggccacctgcccaagggcactgcttttctcaaggtggacttgtttacccagctccttcctccccaccctttgggctgttgtcgccagccttgtttacwgcacgaccccctgtgcgttatctacggcccaggccttgtcaacagcctgcttattaagccctcctcagattatcaccacctgagtgtgtcatctgtttttctgttgggaccaagatgacgcagacatatagaaaaattctcagctttgttattagcgagagccccagttggggaaggatctggataaaggaaaagaaagaaggagccagtataaagggggcagcaaataccacattttcatcagagtactgaccccaaacctacaggctggtctatttaccggcaaatagagcaacattc

SEQ ID NO: 198092 - DNA, 601 bp, Human
gtcaaagtatttgaaacagctgccaactttgcatttctctgtcttaggcactgaatctccaatactgatccacttgatcctgaatgaagactgccacgctgtggttcctgctagtcaggaactccttgttcctaggaagagccagctgccaactgaaactgcaggcaccctgaaggcagaccactctgctcaccctcaacagcaccatgtcgggccagcgtgtaggtgccatcttacaatgtgtatctaaaagcttcctcctgagtgtctgcctcaggccagggctctctgccgggcaccraaacctactcatatcaaatgctaactatgaagcaaaacactggccaacaatgaatcatataataaaacttgatggaatgacctaaagtttaggaaattcataaaagttataaacactacgttagaacagtaatagaaaaagtcatcacagcactagtaacagcaccagccactactgtaaaccaagcacaaggacaaacacactgcgcaatttcattctgtcctcatgactactctctgaggcatgagctcagctccattttacagacagggccacagaggcccaaggaggttaatcagt

SEQ ID NO: 198093 - DNA, 601 bp, Human
ctgtcaaagtatttgaaacagctgccaactttgcatttctctgtcttaggcactgaatctccaatactgatccacttgatcctgaatgaagactgccacgctgtggttcctgctagtcaggaactccttgttcctaggaagagccagctgccaactgaaactgcaggcaccctgaaggcagaccactctgctcaccctcaacagcaccatgtcgggccagcgtgtaggtgccatcttacaatgtgtatctaaaagcttcctcctgagtgtctgcctcaggccagggctctctgccgggcaccaaaacctactcatatcaaatgctaactatgaagcaaaacactggccaacaatgaatcatataataaaacttgatggaatgacctaaagtttaggaaattcataaaagttataaacactacgttagaacagtaatagaaaaagtcatcacagcactagtaacagcaccagccactactgtaaaccaagcacaaggacaaacacactgcgcaatttcattctgtcctcatgactactctctgaggcatgagctcagctccattttacagacagggccacagaggcccaaggaggttaatca

SEQ ID NO: 198094 - DNA, 601 bp, Human
gcctgagacagcagaatactttgaacccaggaggtggaggttgcattgaggcgagatcgtgccactgcactccagcctgggtgacagagtgagactctgtctgctctgccaccgccccgccaaaaaaaaaatgtgtagttaatgaactgtcaaagtatttgaaacagctgccaactttgcatttctctgtcttaggcactgaatctccaatactgatccacttgatcctgaatgaagactgccacgctgtggttcctgctagtcaggaactccttgttcctaggaagagccagctgccaaytgaaactgcaggcaccctgaaggcagaccactctgctcaccctcaacagcaccatgtcgggccagcgtgtaggtgccatcttacaatgtgtatctaaaagcttcctcctgagtgtctgcctcaggccagggctctctgccgggcaccaaaacctactcatatcaaatgctaactatgaagcaaaacactggccaacaatgaatcatataataaaacttgatggaatgacctaaagtttaggaaattcataaaagttataaacactacgttagaacagtaatagaaaaagtcatcacagca

SEQ ID NO: 198095 - DNA, 601 bp, Human
aatcctcctgccttggcctctgaaagtgctgggattacaggtgtgatccaacatggctggcctaaaatttattattttaaaagaagtctaaaaatttgtagttggccgggtgtggtggctcatgcctgtaatcccagcactttgggaggttaaggtgggtggatcacttgaggtcagcagttcgagaccagcctggccaacacggtgaaaccccgtctctactaaaaatacaaaaattagccaggtgtggtggcaggtgcctgtaattccagctactcaggagcctgagacagcagaatastttgaacccaggaggtggaggttgcattgaggcgagatcgtgccactgcactccagcctgggtgacagagtgagactctgtctgctctgccaccgccccgccaaaaaaaaaatgtgtagttaatgaactgtcaaagtatttgaaacagctgccaactttgcatttctctgtcttaggcactgaatctccaatactgatccacttgatcctgaatgaagactgccacgctgtggttcctgctagtcaggaactccttgttcctaggaagagccagctgccaactgaaactgcaggcaccct

SEQ ID NO: 198096 - DNA, 601 bp, Human
atgacttaaaaatgtgactgtgttaagaaaaatatgacttaagagggaaggggaggttttcaggtagaagccaatcgtactgaagaaagcagtgcgatggtggctcctagcgcagagggaaggcagtgcttcactgcactgaccaggactcggtgggcgccaggtccccacagcactaacggcaagtggtgaagagtgggtacagagccctcaggaggcctgcccatgtacccacctctgcctgctcctgcatttgctgaggaacttggaaagcaaaaggcagggccgcttgccatgaagmgcttgcaaagcccttaccctcctacttaacactgatcatgctggttgttgatttttattggggagagggtaaggaaacactcattaaaaagaaaaactaccattgcagatgctcaagaactcttaacatctgtctttctattcactgatttttgagatggggtcttgctctgttgcccaggctggagtacagtggcgagatcatggctcactgcagccccaactgcccaggctcaagtgatctcccaccccagcctcccttgtagctgggaccacaggcgtaggccaccatgtccagcta

SEQ ID NO: 198097 - DNA, 601 bp, Human
caagcagctgggaccacaggcacgtgctacgaagctcagcttaggctcttcttatccgatgtaacctgaaaattctcctgaactaaattttcctaaaacagaacttccatcacgtcccctggtgctcacagccccacagactactgctcaccactgcctgcaagatgaaggctgctattctcaggctggcagaggcaggccttcgttacggtgaactgagctaccgtgtgcagccacaggggcaatgctgtgtcttcaatgtcaggaaatctgcctacatgtcatctgcctcacatgcccrtcttgtttcactcacactgtcccgtctggccctccacaccaaggcctccttactgaattgcttcccctctttcagtgcccagaagacatgccaccctcaccacaaagccctgctaaaccctggatgagaccccctgccctgctggagttctgaggatttatttctaagaggctctaacacagagtccatggcacgtgctgctttccttctgtgcatcctgtctgccctgcacaatcaaggctttcagctttttgtggcagggaccaagccatccatctttctttttttttctttttttga

SEQ ID NO: 198098 - DNA, 601 bp, Human
gcatggtggctattcacaggtgtgatcatggccacaaactccgggtctcaatcaatccttcctgctcagcctcacaagcagctgggaccacaggcacgtgctacgaagctcagcttaggctcttcttatccgatgtaacctgaaaattctcctgaactaaattttcctaaaacagaacttccatcacgtcccctggtgctcacagccccacagactactgctcaccactgcctgcaagatgaaggctgctattctcaggctggcagaggcaggccttcgttacggtgaactgagctaccgygtgcagccacaggggcaatgctgtgtcttcaatgtcaggaaatctgcctacatgtcatctgcctcacatgcccgtcttgtttcactcacactgtcccgtctggccctccacaccaaggcctccttactgaattgcttcccctctttcagtgcccagaagacatgccaccctcaccacaaagccctgctaaaccctggatgagaccccctgccctgctggagttctgaggatttatttctaagaggctctaacacagagtccatggcacgtgctgctttccttctgtgcatcctgtctgcc

SEQ ID NO: 198099 - DNA, 601 bp, Human
acagaagcgacttaccatgatgagcgcagtgtcgctgaagccctcggcgattctggaggccaccttctctgcaacctggtttggactgtcaaagaaatagtcaggctaccacattccagttaatgccattcaacactgtttacaaaaggcacagtcaacaccactgagacttaacaagcaatgacagaaagactggcggagccaacaggctgcacgtgctcgcttcgctggtttacttattatttaattttttggtagagatagggtcttgctctgttgccctagctggagtgtagtgacrcaatcatagcccactgtaacctcaaattcctaggctcaagcaatcccacctctgcctcctgagtagctgggactataggcacaggccaccacacccagttactttttagtgtttttttttgcttttttttttttttttttggtagagaggaggtattgctatgttgcccacactggtcttcaactcctggcctcaagcaatcttactgccctggcctcccaaagtgcttacaggcatgggccactgtgcccagcctacttatttatttgtattgctggggagagtgtgagtgcagttccc

SEQ ID NO: 198100 - DNA, 601 bp, Human
gttagcggaaaggaaaccgccgcagagcaagctccaggttggtgagaggaggcgcaagggcctcccacatgctgcacagaagcgacttaccatgatgagcgcagtgtcgctgaagccctcggcgattctggaggccaccttctctgcaacctggtttggactgtcaaagaaatagtcaggctaccacattccagttaatgccattcaacactgtttacaaaaggcacagtcaacaccactgagacttaacaagcaatgacagaaagactggcggagccaacaggctgcacgtgctcgcttsgctggtttacttattatttaattttttggtagagatagggtcttgctctgttgccctagctggagtgtagtgacgcaatcatagcccactgtaacctcaaattcctaggctcaagcaatcccacctctgcctcctgagtagctgggactataggcacaggccaccacacccagttactttttagtgtttttttttgcttttttttttttttttttggtagagaggaggtattgctatgttgcccacactggtcttcaactcctggcctcaagcaatcttactgccctggcctcccaaagt

SEQ ID NO: 198101 - DNA, 601 bp, Human
taaacccccgcatttctgattcagtggggtctggggtgggtgcctgggaattcgcatttctaacaagttcccaggtgctgcggctggcaggggaccccactcccacttgtgtagtgatgcggaagcacagaagccatggcctgggattcaactggtctgcagctgagagaaaactgcaagaggcggcaatggtctcaagcagataaatgagtgaaggggttagcggaaaggaaaccgccgcagagcaagctccaggttggtgagaggaggcgcaagggcctcccacatgctgcacagaagygacttaccatgatgagcgcagtgtcgctgaagccctcggcgattctggaggccaccttctctgcaacctggtttggactgtcaaagaaatagtcaggctaccacattccagttaatgccattcaacactgtttacaaaaggcacagtcaacaccactgagacttaacaagcaatgacagaaagactggcggagccaacaggctgcacgtgctcgcttcgctggtttacttattatttaattttttggtagagatagggtcttgctctgttgccctagctggagtgtagtgacgcaatcat

SEQ ID NO: 198102 - DNA, 601 bp, Human
ggtgcagagtactgagaaacatgtgcatttcaaacgcatgaagaggtatacagagcatagaagacatggttaatacatggaagggacgcctttcacgtggaattctgagaaagttggaggcagatgactgaagctttctgagtggccacagatacatcaaagcacaggcctgggaagagtgtctgtgctctagcgcctggggtgggaagacctgtgggtaccactgaggttccctctactgcctggaagcgctggaacactggggcctacaggagccggggaatatgcttggtatcatgcytctggagaaaacgctaactgaaaacacaggcggggtgagagtggctctcacgtggccgggcgctgaaggagcccagcccgcgtggcagcatggggcgcactcactggtgtgggtctctgcaccgccatctgttctcatggtgctcgtacacgtggatcgtaggcgctacgcagtccatcgtaaacttggtgttgtctacctgagcacaaggcaaaggacacgagagtgaacagaatgccagccaaacagcagcggcaggcgcctcctcggggctctccctgcagccgtgcccacgctggc

SEQ ID NO: 198103 - DNA, 601 bp, Human
agggctgcagatagggcttggccaatagattacctcaaaatcaagaagaggaagttataaacatgtgattagacttattaatttttcctggctgggcatttggtggaattcgtttgttaatgtttaataaatcattatggatcataactgtagtagaatctcaggcttttgatgttacttagaatcttggaggagaccacgaaggacacacagacgtggctgcacatgtgcagagatcttgtaatgtaactatggcttttctctgcaccatgtgtgaaataagctgccgctggcgttgggrcgccggcctgggttccaacacagtccgctggctgcctcggtatttgccgtgcctctctgggcctcagtttttcctctcttaaataaagaggggactggattagatgatttctaaagtattttccagctttcagatgctatgacttactcttctctttttccttttaaaatttctttttcctgtaaatcaccaagatagttgtcctgaacagtttagatgttatgaatccattaggaatcctgataagaaagtgttgaccctctttctagaaaaatgcgtgtactaacaaaatttttgctt

SEQ ID NO: 198104 - DNA, 601 bp, Human
actgaggttgttggatggggaatttaagaaatcccacctcctcctccctgggacctggccctgtttcccgtctcatggccacctgcagggtggctgaagtttccagaatgcgtacttcttgtgaaggttctgattgatattttgctttctggaccagtgtggctctaccatattttgggatgttatgtcttgttactgctgattgtttcaaactcgtttgcccaaagaggtcacattttaatcagaagaacaaaaatgctatttttttttttttttgggtgggcgtctatccagctgtctyggggatttccagcactgttcttggaaatgttggctctaagtcgataggtcatgctagttctctctctctttctctgtgctgttggggaagctgtctgcttgggtgagagtgttcttccaaaggatgtctttgggtgccctgggatggttaggtccctagagtgggacatgttctggaagaggagcccagtgaactttgccctgttcggtagctgcagtttatttcctcactcttgtccctatctttcagttggtcgtaggagttgcccaggaaggaagtttggataataataatgacatc

SEQ ID NO: 198105 - DNA, 601 bp, Human
gcatctgggactgggtagctgatgccctgagtttaaatgctgatccagcgtctcccagctgagcggtggcgggacttgaatgagatcgcggttctgtctcattctcaaactgctgctcttatcactgtgaaggaacagctatttagatgggctggcctgagggcctcctctttcccagacggcacggacgcagtattctatcagggaatgtggggccagctgggcatctggtagcccagttggttcttcggataatgggctgctcagtgaaggaacctggtgctgtaaaagtgattccccytctccttccagtcttgggctaaaactggagctgttcactgtggttgtatctgcctgaaaggaaagggcagatgaaagctggaaggagcacagccagcacagtgggaggggcctgcagggggctgctggtggctgcaggtggctgcaggtttcccacggagctttcagtttgcactcagggctgtgaggtcatggaggccagcattgccttctcatggcaggtgtcccggagtccctgaatctgtgggtttcccccaagccagcacctttgctgcaaacctctgagtttcctgttagcagt

SEQ ID NO: 198106 - DNA, 601 bp, Human
atcccttggaaacacgctggcaagcaagattataatcaggaagtggatgcctccatttttaaggtaaagagcccagctcccttccccactgtgggcacagtgtctcctttccctcatggactagtggagatgttgagtgacatctttctcatttacttaaaaattaatccagttttttaaaagcaaacattggttcaggagtgctgaatgtgtctcagacatgtacatgagctgatttcacatctcttgaattacggagtcacttttgtggtcgcttgtattctgatgaggagatcgaagsctcttttcttctcttttctgctgcttccttttcctgatgagccaagtgggagaaaatacttcgagaccttcacgctaagacctttccccacgggcttccattagaggcgatgcatataccagggaaggtttcagtccttgttctttcaaagctgatacttctgcctggcattgtagggccagctcaggagggtgagatgccatctgtcattcctttgggggctgggccgtgtggggggttgtgaacctgcagcagatgtctaaaaatagtctcacctcccttgagagtaatcggttcccc

SEQ ID NO: 198107 - DNA, 601 bp, Human
ttctgatcaaggaccccaggtcagggagcctcagcaccaagaagttttgtgatgccactgcctgcctcctcacccttagtgccattgtggatttctctcttgtttgattgcagatcttttttttttttttttttttttttttttgcctttggcatcatggtgaacttctcttgggaaggactgcaaatgtaaacagtgccagagtcccattcagtcggttgggaactctgcattatagataaccccaaaagccggaatttctctgcctcgccactgttgatgtctgggtctgggcaattckttgttgtaagggttccctatgccttgtgggatgtttagtggcatctctgacctctacccaccagatgccagtagcatcccctcccctactgtcacaatcaaaaatgtcttggacattgccaaatatctcctggtggggcagagtcttcccctccccattaagaaccctgataagagctggccactgccaggatcaacagacttaaccagaggtgttgggtgctgaaggcacagttgcaggttggacatcagtaaaacatctttaagacatggcagagggtgctggactaggctgtgtagc

SEQ ID NO: 198108 - DNA, 601 bp, Human
gtggatttctctcttgtttgattgcagatcttttttttttttttttttttttttttttgcctttggcatcatggtgaacttctcttgggaaggactgcaaatgtaaacagtgccagagtcccattcagtcggttgggaactctgcattatagataaccccaaaagccggaatttctctgcctcgccactgttgatgtctgggtctgggcaattctttgttgtaagggttccctatgccttgtgggatgtttagtggcatctctgacctctacccaccagatgccagtagcatcccctcccytactgtcacaatcaaaaatgtcttggacattgccaaatatctcctggtggggcagagtcttcccctccccattaagaaccctgataagagctggccactgccaggatcaacagacttaaccagaggtgttgggtgctgaaggcacagttgcaggttggacatcagtaaaacatctttaagacatggcagagggtgctggactaggctgtgtagccctgacatgtggcatgctgacggagacgaagcttctcccttcaccccattccctacttcaacttgtgctcggggggtaatgaaata

SEQ ID NO: 198109 - DNA, 601 bp, Human
tgaacttctcttgggaaggactgcaaatgtaaacagtgccagagtcccattcagtcggttgggaactctgcattatagataaccccaaaagccggaatttctctgcctcgccactgttgatgtctgggtctgggcaattctttgttgtaagggttccctatgccttgtgggatgtttagtggcatctctgacctctacccaccagatgccagtagcatcccctcccctactgtcacaatcaaaaatgtcttggacattgccaaatatctcctggtggggcagagtcttcccctccccattragaaccctgataagagctggccactgccaggatcaacagacttaaccagaggtgttgggtgctgaaggcacagttgcaggttggacatcagtaaaacatctttaagacatggcagagggtgctggactaggctgtgtagccctgacatgtggcatgctgacggagacgaagcttctcccttcaccccattccctacttcaacttgtgctcggggggtaatgaaataaagccccagatttatacatcttatgcaatgttcttcatggccgtttcaacagtgttgagaaaaatgtgcaagat

SEQ ID NO: 198110 - DNA, 601 bp, Human
aaccccaaaagccggaatttctctgcctcgccactgttgatgtctgggtctgggcaattctttgttgtaagggttccctatgccttgtgggatgtttagtggcatctctgacctctacccaccagatgccagtagcatcccctcccctactgtcacaatcaaaaatgtcttggacattgccaaatatctcctggtggggcagagtcttcccctccccattaagaaccctgataagagctggccactgccaggatcaacagacttaaccagaggtgttgggtgctgaaggcacagttgcagrttggacatcagtaaaacatctttaagacatggcagagggtgctggactaggctgtgtagccctgacatgtggcatgctgacggagacgaagcttctcccttcaccccattccctacttcaacttgtgctcggggggtaatgaaataaagccccagatttatacatcttatgcaatgttcttcatggccgtttcaacagtgttgagaaaaatgtgcaagattcccaatgtttccgttggttacgcagtcgcctgatgtggcaatctgaaatgagtctaccatctcagcaggaatggggcca

SEQ ID NO: 198111 - DNA, 601 bp, Human
atcccctcccctactgtcacaatcaaaaatgtcttggacattgccaaatatctcctggtggggcagagtcttcccctccccattaagaaccctgataagagctggccactgccaggatcaacagacttaaccagaggtgttgggtgctgaaggcacagttgcaggttggacatcagtaaaacatctttaagacatggcagagggtgctggactaggctgtgtagccctgacatgtggcatgctgacggagacgaagcttctcccttcaccccattccctacttcaacttgtgctcggggggtaatgaaataaagccccagatttatacatcttatgcaatgttcttcatggccgtttcaacagtgttgagaaaaatgtgcaagattcccaatgtttccgttggttacgcagtcgcctgatgtggcaatctgaaatgagtctaccatctcagcaggaatggggccaggagggagacgcgggtgcccactggagcagggaggccatcgggagggccaccagtgccggtggagacatggcgccagcaagagcccatcatgtgcttccctgagctatgcttcttcccatccatcctctgagaggc

SEQ ID NO: 198112 - DNA, 601 bp, Human
aggcatcgtaacagtcctgaatgagttaaagctcacttagtagcacagatatttctcattcagcaggccttgaagggaaaaatagcatttaattaaaaaaatgcaacatgaaacaatcatattaaattaggaagacctcctggtcttagttcagtgctgtcagcctgagttgtgcgtcaacaggagaaataagttatggtggaggctgaatgagccatagtgactgttgctggcggcaggggtgggggggccctgaaatcactctcatgtctagtttttgctctagctcaagaaggatctygagagatcatcaagctaagttgaccttttaatgctggccagagaggctgggagagggccaggtgcctgctgtgtcacagagttcagggcaggcggcaagccaggtacccgatggtggccctggatgcttcctggccgtgggccctgctgtgatggatgatgtggcctggacttgctcgtggggtgagtgtgagcttggcgtgaacgagtgagtatggcagtgccttgcaggcaccgcggttgcgtatgtgtaccagcggatcacaacgttgccatgaaatctgtgcatttcaaggcccgt

SEQ ID NO: 198113 - DNA, 601 bp, Human
ttagaggggagttttacatcaatgtcacatgaggaaactaccacttatgctcactaatgggaatgttcttccagtctctttaccccaggtagaggtgcaacattttgcatcaacaaagtaggcagcattggccttgaacagtaagcattcttgtcttttttgagaggaaaaacagtctgggctattttaaaggagctgtgactcatgggggcatgatggagtttctggaagtgtggtctcctgggtagctaaatccaaatccctggaatactggctaaagacagctacctgggccgggcgyggtggctcacgcctgtaagcccagcactttgggaggccgaggcaggcggatcacgaggtcaagagatcaagaccatcctggccaacatggtgaaacctcgtctgtactaaaaatacaaaaattagctgggtatggtggtgcacacctgtagtcccagctacttgggaggctgaggtaggaggattcgcttgaacctggtaggtggaggttgcagtgagccagattgcgccactgcattccagactggtgacagagtgagactccgtctcaaaaaaataaaaaaactaaaataaataaaaa

SEQ ID NO: 198114 - DNA, 601 bp, Human
gaacttgggtctggggtagacacagggtctggggcacatagtttcagttaaacaaagcagttctctccttcgtgtaagcagaaattgagatctctttccagtgacctcagagggaagggcggaggagattgggtgctgcccaacctgtgccccacttgctgcctgaccacagacatttgtagggcctccctggacaggaacaagcatcctccagcagtttctgatgaggaatcctttcattttccagcagcttgcagaggaggccaggggaaaatatggtgaccacagaaggcctggatcrtgagggttgggagtaaagctctcagatgaagttgtcaaagatggcaccatggccttcgttgttggagatgggatatgcctcagtgtgttactagatcctgattgttatttgggaactccgggatgtgatcattcctgaggtttcttccagctctcaaatcccaagaaagcatttgtgacagattaaagcaggacagcaaaaacatgccgcaccctggtcctacatcactaaaataaatcccaaagtactgagctgggatctggcctcagaaggcttctcaaagccctgtgctgtgccgct

SEQ ID NO: 198115 - DNA, 601 bp, Human
cagatgaagttgtcaaagatggcaccatggccttcgttgttggagatgggatatgcctcagtgtgttactagatcctgattgttatttgggaactccgggatgtgatcattcctgaggtttcttccagctctcaaatcccaagaaagcatttgtgacagattaaagcaggacagcaaaaacatgccgcaccctggtcctacatcactaaaataaatcccaaagtactgagctgggatctggcctcagaaggcttctcaaagccctgtgctgtgccgctgccatgaattgtagctgatttaygagataaaacctaattaccagcgctggtttagaacatgcttttaacacattgattttcttagccacttgatgaggcttttagaataacccactctggctttctccttctaagcttctgagtagtccacgaatgcctgtaagaaacagaaacccccaaaacttcttggggctgtgcagaagtttgaagtttgcactcttcccgctgtgggggtgttgacttagaattttttaagaagttaaaatggtgattcaaacaaatctatagtgaatctgtgtcagagagttgtgtaatcgtcatga

SEQ ID NO: 198116 - DNA, 601 bp, Human
gtttcttttggcccctactgccacccccaagatcagtcaggcttgaaccggcaggtgaccccaacttgtttatagcatggggtgcagccagcatcacctgctagtgatgttaaagaagcagcaggaggttctcaggggtgaagcaatgtagcatttgcataattgcctacaggggcccactcgcctctaacctcagtggtttgcaggctccatggtgggcgccccacctgctccctacttccccatcagtagcttctcagtgaattctttaatctatcgaaatggaatcaaaattcagccrggaggaaacagtgggtaaattctgtaggtcactgggaataatgaatttttgtaagtgttggttgtgatacgtctcacactgataaacttcataaggtaagttgtcgactgaggaagcggcatgagaagggaaagagcagaggctggcccagcgtgcccctgtggacactgtgcacctttaggcggtttgtgattacggctggtgcccactgggcatcagtgagggtgctgcggtgtgtgtgtgtgcatggctgtgtgcactgatgcacatgtgtatatttggaaaggccaaaaagagatt

SEQ ID NO: 198117 - DNA, 601 bp, Human
aaacttcataaggtaagttgtcgactgaggaagcggcatgagaagggaaagagcagaggctggcccagcgtgcccctgtggacactgtgcacctttaggcggtttgtgattacggctggtgcccactgggcatcagtgagggtgctgcggtgtgtgtgtgtgcatggctgtgtgcactgatgcacatgtgtatatttggaaaggccaaaaagagatttcctgccaactggcaatacaaaaaagaccccaacctgccaacacgttttgccaggaaatcggtgagtgttttcaaatgccctgkcttataaatgtaaccttcttaagttagcaaatgcttgctgtaaagtatatctgatacagactcattttggatctcagaaaatagaagaaagagaccaaagtgctgtctttatcctttaaaagtgttagcagaaacaaccaccaccaccaccaccaccaacttctctcttttgactttgctgatcagatgactgaagcatgggaaaaaaattctgtgcctttcccaaaccaatgaagacactcactaacttaacgtttccttaaactcagcatttacagagtagattatggcttcagcaaa

SEQ ID NO: 198118 - DNA, 601 bp, Human
tttatcctttaaaagtgttagcagaaacaaccaccaccaccaccaccaccaacttctctcttttgactttgctgatcagatgactgaagcatgggaaaaaaattctgtgcctttcccaaaccaatgaagacactcactaacttaacgtttccttaaactcagcatttacagagtagattatggcttcagcaaaggctgtgatgcctccgtgccatgtgtcatggtgtttgtctggttttctgtaggcaaactaggcgtggcaactgctggctgcgtgaatgaagttacagagatggagtgyggtcgctctgaaatcgacgagctgatcaaggaggtaagcagaggcagcatttcaggggtctggccctgccaggaggagtctcatgtcttctggcagggaggggcaccgttcttgctgtatgaaggcagccagaccctcgggctcgctgaggaagtggcatctccacctgtacagatctggaacggaaggactggctgggcgccccctccccaggccagcttctgccgacaggtcaacccctcacgccagatccctccttcatccctagggctgggcctgagctgccggttatgtgtcagt

SEQ ID NO: 198119 - DNA, 601 bp, Human
cgctgaggaagtggcatctccacctgtacagatctggaacggaaggactggctgggcgccccctccccaggccagcttctgccgacaggtcaacccctcacgccagatccctccttcatccctagggctgggcctgagctgccggttatgtgtcagtgaagttccttccagctccaaactgttcgaacactttggacagcagtcttttaaatggcatcgtgaattcccttgccttcctagcaggctacagagaacaaaatgtaaactttccttgctgcctgcgcttgtcatgatggcgggkgttgttgtaccagctctcatggctatttgattgcttcctttttaatgtgcagtttttattccttaacggattggaaagctggataaccaagcatgttcacattgcacataaattcctaacaggctacaagggagagcataatcggggcctccttaggcaagaatacatggcttttgtatacccatttcagctattgggatgcccttttcttctgtctttggcctcttaactatgcttttcatgggtattacaaggtggacatttgcatgactaaacctcgtgcagcctttgcaaaaggtt

SEQ ID NO: 198120 - DNA, 601 bp, Human
gggcgccccctccccaggccagcttctgccgacaggtcaacccctcacgccagatccctccttcatccctagggctgggcctgagctgccggttatgtgtcagtgaagttccttccagctccaaactgttcgaacactttggacagcagtcttttaaatggcatcgtgaattcccttgccttcctagcaggctacagagaacaaaatgtaaactttccttgctgcctgcgcttgtcatgatggcgggtgttgttgtaccagctctcatggctatttgattgcttcctttttaatgtgcagkttttattccttaacggattggaaagctggataaccaagcatgttcacattgcacataaattcctaacaggctacaagggagagcataatcggggcctccttaggcaagaatacatggcttttgtatacccatttcagctattgggatgcccttttcttctgtctttggcctcttaactatgcttttcatgggtattacaaggtggacatttgcatgactaaacctcgtgcagcctttgcaaaaggttgtgtgtgagtactgcataaattcttcttcttaataacatagcaataatggaat

SEQ ID NO: 198121 - DNA, 601 bp, Human
cttccagctccaaactgttcgaacactttggacagcagtcttttaaatggcatcgtgaattcccttgccttcctagcaggctacagagaacaaaatgtaaactttccttgctgcctgcgcttgtcatgatggcgggtgttgttgtaccagctctcatggctatttgattgcttcctttttaatgtgcagtttttattccttaacggattggaaagctggataaccaagcatgttcacattgcacataaattcctaacaggctacaagggagagcataatcggggcctccttaggcaagaayacatggcttttgtatacccatttcagctattgggatgcccttttcttctgtctttggcctcttaactatgcttttcatgggtattacaaggtggacatttgcatgactaaacctcgtgcagcctttgcaaaaggttgtgtgtgagtactgcataaattcttcttcttaataacatagcaataatggaatccttaagagtagcttggctgtcagagaatgaagataacagaatgtaacctacccgaacggccttgctcttctgcacaggcagctgccaagtgtctgggtggtctttggcag

SEQ ID NO: 198122 - DNA, 601 bp, Human
ggaatccttaagagtagcttggctgtcagagaatgaagataacagaatgtaacctacccgaacggccttgctcttctgcacaggcagctgccaagtgtctgggtggtctttggcagccgactgagtgaattcttggcttcgtggccctccaccaatgtcctgttttctgtagaaggcttttctgctgactcagctgagagagtgagataatcggattgccacaccggggtcacaagaaaagcaatttcaaaacatttcataattggatttatcagcctcctttaaggaatgggccagagaytgaacatctgcatgtggctcgttgagcgagattcttgaaagcatggcagcctttggccagcatcactgttcactggtgtctcagagcttgtctgcgtgtccagggcgttgagggcaattggataacctggaacactgggtctgcaacaggcaggtcctggaaagggccaggaaacttattagtggcccccaaagagcctagtaatttggccacatggtttgaatgctaagcctggtagatttaaggcctagggcctttcaggttgcaaagtgaaacttgacttttgtctcctgagataaa

SEQ ID NO: 198123 - DNA, 601 bp, Human
gaattcttggcttcgtggccctccaccaatgtcctgttttctgtagaaggcttttctgctgactcagctgagagagtgagataatcggattgccacaccggggtcacaagaaaagcaatttcaaaacatttcataattggatttatcagcctcctttaaggaatgggccagagactgaacatctgcatgtggctcgttgagcgagattcttgaaagcatggcagcctttggccagcatcactgttcactggtgtctcagagcttgtctgcgtgtccagggcgttgagggcaattggataayctggaacactgggtctgcaacaggcaggtcctggaaagggccaggaaacttattagtggcccccaaagagcctagtaatttggccacatggtttgaatgctaagcctggtagatttaaggcctagggcctttcaggttgcaaagtgaaacttgacttttgtctcctgagataaaggtgacaatatggttttacttacacatgaactgttcatttttacaaacactggagccccaggtgggagatcagtgactgagctgccctcctctccctcccctgactgtgcagccttctgtggacga

SEQ ID NO: 198124 - DNA, 601 bp, Human
tcctgttttctgtagaaggcttttctgctgactcagctgagagagtgagataatcggattgccacaccggggtcacaagaaaagcaatttcaaaacatttcataattggatttatcagcctcctttaaggaatgggccagagactgaacatctgcatgtggctcgttgagcgagattcttgaaagcatggcagcctttggccagcatcactgttcactggtgtctcagagcttgtctgcgtgtccagggcgttgagggcaattggataacctggaacactgggtctgcaacaggcaggtcstggaaagggccaggaaacttattagtggcccccaaagagcctagtaatttggccacatggtttgaatgctaagcctggtagatttaaggcctagggcctttcaggttgcaaagtgaaacttgacttttgtctcctgagataaaggtgacaatatggttttacttacacatgaactgttcatttttacaaacactggagccccaggtgggagatcagtgactgagctgccctcctctccctcccctgactgtgcagccttctgtggacgattacatggggatgatcaaaaggagcccttcc

SEQ ID NO: 198125 - DNA, 601 bp, Human
agaaggcttttctgctgactcagctgagagagtgagataatcggattgccacaccggggtcacaagaaaagcaatttcaaaacatttcataattggatttatcagcctcctttaaggaatgggccagagactgaacatctgcatgtggctcgttgagcgagattcttgaaagcatggcagcctttggccagcatcactgttcactggtgtctcagagcttgtctgcgtgtccagggcgttgagggcaattggataacctggaacactgggtctgcaacaggcaggtcctggaaagggccargaaacttattagtggcccccaaagagcctagtaatttggccacatggtttgaatgctaagcctggtagatttaaggcctagggcctttcaggttgcaaagtgaaacttgacttttgtctcctgagataaaggtgacaatatggttttacttacacatgaactgttcatttttacaaacactggagccccaggtgggagatcagtgactgagctgccctcctctccctcccctgactgtgcagccttctgtggacgattacatggggatgatcaaaaggagcccttccccgccggaggcct

SEQ ID NO: 198126 - DNA, 601 bp, Human
tgcctttggccctgctctccgctgcttctcaggagggcacaagctgcttgttccctaggtgatgtccatgccagctctccccacgctcctgggaaagtccagggaagagggtctagtgaacttgtgtaaggccagagggaagatgcagctcttggccacgctggcgccccctccctgggtactcccttaggtcggccagtctgttacgacattaaggaccccctcagaaccaaagagagcccagggcatttggaggagaggagaactcagaccaggaacaggaagtttgttcagagccctrgatttgaatcccacgctgggaagttacagatcttgagcctcagtttattcatccgtaaaacagagaaaccaggacttgcgccatggggtcacgagggttaagtgaggcattcatcctttgattctcttttgatgagccactcagaacccccagctgcttgaaatgcccccgcccccgccaggcccaggcttctgcagcccgtgaatgtgtttgcttcctccctcggcgtcttccccctagccctacatcccctgtgggagtctgggaggtggcagctggccccggaggccttgaaggttg

SEQ ID NO: 198127 - DNA, 601 bp, Human
ctgttacgacattaaggaccccctcagaaccaaagagagcccagggcatttggaggagaggagaactcagaccaggaacaggaagtttgttcagagccctagatttgaatcccacgctgggaagttacagatcttgagcctcagtttattcatccgtaaaacagagaaaccaggacttgcgccatggggtcacgagggttaagtgaggcattcatcctttgattctcttttgatgagccactcagaacccccagctgcttgaaatgcccccgcccccgccaggcccaggcttctgcagccsgtgaatgtgtttgcttcctccctcggcgtcttccccctagccctacatcccctgtgggagtctgggaggtggcagctggccccggaggccttgaaggttgccaggccttgggtgtcgagtaagaggtccctggaaaggcacctctgtctgtgctgcaggaacaccatccggaaagctagcttgcacccccaggctctcccccagagataagccctgggtggtgggtatgcagtccagtggtattctgggggcaagtgcttgaggtgggaaggaaatgtggccccacagtgtcacattgac

SEQ ID NO: 198128 - DNA, 601 bp, Human
agctgcttgaaatgcccccgcccccgccaggcccaggcttctgcagcccgtgaatgtgtttgcttcctccctcggcgtcttccccctagccctacatcccctgtgggagtctgggaggtggcagctggccccggaggccttgaaggttgccaggccttgggtgtcgagtaagaggtccctggaaaggcacctctgtctgtgctgcaggaacaccatccggaaagctagcttgcacccccaggctctcccccagagataagccctgggtggtgggtatgcagtccagtggtattctgggggyaagtgcttgaggtgggaaggaaatgtggccccacagtgtcacattgacacatggtcagaaatcccacagcatagaggaagtccccccgacttgccactctggttttctgcatttgtgaaacaatggctctctgctctggtggggaaaagcactgaattcagcggaagcctgtgctccctggagcctctggcacgccatgtgcagccttttaagggacttttggagaaggagcgattggggttactccctgtacaccacacctgggtggctctgagcttgcttttctgtttctcctgcagg

SEQ ID NO: 198129 - DNA, 601 bp, Human
gtacaccacacctgggtggctctgagcttgcttttctgtttctcctgcaggcgtgccgctggtgacggggtacaccacctacgacgcgcaccattcaggtacggggtggtccgggctgagaggggcgtgggcactgtttgaagacaaagcccagataacccaagcagggttgcggggtttcgaggatgagcaggacctggtgtggaagtctaggcctggttccaaggatgagcaggacctggtgtggaagtctaggctccgttccgaggatgagcaggacctggtgtggaagtctaggccyggttctgaggatgagcaggacctggtgtggaagtcgaggctccgttccgaggatgagcaggacctcgtgtggaagtctaggcccggttctgaggatgagcaggacctggtgtggaagtcgaggccccaatttctcctcctcaccatttggtcaggagctggcgagtggcctcttttgaggccacttttcttggactggaccagcaagtagacagagtactctttgaggctgtaactgtgcaggagagacagtgagggacaggccagcgtctgtcccagcgctgcctctcttttggggctg

SEQ ID NO: 198130 - DNA, 601 bp, Human
tgagcaggacctggtgtggaagtcgaggctccgttccgaggatgagcaggacctcgtgtggaagtctaggcccggttctgaggatgagcaggacctggtgtggaagtcgaggccccaatttctcctcctcaccatttggtcaggagctggcgagtggcctcttttgaggccacttttcttggactggaccagcaagtagacagagtactctttgaggctgtaactgtgcaggagagacagtgagggacaggccagcgtctgtcccagcgctgcctctcttttggggctgcaggtggagtgrtggagcctctcagagcctcatctcaggctcccctgcccaccacctctaggtggatgcagctgttcccatttcgcgggctcaggtggtcacgtacttgtgtgctccagactgggggcctccccgcggtgggcagaggtggcctttgtgtgtagtctcagcggctaaggaccctggctgcacttctgccagctgcccctggaagtgacgctcaggcgtggtgacggcatcttctgaacaaggaagctggggcatcttccagcattggctggttctgtgggaggcgagcagctggtctcatca

SEQ ID NO: 198131 - DNA, 601 bp, Human
atgagcaggacctggtgtggaagtcgaggccccaatttctcctcctcaccatttggtcaggagctggcgagtggcctcttttgaggccacttttcttggactggaccagcaagtagacagagtactctttgaggctgtaactgtgcaggagagacagtgagggacaggccagcgtctgtcccagcgctgcctctcttttggggctgcaggtggagtgatggagcctctcagagcctcatctcaggctcccctgcccaccacctctaggtggatgcagctgttcccatttcgcgggctcagatggtcacgtacttgtgtgctccagactgggggcctccccgcggtgggcagaggtggcctttgtgtgtagtctcagcggctaaggaccctggctgcacttctgccagctgcccctggaagtgacgctcaggcgtggtgacggcatcttctgaacaaggaagctggggcatcttccagcattggctggttctgtgggaggcgagcagctggtctcatcagatgggccacagaacgttagggctgggcctctgggcaggggaggaaatggggcagggatagaagcgtgctggctgaggactgc

SEQ ID NO: 198132 - DNA, 601 bp, Human
ggacctggtgtggaagtcgaggccccaatttctcctcctcaccatttggtcaggagctggcgagtggcctcttttgaggccacttttcttggactggaccagcaagtagacagagtactctttgaggctgtaactgtgcaggagagacagtgagggacaggccagcgtctgtcccagcgctgcctctcttttggggctgcaggtggagtgatggagcctctcagagcctcatctcaggctcccctgcccaccacctctaggtggatgcagctgttcccatttcgcgggctcaggtggtcacgtacttgtgtgctccagactgggggcctccccgcggtgggcagaggtggcctttgtgtgtagtctcagcggctaaggaccctggctgcacttctgccagctgcccctggaagtgacgctcaggcgtggtgacggcatcttctgaacaaggaagctggggcatcttccagcattggctggttctgtgggaggcgagcagctggtctcatcagatgggccacagaacgttagggctgggcctctgggcaggggaggaaatggggcagggatagaagcgtgctggctgaggactgcatgggac

SEQ ID NO: 198133 - DNA, 601 bp, Human
aggctgggaggttcaggatctcatccaggtcgcgcaggcctctggctggagcctgttcttgaggcctccttgtgcccggcagccgccatgctcacagggtctcagttctgggaggcctgggtcatgaggctaagcctccgggctcgccagccactgggctatggcctgggagtctgctgaccagtgctttccgggggctgtggagtagccaggcacagaactgagccatctcggtgagatgcagaggcacaatttggggagagcatgtccttgaattagtccagcagggtcatagccactkcctcatgcacagaacatccttctagaagctgtgagctttggtacctctgtccagccccgcccccacctctatgtaaatccatgcttcagtttccttacctggaaaatgggtataataataatctaccttacagggttaaatgtgctggtaggtcccaagccctgggcacagcacctgatatgagctgtgtagaccatagtctgtggtttataacttcaggagtcttgtctgtgtagataagcatttgtcctgttacccagtttctttaactggtgcttacctgtgccgagcacaaataca

SEQ ID NO: 198134 - DNA, 601 bp, Human
ccatgctcacagggtctcagttctgggaggcctgggtcatgaggctaagcctccgggctcgccagccactgggctatggcctgggagtctgctgaccagtgctttccgggggctgtggagtagccaggcacagaactgagccatctcggtgagatgcagaggcacaatttggggagagcatgtccttgaattagtccagcagggtcatagccactgcctcatgcacagaacatccttctagaagctgtgagctttggtacctctgtccagccccgcccccacctctatgtaaatccatgcytcagtttccttacctggaaaatgggtataataataatctaccttacagggttaaatgtgctggtaggtcccaagccctgggcacagcacctgatatgagctgtgtagaccatagtctgtggtttataacttcaggagtcttgtctgtgtagataagcatttgtcctgttacccagtttctttaactggtgcttacctgtgccgagcacaaatacaagctccgataatcctcacagcagcccagtgaggtggatgctgtttttatctctactttgctgatgaaaagctgaggcacagagtg

SEQ ID NO: 198135 - DNA, 601 bp, Human
gatgcagaggcacaatttggggagagcatgtccttgaattagtccagcagggtcatagccactgcctcatgcacagaacatccttctagaagctgtgagctttggtacctctgtccagccccgcccccacctctatgtaaatccatgcttcagtttccttacctggaaaatgggtataataataatctaccttacagggttaaatgtgctggtaggtcccaagccctgggcacagcacctgatatgagctgtgtagaccatagtctgtggtttataacttcaggagtcttgtctgtgtagrtaagcatttgtcctgttacccagtttctttaactggtgcttacctgtgccgagcacaaatacaagctccgataatcctcacagcagcccagtgaggtggatgctgtttttatctctactttgctgatgaaaagctgaggcacagagtggggaagcggcttgccccaggtcatccagctgggcagcagctgggctgggaccgcacgtcaggcaggtgggctgcagggtctgtgctgcgggtgtctttgttgctgcctctgtggtcaggccgttccccagcaaggctgttcttgtgggtgag

SEQ ID NO: 198136 - DNA, 601 bp, Human
ctaccttacagggttaaatgtgctggtaggtcccaagccctgggcacagcacctgatatgagctgtgtagaccatagtctgtggtttataacttcaggagtcttgtctgtgtagataagcatttgtcctgttacccagtttctttaactggtgcttacctgtgccgagcacaaatacaagctccgataatcctcacagcagcccagtgaggtggatgctgtttttatctctactttgctgatgaaaagctgaggcacagagtggggaagcggcttgccccaggtcatccagctgggcagcrgctgggctgggaccgcacgtcaggcaggtgggctgcagggtctgtgctgcgggtgtctttgttgctgcctctgtggtcaggccgttccccagcaaggctgttcttgtgggtgagtggctctataagggcagggctgggtcgcagcaggcccttactgttgcagaaggctcacctgcctcaccttggcagcccttggtgagctgcttctcacctgtcaggtacaagcctgacagctggaaccttctcttagcataagacgttctggggtgtgtggtcactaagacactcctgcttaggcgt

SEQ ID NO: 198137 - DNA, 601 bp, Human
tagagatcacgcctcctatctgtgtgccatttgcagctcagggtggccctgtggtctcatggagggatgtggaggaggagtgaggggcatggtgtggcaaggaggtgctcctttgaatggcactctgccctctccactgagcgatcctggggtgcttctctgtgcctcaacttccccatgtgtacagtgggggtgcagaatcagtaccctcatcaggtgattgtcgggagggtaaaggaacttaacctcatgtaccttggagtatgttccaaggatggtccctgagcgctggctagagacrcagagtctgaggccctgctccagccacaagatccgaacctgcatcttagcaaggtccctggggatctgtgtacaggttttgagacacgctgactttccgcacactaagtgctcaggatggcagctgcacacactaagtgctgcctgttagctttcgttacgctgtagggaggatgtgtaggataccagcctgggtgtctcctggagggttaggatggcgtctcccttctccacgtccccatgctctctgctcctctccctgtagcagcacagcccgagatagtgtcaggtctcagctgcc

SEQ ID NO: 198138 - DNA, 601 bp, Human
cagtgggggtgcagaatcagtaccctcatcaggtgattgtcgggagggtaaaggaacttaacctcatgtaccttggagtatgttccaaggatggtccctgagcgctggctagagacacagagtctgaggccctgctccagccacaagatccgaacctgcatcttagcaaggtccctggggatctgtgtacaggttttgagacacgctgactttccgcacactaagtgctcaggatggcagctgcacacactaagtgctgcctgttagctttcgttacgctgtagggaggatgtgtaggatmccagcctgggtgtctcctggagggttaggatggcgtctcccttctccacgtccccatgctctctgctcctctccctgtagcagcacagcccgagatagtgtcaggtctcagctgccactggcctgagaactgccagaggaggggcctggaagggcgggtgcaggggtatgtgtgagctcaggggcataagccctgaggaatccccctagtgaggaggtgtgaggccgcggttatcacccctgagcaggcagagcggcacagaagtgcgtcctgcaatgtacattcccgggcctacctcac

SEQ ID NO: 198139 - DNA, 601 bp, Human
gttccaaggatggtccctgagcgctggctagagacacagagtctgaggccctgctccagccacaagatccgaacctgcatcttagcaaggtccctggggatctgtgtacaggttttgagacacgctgactttccgcacactaagtgctcaggatggcagctgcacacactaagtgctgcctgttagctttcgttacgctgtagggaggatgtgtaggataccagcctgggtgtctcctggagggttaggatggcgtctcccttctccacgtccccatgctctctgctcctctccctgtagyagcacagcccgagatagtgtcaggtctcagctgccactggcctgagaactgccagaggaggggcctggaagggcgggtgcaggggtatgtgtgagctcaggggcataagccctgaggaatccccctagtgaggaggtgtgaggccgcggttatcacccctgagcaggcagagcggcacagaagtgcgtcctgcaatgtacattcccgggcctacctcacatcctctgattccatgggtctgaggcggggcccaagattctacatttctaatgagctcccagggaaggcgactgctgccgg

SEQ ID NO: 198140 - DNA, 601 bp, Human
ctttcgttacgctgtagggaggatgtgtaggataccagcctgggtgtctcctggagggttaggatggcgtctcccttctccacgtccccatgctctctgctcctctccctgtagcagcacagcccgagatagtgtcaggtctcagctgccactggcctgagaactgccagaggaggggcctggaagggcgggtgcaggggtatgtgtgagctcaggggcataagccctgaggaatccccctagtgaggaggtgtgaggccgcggttatcacccctgagcaggcagagcggcacagaagtgygtcctgcaatgtacattcccgggcctacctcacatcctctgattccatgggtctgaggcggggcccaagattctacatttctaatgagctcccagggaaggcgactgctgccggtccaccggcccactttgagaccctttcagttggctgtcagagattcgggtgagggctgcagccctccctgggtgtcctcaggtcggggttgccaactcagttgcctccaagggccaggcaggtaagagcaatgcacgaattgagagataagagagagcactgggcagctgtgcccatggagaggcg

SEQ ID NO: 198141 - DNA, 601 bp, Human
gtgcgtcctgcaatgtacattcccgggcctacctcacatcctctgattccatgggtctgaggcggggcccaagattctacatttctaatgagctcccagggaaggcgactgctgccggtccaccggcccactttgagaccctttcagttggctgtcagagattcgggtgagggctgcagccctccctgggtgtcctcaggtcggggttgccaactcagttgcctccaagggccaggcaggtaagagcaatgcacgaattgagagataagagagagcactgggcagctgtgcccatggagakgcgttcaaacgaggcattaaaatcccggcaacaacctggaatggccaaacgaacagctccttgcttggaatttggcccaagggccaccagtttgagatcccatggtgccctggcctaaatgctacaagccctgggcctcctgatcccccagccctgctgctgcgggagttggaggtcatctcggccttgcttgcaaacaccctctgcctgtgtcattccagagctgcagcagttctataacagccagggccggcttcctgacggcagggtggtgctgtgctttggggaagagtttccgga

SEQ ID NO: 198142 - DNA, 601 bp, Human
ctaaatgctacaagccctgggcctcctgatcccccagccctgctgctgcgggagttggaggtcatctcggccttgcttgcaaacaccctctgcctgtgtcattccagagctgcagcagttctataacagccagggccggcttcctgacggcagggtggtgctgtgctttggggaagagtttccggatatggcccccttgcgctccaaactcattctcgtgcaggtaagtatgggcagcttttttttttttttttttttttttgagatggagtcttgctctgttgcccaggctggtgtgcartggcgtgaccttggctcactgcaacctccgcctcccgggttcaagtgattctcctgcctcagcctcccgagttgctgggactacaggcccgtgccaccacgctcagctaattttttgtatttttagtagagatggggtttcaccatgttggccaggatggtcttgatcttgtgatcctcccagcttggcctcccaaagtactgggattacaggcgtgagccacctcgcccggcagtctgggcagctttgagccctgcatccaggtctcctggccctgtcatgtaaggatcaagttttggg

SEQ ID NO: 198143 - DNA, 601 bp, Human
tgcgggagttggaggtcatctcggccttgcttgcaaacaccctctgcctgtgtcattccagagctgcagcagttctataacagccagggccggcttcctgacggcagggtggtgctgtgctttggggaagagtttccggatatggcccccttgcgctccaaactcattctcgtgcaggtaagtatgggcagcttttttttttttttttttttttttgagatggagtcttgctctgttgcccaggctggtgtgcaatggcgtgaccttggctcactgcaacctccgcctcccgggttcaagygattctcctgcctcagcctcccgagttgctgggactacaggcccgtgccaccacgctcagctaattttttgtatttttagtagagatggggtttcaccatgttggccaggatggtcttgatcttgtgatcctcccagcttggcctcccaaagtactgggattacaggcgtgagccacctcgcccggcagtctgggcagctttgagccctgcatccaggtctcctggccctgtcatgtaaggatcaagttttgggctggagaagaggacacaaggacaagtttccacctgtgtaggaggca

SEQ ID NO: 198144 - DNA, 601 bp, Human
atgaatgcatgtctatttgagtattgctgtctcagcctcttagagtgtaagccttttgaggccagggagcctgcctgtcttactcattgccgtatctccagcacataggaggcagatgaagacgaactgcagactcttagacaagtcttctctgttaagttttaacttacgtaagtcatacatgaataatacatgaatctgttctcaagatattaaagcagtctggaataccatcagccgtcactgaagtcagttgggatatttgtgtggtgatgcacctgagtaaggggtgcccagatayaccagatctccccagcagaggctcaacagaaatcggtccatgttgaagcggtgacaaacattccttacaatctggagtctttgtttttctctctctctaaaagaaatgtttggtatattaaccattgattttcccttaattgctgggggaccaggcctgaagctctgaagaacccctgaaaccatgaattggccattcttattctggaagatgcaattttgaggtttgcatgcaccaaggttttgagggtttatgtcgttataatagctttttccccccagtctccctgtcatggcattt

SEQ ID NO: 198145 - DNA, 601 bp, Human
cctcttagagtgtaagccttttgaggccagggagcctgcctgtcttactcattgccgtatctccagcacataggaggcagatgaagacgaactgcagactcttagacaagtcttctctgttaagttttaacttacgtaagtcatacatgaataatacatgaatctgttctcaagatattaaagcagtctggaataccatcagccgtcactgaagtcagttgggatatttgtgtggtgatgcacctgagtaaggggtgcccagatacaccagatctccccagcagaggctcaacagaaatcsgtccatgttgaagcggtgacaaacattccttacaatctggagtctttgtttttctctctctctaaaagaaatgtttggtatattaaccattgattttcccttaattgctgggggaccaggcctgaagctctgaagaacccctgaaaccatgaattggccattcttattctggaagatgcaattttgaggtttgcatgcaccaaggttttgagggtttatgtcgttataatagctttttccccccagtctccctgtcatggcatttacaacagctttacaagatgtaattcatataacagt

SEQ ID NO: 198146 - DNA, 601 bp, Human
gcccatgtcaagcacctgtctgccagccagaaggcactgaaggagaaggagaaggcctcctggagcagcctctccatggatgagaaagtcgagtgtgggtattgaagggacccacaggcgcgcccagcagctctcggaagcgtgtgtgtgacagagcctctgctcacttctgggcctactgtctagagagcagtcttgcacaggagggttgctctgctgggtttcggggtcactgtgccagggccccagtttatgtgctcaccagtcacttagctctgccagctgacaggatcttttgctrggcccccttctctgtgctgagtggaggtagcctctcagcatatctgctgggtaagacatagttaactgtaaattattgaaagaaactcagcaaaatgcatagtgtttggtatgaaaggggcagaaaaataacaagattaaatagaccctaatactgtaattcaagtaagaaataattttgcagttttaatttgcacctgaagcgaactgtatgcattttcttccttccttgccctgtcacatgcctgcgtgggcacgtgtgtgcacgtatgtgcgtgaacatgatgtggcctgggttggt

SEQ ID NO: 198147 - DNA, 601 bp, Human
ttgctaggcccccttctctgtgctgagtggaggtagcctctcagcatatctgctgggtaagacatagttaactgtaaattattgaaagaaactcagcaaaatgcatagtgtttggtatgaaaggggcagaaaaataacaagattaaatagaccctaatactgtaattcaagtaagaaataattttgcagttttaatttgcacctgaagcgaactgtatgcattttcttccttccttgccctgtcacatgcctgcgtgggcacgtgtgtgcacgtatgtgcgtgaacatgatgtggcctggsttggtgtatccttcagctctgtgtttcctccttcacaagtgtggttttggggagaagtggttgaatgttgcagaggagggagctgctgacctttgtgcctgtaaatggctgtcctctctgcccccagtgtatcgcattaagttcaaggagagctttgctgagatgaacaggggctcgaacgagtggaagacggttgtgggcggtgccatgttcttcatcggtttcaccgcgctcgttatcatgtggcagaagcactatggtgagtagagagggaggaaggcatgggcgcctggactgggg

SEQ ID NO: 198148 - DNA, 601 bp, Human; identical to SEQ ID NO: 22253

SEQ ID NO: 198149 - DNA, 601 bp, Human; identical to SEQ ID NO: 22254

SEQ ID NO: 198150 - DNA, 601 bp, Human; identical to SEQ ID NO: 22255

SEQ ID NO: 198151 - DNA, 601 bp, Human; identical to SEQ ID NO: 22256

SEQ ID NO: 198152 - DNA, 601 bp, Human; identical to SEQ ID NO: 22257

SEQ ID NO: 198153 - DNA, 601 bp, Human; identical to SEQ ID NO: 22258

SEQ ID NO: 198154 - DNA, 601 bp, Human
tgaaacacttggagaaagtgatccttttcacagtagttagttgggacatcaccatagttatttcagaatcacattttcttccttttagttattgttaagtttgaatatgacctagcatcactttaaaattaatttctaacctaaacctaagttctggatggtgttatgttcaaatttatttttaactttactttgggttccagtcaaattctgataccaactaaatcatagcagccattgtgaattccgaacaagaaggcgtttaacgtattcctacagacaaatgttgagagttaactcyacaggaagttgggctcatgataataatcgcaattaaccccttaattactttcaaattttatttctataaaagtcataattttatttgttatggaataattatttttttaaaacatgtttttcaaatattcatgaaagctggataattctaccatttcacgaattatttcttcttaccaagtgatgagggcaaatgcaaatgtagctgatacgcaaagtatggtcttatctctgtgatttttgtttgtgccaaaaggaaattactatcattttatagaatattttcttttgtttacatatc

SEQ ID NO: 198155 - DNA, 601 bp, Human
ctgataccaactaaatcatagcagccattgtgaattccgaacaagaaggcgtttaacgtattcctacagacaaatgttgagagttaactctacaggaagttgggctcatgataataatcgcaattaaccccttaattactttcaaattttatttctataaaagtcataattttatttgttatggaataattatttttttaaaacatgtttttcaaatattcatgaaagctggataattctaccatttcacgaattatttcttcttaccaagtgatgagggcaaatgcaaatgtagctgatrcgcaaagtatggtcttatctctgtgatttttgtttgtgccaaaaggaaattactatcattttatagaatattttcttttgtttacatatcattttactgtgtgaactgataaggggtctgtgattcatcataaaaacattttcagtctataatcctaaaagatcactagcaagtgaagcattaataaggagcttcatcccacttaaagaaatatgagtgtgcttagattgttcaaattgattccaaatgagttccatcaaatggaaatttgatgacatcgtatgggcagttttgaagtca

SEQ ID NO: 198156 - DNA, 601 bp, Human
cttcttaccaagtgatgagggcaaatgcaaatgtagctgatacgcaaagtatggtcttatctctgtgatttttgtttgtgccaaaaggaaattactatcattttatagaatattttcttttgtttacatatcattttactgtgtgaactgataaggggtctgtgattcatcataaaaacattttcagtctataatcctaaaagatcactagcaagtgaagcattaataaggagcttcatcccacttaaagaaatatgagtgtgcttagattgttcaaattgattccaaatgagttccatcraatggaaatttgatgacatcgtatgggcagttttgaagtcactttagtagacagccttcctaatcattattgcctgagaatcagacgctaatggagtccagtgggctttccatcccctatctgaggctttaattctgtgaatcttttttgcgaagttcaactttgtagtgattcaagtttatatgagtgtgtcaataacaatagctgcaacaagatgaagttagtaattacttcctaaacataatatatacttaaatataaaaagtttggggtatcatatattattagtctaaaaagatg

SEQ ID NO: 198157 - DNA, 601 bp, Human
cccatcattatcttaaaggtgtctactttttctgctctaaactttccttccaatcttatatttcccttctcatacaagattccaatcaaatgttcatggcgattctcaagactttctcctctacttgaaatatttctctccctgttaaatactgcataggcaagcctcatctatatgtcattttttccacacaaagactgctgcttctcttaactgaaacttttattaatagaaaaccacttttgtggcattttctactttttttccctcttacagttgtttttcagtatatgtttcaacrctcttcctaaaattgatgctactcattggcaaggcctgtatcatatttacattgataatctcaacatttgacatagtaatgataatttgataattccgttaatattgtcaaaaattaaattcagaaatttttactccaagtttgagtttttacattcttttgttaaaataaatttttcacatcggctaaatctacctgtaaatctggctttttttcttaatcaaggaaacattgtattcaagtcactcctaaatttctagtaacaaattcttttaaattaatttttttttaaatttatct

SEQ ID NO: 198158 - DNA, 601 bp, Human
ttaaattcagaaatttttactccaagtttgagtttttacattcttttgttaaaataaatttttcacatcggctaaatctacctgtaaatctggctttttttcttaatcaaggaaacattgtattcaagtcactcctaaatttctagtaacaaattcttttaaattaatttttttttaaatttatctttaggtgcaataatgaagagttttcttctagttgtcaatgccctggcattaaccctgccttttttggtaagttaatttcatctaaccagattgtactgactttaagaaaattttrtttaagggctttaactatgcaaacttctaaatacaattatgcttcatagaacaaaatatccacatagttgttacatttttaaggttaatttttttaatatttatttctattatgaaatcaaagtcatgttcttttggatatccatttagttctgtgaattaagaaatcacacttaatcatgtacaggaaacttttaaaattctcatgctatagagaaaatacattcaggggaaaaacaatactgaaaacattttaaaattgtaaatgcattaaggataattcagaaagaataaatacaga

SEQ ID NO: 198159 - DNA, 601 bp, Human
ctagttgtcaatgccctggcattaaccctgccttttttggtaagttaatttcatctaaccagattgtactgactttaagaaaattttgtttaagggctttaactatgcaaacttctaaatacaattatgcttcatagaacaaaatatccacatagttgttacatttttaaggttaatttttttaatatttatttctattatgaaatcaaagtcatgttcttttggatatccatttagttctgtgaattaagaaatcacacttaatcatgtacaggaaacttttaaaattctcatgctataragaaaatacattcaggggaaaaacaatactgaaaacattttaaaattgtaaatgcattaaggataattcagaaagaataaatacagaaatcatagtctgggaatcagaaattattttaattaagttcctgtctcacccagactccaatctctttatggaaacaaaatccttcaaaggtcaactttggttaagctttttcacaagtttcaaagaccttgatacttctgcctttaatatttgaatcattaacttttgttatattcttccccattatgtcaattgactgacccctttccaggg

SEQ ID NO: 198160 - DNA, 601 bp, Human
atcagaaattattttaattaagttcctgtctcacccagactccaatctctttatggaaacaaaatccttcaaaggtcaactttggttaagctttttcacaagtttcaaagaccttgatacttctgcctttaatatttgaatcattaacttttgttatattcttccccattatgtcaattgactgacccctttccagggatcaatggttataaacagcttgaaggcttgcaggcattatcttgaattatatgcaatgttttaaggctactggacttagaaaaaggttctgtttttttctttyaattttttgacttgtttttattgttgttttggctattgcctctttttattttcttgttcatctgggtattctaggcactgacaaaggaggcaagcataaataatggtatatgtcctcctcctagattgtaaaattttgaggaacactagtcctcgttctgtgaatctctgtaatatttatttattattaagtttagagttgcttttaagttaacatctattaattaattctattacctgcatgttgtgcttgtgtataacatgtccattaattctattaggtcaattcttggagtcaaaa

SEQ ID NO: 198161 - DNA, 601 bp, Human
accattcaatcttatgagtagtcaaatttatacaaattaaaacatcaatgtgataccatgttatatgtactattttatcccttcccccaaaataaaaatagttagataatattttactagcacttatgcactaaactgcataaacacatagcctattggtgacattataatttgacacaacttttctataccacaatttcataatttctatcaaagaatcaaatctcatttgtgaaaaatcattttaaggtattaacgaaaattattaaaaaggccactggtatacagatgttaatcatcwctctgtttataattaaaattttatcttaatagataacgataagaaataaacatttcatgacataatcattgatcacttagttatcaactataaaaatgtaactatgaaacctatgatataaataaaaaaaagagacaccacatttcctataaaaatgcaggatactttttagacaagcatataccaggaatacataacataggttgatatcgcattaaggtatctagattgtcagaattttttaaagtatactttctacaatattcatattacttcttttttttttttttttttgagaca

SEQ ID NO: 198162 - DNA, 601 bp, Human
ggtttaagcgattttcctgcctcagcctcccaagtagctgggactacaagtgcccgccaccatgcccagctaatttttgtatttttagtagaggcagggtttcaccatgttggccaggctggtcttgaacccctgacctcagatgatccacccacctctgcctcccaaagtgctgggattacagggtgagacatgtgcccggcctcatattacttctttacattttaaactaatgatttaatatatttaaagaaaagcaagtctttgtctcaaagcaaggaaactttattaccttctcaawtttctgattttctatactcacaccttccaaaaggtttctagagtcattttatacccaaggaatacatgtgtaatgtcctaaaacagaactgtcaatttaaaaatatttaatattatacctcctttcaaaagtttctaaaagctttggagtttttagttttataaatatgtgtccataaaaattgttttctcactcctgattctctaaatatgtcacaatccaaaactaagaaaagcactataaaaacaaatgaaagatggtattaaaaacactattatttatatgttaagtttatgcaag

SEQ ID NO: 198163 - DNA, 601 bp, Human
agctccatatgtcccaatgtattatgtgccaaatagctatccttattatggaaccaatttgtaccaacgtagaccagctatagcaattaataatccatatgtgcctcgcacatattatgcaaacccagctgtagttaggccacatgcccaaattcctcagcggcaatacctgccaaatagccacccacccactgtggtacgtcgcccaaacctgcatccatcatttattgccatccccccaaagaaaattcaggataaaataatcatccctaccatcaataccattgctactgttgaaccwacaccagctcctgccactgaaccaacggtggacagtgtagtcactccagaagctttttcagagtccatcatcacgagcacccctgagacaaccacagttgcagttactccacctacggcataaaaacaccaaggaaatatcaaagaacacaacgcaggtaaattaacagtatataaaatgagtaattccgacaagaagcatggatttatgaatacaaccataaattctaaaatagtacaaatagataaactaagtgtgttacagaagcagacaaaacagggtacttacagttttaccttg

SEQ ID NO: 198164 - DNA, 601 bp, Human
tgtgcctcgcacatattatgcaaacccagctgtagttaggccacatgcccaaattcctcagcggcaatacctgccaaatagccacccacccactgtggtacgtcgcccaaacctgcatccatcatttattgccatccccccaaagaaaattcaggataaaataatcatccctaccatcaataccattgctactgttgaacctacaccagctcctgccactgaaccaacggtggacagtgtagtcactccagaagctttttcagagtccatcatcacgagcacccctgagacaaccacagtygcagttactccacctacggcataaaaacaccaaggaaatatcaaagaacacaacgcaggtaaattaacagtatataaaatgagtaattccgacaagaagcatggatttatgaatacaaccataaattctaaaatagtacaaatagataaactaagtgtgttacagaagcagacaaaacagggtacttacagttttaccttggtaaacccatagcattgatacaccagattctgttccaactagaaatttaaaataattttatttgacaaagtgaaaataattggcaacttcattatcaaa

SEQ ID NO: 198165 - DNA, 601 bp, Human
actgtggtacgtcgcccaaacctgcatccatcatttattgccatccccccaaagaaaattcaggataaaataatcatccctaccatcaataccattgctactgttgaacctacaccagctcctgccactgaaccaacggtggacagtgtagtcactccagaagctttttcagagtccatcatcacgagcacccctgagacaaccacagttgcagttactccacctacggcataaaaacaccaaggaaatatcaaagaacacaacgcaggtaaattaacagtatataaaatgagtaattccracaagaagcatggatttatgaatacaaccataaattctaaaatagtacaaatagataaactaagtgtgttacagaagcagacaaaacagggtacttacagttttaccttggtaaacccatagcattgatacaccagattctgttccaactagaaatttaaaataattttatttgacaaagtgaaaataattggcaacttcattatcaaacttttttctgacaattgggacactcttagaatgtaatagttttatttcatccttattcacacacaaactatgacagtagagtaaaacagca

SEQ ID NO: 198166 - DNA, 601 bp, Human
attcacacacaaactatgacagtagagtaaaacagcaagtaacattttcatgatatttcaaaaataatttttagaagaagttatatagaatatgagtttgagtaaattttaattctgtaacaattctcttgcactctcattgtagtatgaacagagtaaaaggaaatgatatgcttccatgcatttctttatttcagacatcatttccaaaatgattcatgaagttaagcctctcaaatttctcctattctaagataaacccatggaagaattataatgcttaacttgaaaaacacataartattaaaaggatactttcagaacacaatgtgatgcaaagtgttactatttattacttggaccaatggataatggcagaatataaaataatttgaaacttatgagaagaatttaaacaaagagaatgattaataaagtggaaaatatccaaagagtgtaaaataatttggggagaaagttgcaaaatgtggagtttctttacaacaaatattttcagtccatcagatgtctacatgttttatgatctaaaataccagacaatggtctgtgatatcatgggactaccattagcccagaaaag

SEQ ID NO: 198167 - DNA, 601 bp, Human
gcaagtaacattttcatgatatttcaaaaataatttttagaagaagttatatagaatatgagtttgagtaaattttaattctgtaacaattctcttgcactctcattgtagtatgaacagagtaaaaggaaatgatatgcttccatgcatttctttatttcagacatcatttccaaaatgattcatgaagttaagcctctcaaatttctcctattctaagataaacccatggaagaattataatgcttaacttgaaaaacacataaatattaaaaggatactttcagaacacaatgtgatrcaaagtgttactatttattacttggaccaatggataatggcagaatataaaataatttgaaacttatgagaagaatttaaacaaagagaatgattaataaagtggaaaatatccaaagagtgtaaaataatttggggagaaagttgcaaaatgtggagtttctttacaacaaatattttcagtccatcagatgtctacatgttttatgatctaaaataccagacaatggtctgtgatatcatgggactaccattagcccagaaaaggttgcttctttcatctgcttgcctaatgaccata

SEQ ID NO: 198168 - DNA, 601 bp, Human
aactgatcaatctgtaaaatgtcatgtattggaaaagataaagtaaaattcataccagtatcctaagtctccactaaatgataaaaaccgtacataattatgtctgttgattcccatagtaaccatatgaaacagatattattcctatctcaaatttagggataaaaaccagtaggactgaggacattaagtaaattatcacagctagaaattgcaaatgggaggcaaaccaaacctgtttaatttcagatagtggggtttaattactatgtcatttatttttatatgggctgtctaactygctgaaaaacagggaaaatacactgtgatttccttagactagcatatgggtaaattgtgttgtttagttgctgttcaacaggatatccattaagaaaaagagaacaagagctggttaaacagctggcttattatattttggagaacaaaataagaaaattaataaagacaacatgaaagcaagttatttaataagtagttacatattttactgatgcaaaacataaagaagcatgtaaaagagttttttctgtaaatattacataatgtctattattttcagtttactatatgcctattt

SEQ ID NO: 198169 - DNA, 601 bp, Human
tcccttaaggatcatataacctttctgaagagacagaatctattgatgtaccatttacttatcaagtgatcacacacccaagaagagtggtgtaagaataaatatctacctgactctctcaggtaaatttaggactacactaaatctcgcttatttactaaagtggctattgtaattataaaatgtgtcctttttgcacgtctgcctacctactacttagcaagctcttaactatcactggcatctctaacttttcagtttgtaccacagctcctagtcaatgtctgacccatagaaggcygtcagtatatgcttaaggtgaataagttcagagtaaagagagttcaaggcagaaaacaggacaatatggttcattaaaaaaaaaagaagcaaaataacacaatttcaagtagcaagccaatttacaaagttctagaatgttgtattatccagatacttattgtccttaaacacacataaaagaaatatgtactagaacttatatgtcattaacatagctgcattagcttaactgccatgatgtaacaccatagaaaaatagcacaggattttactgttctaaaattgggtagaatgttaa

SEQ ID NO: 198170 - DNA, 601 bp, Human
aaaaacaagatgtgaagtaaggcttgtgtaaaagagatgtgcacaaggaaaatgacagaacattttttagcttttttttccaaattcaatcatattattaaatttaattccggcttttgtaagccttaattactttatctaaatcagaattctcaacagactaattaaaccagaattcatgcaatagtttttttctcaacactcagtttcctctacacaaaaaactagaacaattatatcagaatctctgggtaagcttaggcattgggatttgtggggaaaagttctccaggtgattctrttgtataggtaagcattaagaatcacttatctatgagaacacatggacacaggaaggggaacatcacacacctggacctgtcgtggggtgggggtagggggtagggatagcattaggagatatacctaatgttaaatgacgagttaatgggtgcagcacaccaacatggcacatgtatacatatgtaactaacctgcatgttgtgcacatgtaccctaaaacttaaagtataataataaaagaatcacttatctaaactgtttttttaattcatttactctacatttattcttttattct

SEQ ID NO: 198171 - DNA, 601 bp, Human
gatcttatatgaagaaacaaacaaagagtacaatcctagaagttaataggaggccagaactcaaggaaagaaagcataaaatgttctcaggcagatgaaaattaagaaaataatgattagaacatggtcaccaataattttgaaagtatactttgagtagggtaataaagaagggggaattaaatcaatggagtgcttttccttcttgtttttgaaataagaattatccgtgcaatcttttacaaggaaaagagaagattcagacttcctagtgtagattcaaactcaaggaggtggtacmacagagactcataaaaactgtcaaatgacagtgcacattgtaagccccctacatgtccatagactaagactcatcatcagaatccttatattggtcaagatgtatggtacatttaaggctaagcttctttttgctctcagattcctacacaaccatgttgaccttgttaatttagtcatatgaagtaggtggaatattgtttgaatagactgtttcttttttcttcagtttacagactattttttaaatgatattggcgtatgtatatctttggcatagagtaggagtcaaatatttgaa

SEQ ID NO: 198172 - DNA, 601 bp, Human
agctgcaatctttcttaccagtatttttgaccgtgattcttaatagagttgtgtgcagccagcaagtttatgcagtctttcaaaaaaaaaaaaaaaaactaaaaatcaatagcaagagctgccatgaaagtagaaactaccaaagcactgtggaaaagggtcaaaattctaccaccatttacaaaagataatttatcacttgacattattaatgtcagttgataaaaagtttagtgaatattgtataacataacataggtagttgtatgctaagcagattaatgcaggaacagaaaaccarataccacatgttctcacttgtaagtaggagctaaatattgaatacacgtggatataaagaagggaacaatagacacctggggctaatcgagggtgggaagggggaggagagcggaggatcaaaaaactacctatcaggtactatgcttattacctgcgtgaagaaataatccgtacaccaaacctccatgacacacaatttacctatataacaaacttgcacatgtacctctgaccctaaaataaaagttggaagaaaaaaataaaatttaaataagttctatagttctaactatagaac

SEQ ID NO: 198173 - DNA, 601 bp, Human
tcttaatattagacttagtatggaaataagcctttttgggagcaaataaaaagtttttcaaggacaatttgttgtaaaaagtaataaagattccatcactctagcaggtccaatgtaccccgtataagtggattacagcagcgtaggattttgaaattccattttaacttggtgcccagttcttctctaaggaattcgcttattccctacattaagcaataagtaaaatatcatgaagatatgaaacttaatttgacttctaccaactaagtgcagagggtgacggaaaaaaaaaaaaaaaagacagtcatagcatggtgtaaaggaggactagtctaagggtcatggatgaggatttttgtcatgaattcactactgtttgcctaggctgtccttgggccagccacctggtttctcagagcctcagtgtgatccactggaaaatgtgatcatgttcaatgtcctttcctaatctgtcattctgtgaagtggtgcttccaggtcaaggaaacaaataggtcagaatgttcctgtggtcattgttctctttaggctcattttccatgaaatagttgtattcctcttcctgtagcacactcag

SEQ ID NO: 198174 - DNA, 601 bp, Human
gtacctactcaagatttatattcaaattaacttctgggtcatatagatgtttacattgatctattttagtttcactcttatatttcctctagtgttgagacaatattttatatctttcctctgccttccctgatagtttaacacacttttgaacagaatcttagagtattagaactagaggaaatgatcagccagaatctgtcattttgtgagttaaaaatgcctgatccagtggatgtgaggtcacttgtccatgttcacacagatgtaggtactggtagctcctagatttttgtatacmttttcttccatttcaattatagacactctgtctttttcactaaaaagggaaaaaagggggagattgaggtgccaaaaacactaccttaaccaaggattaggaatatatttatggtatccatatggaaacatagttatgttctgctatagaatttgttacctaaatgtgtattttccctcatggataatcacaactagttatacaccatgattagttctcatcacaaagttttgtatttctaatgattttttataatttgtagttttagcatcttatctgttttggttatcggatgattgt

SEQ ID NO: 198175 - DNA, 601 bp, Human
aaataaaatgaaataacaggcatggtgagggtggtgcctactaccatagcacatgacatataagccccagagggccttggtgcatgtcctgtcttagcagttttacccgaatcgggtgtctctgtgcgcatctgtgacaattcataattttgtcaatgaagacttagtttttatgggtacaaaaacatcttaccttagaattttcttcatggtcttaaagtttttatattattagcaagagtctatacaagtatcttgttgcaaagaatgttgttaggtgtaccatatatatatacacacctatatatatatgtattcataggtgtatatatacttatgaaaatctagaattcacatatgacctaaggagagtatcagcataattgtttaagaaatagaacctaagtgaactgagtaagtgtgaggaaagaaaatagttgttagaatttgagaactcatcatgattttttttgtttgtttgggggaagttatatttttcacttctgtttttaattttgtttattttttgaggcaaggtcttgttctgtcacccactctagagtgcagtggcacgatcacagttcactgcatcctcaacctc

SEQ ID NO: 198176 - DNA, 601 bp, Human
tacaggtgtgacccaccatgcccgaccatatttttcacttttaaatatattatttgggatatgagaaaacatattattgaaatagttctcctctggtagttgacagctgatctatattttattcttaaagcctttaacctatctctctaagggacaaaaaggggatgtgttagatatatttggtttgcttagagaggcaatggagcaaagactggagaagaacagttgcatttacagctaaattttagaatccataaatagctctttctgtaacaattttaaagggattcctgattatctrtaggtcatcttgtctcagcatgtcaccaaaatagtcttttattgtttgcctgagtgccttaaataatggaaaaacaaccagtaccttttagaaaaaaaattaacactttgatagtgcatgtgttgagctaaacatgctttttcataactaattataccctaaatccatctgacattggaagtatgtgagaatgtccctcctcaaacagaaccacaggctgtatttggccattgtctgctaaagtaagcttgattacactttgacaagatatgacctgaatcaaagcacgaaattgcttgg

SEQ ID NO: 198177 - DNA, 601 bp, Human
atatttggtttgcttagagaggcaatggagcaaagactggagaagaacagttgcatttacagctaaattttagaatccataaatagctctttctgtaacaattttaaagggattcctgattatctgtaggtcatcttgtctcagcatgtcaccaaaatagtcttttattgtttgcctgagtgccttaaataatggaaaaacaaccagtaccttttagaaaaaaaattaacactttgatagtgcatgtgttgagctaaacatgctttttcataactaattataccctaaatccatctgacawtggaagtatgtgagaatgtccctcctcaaacagaaccacaggctgtatttggccattgtctgctaaagtaagcttgattacactttgacaagatatgacctgaatcaaagcacgaaattgcttgggttgagatcttatgtgtgtttctacctacaccatctctatgaagatgctgtaattccttcagaatattcttagatctgtaattcattttttgagttactttgctttggaaagaatataaaaagtaatcttgagaaaagcataaattccttcccttgaccttataaacaaacacgt

SEQ ID NO: 198178 - DNA, 601 bp, Human
ctgacattggaagtatgtgagaatgtccctcctcaaacagaaccacaggctgtatttggccattgtctgctaaagtaagcttgattacactttgacaagatatgacctgaatcaaagcacgaaattgcttgggttgagatcttatgtgtgtttctacctacaccatctctatgaagatgctgtaattccttcagaatattcttagatctgtaattcattttttgagttactttgctttggaaagaatataaaaagtaatcttgagaaaagcataaattccttcccttgaccttataaacaracacgttccaaaacttccatacagtctaacttttaaacaaaaaattcagtaattatgttccctttttaaaacaacattctaaaggcagggctgttttaaggatttttcttctagtgactgccatctactggtataatgttgtcagtacactttaggtaacgtgacaattatgttgctattgttttaatatatgggcatatttctgaaaattgaagtactttgatttgaaatattagtaatatgcacactaatttaaaatacaattgtcctgagtgctgtttcagatttttatattctttg

SEQ ID NO: 198179 - DNA, 601 bp, Human
ttcagaatattcttagatctgtaattcattttttgagttactttgctttggaaagaatataaaaagtaatcttgagaaaagcataaattccttcccttgaccttataaacaaacacgttccaaaacttccatacagtctaacttttaaacaaaaaattcagtaattatgttccctttttaaaacaacattctaaaggcagggctgttttaaggatttttcttctagtgactgccatctactggtataatgttgtcagtacactttaggtaacgtgacaattatgttgctattgttttaatwtatgggcatatttctgaaaattgaagtactttgatttgaaatattagtaatatgcacactaatttaaaatacaattgtcctgagtgctgtttcagatttttatattctttgtgtgtctgcagtacttcaagaatagtagttttaataaaattatattaaaaatatatttctagccaactttgaatcctctttttaaagaatctgagacatttgtttagtaaatacatttactgagaactcattatataccaggcatgatgcttagagatacaaaacactcataaacccctaccctgtagg

SEQ ID NO: 198180 - DNA, 601 bp, Human
ctaatttaaaatacaattgtcctgagtgctgtttcagatttttatattctttgtgtgtctgcagtacttcaagaatagtagttttaataaaattatattaaaaatatatttctagccaactttgaatcctctttttaaagaatctgagacatttgtttagtaaatacatttactgagaactcattatataccaggcatgatgcttagagatacaaaacactcataaacccctaccctgtaggaatttacatttttattataatggaataaaatgggtttttaaaaaattcagtccaattgyttaagtctttaccttggctatctactcacttcacaggcattcaaatatgacagtgcaattatgatatatatcttatttcttctcagtgaatatcttccacttgtgaaatgtatttttcctgtaataatcacccttcaccgcgttcctaaaatgtagttggtactttgcagcctagatatgttagagtcaggagattagaactagcaaaagtattcaatatacttgaggggctggggaagttagtctataacccttaaaaatggaaattatattcttatctctaattctcattaaagaagt

SEQ ID NO: 198181 - DNA, 601 bp, Human
atttttatattctttgtgtgtctgcagtacttcaagaatagtagttttaataaaattatattaaaaatatatttctagccaactttgaatcctctttttaaagaatctgagacatttgtttagtaaatacatttactgagaactcattatataccaggcatgatgcttagagatacaaaacactcataaacccctaccctgtaggaatttacatttttattataatggaataaaatgggtttttaaaaaattcagtccaattgcttaagtctttaccttggctatctactcacttcacagrcattcaaatatgacagtgcaattatgatatatatcttatttcttctcagtgaatatcttccacttgtgaaatgtatttttcctgtaataatcacccttcaccgcgttcctaaaatgtagttggtactttgcagcctagatatgttagagtcaggagattagaactagcaaaagtattcaatatacttgaggggctggggaagttagtctataacccttaaaaatggaaattatattcttatctctaattctcattaaagaagtcctgaaaaagggaaaaagcagtgctggataggccttg

SEQ ID NO: 198182 - DNA, 601 bp, Human
atacttgaggggctggggaagttagtctataacccttaaaaatggaaattatattcttatctctaattctcattaaagaagtcctgaaaaagggaaaaagcagtgctggataggccttgtattttgatcattctttctaatataagaaaatgtgctctaaatattcccctgctgaagcccctgtactttttcctccttatcctcaggataaagtctcgtttgagtattagatgcaactcttttatgtttgagatcttacttgtttcaataactttatttccactactctcctcacctcttwctctgtaatccaaccacactcaaatatctgcatttcccaaaacatattatgttcgttcttatgcatgctaccatctgccgtactttacctaactaaacttgtatttgttacatagaccatttatgtagacttgtactaaaaagtgttttaaccctcacccctaccctgaccattctaaatctggatctggatctgttttgtgttttcccatggagtctccattataacaatattccttctctctcactattttaatttccagtttgccagtttaagaccccttctcgttagtttgctaga

SEQ ID NO: 198183 - DNA, 601 bp, Human
gcaactatataataaaaggtttccaaacgcagcctgtaagaaatcaggcaaattttactataagcaataaaccattccgagctttccagacagtgtaccagtagctgtaccagtgggcaataacctttaaccaaacaaaaacaaacaaacaaacaaacaaaagcactttgcaatttgttgctgcaaaatggggagaaaaaaagagtatataaacttgatggaatcacaactgtcaatataatttaagggaaaataaagtcgataaggttgatggtgtctattgtttggaaagtcgaattckgctatttgcttggggctctagagaccacaccactgaataaacaaaactctgcagagtctagctatccgccaacagggggtgccgtccaaattcatggcaaataaagggcatttggtgctcaccattcacaacaggcgggcatttatgtggatgaagtacaatttcttcagcaagctcagcaaaaactcttaaggggcaaatatgaactctgcattttaagaaaaatagaaaacggaaacacaaaatcctaaaaagtatatgaaggctctgcattagcacactggcatcaaaccacacatc

SEQ ID NO: 198184 - DNA, 601 bp, Human
ttaagaaaaatagaaaacggaaacacaaaatcctaaaaagtatatgaaggctctgcattagcacactggcatcaaaccacacatccacagcacatcctaattctatgggaaacaatccttgcttatcggaggtgcatatctaaattcaatagcttaccaatatattcttgggagtaggccaaaaggaaacagaaaacccacattaaaaaaagaagtttcttttcctaaacattttcctgaagctgaaattgaagtggagaggaagtcagttgtcctcgtcgaaatcgtagtcctcctcatyctccccaacctgggacaccggggtcttcaccctggagatgctgtactgagacctgttggagcttgtggccagcatttcatccgcaccattggtcaggtcactggcagagagcctcgtgccgttagacgtggaacctgccgttgtgatgaacacgcctgcaacaattgtctgcgccatttctgtcacgtgtggctccagcgcctttgggaccagacttatggcttttttttttttaagttctgggatacatgtgctgaatgtgcaggattgttacataggtatacatgtgccatggtgctt

SEQ ID NO: 198185 - DNA, 601 bp, Human
catctcataagacataggcatcaacctatagaacagacctggttataattcagctctggaaactcctgttctgctaggtattaactctttagttgtggtaactggtgagttcacaccagtgcatagctgctgactatcagctccactttaaggtttggttcacctttctgcacaggttatggttgtgttacataaatccccaaagggactattttttcatctctgctacttatccagcattacagtataattattcttacaattagataaccataaatgaaaaggtaaaaaaaaaaaaaaacaacacatcaactgattgtgtagtagatggaaactttttttttactttttaaatcgagcatatcgaattccatattccagtggcatgacctaaatgtgtctataaagatggaagcttaatgaatccaggcaactgctttcatgaccttccccctgcaaatagtctttaataattttccatattgataactcagcttttttaactttatcaatgcaaaaatagaatgaatatttcaagtgcagttctacaatgtaaatacaaaatgtgaaaatgaagactttgccaactttaaagtggtaa

SEQ ID NO: 198186 - DNA, 601 bp, Human
ctattgggaaagtcactgcgacatgattaatggtacaggtaagaatatttgttttgtggtcatcacagttaatccacctccctttcccacaaatccaccgttgtactgacagtgttctgaaagttgagggtgtgtgtttacttgcctttatatccccacaacaaaattcagagtcactatttgtatataggctaaaggtctgttcaatgtgatgggatttgtaaagattaatcataaaaaattagcccttactgcatgattcagagaaatgtttgctttgtaaaaactttactgccatcckggcaacagaagtaaatggtaaaaaacaaacaacaacacaaaacactttagttacatttcaaatattttataaatagtatacagataagttagaattgaaagaattaaaaaaagctaattacaaaatagaaaacatatctaagcaaggcttatagctgagatagaataaagttgcaagacagaaccatccatttttggataaggtggtcagaatgagagagaaaacaataacaaagtcagatgtcttcttaactgtgaaaaatatatgtaaaaaatgagcattcataaacttagatttaag

SEQ ID NO: 198187 - DNA, 601 bp, Human
gccagccatatgtaactgttaaggactcaaaatctggctagtatgatttgaaatgtgctgtaaatataaaatgcacagtagattttgagactttaagaatttaaaatattttataatggttacatgttaaaatattttggatattaataagttaaatatagttttgttttgtttgagacaaagttttccacttgtcgcccaggctggagtgcaatggcatgatcttggctcactgcagtatccgcctcctgggtgcaagcaattatcctgcctcaggatagctgggattacgagcgcctayctcaggatagctgaggcaggcctatcctgcctcaggatagctgcctcccaagtagctgggattacaagcacctaccaccacacccagctaattttgtgtatttttagtagagatggggtttcaccatgtaggccaggctggtctcaaacccctgacctcaggtgatccacccgccttggccttccaaagtgctgggcttgcaggcatgagccagcatgcctggccggttatttctttttaccttttaaaaatgtggctgctagataaattacttaggcagtttgcattacatttctatgg

SEQ ID NO: 198188 - DNA, 601 bp, Human
atgcacagtagattttgagactttaagaatttaaaatattttataatggttacatgttaaaatattttggatattaataagttaaatatagttttgttttgtttgagacaaagttttccacttgtcgcccaggctggagtgcaatggcatgatcttggctcactgcagtatccgcctcctgggtgcaagcaattatcctgcctcaggatagctgggattacgagcgcctacctcaggatagctgaggcaggcctatcctgcctcaggatagctgcctcccaagtagctgggattacaagcrcctaccaccacacccagctaattttgtgtatttttagtagagatggggtttcaccatgtaggccaggctggtctcaaacccctgacctcaggtgatccacccgccttggccttccaaagtgctgggcttgcaggcatgagccagcatgcctggccggttatttctttttaccttttaaaaatgtggctgctagataaattacttaggcagtttgcattacatttctatggactacactggaggagagatttctaggtttttttctagaacacacattacatctaatcatttgccactcga

SEQ ID NO: 198189 - DNA, 601 bp, Human
ggctcactgcagtatccgcctcctgggtgcaagcaattatcctgcctcaggatagctgggattacgagcgcctacctcaggatagctgaggcaggcctatcctgcctcaggatagctgcctcccaagtagctgggattacaagcacctaccaccacacccagctaattttgtgtatttttagtagagatggggtttcaccatgtaggccaggctggtctcaaacccctgacctcaggtgatccacccgccttggccttccaaagtgctgggcttgcaggcatgagccagcatgcctggccrgttatttctttttaccttttaaaaatgtggctgctagataaattacttaggcagtttgcattacatttctatggactacactggaggagagatttctaggtttttttctagaacacacattacatctaatcatttgccactcgatttttaaacagatgcagcctcatttccaccttttgttgagaaaagccaggtattgcagttcttttcttctgatatttgcaggtaagacagatactgaagtataagtatgtctgagtcagaccccaggtgacaaaatgcagaccaagaaacttaaac

SEQ ID NO: 198190 - DNA, 601 bp, Human
actaaactagtagtctattaacgatcaagtccagaagggcgtgcccaatctttctaaagacatacagagaagatgatgcaaatgtaacagaactgtgttaatgtgctctgctcagatttgtggggcccagtagataacacacaagcactggagcctttaccactacccttgagcccaagctctgtccctaaagactgtatgcttgtgggtaggcatttaacatctctgaatttttttcttatctgtacaatttaagacagcagtatttcttcatatacgtgtatctggggataagaaaaawatgtgtattgaaccctatgatagacacttggtaaacgatggaaatgtaccaggtatatatccagcatgtatatgcatacactccagtgagtggtctttctttccaggattaattaagccgtgaaagaaactatttcatttaaactgatcacaaataaagtatttgaaggaagtcctataaatatttactctattggataaattgcctgtgagaagtaacttgagtataaataaacatggtacttcacaaacaagaatagttcatgcttggctattgagttttagtatgtgttaaaatttc

SEQ ID NO: 198191 - DNA, 601 bp, Human
ctggattcactttacaatttgcaaaacggctgcaggtcaacctattggtcaagccatcagaaaaaattcagtgagtctcttgaaaatggttattttgatatgatctgtagtatcgtagtatcttcttgtaagaacatgagtaaatctatgtaagtaagtggaaataacatctgatatcaacttatctttagcttaatgtcaccaatcattattaaatgcttatgactaatttcacagattttggaatggttttatggttttatttgagcatttgatagcatctcttattttgttagctgcycaaatatttctatgacaataattaatttttggaattcatatttcagttccccgagaatttattgaaaggaaaaatccacacttgtgaaaaaaaatcaatgtgattagaagacatataagagcaaaggaagtcaaaaacaactatattaaaatttaaatgagtcattacaggaacaaaatcaaattagcaacagcaactaatttatgaacatttattttaaagtttgttatatataaatattagtttatatgttcataattattttcaacgtatattacagagtattaaagaatctgaaga

SEQ ID NO: 198192 - DNA, 601 bp, Human
gccaccagcgtccctgggcccacccctgacacaccccttgccaaggtctttctcctctttcggactctctgaaatgctgtgaacgagccaagcggagcatgacctcctcagaaatcacctcttccacctcggaggacaaaccagctgcccccactcaacaggctgaggctccctggggctccccccagctcttgggggcctggtacagtggcaaaggaccacagcggaggaactgttctccgcccgactgcctttgtcagacacgcactgcccaccagaggggagaatctcaccggctgtktacagcaacctaaacggcacgtgctgagtcagctgtcccggtgccgggtggtgagtgctggaatgtgagcacgccttcctcaccttttcacttcaggtctctgagcatggcacacagttgatgttaacaataaaggcttaaaaaaacgaatcggtggattatgaaatccaccatgtggccccatcagagacacccggggagaaatctcgcaggcttcaccaccctggtgattccctcctgctggccaccaagctccagtgcagcctccctgcttcatctgagagcagaacacttgttcac

SEQ ID NO: 198193 - DNA, 601 bp, Human
tcactggggtgcacggggacggcggccatcactggggtgcacggggacggcggccatcactggggtgcacggggacggcggccatcactggggtgcacggggacagaggtcattactggtctcctgccaaggctggggaaggacagaggagatgctgacagaggcagaggaactccagtctgcacagacaacaggagcaaccccactgcctctggaattaacttccagtttccttggtcatcagtaatagtgaagggaaaagaaaggcaaagtcagacagcaaaatgagggatgaacaaaygaactacaaaaagaatgtttatctgagaagccaaaatccagaagcaactgtttctgagtttctgttcatgaaagtcagtccacatgaggccaccagcgtccctgggcccacccctgacacaccccttgccaaggtctttctcctctttcggactctctgaaatgctgtgaacgagccaagcggagcatgacctcctcagaaatcacctcttccacctcggaggacaaaccagctgcccccactcaacaggctgaggctccctggggctccccccagctcttgggggcctggtacagtggc

SEQ ID NO: 198194 - DNA, 601 bp, Human
gctacttctccaaagatgagactcacttttataagctccaaaaactaattctacacatgcccagctccttagattgaaggtcaggtgcatcacgctggcaagcaagcccctcccaccaccaccacaaacccacgtgaagccattccgtcacctgcaggacgatgcagccctggatgaagtcgtcgaaggcaatctgcccccgtccctgcctgtcaaactttcgaatgaggatgtcgtggaactggtcagagagccggtagccttcaagagggaaagtcagagtcagagaaggctgggagagacgggaggtatgtgccaacactcacccctcctgcccaaggcccacagcctctaacacacacaatgcaaggctgtgtgggaacggaagtgcaaattccctcaaaggcactcagaactgagacacttcccgaatatatcattctgtaatgagctgacatccccagtgcatggagtgaccccttgagaccatgaccccggaaggaggagtgagtgggacgctgccattagtcactcctgtgaattaactactcacctccgggaagcactcaccaaacaccaccccacagggcggccacactca

SEQ ID NO: 198195 - DNA, 601 bp, Human
acatacatgtaaataacccaccggatactgaaaaaccacgtcttgcagatgggctgctctgtgccatttccaaggggaggaaaacatgtttgtccacacttcactaaccggctacttctccaaagatgagactcacttttataagctccaaaaactaattctacacatgcccagctccttagattgaaggtcaggtgcatcacgctggcaagcaagcccctcccaccaccaccacaaacccacgtgaagccattccgtcacctgcaggacgatgcagccctggatgaagtcgtcgaaggcratctgcccccgtccctgcctgtcaaactttcgaatgaggatgtcgtggaactggtcagagagccggtagccttcaagagggaaagtcagagtcagagaaggctgggagagacgggaggtatgtgccaacactcacccctcctgcccaaggcccacagcctctaacacacacaatgcaaggctgtgtgggaacggaagtgcaaattccctcaaaggcactcagaactgagacacttcccgaatatatcattctgtaatgagctgacatccccagtgcatggagtgaccccttgagaccatg

SEQ ID NO: 198196 - DNA, 601 bp, Human
cactcccgtctgggtgacagagcgagactcggtctcaaaacaaaacaaaacaaaacaaaaaacaaaaaaaaccacaacaccagaacatacatgtaaataacccaccggatactgaaaaaccacgtcttgcagatgggctgctctgtgccatttccaaggggaggaaaacatgtttgtccacacttcactaaccggctacttctccaaagatgagactcacttttataagctccaaaaactaattctacacatgcccagctccttagattgaaggtcaggtgcatcacgctggcaagcaagyccctcccaccaccaccacaaacccacgtgaagccattccgtcacctgcaggacgatgcagccctggatgaagtcgtcgaaggcaatctgcccccgtccctgcctgtcaaactttcgaatgaggatgtcgtggaactggtcagagagccggtagccttcaagagggaaagtcagagtcagagaaggctgggagagacgggaggtatgtgccaacactcacccctcctgcccaaggcccacagcctctaacacacacaatgcaaggctgtgtgggaacggaagtgcaaattccctcaaaggc

SEQ ID NO: 198197 - DNA, 601 bp, Human
gatacagctactattacagttgcaaaaccattaatcagcttatccacatatgtacagctgggtccccacgtgacaaaatctaaaggaagaacagcatctaactgcacctgtgctccattccctcacagataggaactgtgacattttggctctttccatgttgtgctgctcttcacgagaggccagggtcatacgatactgaagaccatggacaggtactgttcgtacgacacctgaatccagccgtcctgatccgtgtcgtaacgtctgaatatatccgtcaacctctggggagaaaacrggcatttaaatctcgatagtaaatggaaggagcaaggtgcactgggacaaaggcatgtagggacccaatttcagaagcacacacgtcttctgggctccctgatggagcccagcacagggaggcgcaggtggggctggagctgttcacacggacggtgggagtgcgaagaacgaagaacacagggctgcggggctggctccggacatccagccctggctgagcccctggctgagcccctgaccccaggctctggtctcctgagtctcctgggggcctgggcccttccttctccccctgaag

SEQ ID NO: 198198 - DNA, 601 bp, Human; identical to SEQ ID NO: 26052

SEQ ID NO: 198199 - DNA, 601 bp, Human; identical to SEQ ID NO: 26053

SEQ ID NO: 198200 - DNA, 601 bp, Human; identical to SEQ ID NO: 26054

SEQ ID NO: 198201 - DNA, 601 bp, Human; identical to SEQ ID NO: 26055

SEQ ID NO: 198202 - DNA, 601 bp, Human; identical to SEQ ID NO: 26056

SEQ ID NO: 198203 - DNA, 601 bp, Human; identical to SEQ ID NO: 26057

SEQ ID NO: 198204 - DNA, 601 bp, Human; identical to SEQ ID NO: 26058

SEQ ID NO: 198205 - DNA, 601 bp, Human; identical to SEQ ID NO: 26059

SEQ ID NO: 198206 - DNA, 601 bp, Human
cagcattaggtccataatgatgtagcaggaaaatcaactgtctgctgtggacggctcctgcttcttgcatgccaggattaagactaactccttacttcaagtgtggtagagacagaagctttcatagagcccatgcatgagatctttcataagggacagaccctggatagccaggctcaggctgggcgccgtatcctgcccgctctggtgccctcctgagcatgggtacggccaggccgggcgccggatcctgcccgctcgcgtgccctcctgggcatgggtgcggccaggccgggcgccrgatcctgcccgctcgcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgccggatcctgcccgctctcgtgccctcc

SEQ ID NO: 198207 - DNA, 601 bp, Human
caaacagtcgaggagtcagcgcacacacaaagaaaatccagatggaaggaaagaaaggaaccttaacgatgtctaccggggacagagcgtggggtccacggagaagtcccaggcgttttccacctaagaagcatcatggtgattcaaacaccagggaaatgaatggactcagtggagccactttctgctacttgaccaggtttaattcgagttgtccatgtcgggaatctacagggaagtgacgcaggctgccatcttgctcagcaccccagtgtggcgggcgccccagtgtggcgggcgycccagtgtggtgagcaccggccaagtcagtttgggttgggctgcaccctcgtgcctgggacacccaggaagacccacctctctcgtgttagtggaccagggaggcagccacagacaccaggctctgcgtgctccgctggcacccgaatggccactgggtaccatcccgtgccaagctcagcaaatgtaaatcgctctcattgttattttctaattcactcagggctcattgggttaaaagtttatacattggttaaatacatttgtaagacaacagagggtttttttttagctttagata

SEQ ID NO: 198208 - DNA, 601 bp, Human
cgaggtgaccccagaactggactgggtgcagaggtcaagctagagcccctcacgtctggcagagcaaaactcggctcaaggtaactgtggttggggatgctctgggtgccccacacggttcaagccctccccagacctgggtctcagggatgccacttggcactgactacacactacacgcatgcagatacatgtacatgggtacacaggcatgcacacaccacacaacactcacccacactcacatcatacatatgcacatgcacacacacagaggcatgcacacacccaaacacacacccccacactcacactcacgtcatacatatgcacatgtgcacacacacaggcatgcacacaccacacaacactcacccacactcacatcatacatacgcacatgcacacacacacaggcatgcacacatcacacaacactcacacccacactcatgtcatacatacacagatgcacacacatacacacacaggcatgcacacaccacacaacactcgcatccaccctcacgtcatacatatgtacatgcacacacatacacattcatgcacacatccaaacacacacaccccacacatcata

SEQ ID NO: 198209 - DNA, 601 bp, Human
catattgctgggatcaaaggaggcaaatctgcatcttattcacttgaaaatcaagtagatcagaatcataacaaactagctatttcttatgtttttttttcctttgaacaaattctaaatccttcttttggagaaactgaaatgcctccagatccttattaaaaatataagttaaagaaaatgtagaagtgtatgaatgagtactgtcattttaaagtcaccatccccaatactccaggaggacagggaattgtgcaaaatatcctggtaagtttctatcgactgctggaccatcccatartactgttgaggtgctggcagcatcaacgcggagacaccggacctctgcacccctgtgcaggcgagcacagcttcacgattcaaggggggattgttaaaagggaaagacgaatacgatggctccacaattccgagtcctatctgtgtgtgaacacgtgcacattggtgcgacgcggtgcccaccgcagtttgctgccatcccacctacctgccctgcacaaccagtgccagggcaccggggcaggaccgagatgcaaacgcagcgtctgtgctgacagaagaggtttgggagcagcacgag

SEQ ID NO: 198210 - DNA, 601 bp, Human
tcaccacacacagcagatcaggaccacgtgctcccacatcaccacacagcagatcaggaccacgtgctcccgcttcaccacacacagcagatcaggaccacgtgctcccacgtcaccacacacagcagatcaggaccacgtgctcccgcatcaccacacaccacagatcaggaccacgtgctcccacatcaccacacaccacagatcaggaccacgtgctcccacatcaccacacacagcagatcaggaccacgtgctcccacatcaccacacacagcagatcaggaccacgtgctcccaygtcaccacatgccacagatcaagaccacgtgctcctgcatcaccacagacagcagatcaggaccatgtgctcccacatcaccacaccacacacagcagatcaggaccacgtgctcccgcacacgctcgaggcagcaggctctctgctccatggcccctctcgcttcccacaggcaactttccatctactacttgggcctgcccttaaaagttaagagaatataggaggaaatctaagaacagatagcagaaggtctttgtgtccttggatttggccaatatatcttgggtatgatactaa

SEQ ID NO: 198211 - DNA, 601 bp, Human
cgtcaccacacacagcagatcaggaccacgtgctcccgcatcaccacacaccacagatcaggaccacgtgctcccacatcaccacacaccacagatcaggaccacgtgctcccacatcaccacacacagcagatcaggaccacgtgctcccacatcaccacacacagcagatcaggaccacgtgctcccatgtcaccacatgccacagatcaagaccacgtgctcctgcatcaccacagacagcagatcaggaccatgtgctcccacatcaccacaccacacacagcagatcaggaccacrtgctcccgcacacgctcgaggcagcaggctctctgctccatggcccctctcgcttcccacaggcaactttccatctactacttgggcctgcccttaaaagttaagagaatataggaggaaatctaagaacagatagcagaaggtctttgtgtccttggatttggccaatatatcttgggtatgatactaaaagcacaagaaaaaaaaaatatatttttgagatggagtttctttcttgttgcccaggctggagcgcaatggtgcgatctcaggtcactgcaacctccgcctcccgggttc

SEQ ID NO: 198212 - DNA, 601 bp, Human
catcaccacacacagcagatcaggaccacgtgctcccatgtcaccacatgccacagatcaagaccacgtgctcctgcatcaccacagacagcagatcaggaccatgtgctcccacatcaccacaccacacacagcagatcaggaccacgtgctcccgcacacgctcgaggcagcaggctctctgctccatggcccctctcgcttcccacaggcaactttccatctactacttgggcctgcccttaaaagttaagagaatataggaggaaatctaagaacagatagcagaaggtctttgtgwccttggatttggccaatatatcttgggtatgatactaaaagcacaagaaaaaaaaaatatatttttgagatggagtttctttcttgttgcccaggctggagcgcaatggtgcgatctcaggtcactgcaacctccgcctcccgggttcaagtgattctcctgcctcagcctcctgagtagcatctgccaccacacctggctaatgtttgtatttttagtagagactgggttttgccacgttggccaggctggtctcgaactcctgacctcaggtgatccacccgccttggcctcccaaag

SEQ ID NO: 198213 - DNA, 601 bp, Human
tgccacagatcaagaccacgtgctcctgcatcaccacagacagcagatcaggaccatgtgctcccacatcaccacaccacacacagcagatcaggaccacgtgctcccgcacacgctcgaggcagcaggctctctgctccatggcccctctcgcttcccacaggcaactttccatctactacttgggcctgcccttaaaagttaagagaatataggaggaaatctaagaacagatagcagaaggtctttgtgtccttggatttggccaatatatcttgggtatgatactaaaagcacaagaaaaaaaaaatatatttttgagatggagtttctttcttgttgcccaggctggagcgcaatggtgcgatctcaggtcactgcaacctccgcctcccgggttcaagtgattctcctgcctcagcctcctgagtagcatctgccaccacacctggctaatgtttgtatttttagtagagactgggttttgccacgttggccaggctggtctcgaactcctgacctcaggtgatccacccgccttggcctcccaaagtgctgggattacaggtgtgagtcacaagaaaaatattttttaaaaagt

SEQ ID NO: 198214 - DNA, 601 bp, Human
tccaggactctgggcctttgatcatttgagaaacgctgggtctgcagtgggggcctccagcttctcaggccagacaaagacgccccgccacacgggcagggcccagcctgcaccagaacaaaaccccagcgcctctcagtgtggaggcctgggaaaggcccacctcagccggcagaggggctgcctgccctttgatctctcctgagactgtggcctgggacccgggtcagggaatttcacaccgcacacaccccagggaaagaggagcaggtcaagaacaggaggagggtcaccaatctcmgaaaaggccccaggccagccctctttggccatttccacatggctgcatgcgtattgtccaaagctgagcccactctcaaaggagaattgacatcacatgccacaatggagccagtgaacagcagctcaggtgcctggacaatatgccagccctgccccccgtaccggggtctcgaacccaggacatacttctccatgtttccttctctgtggagtgaacctgagccactcagaacccaggctccatcccatccctgtggagacgcacgctggggtcacctgcgtccggccgcctgcctgt

SEQ ID NO: 198215 - DNA, 601 bp, Human
caagaacaggaggagggtcaccaatctcagaaaaggccccaggccagccctctttggccatttccacatggctgcatgcgtattgtccaaagctgagcccactctcaaaggagaattgacatcacatgccacaatggagccagtgaacagcagctcaggtgcctggacaatatgccagccctgccccccgtaccggggtctcgaacccaggacatacttctccatgtttccttctctgtggagtgaacctgagccactcagaacccaggctccatcccatccctgtggagacgcacgctgsggtcacctgcgtccggccgcctgcctgtgcttctggtccctggatgggcaggttccattggaatcacaggtgcccccagcaactcaccacatcacacgttcacaaacataggcttggtcagaaacacttacatcaaatgatctgtaacgttctgaagacattttggtttaagagaagaaaaatctttgtctgagagagggaaagaagggagggcccatgataagtggagaaatacaaattccatggatggctctgagctccaatagctgtaaatttggaaaggaaaagaaatatttgaca

SEQ ID NO: 198216 - DNA, 601 bp, Human; identical to SEQ ID NO: 26060

SEQ ID NO: 198217 - DNA, 601 bp, Human; identical to SEQ ID NO: 26061

SEQ ID NO: 198218 - DNA, 601 bp, Human; identical to SEQ ID NO: 26062

SEQ ID NO: 198219 - DNA, 601 bp, Human; identical to SEQ ID NO: 26063

SEQ ID NO: 198220 - DNA, 601 bp, Human; identical to SEQ ID NO: 26064

SEQ ID NO: 198221 - DNA, 601 bp, Human; identical to SEQ ID NO: 26065

SEQ ID NO: 198222 - DNA, 601 bp, Human; identical to SEQ ID NO: 26066

SEQ ID NO: 198223 - DNA, 601 bp, Human; identical to SEQ ID NO: 26067

SEQ ID NO: 198224 - DNA, 601 bp, Human; identical to SEQ ID NO: 26068

SEQ ID NO: 198225 - DNA, 601 bp, Human
ttacagcctaactacccaaaaccactaatcctgtggggcacactgatgtggcatttgtagatttttattagcatatgaaattatagagtgaagaggggtctgctttttctgcaatgggttacattaacttggcagaaatgtttataagcaactgcatttagatgtaaatttggtatccaagacagtttctatttcttttaaaaacagacacaaaaatccaattaagaccttgttattttaaaaaccctcatatcccaaatataaaatgctgtcatcgtagcgcatgttactgaattccacrtttatattttaaaaatcagacacaaacacgacattttccttttttaatattgatttatgttctcacggggctgaaatagtcaatatcctcaaggcacctcactgtgtaacatttacatcggaagccaatggaaccaactgaagtatttacaaaacgcccacaaataaataagaattatgctcaaatttgtgcactttctctttccttagtgcccatccgacaacaagatgagaattcaaaacatgtttcttacgccaggcttttcaggctttcaaacctgctcctccaaatcggttcttc

SEQ ID NO: 198226 - DNA, 601 bp, Human
aacagtatggagggccaggcacggtggctcacacctgtaatcccagcactttgggaggccgaggcaggtggatcacgaggtcaggagttcgagaccagcctgaccaacatggtgaaacaccatctctactaaaaatacaaaaattagccgggtatcgtggcatgcacctgtaatcccagctactcaggaggctgaggcaggagaacctcttgaacctaggaggcggaggttgcagtgagccgagaccgtgtcattgcactccagcctgggtaacaagagcaaaactccacctcaaaaaaacaaaacaaaacaaaaaaaacaataaaaccagtatggagagcctcaaacaattacacagaaccactgtgtgatccagcaatcccacttctgggtatagacccaaaggaaataaaatcagtgtgtggaagggacatcagcacccctttgtttattgcagaactattcacaataaacaagatttggaacaacccacatgtctgtcaatggataatggctaaagaaaatgtggtatatacacaatgaaatattattcagccttaagaaagaatgaactcctgtcatttttgacaacatggatgaa

SEQ ID NO: 198227 - DNA, 601 bp, Human
actttgggaggccaaggcaggcgaatcacttgaggtcaggagttcgagactagcctcgccaacatggcaaaaccctgtctttactaaaaatagaaaattagccaggtgtgttggtgggtgctgtaatcccagctactcaggaggctgaggcaggagaactgcttgtgcctggaaggcagaggttgcagtgagctgagatcatgccactgcacgccagcctgggtgacagagcgagactctgtctcaaacacacacacacacacacacacacacacacacacacacacacacacacacacttttaaaataagctctcctgaagccccacagagacctgatttaagggaagatgatcaatctgaaatagtgaaacactggagctggatgtggtggtgtgaacctgtagtcccagctagttgggaggctgaggtgggtgggaggatcatttgagcccaggagttcaggaccagcctgggcaacatagtgagatcccatctctgaaaaacaaaacaaaaaactgaaatagtgaaacgccaggccattttctctacaaaacatccctgggccccttcaggaggaaagcttctcctccttctactta

SEQ ID NO: 198228 - DNA, 601 bp, Human
ggcaggcgaatcacttgaggtcaggagttcgagactagcctcgccaacatggcaaaaccctgtctttactaaaaatagaaaattagccaggtgtgttggtgggtgctgtaatcccagctactcaggaggctgaggcaggagaactgcttgtgcctggaaggcagaggttgcagtgagctgagatcatgccactgcacgccagcctgggtgacagagcgagactctgtctcaaacacacacacacacacacacacacacacacacacacacacacacacacacactcttaaaataagctctyctgaagccccacagagacctgatttaagggaagatgatcaatctgaaatagtgaaacactggagctggatgtggtggtgtgaacctgtagtcccagctagttgggaggctgaggtgggtgggaggatcatttgagcccaggagttcaggaccagcctgggcaacatagtgagatcccatctctgaaaaacaaaacaaaaaactgaaatagtgaaacgccaggccattttctctacaaaacatccctgggccccttcaggaggaaagcttctcctccttctacttagatcttttgtgatga

SEQ ID NO: 198229 - DNA, 601 bp, Human
ggatgccatctttggaggatttaaatgtttttaaaaattaggtggtgtaggaccatcccctccaccggggccaggccagggtcatctctggatgctctgaggtttggttgctggtggtgctgatggtgatgcctgcagtggtcatcctgggctgatcaaggaagctgcccagagacagtgcatggtgtggaatccaggcctgccatcttcccacccacccctgcctggactagtgcagtagctgacacagcagacaggcagatacacaggcaggcagacaggcagacaggcaggcagacagacaagacaggcagatagagacaagacaggcaggcagacagagacaagacacacaggcagacaggcagacagcgagacaggcagacagacaggcagacaaacaggcagacaggcagacgagccactggtgccgggtggtgggcggccctgcacggtgacagtcagctgtcaactgtcattctcctgcacctcggccttgtcaccggtggctggcaggcagttggaaggaaacaccgttaaattctttgggtcttccacagttccaagttcaggattttttcttaaccatagtaagaactat

SEQ ID NO: 198230 - DNA, 601 bp, Human
tgccatctttggaggatttaaatgtttttaaaaattaggtggtgtaggaccatcccctccaccggggccaggccagggtcatctctggatgctctgaggtttggttgctggtggtgctgatggtgatgcctgcagtggtcatcctgggctgatcaaggaagctgcccagagacagtgcatggtgtggaatccaggcctgccatcttcccacccacccctgcctggactagtgcagtagctgacacagcagacaggcagatacacaggcaggcagacaggcagacaggcaggcagacagacgagacaggcagatagagacaagacaggcaggcagacagagacaagacacacaggcagacaggcagacagcgagacaggcagacagacaggcagacaaacaggcagacaggcagacgagccactggtgccgggtggtgggcggccctgcacggtgacagtcagctgtcaactgtcattctcctgcacctcggccttgtcaccggtggctggcaggcagttggaaggaaacaccgttaaattctttgggtcttccacagttccaagttcaggattttttcttaaccatagtaagaactatgat

SEQ ID NO: 198231 - DNA, 601 bp, Human
ccatctttggaggatttaaatgtttttaaaaattaggtggtgtaggaccatcccctccaccggggccaggccagggtcatctctggatgctctgaggtttggttgctggtggtgctgatggtgatgcctgcagtggtcatcctgggctgatcaaggaagctgcccagagacagtgcatggtgtggaatccaggcctgccatcttcccacccacccctgcctggactagtgcagtagctgacacagcagacaggcagatacacaggcaggcagacaggcagacaggcaggcagacagacaacacaggcagatagagacaagacaggcaggcagacagagacaagacacacaggcagacaggcagacagcgagacaggcagacagacaggcagacaaacaggcagacaggcagacgagccactggtgccgggtggtgggcggccctgcacggtgacagtcagctgtcaactgtcattctcctgcacctcggccttgtcaccggtggctggcaggcagttggaaggaaacaccgttaaattctttgggtcttccacagttccaagttcaggattttttcttaaccatagtaagaactatgatct

SEQ ID NO: 198232 - DNA, 601 bp, Human
ctttggaggatttaaatgtttttaaaaattaggtggtgtaggaccatcccctccaccggggccaggccagggtcatctctggatgctctgaggtttggttgctggtggtgctgatggtgatgcctgcagtggtcatcctgggctgatcaaggaagctgcccagagacagtgcatggtgtggaatccaggcctgccatcttcccacccacccctgcctggactagtgcagtagctgacacagcagacaggcagatacacaggcaggcagacaggcagacaggcaggcagacagacaagacaagcagatagagacaagacaggcaggcagacagagacaagacacacaggcagacaggcagacagcgagacaggcagacagacaggcagacaaacaggcagacaggcagacgagccactggtgccgggtggtgggcggccctgcacggtgacagtcagctgtcaactgtcattctcctgcacctcggccttgtcaccggtggctggcaggcagttggaaggaaacaccgttaaattctttgggtcttccacagttccaagttcaggattttttcttaaccatagtaagaactatgatctacag

SEQ ID NO: 198233 - DNA, 601 bp, Human
tttggaggatttaaatgtttttaaaaattaggtggtgtaggaccatcccctccaccggggccaggccagggtcatctctggatgctctgaggtttggttgctggtggtgctgatggtgatgcctgcagtggtcatcctgggctgatcaaggaagctgcccagagacagtgcatggtgtggaatccaggcctgccatcttcccacccacccctgcctggactagtgcagtagctgacacagcagacaggcagatacacaggcaggcagacaggcagacaggcaggcagacagacaagacagacagatagagacaagacaggcaggcagacagagacaagacacacaggcagacaggcagacagcgagacaggcagacagacaggcagacaaacaggcagacaggcagacgagccactggtgccgggtggtgggcggccctgcacggtgacagtcagctgtcaactgtcattctcctgcacctcggccttgtcaccggtggctggcaggcagttggaaggaaacaccgttaaattctttgggtcttccacagttccaagttcaggattttttcttaaccatagtaagaactatgatctacaga

SEQ ID NO: 198234 - DNA, 601 bp, Human
ggaggatttaaatgtttttaaaaattaggtggtgtaggaccatcccctccaccggggccaggccagggtcatctctggatgctctgaggtttggttgctggtggtgctgatggtgatgcctgcagtggtcatcctgggctgatcaaggaagctgcccagagacagtgcatggtgtggaatccaggcctgccatcttcccacccacccctgcctggactagtgcagtagctgacacagcagacaggcagatacacaggcaggcagacaggcagacaggcaggcagacagacaagacaggcagatagagacaagacaggcaggcagacagagacaagacacacaggcagacaggcagacagcgagacaggcagacagacaggcagacaaacaggcagacaggcagacgagccactggtgccgggtggtgggcggccctgcacggtgacagtcagctgtcaactgtcattctcctgcacctcggccttgtcaccggtggctggcaggcagttggaaggaaacaccgttaaattctttgggtcttccacagttccaagttcaggattttttcttaaccatagtaagaactatgatctacagatgc

SEQ ID NO: 198235 - DNA, 601 bp, Human
ccatcccctccaccggggccaggccagggtcatctctggatgctctgaggtttggttgctggtggtgctgatggtgatgcctgcagtggtcatcctgggctgatcaaggaagctgcccagagacagtgcatggtgtggaatccaggcctgccatcttcccacccacccctgcctggactagtgcagtagctgacacagcagacaggcagatacacaggcaggcagacaggcagacaggcaggcagacagacaagacaggcagatagagacaagacaggcaggcagacagagacaagacacrcaggcagacaggcagacagcgagacaggcagacagacaggcagacaaacaggcagacaggcagacgagccactggtgccgggtggtgggcggccctgcacggtgacagtcagctgtcaactgtcattctcctgcacctcggccttgtcaccggtggctggcaggcagttggaaggaaacaccgttaaattctttgggtcttccacagttccaagttcaggattttttcttaaccatagtaagaactatgatctacagatgccaaataataaaaagctgtatttacatcaagcctatcaat

SEQ ID NO: 198236 - DNA, 601 bp, Human
cttcggttgactcgagccgcgtagcacagggtgtggtagaaggtggcgcagcaggtgcaggcagtagggaggtggtccgtgatggaatatcgatgcccgcggcccctcccctgcctccccggcagtcctaatcttacagctacagtcctgcccgcaggggcttctctgtgatccagctacagtcctgcctgcgggggcttctctgcgacagctgccctgtgcaccaggacatgactgggctggggacgcactgtggggccacgtccccgggaaggtgcagaccttgcttccccgtggggargtctcggcacctggagaaagcgtcactttatctcctgtctctgaggactttgactttcacatattctgcgccttgagactctgcacacgtgtatttttgtaaacaacacctactctggaaatgccgaggtcactgctgccggatctctcttttctgtttatagagacgtcttcatgtcactgtgccttctttatctgtgaggagtgtgtatgctgaagagacaccctggcactacacatgtctgggtctagaatgggctttgcctcccaccagctgtgtggatctgggtgggtccttatg

SEQ ID NO: 198237 - DNA, 601 bp, Human
catcctgggtagaattgggctcactctgtatatctctattttaattgtagtaaaagatacctaacatataatttaccgtttgtaagtgcacagtgcagcggcagtaagggccttcccaccgttctacaaccgtcaccgtcaccacgctcttcagagcattctcatcttcccaaatggaagccctgtcaccatcaagcccctctgcactgtcccctccctgagcccctggctactaccccctagattcatactaggcttctatgaatctgacgcctccggggaccccatgaggtggaatgaygggaggctcacgatggcttcatcgcagggtcaatggctcggccaaatgagatcccatatgggaagtgcctgcccagggcctggcattgaagagctcagtaaatgggacttcctttcttcccccagccccctttccttatgcccactggactcgaatgtcccctccaatgggtgcgtgtctttcactcaaggtggccccatttggcaggtgggaggcgtctttgcagattaaaatacactttctagagaaaggctttctagagaaaggctatctgacaggtacccaaagccgcagggatcc

SEQ ID NO: 198238 - DNA, 601 bp, Human
ctcggccaaatgagatcccatatgggaagtgcctgcccagggcctggcattgaagagctcagtaaatgggacttcctttcttcccccagccccctttccttatgcccactggactcgaatgtcccctccaatgggtgcgtgtctttcactcaaggtggccccatttggcaggtgggaggcgtctttgcagattaaaatacactttctagagaaaggctttctagagaaaggctatctgacaggtacccaaagccgcagggatccaggagtggaccatggagacctgcctcctcctctcgtyttccttcctgatattcagcctcctccctaagcggcttgttgacagcaaccagagctcaacgcctgggggtgtcaacggatgggtatgaggtgttaagactccttatttagaagcattgaacaaaacagtaaaacctcacagccaaactcgtgttcctaatttaaaatttattagaatattcttaacccttcttcagatttaaattaggattttaaaaagaaagtttaggatttaaaaagaaaattaggattttaaaaagaaagttttacgcaccaccaagtccagacgccagccgaggcc

SEQ ID NO: 198239 - DNA, 601 bp, Human
aggaagcaactctcctccatcctgctctgtgtggatttatggcatcgatggtgggcagctcctgtgttctgcacagagggatccccaggttgaaggatgacgtggaagcaatgacgtcgtggtcagggacgtctgcagggagcaaaatgaagcgagtttctttagttcacaatttctcagaggctctgctcggctggcatgctcgagaacatcctgggagggctgaggctactggccatgagctcttgtcttagaaaagctgtgaccaggttgagggacgctggggtttcctggaaccacytgatacctgctgtccgagatgtgtctcaaaattatcttgcatttcaccttgctttaaaatttgtctctacttatttcatacagagatgcatcatttcaatttcaagaatatatgctccttgattatcactctaaaatagcccataagatgtaaacactgatcaaatgaattgcctccaacaattgcaactatccataataaacagtaagaaaaatggttcacgccttctattcactagccacaggaatctgggcacgctatgagcctctgagtctcacggaccacagagactacaggtca

SEQ ID NO: 198240 - DNA, 601 bp, Human
gtctcaaaattatcttgcatttcaccttgctttaaaatttgtctctacttatttcatacagagatgcatcatttcaatttcaagaatatatgctccttgattatcactctaaaatagcccataagatgtaaacactgatcaaatgaattgcctccaacaattgcaactatccataataaacagtaagaaaaatggttcacgccttctattcactagccacaggaatctgggcacgctatgagcctctgagtctcacggaccacagagactacaggtcagcatgtgagagcttcatgtaggwcccagcacctgctgaacggaggttggatgtgggcatcatcgtggtcgttgagtgtggacaccgagagccttcacacaggatggagggtggatgtggcacctgctgaacggaggttggatgtgggcatcatcgtggtcgttgagtgtggacgccgagaggcttcacacaggacggagggtggatgtggcacctgctgaaccaagggtggatgtgggcatcatcgtggtcgttgagcatggacgccaagagccttcacacaggacagagggtggatgtggcacctgctgaaccgagggtgga

SEQ ID NO: 198241 - DNA, 601 bp, Human
ccagcgtcactgctgcgacaggcacctccctgcctggattctgccgcatgggtgacgcgtcgcttcccaccttcgtccccagctcgactctccttaggagctcctctctgccaggctcggggttggctggtgtgcccgacacgcggccggtgcctgtgctcctgcggtaactcacggccacgttccaggttccagaacccattcctattcagctttgtcacgtggctggtgaggggagacccgggggcagctggagaaggaagaccccacctgccctctgcatgttgctctatttgctgaygtttgacattcacgtcagccctcacgtctgtgccttcatctgtgtgacctgggcttgcgtcgagtagagaagcacggcctggccttcagatgccctacaggactccaggagaggatgacagaggatgtacttgggtcctgctgtgaccgccatcataacaacgccatggacaacaggcacatttcaataacatggaatgacttactaactttatcctcgctgttttataaaatgcaaatgtaaagtggcttaaaagtaatgatcttgaaagcattaaatctctcaaagggaattttttca

SEQ ID NO: 198242 - DNA, 601 bp, Human; identical to SEQ ID NO: 26069

SEQ ID NO: 198243 - DNA, 601 bp, Human; identical to SEQ ID NO: 26070

SEQ ID NO: 198244 - DNA, 601 bp, Human; identical to SEQ ID NO: 26071

SEQ ID NO: 198245 - DNA, 601 bp, Human; identical to SEQ ID NO: 26072

SEQ ID NO: 198246 - DNA, 601 bp, Human; identical to SEQ ID NO: 26073

SEQ ID NO: 198247 - DNA, 601 bp, Human; identical to SEQ ID NO: 26074

SEQ ID NO: 198248 - DNA, 601 bp, Human
aggcaccatgagttcccactctgatccacaggacttgcagcccagcccccagccttcaaaccctccctggcctgaaggtggtgcttcatggaggacctgcccccttttgcccaggaatctctgtctcctgctgccattcatggcacccaggctgtttgtgccaaggggcacctgcaggccagagctgagctgccctcagccctccttcggcttccctcccatgcttgttggtgcccaaagtccagagggggctgaggtggcagggggctggtgtgtcagcactgcccagagtgtcacaccygctgggctgtgacagcgcccgggctcagccctgactttgctccaagatcagcatgggtgccaacagcagggagaatccaggtagcaggaacaggcacttcctgcaggggcaaggatcttcttcctgggtgcctaagtgtgcagggctgcctgggtctgcagctacggtttgggcagctgtagctcctccccagcgtgggggtgggggtggggtcctgcctgccgcgtggaacaggatgcccaggttacgcctccctgctgcagctggtgtgatggtagtggccactccagagggcctgtc

SEQ ID NO: 198249 - DNA, 601 bp, Human
gagttcccactctgatccacaggacttgcagcccagcccccagccttcaaaccctccctggcctgaaggtggtgcttcatggaggacctgcccccttttgcccaggaatctctgtctcctgctgccattcatggcacccaggctgtttgtgccaaggggcacctgcaggccagagctgagctgccctcagccctccttcggcttccctcccatgcttgttggtgcccaaagtccagagggggctgaggtggcagggggctggtgtgtcagcactgcccagagtgtcacacctgctgggctstgacagcgcccgggctcagccctgactttgctccaagatcagcatgggtgccaacagcagggagaatccaggtagcaggaacaggcacttcctgcaggggcaaggatcttcttcctgggtgcctaagtgtgcagggctgcctgggtctgcagctacggtttgggcagctgtagctcctccccagcgtgggggtgggggtggggtcctgcctgccgcgtggaacaggatgcccaggttacgcctccctgctgcagctggtgtgatggtagtggccactccagagggcctgtcactgccatc

SEQ ID NO: 198250 - DNA, 601 bp, Human
atcatggagcagtgtggtggtggtgaagctgcacggactctgcttctctacgcaattctttcatttttcttggagattttacttacagtttttaaaacaacaaatcctagggcttggaaaacttagtgagtgttttaactgattgaactaggaaagtactgtgcactagagatcaatacactccaggttggatgctgtcctgacaccttccttcaggtaggaatgtcagcctctttcaggggtgacaagatgggataagataaaacatctagagagaggagaagaatgcatgtgtacataygcacatgctctatgcagctgaatgcctcaggaatgtcatgaagctgcaagtcatcccatcagctctgaacgaaggtgtgaatgatgcaaaaatcccagggactcaatggcttttagctcctgcacaaattagttcttggagagtgaaaattggcagtggcaggaaattgtaatacaaatcatcagaaaaaaactggttgactctgacatctgaacaccccacacacactactccaaacattgattccagaaacccagtttcacagtggggccacacagacaccgcagccagagatgaggc

SEQ ID NO: 198251 - DNA, 601 bp, Human
cctgcctcattttcagcacagccacctttaggcacttgtgagaccagcaactgcggaccgttcttacgtgtctgagaaggcattaccaagagcagggtcaggagggagcagggcagggaacaggcagcgcagcctggagccctcaggcttttgacctggcttggtctcgtgctttgatggtgcccacggcaccctgagaccagtggcctggcctctacggagggcagaggaggcatcagggcagcgtgctgggagctcctcctcagctgaggggtccctgctgccaggccctgtgagcaayaggccacggggaaagtggccactgccattggactcagcagacaagtgccagctggattttctcattggaaaattaagaaaatgcttccctagctcgggagtcctggggagttagacatgcattctacgagcccggccctctcctctcgatggcagagggggaatctgccatgggcacctgagccctgctggcaagtggacaatccatgggcttcttggtggaaaattgttttagccgaattcatttcccccgaggtcaccctttaaagatggcactgagtcaaggacccggcttccatga

SEQ ID NO: 198252 - DNA, 601 bp, Human
tctcattggaaaattaagaaaatgcttccctagctcgggagtcctggggagttagacatgcattctacgagcccggccctctcctctcgatggcagagggggaatctgccatgggcacctgagccctgctggcaagtggacaatccatgggcttcttggtggaaaattgttttagccgaattcatttcccccgaggtcaccctttaaagatggcactgagtcaaggacccggcttccatgacttcggagagctcctacttcctgatcgcatatttgattttgtgtcaacatattgcttttsaaattaccagcgaagtcttttttttaaagagacagggtcttgctccgtcacccaagctcaagtgcagtggcacaatattggatcactgcaacctccacctctcgggttcaagtgattctcctgcctcagcctcccgagtagctgggactacaggcacgcaccactgcacatggctaatttttgtatttttagtagagacagggcttcaccatgttggccagggtggtctcaaactcctgacctcagatgatccacctgcctcggcctcccaaagtgctgggattacaggcatgagccact

SEQ ID NO: 198253 - DNA, 601 bp, Human
tttgagagcaaataggatgatgccatccagttcccgagtcccctaaagggcagtttccttgacgtgcgaggcctgtggaggggtcttcgtgttctatgaagtgaagggaagcaggtggcctggggcctctcaaggccaaccccaggctggagatgaagccagggcaggcccacgcgcaatcagccctggcctgtgctcggggaactgaaggctgctcccttctgttgtcaaatgaaatatcagacctccctggggaggcaacacagagcaatggcgggaaccacagggtgagaattcatarcagcctggggctcatgtttccattaagaacgggtgtgctctatcaaaaccgtagtctgagaatttactgagaggccaggaaaatgtgggaactcacgtagagtcttccttcacctggccctataactgagttaatgtcattgggttaaattaacccactgtgcacgttccttttctgaccctttactgtgtttatcatgcgttagtgccttgttcaacaatatttcaggccggccgcggtggctcacacctataatcccagtactttgggaggctgaggtgggtggatcacctgaggtca

SEQ ID NO: 198254 - DNA, 601 bp, Human
aacagcgtgatgacagaacgcattctgaaggggcaggtcctcttcctcccacacgctcctgtccttagtcagcaggcagacattctgcttccaactatgcctttgggaaatgctcagctcaagctataaagctcatcgaacatttaggaaagtcagctgagtgtcattcagggcctccgcagctcagcatacaatgctgcatctgggcagactgggacaggctggggctcatatccagaaagccctgctacatccagagatggtcatgaaaatgagacctgccccacccaccactcaggargcacgctgcccaccgctgagctgaataaccgagcgcgaggctggtgtccggcttccacactggacgcgtcaaaagcaggtcccagaggagcaacagtggccccaaatggcatggtcacaaggctggtttagtgtctcatgtcttaaatggtttcactggcatcccccacagacagatctctcagaaagtcgccccccaatgggatcggaagcatgttgggcaggtgacctggggcaggtggactagaaggagcctcaagccctgggggattcccatacctgaagcgattttaacccacac

SEQ ID NO: 198255 - DNA, 601 bp, Human
ctgcatctgggcagactgggacaggctggggctcatatccagaaagccctgctacatccagagatggtcatgaaaatgagacctgccccacccaccactcaggaggcacgctgcccaccgctgagctgaataaccgagcgcgaggctggtgtccggcttccacactggacgcgtcaaaagcaggtcccagaggagcaacagtggccccaaatggcatggtcacaaggctggtttagtgtctcatgtcttaaatggtttcactggcatcccccacagacagatctctcagaaagtcgccccycaatgggatcggaagcatgttgggcaggtgacctggggcaggtggactagaaggagcctcaagccctgggggattcccatacctgaagcgattttaacccacactagtctcatctcaggcatctgtgtagaaggaactccccaggcagggctatgcgggggcagaatgcagggggaacagacgccaaaggtgtgtgggggttgccgtggccaggcagcgcccgcccagtcactgagctgacttggaggcaccaggtcccagggttgagctgcgtaccctcccccaaaaagacacactgga

SEQ ID NO: 198256 - DNA, 601 bp, Human
ggcaccaggtcccagggttgagctgcgtaccctcccccaaaaagacacactggagtcccagccctgggaacatgaccttatttggaaatagggtctttacagaggtaagcgagcggagggcatttgggcggccctaatgcaatatgactggcgtgctgttaggaagaaggactctgcacacccacacgggagggagagcgcccgtgtgaagacgaagacagccgcggtcatgctggggacacgcggagggagcgcgcccgtgtgaagacgaagacagccgcagtcatgctggggacacgcrgagggagagcgcccgtgtgaagacgaagacagccgcagtcatgctggggacacgcggagggagagcgcccgtgtgaagacgaagacagccgcagtcatgctggggacacgcggagggagagcgcccgtgtgaagacgaagacagccgtggtcgtgctgaggagcgaggcctccagagaagccagccctgctgacaccctgacctccatttctggcctccggaatgggagacagcctgctttggccacatacactgcccatccctggcgctctgtccctgcagccctccaggcccagagca

SEQ ID NO: 198257 - DNA, 601 bp, Human
gccgtggtcgtgctgaggagcgaggcctccagagaagccagccctgctgacaccctgacctccatttctggcctccggaatgggagacagcctgctttggccacatacactgcccatccctggcgctctgtccctgcagccctccaggcccagagcacctggagcgacctgggtttggcttcccatgccctgagcagcacctggtgcctgcacggagaaagcgccgcctggagccagcctgcagttgtggagtgtgggcaacccagagaccagctccagacacacagcgaggcgtggctgygtgcgctggtggcgactttctcgcaggaactagaacagtttgctgtaacaggagcacagatatcagacaggcagggccacgctgtctgcacggctccaccgagaggccgtccatcgacactgatgacgaatctcgtctgtgcgagcagcgcagatgagtgtggcggcggcaagacagagacacaaacggctggggggcgcctccaaggagctgaaactaggagcagggggcagctcacacgccttatcaccaggacacagggtatcaccagaagaacagctctggcttgtggctgtgctg

SEQ ID NO: 198258 - DNA, 601 bp, Human
cttgtggctgtgctgcctgagattaacgcccgttttgtggatcgggggcagaagctgcacctgtgaccgacggtcttggggctgccaggggagccgcagaaggcagtgacctctgaccccacagcacggggcgcagggcagactgtgccaagcaggcgcgtctggaaaagtaagggaggaaattcggcgggaacctacacattagctccctagaggcgtaactgatgggcaggtgtggaaaacgcccaaacagctcgcgggagcaactcacttccgccgcacgggaggggtcgcggtcaaagggcatccacagaggcgctggggtgaagcggggaagcgggtgggagcagctccggcggcacaccccggccagggcagggccccccacaccccacggcagccgaaggccccgcctccccgcccgggtctgcggctccgtgaagacacagcagctccggagggttgatctcactgacagggagagtccctgaggaggggccggggtgcttccggcctgggtggccggaggaggaggcagggagagccctgcggctgaacagggcagcgccccccgcatccggagggacaggcccggccccgt

SEQ ID NO: 198259 - DNA, 601 bp, Human
cacaccccggccagggcagggccccccacaccccacggcagccgaaggccccgcctccccgcccgggtctgcggctccgtgaagacacagcagctccggagggttgatctcactgacagggagagtccctgaggaggggccggggtgcttccggcctgggtggccggaggaggaggcagggagagccctgcggctgaacagggcagcgccccccgcatccggagggacaggcccggccccgtctccagtcccgcctcccgcctcagccgcagaacctcggtggttccttcagctcctgaarcggtccgcaaacaggtcgagggcgctgacgaggccgttttctgggctaagcagcgacggcgctaggcgactccgcttgtccttcgtttccgctgtcagctcagcaggtgacttattcccagtgctgctcttctcacagacacaaaaccaacagttccggtctcttccgatagttctggcagagacggctgcggggagacacgggcggaggcgggtccgggcgggccccacgtcgcgcagcctcagcgtgttgcgcctcccgcggctgcggccagagacttccgcaaacctcggggcctca

SEQ ID NO: 198260 - DNA, 601 bp, Human
cgaaggccccgcctccccgcccgggtctgcggctccgtgaagacacagcagctccggagggttgatctcactgacagggagagtccctgaggaggggccggggtgcttccggcctgggtggccggaggaggaggcagggagagccctgcggctgaacagggcagcgccccccgcatccggagggacaggcccggccccgtctccagtcccgcctcccgcctcagccgcagaacctcggtggttccttcagctcctgaagcggtccgcaaacaggtcgagggcgctgacgaggccgttttcygggctaagcagcgacggcgctaggcgactccgcttgtccttcgtttccgctgtcagctcagcaggtgacttattcccagtgctgctcttctcacagacacaaaaccaacagttccggtctcttccgatagttctggcagagacggctgcggggagacacgggcggaggcgggtccgggcgggccccacgtcgcgcagcctcagcgtgttgcgcctcccgcggctgcggccagagacttccgcaaacctcggggcctcaatcgacagaacgtgtcacctcaggcccaggagagcagggtcc

SEQ ID NO: 198261 - DNA, 601 bp, Human
cgggccgccgtcctgcggcccccccacagtgtgccgggactcggggtctctcaccacgagcagacctcggcgctgctatccggactcctcgagccccttacaggccacatggccaggggcgaccctcccgtcacaactgtgactctgtgagctcacagggctggcctccacattcttgctggtggaagaccacaagcaacgggatgccttggaaagcatcgttctgcagcaggactgctcaaccggccaatcagaacacagggaaccatgaaagaggtgggaggaggaaaaaggaggacgsagaggagggggaagacaggggaggaagggggaggacaggggagggccagggtggagctcagggccaaggcagggtttgaagtctgtggcccgtggcaaggtcgcagagcaggctggtcatgttcctacagcatcgtggagacctgtacactccgggttcttgggaaacgggggttctggaagggggcaggtgagcttctcgtgggcttgcagagttccctacagacttccacatggagagtctgtgattgtttggaatgggaaagtggtcactaaaagaacagctttattaggtaccatt

SEQ ID NO: 198262 - DNA, 601 bp, Human
tctggaggctgaacgagaatcggttacaggagatgaacacaaggctcgattctcctgttaaacttgactgtcaccaacggggggtggggggtgcgcgaggccctgggctccaccgaagaccttaaggaaaagactctggatgttagtgggttcggcctcagaatcagccggcgctgagatgtgcacctggcaggatgaacgtaacttctggtggataaagtgggaggcctgatccaggaagaagcacaccgtggcctggggcccctctggagggtaggtcttccaagtcacgggaaacagkgcgcccaggagacggtgagcccggctgctgccaccccgaaggccaggctcgccccacactgtgagaccctccccacacgaagattctgtaagcggaatcggaaggaggatgtgagaaggacgggtagccatgccacaccaggccagacatcttaccaacctatcggttcagttttaagaaagagagcaaagaggatctaaaatctgaactttgagcagctgaactgtgtggagtatcaacgtggctcctgacaaccccaccggcactgtttctttgcactggaggtcctgaagagctcac

SEQ ID NO: 198263 - DNA, 601 bp, Human
aggactcagcaggatacccgctcaccaccaccctcacttgtcctaccacaccggcttcactccccgccctctcctcccccaggctgctcctctctgaggacagtggccaggcccccagagcctgttagtagcccccgacacagggccggtgcttagtaaatatctgttagttggctaatgggatgtattgtattttgcttttcttctaaatataaaatttataaatcacacagcttctgtttttagatctctttagggttaaaaccctcagacctcatagaaactggtctgaacactaaaygggtagcaagaagcgtgcacccagctgggtgaatgggattttacacaggtctgcagtgccccaggttagtttctgaagcaaaacaagattccagcttctcactgttctgacctgtaacacttcctgagggctggaaggagggcaagggcagtgcctctccctggcgtggggggctgtgctgctggtacggggacaggcggtgtctcagggacaccagtctgatcccttgaccggctccgaagggttgaggcagggacacagtgacggagagacggcctcggccacaggggacactggtcc

SEQ ID NO: 198264 - DNA, 601 bp, Human
gcacggccagtttccaccgcccgtaacccaggcttcctgcccccggggctggtacgtacaggtcagcacggccagggagcggttcttgggcacgttctcctccctctgggccacgaacgagctgttgggctccgcctggtaggcgcacagcgcttcccactccttctccagccggttcttgttcttcaggtggtcctccatgtaggactgaaagggaaacacagggtcaggagcgcacctaggtggtgagcccagaccggcagatgcacaaaaggcagcggaggcctttgcactcgccgcrtgggccatgcccaccttgctcacgagcctgggccatggtgcgacgttgtgctacggtgcacaatgcatatcataccatgcaaccgttaagtgaaatatgtgcattgttaacacacattttacatatgtaaatataaactccggtgtttgggaatcagtttaccgctgagatgacaacaattatcacatgctttaacgacagggccagggagctcagaccaagctctcggtggggctgctccgcgtgcccatttctgcttgcatggaagtcatttttcttaaaaccggcgcacgtttctga

SEQ ID NO: 198265 - DNA, 601 bp, Human
aacccaggcttcctgcccccggggctggtacgtacaggtcagcacggccagggagcggttcttgggcacgttctcctccctctgggccacgaacgagctgttgggctccgcctggtaggcgcacagcgcttcccactccttctccagccggttcttgttcttcaggtggtcctccatgtaggactgaaagggaaacacagggtcaggagcgcacctaggtggtgagcccagaccggcagatgcacaaaaggcagcggaggcctttgcactcgccgcgtgggccatgcccaccttgctcacragcctgggccatggtgcgacgttgtgctacggtgcacaatgcatatcataccatgcaaccgttaagtgaaatatgtgcattgttaacacacattttacatatgtaaatataaactccggtgtttgggaatcagtttaccgctgagatgacaacaattatcacatgctttaacgacagggccagggagctcagaccaagctctcggtggggctgctccgcgtgcccatttctgcttgcatggaagtcatttttcttaaaaccggcgcacgtttctgaacccactgggtgtgatgcagttga

SEQ ID NO: 198266 - DNA, 601 bp, Human
tgtgcaaaatgcgggacagcttctagcatgaaacaaacacaaatggatggaagcaaatattttaacccttggctgtttcgatcttaatttttctggtgcttgtcgttgagcattactatgagtagacaaggaaacaaaggcctcctgaaaattcccttccacaaaaacccccatgccgccagcacagcccactcggttcttattcatctgtaccgttgagaacaagccctgattttaagaaagaacatttcaaaggaccaaacccagctgcactatggcaccacaggaagtgacggcctcrtctgctgtcactctgcttgtggatttgcaaggtactgtgtgtcatgtgtagacacaggttccaagtgtgtccacacgagaaaataaagcatgcatgtgtacacatggtcctttgctgcaaagcggccacgcattccaatgtcaggcccggggtccaagcccttctcaccttctgcccaccccctgacatccccttcgattgatccgaggagctgggatggtccctccctgcccactggggcccgttccaggagacaggtagagaaagagacacagagggagggagggctggacacggcga

SEQ ID NO: 198267 - DNA, 601 bp, Human
gtgagggaagctgggaggttgatagttatggtgaaaggatagtcccagtctgtttctgtggctacttttctcaagttgggcttacgtagagttctacaaataggtaggtcgaaaatggttcctggcaaaatcattctgggtcctagcttttctttgaaaaatgctcttttcataaaatccatcacaaacaaatgggcttccttcagtaaaacatgatgggttctaaaatgatgaaccctagcaggtttaatccaatcgaaaatattatctgcaaaagaggcactggatattatcttaattygtataaactacagctatttaaattctcacatttatcttaactataggaagcaaaattacactctaagttctcttgaatttctaaatttatggcaaaaatataaactgagcctgtgtggcccaaggttgggtggtaggagggaggaagaggtagatactgacgcgatgttttttcacggagaatgaagtcatctgcagaggcacgtgactctattaaaactgagatagagctgacatctctctgcacacgccactccagtgggctgtgtttgtcccgttctgctcatttcaatttgatctg

SEQ ID NO: 198268 - DNA, 601 bp, Human
tatcaatattttttatgaaacatcctttgtgatattaaactgatgaaatatcccccaactacatcttaggagtcttttttctctttcatggcttgtagataagatgcttttcatctgtgagtctgtggggaagctaggccttcatagcaaagtaatgttttaaacaatgaaagcaaaaccaaaaggtaccacgggagcttagtacagatgctcccctacttatgatgggttatggcccaagaacttcttaagttgaaagtgcattgaggccgggctcggtggctcacgcctataatcctakcactttggaaggctgaggcgggtggatcacctgaggccaggagttcgagaccagcctggccaacatggtgaaaccttgtctctactaaaaatacaaaaattagtcgggcatggtggcgggcgcctctaagcccaactactcgggagactgaggcaggagaatcgcttgaacctgggaagcggatgttgcagtgaaccgagatcgcatcattgcactccagtctgggtgaccagagtgaaactccgtctcaaaaaaaaaaaaagtgcattgaacacaggtaacctactgagtgtcacagct

SEQ ID NO: 198269 - DNA, 601 bp, Human
tcttttttctctttcatggcttgtagataagatgcttttcatctgtgagtctgtggggaagctaggccttcatagcaaagtaatgttttaaacaatgaaagcaaaaccaaaaggtaccacgggagcttagtacagatgctcccctacttatgatgggttatggcccaagaacttcttaagttgaaagtgcattgaggccgggctcggtggctcacgcctataatcctagcactttggaaggctgaggcgggtggatcacctgaggccaggagttcgagaccagcctggccaacatggtgamaccttgtctctactaaaaatacaaaaattagtcgggcatggtggcgggcgcctctaagcccaactactcgggagactgaggcaggagaatcgcttgaacctgggaagcggatgttgcagtgaaccgagatcgcatcattgcactccagtctgggtgaccagagtgaaactccgtctcaaaaaaaaaaaaagtgcattgaacacaggtaacctactgagtgtcacagctgagcctagcctgccttacacatgctcagaatacctaccttcctctgctgctgggcaaacccatctcacacaa

SEQ ID NO: 198270 - DNA, 601 bp, Human
attgaggccgggctcggtggctcacgcctataatcctagcactttggaaggctgaggcgggtggatcacctgaggccaggagttcgagaccagcctggccaacatggtgaaaccttgtctctactaaaaatacaaaaattagtcgggcatggtggcgggcgcctctaagcccaactactcgggagactgaggcaggagaatcgcttgaacctgggaagcggatgttgcagtgaaccgagatcgcatcattgcactccagtctgggtgaccagagtgaaactccgtctcaaaaaaaaaaaaagtgcattgaacacaggtaacctactgagtgtcacagctgagcctagcctgccttacacatgctcagaatacctaccttcctctgctgctgggcaaacccatctcacacaaagcctactgaggataaagtgttgaatatcttacatgattcattgaacactgaactgaaagtgagtaacagaatggttgcatgggtacttgaagttcagtttctatttaatgcgtgttgcttctgcactgtaaagtcaaaccatcataagttgggggccgtctatactgtggtcatcctgcatgtgaactt

SEQ ID NO: 198271 - DNA, 601 bp, Human
gaagataagcagaatggcaacgaataaccccagggcccacagcaaactgtaaggcaaccttttcccccagtgctgagtaccttcatttcagctttggacatcctcaacagaatacaatttactgctttaaagtgaaaaaatgcagagatgaggctcacatcttacagataaggaaaccaaggcctagagaaggtaagcaattggtccacagcccccagcagccagtggcagcaccaaagcctgagcctggcctctgaaatgccctgtgggttttctcctggcccgtcactgcagccttctygctgatcttcttaccatcgcttcccctttccagttgctttttcactgaacgaccaggttggcgtttctggtgcaaaatataacctatttaaaaaaattaccaagggtgcctagactagcattgtcctttttctgaatttccttttactaatctgatactttctatcccataagactgcttctcagcctttgccccgtccccaccgccatccttctctacattttgtgctgatttttctgtaatgaaccgacccagacttcaaggtgcagttcagacaacacttcctcctccaggagtccg

SEQ ID NO: 198272 - DNA, 601 bp, Human
ggaggaaacagcctccatgtgtcaggcaaaccaactggcttccacatttaatggaatcattatacacagaaccccaaaatttgtgtaacaaaagtgtgattgccatgaacactttgagggagaatgtgttcacaatgtattacatagcacaaatgtcgtcagcaccgtcttccggtcaaatggtcaacaccttgaggtcaaggggctgatttctaggaacacggagcacagacagtccagaacacaacagtgtctgttaacgattgcaagagcaccttctcttcaggagaggaaccacccygtcactcgcagagatgaacatggaaaggagcttctgtggaacaggaacgcacatgaacacactgggaaggcactggactttgtgttgatagagttcttaacagtcttacacagaacggtgtgggtccctcccacagctactttttggcgtggagccttccggcaagtcaggccatctgactgagccccacgggtgcaccccttcgtaacctggtcatcacagctcacaggggagagccagagtctatgttcccaaggaggttttgaggggtgatgcgtgaatatgggagacacagtagaa

SEQ ID NO: 198273 - DNA, 601 bp, Human
ggagccttccggcaagtcaggccatctgactgagccccacgggtgcaccccttcgtaacctggtcatcacagctcacaggggagagccagagtctatgttcccaaggaggttttgaggggtgatgcgtgaatatgggagacacagtagaaggtgtgtgcccggggatggggtgcgggacggtctcagtgtttcagtagaggaagagggtactggaaagactcctgagttccctcccacgctctgtggctgcactgcggttctggggagactcttatcctcttgtttaaggaaatacaacaygtccactctcttctgttcacttcttttttgaagagggaaatatttcatggcctgtcttcaggagaggaaatcctaggaaatgcctgtttaagagactatgtgacactaaactgctagttaacaaggacaatttctccggtgggaagagcacaccagcatcccgtgtgcatctgatgcaggacccgctcacacgaaacatgctcgccttcctgttggcaccaggaggaagtgcagctgccacctctgagtactggggtagtgcatctggagacttgtaaagggtccagatgtggttccatg

SEQ ID NO: 198274 - DNA, 601 bp, Human
gaattaatgccatttattccaagctctttctctgagagttttgtctccagctgacctattctgaggaccacctagaatctctggcaagcccagagacccttgaaaactgttctccctgcgtcttaatgtgacttagaaatccatttccattctttgccttgttaccaatcaaactgtggagtaacagaaaattataaaccattaaggtagtggagaaaagttcaaatacttcaaaatggaatcttccggagaaagtccccagttggtatgcagttcgggtggagaaggtgaagtagcagcrgcaggaacaaagcgtagaaggggaaacaacgtgtggtgcgtgttggttttgagaccgggaacgctactgaactatctgctttatttaaaactttttcatcattgaaaaataaattcactcactgagaattaagaatcccagcactttgggaggctgaggcgggcggatcacgaggtcaggagatcgagaccatcctggctaacacggtgaaaccctgtctctactaaaaatacaaaaaattagccaggcgtggtggcgggcgcctgtaatcccagcactttgggaggccgaggcgggtgg

SEQ ID NO: 198275 - DNA, 601 bp, Human
gggaggctgaggcgggcggatcacgaggtcaggagatcgagaccatcctggctaacacggtgaaaccctgtctctactaaaaatacaaaaaattagccaggcgtggtggcgggcgcctgtaatcccagcactttgggaggccgaggcgggtggatcacgaggtcaggagatcgagtccatcctggctaacacggtgaaaccccgtctctgctaaaaatacaaaaaattagccaggcgtggtggtgggcacctgtagtcccagctacacaggaggctgaggcaggagaacggcgtgaacccrggaggcggagcttgcagtgagccgagattgtgccactgcactccagcctgggcgacagagcgagactccgtctcaaaaaaaaaaaaaaaaagagagaattaagaatgcccttcagataaggctgtcaagaaaatgacatgcttttttcaaagtcctgttagaaaaacactgtaagaggacagattccttgcctctaatagaggcactgggacatgatcacagaccttacgtactttccgaagagcaaagggaaaggaaggttaactctttgcaaagtggtgtgttaagaggacatgaaaa

SEQ ID NO: 198276 - DNA, 601 bp, Human
gtttattttaagagccacgggaagctttcatgagttttaagccaaagatgcttgtgatggtggttgatggtggcgcttttggaagaccaccctggttcccaggtggcagtgcaggatgcaagtcaggactgctgcagcccaccatggaagagcaggcagtggctgtggcatggggaacagcgcgtggggaacagcagtggaggcgggcgaatgagagaactgggcagggtgcaccgcgtcctgcaggcaacacgtcctaggattcccgtctgctcatctgacctgcccttcctcacacacytaagttgtcttcagctctttagcttgcaaaatattttgtcattgtttaaactcttcacccctcacagaaccacagcaaggaaagaccctaatgatttgatctgagaagcaaggtcatacctacccttaagttacctgaagttaacagtctggataaaaacctgaaaaattctatccacaactctgatatttccaatagccttcatgcttttgttacatgggcaagacattcagatattgaatggcactattcagctttcgtcaaagtaagtttgctcaaagtaccatagaaaattaactg

SEQ ID NO: 198277 - DNA, 601 bp, Human
aggactgctgcagcccaccatggaagagcaggcagtggctgtggcatggggaacagcgcgtggggaacagcagtggaggcgggcgaatgagagaactgggcagggtgcaccgcgtcctgcaggcaacacgtcctaggattcccgtctgctcatctgacctgcccttcctcacacacctaagttgtcttcagctctttagcttgcaaaatattttgtcattgtttaaactcttcacccctcacagaaccacagcaaggaaagaccctaatgatttgatctgagaagcaaggtcatacctacmcttaagttacctgaagttaacagtctggataaaaacctgaaaaattctatccacaactctgatatttccaatagccttcatgcttttgttacatgggcaagacattcagatattgaatggcactattcagctttcgtcaaagtaagtttgctcaaagtaccatagaaaattaactgcccatagctaaaccccaaatttaaaatgtaaagacaaccgaatcactaacctaacctgggacgccgtgatgtgcttgtccacagatgaggcaactcctgaaacacagaccaaggcatccgggtg

SEQ ID NO: 198278 - DNA, 601 bp, Human
ggctgtggcatggggaacagcgcgtggggaacagcagtggaggcgggcgaatgagagaactgggcagggtgcaccgcgtcctgcaggcaacacgtcctaggattcccgtctgctcatctgacctgcccttcctcacacacctaagttgtcttcagctctttagcttgcaaaatattttgtcattgtttaaactcttcacccctcacagaaccacagcaaggaaagaccctaatgatttgatctgagaagcaaggtcatacctacccttaagttacctgaagttaacagtctggataaaaayctgaaaaattctatccacaactctgatatttccaatagccttcatgcttttgttacatgggcaagacattcagatattgaatggcactattcagctttcgtcaaagtaagtttgctcaaagtaccatagaaaattaactgcccatagctaaaccccaaatttaaaatgtaaagacaaccgaatcactaacctaacctgggacgccgtgatgtgcttgtccacagatgaggcaactcctgaaacacagaccaaggcatccgggtgcctgtgtgcacacagggctgcgttgtcaatgcatcg

SEQ ID NO: 198279 - DNA, 601 bp, Human
cttttgttacatgggcaagacattcagatattgaatggcactattcagctttcgtcaaagtaagtttgctcaaagtaccatagaaaattaactgcccatagctaaaccccaaatttaaaatgtaaagacaaccgaatcactaacctaacctgggacgccgtgatgtgcttgtccacagatgaggcaactcctgaaacacagaccaaggcatccgggtgcctgtgtgcacacagggctgcgttgtcaatgcatcgcgaccgggcatggtcctgggagtgaattatcccccacaggtcagagrggccgtacgacctcttccagaccccccgggctccagttattaaatgactcctgcaatcatgaactgctttccaaagaacacaaaacaattctgtgaaagattcacaggctgacgtaggctgacaggggttctagcccattaaatccatttcaaactgaaaccagggagacagcaagtttgagaaaaccagaatttttaagagatgaaaactgcacatctgcagtggacgtggtcacctgcctgttgtccttggacaccgcgtgtgggaggagcccagaactttctaaagaacctaacagg

SEQ ID NO: 198280 - DNA, 601 bp, Human
cccgtccattttaaacctctctgcttagcaataattaaatcctctcattccatttggataatcaaagtttaactatagatagtttaacacagaaaccaatgctaacctttacaaagaaagtaaatatcttctaagcctttgatgaggaagagaaatcggaatattataaccagaaaaaggaagttggaaaaaactatatttctgtttactttttataacttatttgaacaatatgaacaaatgtatttgcaaatatttgttctacaacatttttttattaatataaatcaatacacattcyttattcaatgagaaaagaatttgactctagcttcgaacatatccctttgacatatgaaatatagtttaagcaatgagttacttaaaaattccattagtgtgcaaaattcagctgaaaaccaaccttggattccaaacagatcataggaaaagagggtgcaagagaaagaaaacagttcatgaaatgcaacctttacgtaactaagccctgaagaggtctcctaccacactaacatattctaggagaagagcagaatctctaaagtgaacagcagcccctgtcatcccagctctgtgacaa

SEQ ID NO: 198281 - DNA, 601 bp, Human
ctatagatagtttaacacagaaaccaatgctaacctttacaaagaaagtaaatatcttctaagcctttgatgaggaagagaaatcggaatattataaccagaaaaaggaagttggaaaaaactatatttctgtttactttttataacttatttgaacaatatgaacaaatgtatttgcaaatatttgttctacaacatttttttattaatataaatcaatacacattctttattcaatgagaaaagaatttgactctagcttcgaacatatccctttgacatatgaaatatagtttaagcmatgagttacttaaaaattccattagtgtgcaaaattcagctgaaaaccaaccttggattccaaacagatcataggaaaagagggtgcaagagaaagaaaacagttcatgaaatgcaacctttacgtaactaagccctgaagaggtctcctaccacactaacatattctaggagaagagcagaatctctaaagtgaacagcagcccctgtcatcccagctctgtgacaagcagccctgggtgggggaatcggggtggctcagcagcaacatccacaccagcctccagcagcctggggagtg

SEQ ID NO: 198282 - DNA, 601 bp, Human
tgagacaaagttaatatccagctcttcaccaaccaaacgtgatcacaaggaatggatcttgaaggggtcagtctatgtgcgagacaaagttattgtccagctcttcaccaaccaaacgtgctcacaaggaacggagcttggaggggtcagtctatgtgcgagacaaagttaatatccagctcttcaccaaccaaacgtgctcacaaggaactgagcctggagggctcagtctacctcctccaccttccagaccttcctgtgagcagtgaaatttctaaaatgttggtgaagggaagagaayattcaggcttccatagtcaaccacaattaccaagtgttgactggtcaccactcctcttccaattgctttgaaacgaggagtttggaggagaagagaacagagagctgatatgtcaaacagtgttttcacttttcagggtgaagagttagaggtgagactatcagagatattttacatcttttcccagctcagtgccagtcacacggcatggggaccaaatgacatgcccgctggcattcccagggtttggagggtgaggtgggagtggatgatcggggtcactcttcttgctgggacttc

SEQ ID NO: 198283 - DNA, 601 bp, Human
aaggaactgagcctggagggctcagtctacctcctccaccttccagaccttcctgtgagcagtgaaatttctaaaatgttggtgaagggaagagaacattcaggcttccatagtcaaccacaattaccaagtgttgactggtcaccactcctcttccaattgctttgaaacgaggagtttggaggagaagagaacagagagctgatatgtcaaacagtgttttcacttttcagggtgaagagttagaggtgagactatcagagatattttacatcttttcccagctcagtgccagtcacayggcatggggaccaaatgacatgcccgctggcattcccagggtttggagggtgaggtgggagtggatgatcggggtcactcttcttgctgggacttctcatctgtccctccctgcagctgccttgtcgtcactcagccacgtggaccacctggacttccctaaggccatcagcattagccgtcagggcccactcgctgctcacctgctgcagaccttggcccatcagcactcccagaggcagagcattctggacacagcgatccctttgactgcttacagaaaggtgagtgtggaaacccg

SEQ ID NO: 198284 - DNA, 601 bp, Human
acttccctaaggccatcagcattagccgtcagggcccactcgctgctcacctgctgcagaccttggcccatcagcactcccagaggcagagcattctggacacagcgatccctttgactgcttacagaaaggtgagtgtggaaacccggcggaatgtgatcattacctgctcatctttgactctagacagccatcggtaggatgtctttctttccttctttctttctttttttttttttgacagagtcttgctctgtggcccatgctggagtgcagtggtgtgatctcggctcactgcaayctctgcctcctgggttcaagtgattctcctgcctcagcctcctgagtagctgggattataggcatgcgccaccaaatctagctaagttttgtatttctggtagagatggggtttcgcctgttggccaggctggtcttgaactcctgacctcaagtgatctgcccgccttggcctcccaaagtgttggggttacaggtgtaagccactgtgcccagctatctttctttattagggagaacacacagttggttcttggaggcaattgtcaatgtgatgtgagatgaagcacagtgcggcctc

SEQ ID NO: 198285 - DNA, 601 bp, Human
gtagagatggggtttcgcctgttggccaggctggtcttgaactcctgacctcaagtgatctgcccgccttggcctcccaaagtgttggggttacaggtgtaagccactgtgcccagctatctttctttattagggagaacacacagttggttcttggaggcaattgtcaatgtgatgtgagatgaagcacagtgcggcctctgcactgttttcctttgtgtaatttgcatggcatgtgtgtttccagtgatatgaagaaggagataacctgaagtgtcttcctccacagacacgtagaatkctggacaaatggcacagtcagcctttcacagaattaagggaaatccccaggaatccaagctgaaggagaaagtgaaactggaatgggggatgtgcggcctgaagccgctcaagccctgggtggaaggcaggcgacaggattccctacatctaaaatcagggtcttggactttgctgcccatgtggggccagcagggaaaaccctgccttgctggaggtagagagctggacccgagccccccacataacacaggaccctcaacaaccacacccttagcaaatgggtgtgctcacaccacag

SEQ ID NO: 198286 - DNA, 601 bp, Human
ctgtgcccagctatctttctttattagggagaacacacagttggttcttggaggcaattgtcaatgtgatgtgagatgaagcacagtgcggcctctgcactgttttcctttgtgtaatttgcatggcatgtgtgtttccagtgatatgaagaaggagataacctgaagtgtcttcctccacagacacgtagaatgctggacaaatggcacagtcagcctttcacagaattaagggaaatccccaggaatccaagctgaaggagaaagtgaaactggaatgggggatgtgcggcctgaagcygctcaagccctgggtggaaggcaggcgacaggattccctacatctaaaatcagggtcttggactttgctgcccatgtggggccagcagggaaaaccctgccttgctggaggtagagagctggacccgagccccccacataacacaggaccctcaacaaccacacccttagcaaatgggtgtgctcacaccacaggaatctcgtctgtcaccatatggactcaaaatgggaagacgcttgaaacatgggcctcatccagaattgaggctcaaacacatgagtgatctgggtgaggaattga

SEQ ID NO: 198287 - DNA, 601 bp, Human
cctttcacagaattaagggaaatccccaggaatccaagctgaaggagaaagtgaaactggaatgggggatgtgcggcctgaagccgctcaagccctgggtggaaggcaggcgacaggattccctacatctaaaatcagggtcttggactttgctgcccatgtggggccagcagggaaaaccctgccttgctggaggtagagagctggacccgagccccccacataacacaggaccctcaacaaccacacccttagcaaatgggtgtgctcacaccacaggaatctcgtctgtcaccatatrgactcaaaatgggaagacgcttgaaacatgggcctcatccagaattgaggctcaaacacatgagtgatctgggtgaggaattgacatgaagatagtctcagtttaatgacagcctagtgtgtctggcaaaagctctcttgaggttaatactctcagaacagggccatacaaaactagaactaaagccccaccaatgaggagcttataatctggaattatagaacccaccagacaacaaactaccatgagcaaatcagcaaacatcaaagagcaggcttagacccatgagaccttaataaa

SEQ ID NO: 198288 - DNA, 601 bp, Human
cgtcaggcctcgaaggttcgtcaccaactcgtgcagcagatagacggcagtccgggctgtggcaggtgacagcccagggcccagacaccggccagcctcatagtgctcgccgcacgctcagctcaccagtgcggggagactggagcttcccccgtgggactgtggctggaagaccaggggcctctcatgcgctacaagctaccagaaaacactggtgtgcatcaggcgtcggtccctgttacgggctgaaccattccctagaatccatgtgctgcctccctaatcccctccaggttacccygcacataacctcatttgcaggtggggcctttacagagatgatggagttaaaatgaggccactggggttggccccagaccaatctgagtgaggtcctgagaagacagagcaggatgtgctcccacagacgaaaggttctgggaggacacaggaaaaagatgtcatctgccagccacggagagagacctcaggaggaacaagccctgcctgcattgtagacttctggcctccgaaactgtgaggaagacactgctgtggtttcagctgcccagcctgagggatgtcgtcacggcagccccag

SEQ ID NO: 198289 - DNA, 601 bp, Human
caggcctcgaaggttcgtcaccaactcgtgcagcagatagacggcagtccgggctgtggcaggtgacagcccagggcccagacaccggccagcctcatagtgctcgccgcacgctcagctcaccagtgcggggagactggagcttcccccgtgggactgtggctggaagaccaggggcctctcatgcgctacaagctaccagaaaacactggtgtgcatcaggcgtcggtccctgttacgggctgaaccattccctagaatccatgtgctgcctccctaatcccctccaggttaccctgcacataacctcatttgcaggtggggcctttacagagatgatggagttaaaatgaggccactggggttggccccagaccaatctgagtgaggtcctgagaagacagagcaggatgtgctcccacagacgaaaggttctgggaggacacaggaaaaagatgtcatctgccagccacggagagagacctcaggaggaacaagccctgcctgcattgtagacttctggcctccgaaactgtgaggaagacactgctgtggtttcagctgcccagcctgagggatgtcgtcacggcagccccagcag

SEQ ID NO: 198290 - DNA, 601 bp, Human
gcaggatgtgctcccacagacgaaaggttctgggaggacacaggaaaaagatgtcatctgccagccacggagagagacctcaggaggaacaagccctgcctgcattgtagacttctggcctccgaaactgtgaggaagacactgctgtggtttcagctgcccagcctgagggatgtcgtcacggcagccccagcaggccagggcaggcccctggaggtccacagacctcacatagccagcatacgcctctcccaggagccccattcttgcttcatcaattaaagcagcactctggctgggygcggtggctcatgcctgtaatcccagcactttgggaggctgaggcaggcggatcacgaggtcaggagtttgagatcagcctgaccaacatggagaaaccccgactctactaaaaatacaaaattagccaggcgtggtggctaacgcctataattccagttactcggaaggctgaggcaggagaatcacttgaacccgagaggcagaggttgcagtgagccgagatcacaccattgcactccagcctgggcaacaagagtgaaactccatctcaaaaaacaaaaaaaaaaaaaccaaaaaa

SEQ ID NO: 198291 - DNA, 601 bp, Human
gatgtcatctgccagccacggagagagacctcaggaggaacaagccctgcctgcattgtagacttctggcctccgaaactgtgaggaagacactgctgtggtttcagctgcccagcctgagggatgtcgtcacggcagccccagcaggccagggcaggcccctggaggtccacagacctcacatagccagcatacgcctctcccaggagccccattcttgcttcatcaattaaagcagcactctggctgggtgcggtggctcatgcctgtaatcccagcactttgggaggctgaggcaggyggatcacgaggtcaggagtttgagatcagcctgaccaacatggagaaaccccgactctactaaaaatacaaaattagccaggcgtggtggctaacgcctataattccagttactcggaaggctgaggcaggagaatcacttgaacccgagaggcagaggttgcagtgagccgagatcacaccattgcactccagcctgggcaacaagagtgaaactccatctcaaaaaacaaaaaaaaaaaaaccaaaaaacaaaagaaaacaaaacaaaagcagcagcactgtctgctctgagctacaa

SEQ ID NO: 198292 - DNA, 601 bp, Human
agcagcactctggctgggtgcggtggctcatgcctgtaatcccagcactttgggaggctgaggcaggcggatcacgaggtcaggagtttgagatcagcctgaccaacatggagaaaccccgactctactaaaaatacaaaattagccaggcgtggtggctaacgcctataattccagttactcggaaggctgaggcaggagaatcacttgaacccgagaggcagaggttgcagtgagccgagatcacaccattgcactccagcctgggcaacaagagtgaaactccatctcaaaaaacaacaaaaaaaaaaccaaaaaacaaaagaaaacaaaacaaaagcagcagcactgtctgctctgagctacaatcctatgcacgatttccacccgtgggaaccacacgggcccgagctacccagccggctcctttctcacctggtcacatacatctggacaggacaagaactctcagagggctttctctttctccttggtcttcctaaactttgccctaattaatcgatatcactgcctctctcagaggtgactgtggctgtgatgacggacacggaggagacgaacaggagcagaacagtttcac

SEQ ID NO: 198293 - DNA, 601 bp, Human
ggctgggtgcggtggctcatgcctgtaatcccagcactttgggaggctgaggcaggcggatcacgaggtcaggagtttgagatcagcctgaccaacatggagaaaccccgactctactaaaaatacaaaattagccaggcgtggtggctaacgcctataattccagttactcggaaggctgaggcaggagaatcacttgaacccgagaggcagaggttgcagtgagccgagatcacaccattgcactccagcctgggcaacaagagtgaaactccatctcaaaaaacaaaaaaaaaaaaamcaaaaaacaaaagaaaacaaaacaaaagcagcagcactgtctgctctgagctacaatcctatgcacgatttccacccgtgggaaccacacgggcccgagctacccagccggctcctttctcacctggtcacatacatctggacaggacaagaactctcagagggctttctctttctccttggtcttcctaaactttgccctaattaatcgatatcactgcctctctcagaggtgactgtggctgtgatgacggacacggaggagacgaacaggagcagaacagtttcactgccacgtcca

SEQ ID NO: 198294 - DNA, 601 bp, Human
tgagatcagcctgaccaacatggagaaaccccgactctactaaaaatacaaaattagccaggcgtggtggctaacgcctataattccagttactcggaaggctgaggcaggagaatcacttgaacccgagaggcagaggttgcagtgagccgagatcacaccattgcactccagcctgggcaacaagagtgaaactccatctcaaaaaacaaaaaaaaaaaaaccaaaaaacaaaagaaaacaaaacaaaagcagcagcactgtctgctctgagctacaatcctatgcacgatttccaccygtgggaaccacacgggcccgagctacccagccggctcctttctcacctggtcacatacatctggacaggacaagaactctcagagggctttctctttctccttggtcttcctaaactttgccctaattaatcgatatcactgcctctctcagaggtgactgtggctgtgatgacggacacggaggagacgaacaggagcagaacagtttcactgccacgtccatttccgtgacagcacctgtgattggtgttgcgtggacgtgccacacttgcacttggcaggctttcgaggctgctggc

SEQ ID NO: 198295 - DNA, 601 bp, Human
aaagcagcagcactgtctgctctgagctacaatcctatgcacgatttccacccgtgggaaccacacgggcccgagctacccagccggctcctttctcacctggtcacatacatctggacaggacaagaactctcagagggctttctctttctccttggtcttcctaaactttgccctaattaatcgatatcactgcctctctcagaggtgactgtggctgtgatgacggacacggaggagacgaacaggagcagaacagtttcactgccacgtccatttccgtgacagcacctgtgattgrtgttgcgtggacgtgccacacttgcacttggcaggctttcgaggctgctggccttgctgccatgaggactgtgtccaaaaccactcttggaaggaaccataaacggctcccaaacatgagaaagtatgctcagtctcacgcaagccagagaaacagaagtgaaaaccacttggatgcagcccttcccacctaccagcggcaaagctcaaaggttcgctgatacctgaggctgggagacctgggacagaggtaccatgtctatggcactagggggacgccatcttggcaaagattatggca

SEQ ID NO: 198296 - DNA, 601 bp, Human
cagaacagagtcccaggagcgtcaagcaggagctgtggcttgggtggctgcatggacacgggaggctctagaacgtcccctcaagcaagttagggtgtgaggacggatacttgggtctgcaccgggcccaaaggccatggcagccactgggaggtcagacccatccagcgtgcaccgaactcggtgggtcggacccattcactgtgcaccgaactcggtgggtcagacccatccagtgtgcactgaactcggtgggtcagacccatccggggtgcactgaactcggtgggttggacccatycactgtgcactgaactcggtgggtcggacccattcactgtgcactgaactcggtgggtcggacccatccagcgtgcactgaactcggtgggtcggacccattcactgtgcactgaactcggtgggtcagacccatccagcatgcactgaactcggtgggtcggacccattcactgtgcactgaacgcggtgggtcggacccatccagcgtgcactgaactcggtgggtcggacccatccagcatgcactgaactcggtgggtcggacccatccagcgtgcactgaactcggtgggtcgga

SEQ ID NO: 198297 - DNA, 601 bp, Human
aacagagtcccaggagcgtcaagcaggagctgtggcttgggtggctgcatggacacgggaggctctagaacgtcccctcaagcaagttagggtgtgaggacggatacttgggtctgcaccgggcccaaaggccatggcagccactgggaggtcagacccatccagcgtgcaccgaactcggtgggtcggacccattcactgtgcaccgaactcggtgggtcagacccatccagtgtgcactgaactcggtgggtcagacccatccggggtgcactgaactcggtgggttggacccattcastgtgcactgaactcggtgggtcggacccattcactgtgcactgaactcggtgggtcggacccatccagcgtgcactgaactcggtgggtcggacccattcactgtgcactgaactcggtgggtcagacccatccagcatgcactgaactcggtgggtcggacccattcactgtgcactgaacgcggtgggtcggacccatccagcgtgcactgaactcggtgggtcggacccatccagcatgcactgaactcggtgggtcggacccatccagcgtgcactgaactcggtgggtcggaccc

SEQ ID NO: 198298 - DNA, 601 bp, Human
acagagtcccaggagcgtcaagcaggagctgtggcttgggtggctgcatggacacgggaggctctagaacgtcccctcaagcaagttagggtgtgaggacggatacttgggtctgcaccgggcccaaaggccatggcagccactgggaggtcagacccatccagcgtgcaccgaactcggtgggtcggacccattcactgtgcaccgaactcggtgggtcagacccatccagtgtgcactgaactcggtgggtcagacccatccggggtgcactgaactcggtgggttggacccattcacygtgcactgaactcggtgggtcggacccattcactgtgcactgaactcggtgggtcggacccatccagcgtgcactgaactcggtgggtcggacccattcactgtgcactgaactcggtgggtcagacccatccagcatgcactgaactcggtgggtcggacccattcactgtgcactgaacgcggtgggtcggacccatccagcgtgcactgaactcggtgggtcggacccatccagcatgcactgaactcggtgggtcggacccatccagcgtgcactgaactcggtgggtcggaccca

SEQ ID NO: 198299 - DNA, 601 bp, Human
tctttatcttacaaaaggatgtgacaggatttcttgagaagccacgtccccgcagatgattaacacgcagccgctttgataaccgtcctgcgaagtcgccttcatcacgtccttgcttttcagagtcccgagccttgctctgagtgagcatctccgtgttgcctttcggccgtttccagagaaatgtaccggtttcttgatggaagtgtttccttcctgcctctccctcctctgagtgctccattcacccgcaggtgagcctcgactcagcttcttccagacagtccaaggcaggggcacrgactgcaccttccctgcgcctgggaggcccattttccaggaacaagtgacattctgggctgggttttccctgcaaataaagccctttctccttagttcatcccagaagaaaactggaatttttaaaggacctttctaagaaaatgaaggcaaagcaacacaaaaaccagaatcaaagcccagagacagggatcaggcagagtgtagagaatgcaggcccagaggcccaaaccctaccaagcaaaggccccgccgggctctgttccttcagcacaaccccttcctctccagcccgacgcac

SEQ ID NO: 198300 - DNA, 601 bp, Human
gcctgggaggcccattttccaggaacaagtgacattctgggctgggttttccctgcaaataaagccctttctccttagttcatcccagaagaaaactggaatttttaaaggacctttctaagaaaatgaaggcaaagcaacacaaaaaccagaatcaaagcccagagacagggatcaggcagagtgtagagaatgcaggcccagaggcccaaaccctaccaagcaaaggccccgccgggctctgttccttcagcacaaccccttcctctccagcccgacgcacctgcggcacaggtgaggyctcaggatgggcggcatctcagatgctcacccggttttaccctcacaggaaccccaggggaaaggcactgccatcaagcccgtctcacaggggagaagaaggttggaggtctgtcctgggacacagcacctgcaacagcaaagcgtctcagctctgacaccttgctgatggagcccagaatctgtgctccacatctagacctgaccacctgctgtcatggcagagcgggggacccagcggctgccccaatgacctgcccacccctgccccttcccatcaggctttcatgtggccccttcc

SEQ ID NO: 198301 - DNA, 601 bp, Human
cttgaccaggtaactaagtccctccctgcagtcctgagacaccagcctcttcctggtgacacccagtggctgcacagccccatggatccccccatcggggcaggcacctgccgcctcctgtctcccagggaagcctccttctctcacaccctggcctgtctcctttataagagtgttgtatgctcccctctctagatggagtgctcatttctagagttctgttactccgggtctccagcacggaatcccagcctctgtgcagaaagcagcagcgtgagctccagtgggtagagtgtcccarggcgggagggggctctcggggccaggaggcccttcctgtggggccacagccaggccagccccgcctgaaggtctgggctccggggcagtgtgcagcctccaccctcccacatgtgtcctttgtcacagaaagtctccgctcttggtgctgagcctgccccccagacggtgcagccggcctctcccacctgctggggctcctcacatctagcttggcctccagacatcaccaacctctgctgtttatttcatcggatcgtggggttcagatgccacgttttgtccaacgtgccccaggagt

SEQ ID NO: 198302 - DNA, 601 bp, Human
gctggggctcctcacatctagcttggcctccagacatcaccaacctctgctgtttatttcatcggatcgtggggttcagatgccacgttttgtccaacgtgccccaggagtggctgcatgtcaggaacatgtcgctgggaatctctgtggcttatctgaccgtcctgccatcctcaggtgaggggcagtgaggtggccggttgggtgtctggcggaaacgaggctttgcgcacagagggctgggctgctggatcaccacggaattggctgccttgtagctgtgatgagtcggaaggtcggygactctgatgcgttcctgcggcaccaacctgcatgtgctttctacagcctgtgtgtgccagggagggtggcggtcagtgccccgagattggctgtagcttccgagcctaaaaggctacctgtgtgagtcctgggaagaggtctacctggagctcacctgtggcgtgagtctgtgcctctctgctcctgtaccagggacatgcccaccaggagaccccgcatggctgagagggcacgggaatgcacttgtaaagtgagctcagaggaaggaaaatcagaactgctgagtgagaggagacgc

SEQ ID NO: 198303 - DNA, 601 bp, Human
accaacctctgctgtttatttcatcggatcgtggggttcagatgccacgttttgtccaacgtgccccaggagtggctgcatgtcaggaacatgtcgctgggaatctctgtggcttatctgaccgtcctgccatcctcaggtgaggggcagtgaggtggccggttgggtgtctggcggaaacgaggctttgcgcacagagggctgggctgctggatcaccacggaattggctgccttgtagctgtgatgagtcggaaggtcggcgactctgatgcgttcctgcggcaccaacctgcatgtgytttctacagcctgtgtgtgccagggagggtggcggtcagtgccccgagattggctgtagcttccgagcctaaaaggctacctgtgtgagtcctgggaagaggtctacctggagctcacctgtggcgtgagtctgtgcctctctgctcctgtaccagggacatgcccaccaggagaccccgcatggctgagagggcacgggaatgcacttgtaaagtgagctcagaggaaggaaaatcagaactgctgagtgagaggagacgccagggtccaaggcccacgcctggcccacttggttgctg

SEQ ID NO: 198304 - DNA, 601 bp, Human
tacctgtgtgagtcctgggaagaggtctacctggagctcacctgtggcgtgagtctgtgcctctctgctcctgtaccagggacatgcccaccaggagaccccgcatggctgagagggcacgggaatgcacttgtaaagtgagctcagaggaaggaaaatcagaactgctgagtgagaggagacgccagggtccaaggcccacgcctggcccacttggttgctggactccacacgatgcccgctgctccccacacccaccccaactgcacacgacgcccgccactccccacacccaccccgrctccacacgatgcccgctgatccccacacccaccccaactccacatgacgcccgtctctccccacacccaccccaactgcacacgatgcccgctgctccccacacccaccccgactccacaccatgcccgccgctccccacacccaccccgactccacacgacgcccgcctctccccacacccaccccaactccacacgatgcccgccgctccccacacccaccccgactccacaccatgcccgccgctccccacacccaccccaactccacactgcccgccactccccacacccacccc

SEQ ID NO: 198305 - DNA, 601 bp, Human
cccgtaagtgcagccgctgcttcggccaagcagcgtaacaggctctgccctttcaccccagaggctccgtctccagtgcgggaaacagcacagccaggcacggtcacccaccaggacgacgcctacggcctggagatccaggaggcagccagcaggacgtgctgcgctattgacagctgtcctaataacacccggacattcattatgtatggagtggcaatgcacggccacacacgcgtgatcactccagcgaggaccctggaaaaggccgctgaagccgcgtcgccgtgagcctctggcyggcgccaccaggaaggctcctgtgaagagccgagcacccagcccacacctcctcctgccttgctgtcacagcagtgacatttatttacccaaatgacgcttgctggccttgagtgccaaggagacagcagctgcttccgagtcagaggcccaaaacggcagcgcacatggtaggcactaacagacgtgtattccactgaaaactaaatagcgggtgctcactctttgttttttttttttttttttttgagacggagtctcgctctgtcgcccaggctggagtgcagtggcgcgatctcgg

SEQ ID NO: 198306 - DNA, 601 bp, Human
actcccctgattagctgggattacaggcgcctgccaccacgcccggctaatttttctatttttagtagagacagggtttcaccatattggccaggctggtctcgaactcctgacctgaggtgatccacccaatgagggatgattttaataaggtagatgataccagtaaccaacctgagtatacatctcatttatttctcaattgtgcacatgaattttgcttgacgtgggggaaaagcacactgagaaatgtttctgaagtaacttctatctcttcacacaatttctccagaaaaataaygtccaaccaaagcatgagaacagctacagctcagggaacccagagggtccgagaatgtgaccctctggggaagaggatttgaaacgctggagatttactcacataaaaataaaaaatcaagctagttccatgcccatcctgtgatttgccacccatgggagagctacagtgaggtctgagctctgttatttcctgagtgccatggagggtgaagccaccaagaggccccacaggactgaggtccctgctgcaccacaaacttccgtttttattgtatttatttttctcccaaagtcacca

SEQ ID NO: 198307 - DNA, 601 bp, Human
gtgcttagcatggaggcagctacagagaaagcctcaagcattcatgagtaagagagacgtattagtgaatagaagttagggccgttctctaagccagagccaaactcttgacggcttggcaaatgtaaagatatttctgaagaagttacagaatttattattactattattatgagacagagtctcgctctgtcgcccaggctggagtgcagtggtgtaatctcagctcactgcagcctccgcctcccgggttcaagcgattctgctgcctcagcctcccgagtagctggaattataggcrtgcaccaccacacccagctaatttttgtatttttagtagagacgggcttcaccacgttggccaggctgatcttgaactcctgaccttaggtgatccacccgccttggcctcgcaaagtgttgggattacaggcgtgagccactgcaccgggccaaagtcgcagaatttagagctggacaagccgacatcgcctcctccggcgggtggctcagtgcccagtggctcagtgctggtgcacggtgagggagacccagggttcggtgccgctcagcggggacccgcggctctcaccagtggtct

SEQ ID NO: 198308 - DNA, 601 bp, Human
ccagtggtctcgcgtcactgcgcagcgcagggtcttcttgaaggtcttaactttttcaaaggagggaaactgcgataaagatccaagaaaaatgtccctggcagagaggaagcccccgaaagcttggcgcagaatgctggagacccgtggcggcagctcttcgcctgtgcagagggagacgctgccgtgggagaagggtgtgcccacagcaaggcaacgcgcggccggggacgctgctcttgcccgaaggcgctctccctgcgggcttccgcctgggaacgggggcgggtgctctagcccggcgctgctccgctctgaacccaccgctaccaagtttctattcagcaagtggctcaggcaaacatctgagcagcgataaggccgggaatggcctgcagggaggaatgggatgatggggaagccgggtcctgggtggaggaggttggcagtgataaggccaggaatggcctgcagggaggaacgggatggtggggaagccgggtcctgggtggaggaggtgtctggggctgaagccccccatgctgcccctgagcctgggggcaggtgagagacgcgtcctacttccctggacactacgatg

SEQ ID NO: 198309 - DNA, 601 bp, Human
agtggtctcgcgtcactgcgcagcgcagggtcttcttgaaggtcttaactttttcaaaggagggaaactgcgataaagatccaagaaaaatgtccctggcagagaggaagcccccgaaagcttggcgcagaatgctggagacccgtggcggcagctcttcgcctgtgcagagggagacgctgccgtgggagaagggtgtgcccacagcaaggcaacgcgcggccggggacgctgctcttgcccgaaggcgctctccctgcgggcttccgcctgggaacgggggcgggtgctctagcccggcgctgctccgctctgaacccaccgctaccaagtttctattcagcaagtggctcaggcaaacatctgagcagcgataaggccgggaatggcctgcagggaggaatgggatgatggggaagccgggtcctgggtggaggaggttggcagtgataaggccaggaatggcctgcagggaggaacgggatggtggggaagccgggtcctgggtggaggaggtgtctggggctgaagccccccatgctgcccctgagcctgggggcaggtgagagacgcgtcctacttccctggacactacgatggg

SEQ ID NO: 198310 - DNA, 601 bp, Human
ataaagatccaagaaaaatgtccctggcagagaggaagcccccgaaagcttggcgcagaatgctggagacccgtggcggcagctcttcgcctgtgcagagggagacgctgccgtgggagaagggtgtgcccacagcaaggcaacgcgcggccggggacgctgctcttgcccgaaggcgctctccctgcgggcttccgcctgggaacgggggcgggtgctctagcccggcgctgctccgctctgaacccaccgctaccaagtttctattcagcaagtggctcaggcaaacatctgagcagcrataaggccgggaatggcctgcagggaggaatgggatgatggggaagccgggtcctgggtggaggaggttggcagtgataaggccaggaatggcctgcagggaggaacgggatggtggggaagccgggtcctgggtggaggaggtgtctggggctgaagccccccatgctgcccctgagcctgggggcaggtgagagacgcgtcctacttccctggacactacgatgggcaggacgtggctccccggaggcaccagccatgtttccctcacatcaccagcgcaggcttttctgaaggctct

SEQ ID NO: 198311 - DNA, 601 bp, Human
caagaaaaatgtccctggcagagaggaagcccccgaaagcttggcgcagaatgctggagacccgtggcggcagctcttcgcctgtgcagagggagacgctgccgtgggagaagggtgtgcccacagcaaggcaacgcgcggccggggacgctgctcttgcccgaaggcgctctccctgcgggcttccgcctgggaacgggggcgggtgctctagcccggcgctgctccgctctgaacccaccgctaccaagtttctattcagcaagtggctcaggcaaacatctgagcagcgataaggccrggaatggcctgcagggaggaatgggatgatggggaagccgggtcctgggtggaggaggttggcagtgataaggccaggaatggcctgcagggaggaacgggatggtggggaagccgggtcctgggtggaggaggtgtctggggctgaagccccccatgctgcccctgagcctgggggcaggtgagagacgcgtcctacttccctggacactacgatgggcaggacgtggctccccggaggcaccagccatgtttccctcacatcaccagcgcaggcttttctgaaggctctgggggaacc

SEQ ID NO: 198312 - DNA, 601 bp, Human
atgctggagacccgtggcggcagctcttcgcctgtgcagagggagacgctgccgtgggagaagggtgtgcccacagcaaggcaacgcgcggccggggacgctgctcttgcccgaaggcgctctccctgcgggcttccgcctgggaacgggggcgggtgctctagcccggcgctgctccgctctgaacccaccgctaccaagtttctattcagcaagtggctcaggcaaacatctgagcagcgataaggccgggaatggcctgcagggaggaatgggatgatggggaagccgggtcctgggyggaggaggttggcagtgataaggccaggaatggcctgcagggaggaacgggatggtggggaagccgggtcctgggtggaggaggtgtctggggctgaagccccccatgctgcccctgagcctgggggcaggtgagagacgcgtcctacttccctggacactacgatgggcaggacgtggctccccggaggcaccagccatgtttccctcacatcaccagcgcaggcttttctgaaggctctgggggaacctgccacttaggagagtctctgcacctccacaaagctgccctgagacagag

SEQ ID NO: 198313 - DNA, 601 bp, Human
gggaacgggggcgggtgctctagcccggcgctgctccgctctgaacccaccgctaccaagtttctattcagcaagtggctcaggcaaacatctgagcagcgataaggccgggaatggcctgcagggaggaatgggatgatggggaagccgggtcctgggtggaggaggttggcagtgataaggccaggaatggcctgcagggaggaacgggatggtggggaagccgggtcctgggtggaggaggtgtctggggctgaagccccccatgctgcccctgagcctgggggcaggtgagagacgygtcctacttccctggacactacgatgggcaggacgtggctccccggaggcaccagccatgtttccctcacatcaccagcgcaggcttttctgaaggctctgggggaacctgccacttaggagagtctctgcacctccacaaagctgccctgagacagaggcaacggggccaccatggacgcctcctagaaaccaggacccagaaaacaggtatgtcttcagaggagcaggatgagaactgcaaaaacagacctaactttggttcttttccttgacgtccagggcagtcattgactcattc

SEQ ID NO: 198314 - DNA, 601 bp, Human
tggggaagccgggtcctgggtggaggaggtgtctggggctgaagccccccatgctgcccctgagcctgggggcaggtgagagacgcgtcctacttccctggacactacgatgggcaggacgtggctccccggaggcaccagccatgtttccctcacatcaccagcgcaggcttttctgaaggctctgggggaacctgccacttaggagagtctctgcacctccacaaagctgccctgagacagaggcaacggggccaccatggacgcctcctagaaaccaggacccagaaaacaggtatgwcttcagaggagcaggatgagaactgcaaaaacagacctaactttggttcttttccttgacgtccagggcagtcattgactcattcactcatagcacctgcagtcagagggcctgattttgaatctgggcttcaggtcttactgactgtgtggccttgggaaaacactaatctctgtgtgcctcagtttccccatctgtgaagtggtgataatggtaccgacttcaccgctgggaggattaaataagataacatgcttagagtgaggctttgggcctgtgcctgacacacaccaggtgatt

SEQ ID NO: 198315 - DNA, 601 bp, Human
cctcctgggtgggcagtgctgcgggcacagcgctctgcatccatgccgcgactgctttcggaatgtgcttttccagggcgagccttctttttggacatgggatgtacccgatgtctacaagcttgaagtaacattgccgaccgtgtgcttcttgtgcatgcagggtctgaagggaaggccttgcatccaccgcccacctaacctcacggctcagccacgttcacgcagcacggttcagtcagaagttcacacctcattcaacccagctgttgctaagtcagtgtggctgtcatgggaccarctgaagagtgtcctgcctcacgccgtatctcaggacatccacaaagcattgcttttgccacattctgcttggccgcgaagccactttctgcagcccgagctccacccccggccataacccaggctgggaagaagttccccgggcatcggcgactccctgcaggtacggcaggggtggcaaggggcgaacagcgcaccaggcccgcgaggaggtcaccgagcaagggctgtgcgcgtggaaaccgtgatgacatcacactgacaagttaaaccctggagtcccagcggcactggctgtcgg

SEQ ID NO: 198316 - DNA, 601 bp, Human
acagcgctctgcatccatgccgcgactgctttcggaatgtgcttttccagggcgagccttctttttggacatgggatgtacccgatgtctacaagcttgaagtaacattgccgaccgtgtgcttcttgtgcatgcagggtctgaagggaaggccttgcatccaccgcccacctaacctcacggctcagccacgttcacgcagcacggttcagtcagaagttcacacctcattcaacccagctgttgctaagtcagtgtggctgtcatgggaccaactgaagagtgtcctgcctcacgccgyatctcaggacatccacaaagcattgcttttgccacattctgcttggccgcgaagccactttctgcagcccgagctccacccccggccataacccaggctgggaagaagttccccgggcatcggcgactccctgcaggtacggcaggggtggcaaggggcgaacagcgcaccaggcccgcgaggaggtcaccgagcaagggctgtgcgcgtggaaaccgtgatgacatcacactgacaagttaaaccctggagtcccagcggcactggctgtcggccgtcctgcacgtgcccccgggaaga

SEQ ID NO: 198317 - DNA, 601 bp, Human
ggcgagccttctttttggacatgggatgtacccgatgtctacaagcttgaagtaacattgccgaccgtgtgcttcttgtgcatgcagggtctgaagggaaggccttgcatccaccgcccacctaacctcacggctcagccacgttcacgcagcacggttcagtcagaagttcacacctcattcaacccagctgttgctaagtcagtgtggctgtcatgggaccaactgaagagtgtcctgcctcacgccgtatctcaggacatccacaaagcattgcttttgccacattctgcttggccgygaagccactttctgcagcccgagctccacccccggccataacccaggctgggaagaagttccccgggcatcggcgactccctgcaggtacggcaggggtggcaaggggcgaacagcgcaccaggcccgcgaggaggtcaccgagcaagggctgtgcgcgtggaaaccgtgatgacatcacactgacaagttaaaccctggagtcccagcggcactggctgtcggccgtcctgcacgtgcccccgggaagacgtggctgcaggcccaactcctggtgtctcccttggcgataaacacaaga

SEQ ID NO: 198318 - DNA, 601 bp, Human
ctgaagggaaggccttgcatccaccgcccacctaacctcacggctcagccacgttcacgcagcacggttcagtcagaagttcacacctcattcaacccagctgttgctaagtcagtgtggctgtcatgggaccaactgaagagtgtcctgcctcacgccgtatctcaggacatccacaaagcattgcttttgccacattctgcttggccgcgaagccactttctgcagcccgagctccacccccggccataacccaggctgggaagaagttccccgggcatcggcgactccctgcaggtayggcaggggtggcaaggggcgaacagcgcaccaggcccgcgaggaggtcaccgagcaagggctgtgcgcgtggaaaccgtgatgacatcacactgacaagttaaaccctggagtcccagcggcactggctgtcggccgtcctgcacgtgcccccgggaagacgtggctgcaggcccaactcctggtgtctcccttggcgataaacacaagaaagccacatctatctactggagacagaaacagaaattcctcacaagtgagctggaaatgcgccagtctgctgcgctcacggggaacgggg

SEQ ID NO: 198319 - DNA, 601 bp, Human
cacgccgtatctcaggacatccacaaagcattgcttttgccacattctgcttggccgcgaagccactttctgcagcccgagctccacccccggccataacccaggctgggaagaagttccccgggcatcggcgactccctgcaggtacggcaggggtggcaaggggcgaacagcgcaccaggcccgcgaggaggtcaccgagcaagggctgtgcgcgtggaaaccgtgatgacatcacactgacaagttaaaccctggagtcccagcggcactggctgtcggccgtcctgcacgtgccccygggaagacgtggctgcaggcccaactcctggtgtctcccttggcgataaacacaagaaagccacatctatctactggagacagaaacagaaattcctcacaagtgagctggaaatgcgccagtctgctgcgctcacggggaacggggtcgggccagctccctccaaggacgggggctgggacgtttggccgctgcctctcccactcactgtggcctgcccctgccagcgtcccttccccttgctgtgtggcccctttctgggccacctgccagagctcctcacagtggggaccggcccct

SEQ ID NO: 198320 - DNA, 601 bp, Human
ggaggatcacttgagcccaggaggatgaggctgcagtgagctatgattgcaccaatgcactccaaccctggtgacagagcaagaccctgtccgcctacacccgccaaaaatacagagctatgatctcgagagcattttatttgagcaaaagataatttataaagcaaaatcaacaacatgagcctcctctgagagaaagctggaggccagccccatcatgttttgaaatttccctgatttataatcctcggtaaacacaaagggtgcatcctcacccggaacaaaactctcctggtcagayggtgaacaccccagagcgaggcctgtgggccacacgagcctgctgaaggggttaaccggcagtggtgccaagcaggaagccccgagacctgcccctccacagcgcctgcttgcaggggcccaagggcctcccctgcacagcctggcctgggggcactgacacatttttggcaaacagatcttggccggacagaaggtccaatccttccagccacttcacttaaaggaaaatcttctatttaagatccagactcagcctaacaatcacgaagatggctctgtttatgatccgcgacaatgc

SEQ ID NO: 198321 - DNA, 601 bp, Human
caggaggatgaggctgcagtgagctatgattgcaccaatgcactccaaccctggtgacagagcaagaccctgtccgcctacacccgccaaaaatacagagctatgatctcgagagcattttatttgagcaaaagataatttataaagcaaaatcaacaacatgagcctcctctgagagaaagctggaggccagccccatcatgttttgaaatttccctgatttataatcctcggtaaacacaaagggtgcatcctcacccggaacaaaactctcctggtcagatggtgaacaccccagagygaggcctgtgggccacacgagcctgctgaaggggttaaccggcagtggtgccaagcaggaagccccgagacctgcccctccacagcgcctgcttgcaggggcccaagggcctcccctgcacagcctggcctgggggcactgacacatttttggcaaacagatcttggccggacagaaggtccaatccttccagccacttcacttaaaggaaaatcttctatttaagatccagactcagcctaacaatcacgaagatggctctgtttatgatccgcgacaatgcaccttcagccacagcgg

SEQ ID NO: 198322 - DNA, 601 bp, Human
cagatggtgaacaccccagagcgaggcctgtgggccacacgagcctgctgaaggggttaaccggcagtggtgccaagcaggaagccccgagacctgcccctccacagcgcctgcttgcaggggcccaagggcctcccctgcacagcctggcctgggggcactgacacatttttggcaaacagatcttggccggacagaaggtccaatccttccagccacttcacttaaaggaaaatcttctatttaagatccagactcagcctaacaatcacgaagatggctctgtttatgatccgcgacratgcaccttcagccacagcggcccagtgtgtgcagcttggcgaccttgagtttgtaaggacgagtaagaccttgtggcatttgcgtgactcaataaccaacaggtaattaaatatgaatgaagaagaaaggtagatgtaaccacataactcttttgattgtagatttagctgcgatgtcggcggcactcgtgaattccctccccactctgaggagctggacggaggctccatcccactgagggctgggcatgggcctgcctggccctgaaggcacccacggggccactcccaccagggtg

SEQ ID NO: 198323 - DNA, 601 bp, Human
cggcagtggtgccaagcaggaagccccgagacctgcccctccacagcgcctgcttgcaggggcccaagggcctcccctgcacagcctggcctgggggcactgacacatttttggcaaacagatcttggccggacagaaggtccaatccttccagccacttcacttaaaggaaaatcttctatttaagatccagactcagcctaacaatcacgaagatggctctgtttatgatccgcgacaatgcaccttcagccacagcggcccagtgtgtgcagcttggcgaccttgagtttgtaaggaygagtaagaccttgtggcatttgcgtgactcaataaccaacaggtaattaaatatgaatgaagaagaaaggtagatgtaaccacataactcttttgattgtagatttagctgcgatgtcggcggcactcgtgaattccctccccactctgaggagctggacggaggctccatcccactgagggctgggcatgggcctgcctggccctgaaggcacccacggggccactcccaccagggtgtggatgaaacctgttttcttttctcttcccaattcatactctttagcagcgaagaaaaaac

SEQ ID NO: 198324 - DNA, 601 bp, Human
ccggacagaaggtccaatccttccagccacttcacttaaaggaaaatcttctatttaagatccagactcagcctaacaatcacgaagatggctctgtttatgatccgcgacaatgcaccttcagccacagcggcccagtgtgtgcagcttggcgaccttgagtttgtaaggacgagtaagaccttgtggcatttgcgtgactcaataaccaacaggtaattaaatatgaatgaagaagaaaggtagatgtaaccacataactcttttgattgtagatttagctgcgatgtcggcggcactygtgaattccctccccactctgaggagctggacggaggctccatcccactgagggctgggcatgggcctgcctggccctgaaggcacccacggggccactcccaccagggtgtggatgaaacctgttttcttttctcttcccaattcatactctttagcagcgaagaaaaaacaatatatatgtgaactaagaaaaggactataaatcatgctaccataaggacacatgcacacatatgtttattgtggcactattcacaatagtaaagacttggaaccaacccaaatgtccatcaatgat

SEQ ID NO: 198325 - DNA, 601 bp, Human
ggacagaaggtccaatccttccagccacttcacttaaaggaaaatcttctatttaagatccagactcagcctaacaatcacgaagatggctctgtttatgatccgcgacaatgcaccttcagccacagcggcccagtgtgtgcagcttggcgaccttgagtttgtaaggacgagtaagaccttgtggcatttgcgtgactcaataaccaacaggtaattaaatatgaatgaagaagaaaggtagatgtaaccacataactcttttgattgtagatttagctgcgatgtcggcggcactcgygaattccctccccactctgaggagctggacggaggctccatcccactgagggctgggcatgggcctgcctggccctgaaggcacccacggggccactcccaccagggtgtggatgaaacctgttttcttttctcttcccaattcatactctttagcagcgaagaaaaaacaatatatatgtgaactaagaaaaggactataaatcatgctaccataaggacacatgcacacatatgtttattgtggcactattcacaatagtaaagacttggaaccaacccaaatgtccatcaatgatag

SEQ ID NO: 198326 - DNA, 601 bp, Human
tttgcgtgactcaataaccaacaggtaattaaatatgaatgaagaagaaaggtagatgtaaccacataactcttttgattgtagatttagctgcgatgtcggcggcactcgtgaattccctccccactctgaggagctggacggaggctccatcccactgagggctgggcatgggcctgcctggccctgaaggcacccacggggccactcccaccagggtgtggatgaaacctgttttcttttctcttcccaattcatactctttagcagcgaagaaaaaacaatatatatgtgaactaaraaaaggactataaatcatgctaccataaggacacatgcacacatatgtttattgtggcactattcacaatagtaaagacttggaaccaacccaaatgtccatcaatgatagactggattaagaaaatgtggcacatatacaccatggaatactatgcagccataaaaaaggatgagttcatgttctttgcagggacatggatgaagctggaaaccatcattctcagcaaaatatcacaaagacagaaaatcaaacaccacatgttctcactcatcggtgggaagtgaacaatgagaacac

SEQ ID NO: 198327 - DNA, 601 bp, Human
taattaaatatgaatgaagaagaaaggtagatgtaaccacataactcttttgattgtagatttagctgcgatgtcggcggcactcgtgaattccctccccactctgaggagctggacggaggctccatcccactgagggctgggcatgggcctgcctggccctgaaggcacccacggggccactcccaccagggtgtggatgaaacctgttttcttttctcttcccaattcatactctttagcagcgaagaaaaaacaatatatatgtgaactaagaaaaggactataaatcatgctaccmtaaggacacatgcacacatatgtttattgtggcactattcacaatagtaaagacttggaaccaacccaaatgtccatcaatgatagactggattaagaaaatgtggcacatatacaccatggaatactatgcagccataaaaaaggatgagttcatgttctttgcagggacatggatgaagctggaaaccatcattctcagcaaaatatcacaaagacagaaaatcaaacaccacatgttctcactcatcggtgggaagtgaacaatgagaacacttggacacaaggcggggaccatcac

SEQ ID NO: 198328 - DNA, 601 bp, Human
tttagctgcgatgtcggcggcactcgtgaattccctccccactctgaggagctggacggaggctccatcccactgagggctgggcatgggcctgcctggccctgaaggcacccacggggccactcccaccagggtgtggatgaaacctgttttcttttctcttcccaattcatactctttagcagcgaagaaaaaacaatatatatgtgaactaagaaaaggactataaatcatgctaccataaggacacatgcacacatatgtttattgtggcactattcacaatagtaaagacttggawccaacccaaatgtccatcaatgatagactggattaagaaaatgtggcacatatacaccatggaatactatgcagccataaaaaaggatgagttcatgttctttgcagggacatggatgaagctggaaaccatcattctcagcaaaatatcacaaagacagaaaatcaaacaccacatgttctcactcatcggtgggaagtgaacaatgagaacacttggacacaaggcggggaccatcacacaccacagcctgtcaggggctgggggccagggggagggatagcattaggagaaatacct

SEQ ID NO: 198329 - DNA, 601 bp, Human
cactcgtgaattccctccccactctgaggagctggacggaggctccatcccactgagggctgggcatgggcctgcctggccctgaaggcacccacggggccactcccaccagggtgtggatgaaacctgttttcttttctcttcccaattcatactctttagcagcgaagaaaaaacaatatatatgtgaactaagaaaaggactataaatcatgctaccataaggacacatgcacacatatgtttattgtggcactattcacaatagtaaagacttggaaccaacccaaatgtccatcartgatagactggattaagaaaatgtggcacatatacaccatggaatactatgcagccataaaaaaggatgagttcatgttctttgcagggacatggatgaagctggaaaccatcattctcagcaaaatatcacaaagacagaaaatcaaacaccacatgttctcactcatcggtgggaagtgaacaatgagaacacttggacacaaggcggggaccatcacacaccacagcctgtcaggggctgggggccagggggagggatagcattaggagaaatacctaatgtaaatgacgagttggt

SEQ ID NO: 198330 - DNA, 601 bp, Human
ccctgaaggcacccacggggccactcccaccagggtgtggatgaaacctgttttcttttctcttcccaattcatactctttagcagcgaagaaaaaacaatatatatgtgaactaagaaaaggactataaatcatgctaccataaggacacatgcacacatatgtttattgtggcactattcacaatagtaaagacttggaaccaacccaaatgtccatcaatgatagactggattaagaaaatgtggcacatatacaccatggaatactatgcagccataaaaaaggatgagttcatgtyctttgcagggacatggatgaagctggaaaccatcattctcagcaaaatatcacaaagacagaaaatcaaacaccacatgttctcactcatcggtgggaagtgaacaatgagaacacttggacacaaggcggggaccatcacacaccacagcctgtcaggggctgggggccagggggagggatagcattaggagaaatacctaatgtaaatgacgagttggtgggtgcagcaatccaacatggcacatgtatacatatgtaacaaacctgcacgttgtgcacatgtaccctagaacttaaa

SEQ ID NO: 198331 - DNA, 601 bp, Human
cacaatagtaaagacttggaaccaacccaaatgtccatcaatgatagactggattaagaaaatgtggcacatatacaccatggaatactatgcagccataaaaaaggatgagttcatgttctttgcagggacatggatgaagctggaaaccatcattctcagcaaaatatcacaaagacagaaaatcaaacaccacatgttctcactcatcggtgggaagtgaacaatgagaacacttggacacaaggcggggaccatcacacaccacagcctgtcaggggctgggggccagggggagggrtagcattaggagaaatacctaatgtaaatgacgagttggtgggtgcagcaatccaacatggcacatgtatacatatgtaacaaacctgcacgttgtgcacatgtaccctagaacttaaagtataattaaaaaaaaaaaagaaaaaaaattccaggtacaaaggggaagtcatttatttttgtgccatgctgccttgcatttttggaatgcctgtccctggagatggagctcacatctttccggaaagctctgaaggtccctgcgtctcagtatagctgctctgtagctttttagctgtct

SEQ ID NO: 198332 - DNA, 601 bp, Human
ggacatggatgaagctggaaaccatcattctcagcaaaatatcacaaagacagaaaatcaaacaccacatgttctcactcatcggtgggaagtgaacaatgagaacacttggacacaaggcggggaccatcacacaccacagcctgtcaggggctgggggccagggggagggatagcattaggagaaatacctaatgtaaatgacgagttggtgggtgcagcaatccaacatggcacatgtatacatatgtaacaaacctgcacgttgtgcacatgtaccctagaacttaaagtataattaaaaaaaaaaaagaaaaaaaattccaggtacaaaggggaagtcatttatttttgtgccatgctgccttgcatttttggaatgcctgtccctggagatggagctcacatctttccggaaagctctgaaggtccctgcgtctcagtatagctgctctgtagctttttagctgtctggcccctcttaggtgttgagaaagttattaagaaaattattaaggatagcatgtcaaattcccagtgagaaggacgcatttgcaataatggaaaaagggcacggttttgcaggtcatctccatagtaa

SEQ ID NO: 198333 - DNA, 601 bp, Human
caaagacagaaaatcaaacaccacatgttctcactcatcggtgggaagtgaacaatgagaacacttggacacaaggcggggaccatcacacaccacagcctgtcaggggctgggggccagggggagggatagcattaggagaaatacctaatgtaaatgacgagttggtgggtgcagcaatccaacatggcacatgtatacatatgtaacaaacctgcacgttgtgcacatgtaccctagaacttaaagtataattaaaaaaaaaaaagaaaaaaaattccaggtacaaaggggaagtcayttatttttgtgccatgctgccttgcatttttggaatgcctgtccctggagatggagctcacatctttccggaaagctctgaaggtccctgcgtctcagtatagctgctctgtagctttttagctgtctggcccctcttaggtgttgagaaagttattaagaaaattattaaggatagcatgtcaaattcccagtgagaaggacgcatttgcaataatggaaaaagggcacggttttgcaggtcatctccatagtaaaatatcaatgattataatgtgcctctattcttgagaagaaagta

SEQ ID NO: 198334 - DNA, 601 bp, Human
gcatttttggaatgcctgtccctggagatggagctcacatctttccggaaagctctgaaggtccctgcgtctcagtatagctgctctgtagctttttagctgtctggcccctcttaggtgttgagaaagttattaagaaaattattaaggatagcatgtcaaattcccagtgagaaggacgcatttgcaataatggaaaaagggcacggttttgcaggtcatctccatagtaaaatatcaatgattataatgtgcctctattcttgagaagaaagtattccagagccattagtgtgttagraaaaaaaaaaaccccacagtagaaaatgaaatccattattggcaaaaaaagcaagccaagacagagctgagatctgcacggtgtggccgtgtaaggcagaggctgaggaccaggactctgggtccagatcacccggggctgtgtgccactggacaggctgccaaaagctgcgtgtgtgtttttaatctgtgaaatggggatgaaggcagagcagctccacagagttgttgggaggactctgagggtggatgtgtgtggagcacagagtacaaggcctggcttgcagactcggcccgtgtg

SEQ ID NO: 198335 - DNA, 601 bp, Human
tgcctgtccctggagatggagctcacatctttccggaaagctctgaaggtccctgcgtctcagtatagctgctctgtagctttttagctgtctggcccctcttaggtgttgagaaagttattaagaaaattattaaggatagcatgtcaaattcccagtgagaaggacgcatttgcaataatggaaaaagggcacggttttgcaggtcatctccatagtaaaatatcaatgattataatgtgcctctattcttgagaagaaagtattccagagccattagtgtgttagaaaaaaaaaaaaccccacagtagaaaatgaaatccattattggcaaaaaaagcaagccaagacagagctgagatctgcacggtgtggccgtgtaaggcagaggctgaggaccaggactctgggtccagatcacccggggctgtgtgccactggacaggctgccaaaagctgcgtgtgtgtttttaatctgtgaaatggggatgaaggcagagcagctccacagagttgttgggaggactctgagggtggatgtgtgtggagcacagagtacaaggcctggcttgcagactcggcccgtgtgacactgatctca

SEQ ID NO: 198336 - DNA, 601 bp, Human
ggaccaggactctgggtccagatcacccggggctgtgtgccactggacaggctgccaaaagctgcgtgtgtgtttttaatctgtgaaatggggatgaaggcagagcagctccacagagttgttgggaggactctgagggtggatgtgtgtggagcacagagtacaaggcctggcttgcagactcggcccgtgtgacactgatctcaggtgggtgcaacaagtacacagcctgacttgcacacttggcccatgcggcactgatctcaggtgggtgtgatgagtacgagccctggcttgcacrctcagcctgtgggacactgatctctggtgggtgcaatgagtacacagcctggcttgcacgctcagcctgtgggacactgatctctggtgtgtgcaatgagtacacagcctggcttgcacactcggcccgtgggacactgatctcaggtgggtgcaacgagtacacagcctggcttgcacactcggcccgtgggacactgatctcaggtgggtgcaacgagtacacagcctgacttgcacactcggcccgtgggacactgatcttacacgggtgtgggcatccccctgccagtgcccgcat

SEQ ID NO: 198337 - DNA, 601 bp, Human
gttgggaggactctgagggtggatgtgtgtggagcacagagtacaaggcctggcttgcagactcggcccgtgtgacactgatctcaggtgggtgcaacaagtacacagcctgacttgcacacttggcccatgcggcactgatctcaggtgggtgtgatgagtacgagccctggcttgcacactcagcctgtgggacactgatctctggtgggtgcaatgagtacacagcctggcttgcacgctcagcctgtgggacactgatctctggtgtgtgcaatgagtacacagcctggcttgcacrctcggcccgtgggacactgatctcaggtgggtgcaacgagtacacagcctggcttgcacactcggcccgtgggacactgatctcaggtgggtgcaacgagtacacagcctgacttgcacactcggcccgtgggacactgatcttacacgggtgtgggcatccccctgccagtgcccgcatctacatttgggcacagagaagccacacagcctcacgggagctgggggcctctggcagggcctccttccaggacacaataccaaggaggccagacccccagggctgtccgcactggatgac

SEQ ID NO: 198338 - DNA, 601 bp, Human
ggaggactctgagggtggatgtgtgtggagcacagagtacaaggcctggcttgcagactcggcccgtgtgacactgatctcaggtgggtgcaacaagtacacagcctgacttgcacacttggcccatgcggcactgatctcaggtgggtgtgatgagtacgagccctggcttgcacactcagcctgtgggacactgatctctggtgggtgcaatgagtacacagcctggcttgcacgctcagcctgtgggacactgatctctggtgtgtgcaatgagtacacagcctggcttgcacactcrgcccgtgggacactgatctcaggtgggtgcaacgagtacacagcctggcttgcacactcggcccgtgggacactgatctcaggtgggtgcaacgagtacacagcctgacttgcacactcggcccgtgggacactgatcttacacgggtgtgggcatccccctgccagtgcccgcatctacatttgggcacagagaagccacacagcctcacgggagctgggggcctctggcagggcctccttccaggacacaataccaaggaggccagacccccagggctgtccgcactggatgaccctc

SEQ ID NO: 198339 - DNA, 601 bp, Human
gactctgagggtggatgtgtgtggagcacagagtacaaggcctggcttgcagactcggcccgtgtgacactgatctcaggtgggtgcaacaagtacacagcctgacttgcacacttggcccatgcggcactgatctcaggtgggtgtgatgagtacgagccctggcttgcacactcagcctgtgggacactgatctctggtgggtgcaatgagtacacagcctggcttgcacgctcagcctgtgggacactgatctctggtgtgtgcaatgagtacacagcctggcttgcacactcggccygtgggacactgatctcaggtgggtgcaacgagtacacagcctggcttgcacactcggcccgtgggacactgatctcaggtgggtgcaacgagtacacagcctgacttgcacactcggcccgtgggacactgatcttacacgggtgtgggcatccccctgccagtgcccgcatctacatttgggcacagagaagccacacagcctcacgggagctgggggcctctggcagggcctccttccaggacacaataccaaggaggccagacccccagggctgtccgcactggatgaccctctggc

SEQ ID NO: 198340 - DNA, 601 bp, Human
ggggaaaaaaagaaaaaaaggtttcttgtataatcacctctccccgatcatgacacagttttacttgattttatttcatcataaaactcagagggactcagaaggaaccgcctcacatgctaggccagcaaggccagctgggagcagaggagcagtaaccaatgatttcgttgaggagagcgactttacacaaacactccaccatgctaggtctctgatcggcaccgctacaaggtgctccggggtctgggtgcatctggggcagccctgtgagacctcagggaacacagggccacgctcrcttctggagagcaaatggcccacggccgcccctgaatgccaggggagcctcccttcttctgccacggagtcagggccccggcagccgagcctgtccgtgatctaagccggggacgtcctcggctcatggcccacgtggccaacgctgctctggtgacacagtcccaccgcctccagtggcttctccttggtgtccaggtaacttttacacttggaccaagaacaacccacacacgtgtttgcacgcgcacacacacacacacccaggggaggatgcccctgacagcagcgcccaagccag

SEQ ID NO: 198341 - DNA, 601 bp, Human
aaaggtttcttgtataatcacctctccccgatcatgacacagttttacttgattttatttcatcataaaactcagagggactcagaaggaaccgcctcacatgctaggccagcaaggccagctgggagcagaggagcagtaaccaatgatttcgttgaggagagcgactttacacaaacactccaccatgctaggtctctgatcggcaccgctacaaggtgctccggggtctgggtgcatctggggcagccctgtgagacctcagggaacacagggccacgctcacttctggagagcaaayggcccacggccgcccctgaatgccaggggagcctcccttcttctgccacggagtcagggccccggcagccgagcctgtccgtgatctaagccggggacgtcctcggctcatggcccacgtggccaacgctgctctggtgacacagtcccaccgcctccagtggcttctccttggtgtccaggtaacttttacacttggaccaagaacaacccacacacgtgtttgcacgcgcacacacacacacacccaggggaggatgcccctgacagcagcgcccaagccagggccacagagctctgc

SEQ ID NO: 198342 - DNA, 601 bp, Human
gggtgcatctggggcagccctgtgagacctcagggaacacagggccacgctcacttctggagagcaaatggcccacggccgcccctgaatgccaggggagcctcccttcttctgccacggagtcagggccccggcagccgagcctgtccgtgatctaagccggggacgtcctcggctcatggcccacgtggccaacgctgctctggtgacacagtcccaccgcctccagtggcttctccttggtgtccaggtaacttttacacttggaccaagaacaacccacacacgtgtttgcacgcgcacacacacacacacccaggggaggatgcccctgacagcagcgcccaagccagggccacagagctctgcaggcccctccccgctcctgacacacgacgacacccagtcaggggctgtaagcacagctcctgcaggaaggggttccacgcacgggcaaacaagccgagtcagcccacgatgagcgatgttggccaagcaatatggagtgagttcttcccatttcgcaagatgttttctcaaaacaaaaattaaagatatagacatgtttcatgtaagtgaaaaataattttcaacactcttc

SEQ ID NO: 198343 - DNA, 601 bp, Human
aagccagggccacagagctctgcaggcccctccccgctcctgacacacgacgacacccagtcaggggctgtaagcacagctcctgcaggaaggggttccacgcacgggcaaacaagccgagtcagcccacgatgagcgatgttggccaagcaatatggagtgagttcttcccatttcgcaagatgttttctcaaaacaaaaattaaagatatagacatgtttcatgtaagtgaaaaataattttcaacactcttctaaatgtggaacagtcttggaacagcctaagatcagtaggaaaaargcggcctctccgctcgctcagcccccatccctgcggcgcccagagcaccagccctttctcgagtccccacacaacctcgcggccgggctccgggcatccaggcgtgtgctgtttcctagttattttcacgtccatacccctgcctcccacactcaagagcagaagtccttctgtctgctttctgtacccacagcatctacgtggtgcagaggggccctcgctgagcccctgcacactggtcagcatccctggcctccagatcacggctcgctcagggaccgagtgtcccacaccaaggca

SEQ ID NO: 198344 - DNA, 601 bp, Human
ctggagcagctgcatcgagcccccgccggccgacagctgcggcttcctgctctggggaggtgagggctgtgtttgaatctcctgaagcccctggtgggtggctgggaaacgcaggtgctccacgtgaagcacagaaggcacgtacgggctcacgggacccgcggtcagctgcatccgagagtgaccgacgtgctgaaacccgacctcctgcctccctttttcttagggactgcctctcccctaagactaaagacattcattttcttcatttgctctgctcctgataacgtcagattgaaascaggaaacagttgtgaaaataaagacattggaaggaaacacagaattttaatgagcatcttctctctggaacagcccatgtctaagaccggcttctgtgatggtctttaatgcttccataaaggtggcatcttagatgtgagagggagcacctttaacccacgatgcctgcaacccttcccgttgtcatgggagaccccagtcacaccgcagcaaagcccctccagccagactgccgttggtgagacaaatccctcccttcccggctcccacggaggatgactcaccgggcaattaagtt

SEQ ID NO: 198345 - DNA, 601 bp, Human
tcatagtcagacaatttaaaatagccagtcagtaagaaacaagtcatccgccttcagagcagcccaggcctgacgtggaagtagagaacgggcagctgttttttttacaagaaacttttgcaccttcctaattttctttttgctcagaataagggctgattttcatgtgccatccctgtcatcacccgcatcttcagcctgcagcgcgtagggaggactccccatgggcgggcaggactctggacctgagaattgcacaggatggtttccaagagggtttacatgctcccccgccccccgycccctgcccacagacctgctcttaccacatcaagatcttagttcaatgtatcgattcattcttatcgagcatgtaaaggtccccggtgggtgctgtgggtctattggacagacctggcctttgggaagccaaggctgtccccacacgggctggtctggtgtgggcaacaaggcccgctctgcacccaggcctgcctccatccaacacaatgaggaagtcaccctacactggagggatggtgacgagacgtcaccgcagaggcggcagaagggataaaggggaggtagggatgaatagggc

SEQ ID NO: 198346 - DNA, 601 bp, Human
ctgacgtggaagtagagaacgggcagctgttttttttacaagaaacttttgcaccttcctaattttctttttgctcagaataagggctgattttcatgtgccatccctgtcatcacccgcatcttcagcctgcagcgcgtagggaggactccccatgggcgggcaggactctggacctgagaattgcacaggatggtttccaagagggtttacatgctcccccgccccccgccccctgcccacagacctgctcttaccacatcaagatcttagttcaatgtatcgattcattcttatcgarcatgtaaaggtccccggtgggtgctgtgggtctattggacagacctggcctttgggaagccaaggctgtccccacacgggctggtctggtgtgggcaacaaggcccgctctgcacccaggcctgcctccatccaacacaatgaggaagtcaccctacactggagggatggtgacgagacgtcaccgcagaggcggcagaagggataaaggggaggtagggatgaatagggccctggtgttcgggatgggacgggccaccccgggctgagatggaagctcaggggactggggtctgcacag

SEQ ID NO: 198347 - DNA, 601 bp, Human
acgtggaagtagagaacgggcagctgttttttttacaagaaacttttgcaccttcctaattttctttttgctcagaataagggctgattttcatgtgccatccctgtcatcacccgcatcttcagcctgcagcgcgtagggaggactccccatgggcgggcaggactctggacctgagaattgcacaggatggtttccaagagggtttacatgctcccccgccccccgccccctgcccacagacctgctcttaccacatcaagatcttagttcaatgtatcgattcattcttatcgagcaygtaaaggtccccggtgggtgctgtgggtctattggacagacctggcctttgggaagccaaggctgtccccacacgggctggtctggtgtgggcaacaaggcccgctctgcacccaggcctgcctccatccaacacaatgaggaagtcaccctacactggagggatggtgacgagacgtcaccgcagaggcggcagaagggataaaggggaggtagggatgaatagggccctggtgttcgggatgggacgggccaccccgggctgagatggaagctcaggggactggggtctgcacagggc

SEQ ID NO: 198348 - DNA, 601 bp, Human
atgtgccatccctgtcatcacccgcatcttcagcctgcagcgcgtagggaggactccccatgggcgggcaggactctggacctgagaattgcacaggatggtttccaagagggtttacatgctcccccgccccccgccccctgcccacagacctgctcttaccacatcaagatcttagttcaatgtatcgattcattcttatcgagcatgtaaaggtccccggtgggtgctgtgggtctattggacagacctggcctttgggaagccaaggctgtccccacacgggctggtctggtgtggrcaacaaggcccgctctgcacccaggcctgcctccatccaacacaatgaggaagtcaccctacactggagggatggtgacgagacgtcaccgcagaggcggcagaagggataaaggggaggtagggatgaatagggccctggtgttcgggatgggacgggccaccccgggctgagatggaagctcaggggactggggtctgcacagggctggacagatgggagggtctgcagggataaagtgggagggggggcggtgcaacggagggagccgggcaaacaaaggctcagaagcagaggagc

SEQ ID NO: 198349 - DNA, 601 bp, Human
tcattcttatcgagcatgtaaaggtccccggtgggtgctgtgggtctattggacagacctggcctttgggaagccaaggctgtccccacacgggctggtctggtgtgggcaacaaggcccgctctgcacccaggcctgcctccatccaacacaatgaggaagtcaccctacactggagggatggtgacgagacgtcaccgcagaggcggcagaagggataaaggggaggtagggatgaatagggccctggtgttcgggatgggacgggccaccccgggctgagatggaagctcaggggackggggtctgcacagggctggacagatgggagggtctgcagggataaagtgggagggggggcggtgcaacggagggagccgggcaaacaaaggctcagaagcagaggagcccagcccagggacacaaaaggtattcacatccttccattcggtggccaccacagcttaattaagccaaaggaagggcaggggcatgcgggctgggggcggagcggctactggagcagctgcttctccattttcggaactgcacgtcgttctggggcccaattattctacctaaaactgatctgagtgacacc

SEQ ID NO: 198350 - DNA, 601 bp, Human
cagaggtctcagctctgaccgaagggtgctgagccctaaggtctgtacggggagtttctaaaagtctacgctgtaccccaagaaggggacgggtggggcagcagccctggaggaaaacccgtgagcgagtcgtggagggagtgtgagggtttttggggagtgaactttgcagagggtgctgggagcagccggcccgaggacaccgctgactggggtgcaggggccacgggtcgcacgtggggtgtcagctctgccgcctcacttggggttgatttgaaatctcaagatgtgtctgaaaacmccccctggagaagcgaggggcccactgggaacgggaaggcctgagcaagacagacgcatgcccggggcgaggaaggggagcctggaaatccaccctcagaagaatcagacacgttttctagactttccccttcacatttcagcttcacgtttggggctcacttaacaatttgtatatttgttctccttgaatctggtagagaataagaaatccctgggatggggacagaaataattctgaaactcacacaccagctccagtttccatccaatttagtattttgttttgcaaaaaaatctg

SEQ ID NO: 198351 - DNA, 601 bp, Human
gtctgaaaacaccccctggagaagcgaggggcccactgggaacgggaaggcctgagcaagacagacgcatgcccggggcgaggaaggggagcctggaaatccaccctcagaagaatcagacacgttttctagactttccccttcacatttcagcttcacgtttggggctcacttaacaatttgtatatttgttctccttgaatctggtagagaataagaaatccctgggatggggacagaaataattctgaaactcacacaccagctccagtttccatccaatttagtattttgttttgcaaaaaaatctgcattgtatttcctcccactcaggaacatccgatctctggtttcagggtgcgttttacaggccaggaaaggtgattccaggtcgggaaaggccattccaggaagattgcgttattgtccactctcctgcatcatcgtcttcaccaaaaaagctgaaagcgacgaaacgcctacccagagggcaaatccagcttccgctctcctcagaggcactcagtccagttatacatcaatgtgagaatagtcccagcacttatcacttgtaaactcttttaattgattagctattaaa

SEQ ID NO: 198352 - DNA, 601 bp, Human
aatccctgggatggggacagaaataattctgaaactcacacaccagctccagtttccatccaatttagtattttgttttgcaaaaaaatctgcattgtatttcctcccactcaggaacatccgatctctggtttcagggtgcgttttacaggccaggaaaggtgattccaggtcgggaaaggccattccaggaagattgcgttattgtccactctcctgcatcatcgtcttcaccaaaaaagctgaaagcgacgaaacgcctacccagagggcaaatccagcttccgctctcctcagaggyactcagtccagttatacatcaatgtgagaatagtcccagcacttatcacttgtaaactcttttaattgattagctattaaatggcataagatcaatccaagtttaaacctgtatatcaaatccacattccacaaactctgtagtgaattatgtattttaaaacatgtagctttactggctaatgtaatcgtctgcgaatcttcccatctgttcttcaagtcactgtacctggaggcgcacactagcacagacccagacactcaattctggggctgcattattatcctgtacattaaaaaa

SEQ ID NO: 198353 - DNA, 601 bp, Human
cctgggagagaagagacagccaggcggcgagggacttgtcctgtggaggcctccccaggaggcgagggtggggggactcctgctggaggcggccggcagatcagccttccttatccacgtcctcgaagtgatccccgtttgacatttggaaatgactttcatctgctgggtcctcctcggtttgacgtgcaattgcttttcccgaagctttctcctcttgtaacacccagctcctgcatgccgtggcggctccagccatcattcctcatcccaccaccccgcgcagcgtcttgcctccttktatgccggtgtacgtgttgtgttaagagctgggctttgccatttttgacaggctaatgcatttcaccacagataatgccattcaccacagaggcgcattctctctcgtgcccatcaaggcagaggctgagaagaaggtctgctttacagcaacggcctgaggaccctcggccccaaggtgaggccccgcgcaggtacctctgtacacgcctgtggagtcccaccctgtcgtgtgcacgaggctgtcacctggagattccggccctgccgggcgtctcctcccacgccgagctcctcctgc

SEQ ID NO: 198354 - DNA, 601 bp, Human
tgtgagcacccatcctcctcccggggcccagccctcttccttggctgctggagtgcagggtgagcacgtctggaagaagcctgcagcccccacctcctttcctgcgcccctccttgtgtgtagcaggaagtggcttccttaggaagcagttattcgagtcatacccaggtgtgaaaagctaccaaggtcaaggcaaacataggaatggcctagtgccaaaatgaagccacagaattcagccctccacattttatgtctcagactttccaattttttttttatttccaaatatctcactgcrtggtctctgtgattttaattaagtctgatctaatgactactgtctgatggggggagtggcttgctgtaccccaacgagcagcatgcttctgttttatgtttagaggtttctctggccacctttcgagacttcattgttctctgaagatcgagctctatctctcaggagctgtatctgaggaagcattttgggcaaaacggcaggatgtacactgcttttggaaactgcatctgtgaacacttcagatttatgagaaaaatgcacttcaaaggggcactttccagaaaaacgttcagactc

SEQ ID NO: 198355 - DNA, 601 bp, Human
aaattctgcaggagtctctgccctcatgtcggggaagggagagtgggctggcagaatactaaacttgctgctcaaagatgatcaaagcctcaaggaaatggatgcaacattcaaagagactccgagagaaaaggaggagaatgtcttctaatcatctaacaacttatttttggcacagtttttacccaatcaccttccatagaaataggacacctacatgaaaaaagaatgcataaagtatactggtaccaaaaatcacaattcttccatgtcttcacattatccttagtgtgtgtgtgtrtacatgtgtgtataaatatatatatacacacatatatgcatatatgacaggctatgccaatttgaaaaaaaagaataaaagtcaataaaattggatttttacatcatgaagtacagaattaatccaaatatatcatgttttatctatttagaagaaaaaacaacatttactaaaacaatggggagaagtttggtgcgagtagtctgttaaacaaatgacctttaagaatatatttcagttattctgaaagttaatacacccaatttttgctccagtctgagcaaattaaacttggctgga

SEQ ID NO: 198356 - DNA, 601 bp, Human
cttccatgtcttcacattatccttagtgtgtgtgtgtgtacatgtgtgtataaatatatatatacacacatatatgcatatatgacaggctatgccaatttgaaaaaaaagaataaaagtcaataaaattggatttttacatcatgaagtacagaattaatccaaatatatcatgttttatctatttagaagaaaaaacaacatttactaaaacaatggggagaagtttggtgcgagtagtctgttaaacaaatgacctttaagaatatatttcagttattctgaaagttaatacacccawtttttgctccagtctgagcaaattaaacttggctggattatctgatggggttgatatcctggtaagtgtcaaaaatatgagagtctgtcaaaaaagatttgcttttccaataggtaaggcaaacaaaaatatcacactcatgtaaatgaagaaagctctaacatcctgaccctgtccatgaaatagttctattttgaggaaaaacaggtaaacatgtttgaaggtgtttgcattagaagctagtaattcaatctccttactgcttcaaaactattttaagaaaagctctcttactcccca

SEQ ID NO: 198357 - DNA, 601 bp, Human
accctgtccatgaaatagttctattttgaggaaaaacaggtaaacatgtttgaaggtgtttgcattagaagctagtaattcaatctccttactgcttcaaaactattttaagaaaagctctcttactccccaggagcacaacgtgggccccctgtggtcccaagcccaggctctgactcacacacacaggggtcggggcgggggggttctgtacaagcactaatgatgtgcgtgcattatcagggctgaggcggacaaatgctttagcagaggttggcaacatgagggccccccaggtcaygcgggaagtgccttgccaggacactaacccagctgctgtttaacagaggacatgaggattcaccttttggaaccccagggaggacgcagctctacaccctgaggccaccagtgccccccaggataccacctccacgcacccgtctcctccactccatcagaacacctctgctcctgaccttcctttccccaggtaagaacacaagttcttttgtttaaagtgtaacttcatattctgatattaataaaacttatgatattgccacctaccattctctctctccgaggttacctacctctc

SEQ ID NO: 198358 - DNA, 601 bp, Human
tttggaaccccagggaggacgcagctctacaccctgaggccaccagtgccccccaggataccacctccacgcacccgtctcctccactccatcagaacacctctgctcctgaccttcctttccccaggtaagaacacaagttcttttgtttaaagtgtaacttcatattctgatattaataaaacttatgatattgccacctaccattctctctctccgaggttacctacctctcacctaccttgcacaataatctttttatttttcagaagctttaagacaatgaattgagtagttccarcatgtccccatgaaataaagcataagatcaaattgttccattttccttgtaacccagtgatgagagttatcatccacaacctcactgtgattatagaatcagcaaagtacacaggttcagtgagccagaaataaatacattaatgcgagaagacacctttcctgaaatttgttttatgtttgcaatattttaaaaaacttttcaaacagatttttacacttcacaggggactcatggctgtgatagaaaacccaagtgagatatggatacgttaatgaattaatacctgcttcatttacc

SEQ ID NO: 198359 - DNA, 601 bp, Human
gtaacttcatattctgatattaataaaacttatgatattgccacctaccattctctctctccgaggttacctacctctcacctaccttgcacaataatctttttatttttcagaagctttaagacaatgaattgagtagttccagcatgtccccatgaaataaagcataagatcaaattgttccattttccttgtaacccagtgatgagagttatcatccacaacctcactgtgattatagaatcagcaaagtacacaggttcagtgagccagaaataaatacattaatgcgagaagacayctttcctgaaatttgttttatgtttgcaatattttaaaaaacttttcaaacagatttttacacttcacaggggactcatggctgtgatagaaaacccaagtgagatatggatacgttaatgaattaatacctgcttcatttaccaaagtaaatatcctttccttgtaaccgcaattgtctgagtccttgacacgttactcagctaacttcaaagtgaacaatcatacagtcccatcctcactactgcgtcctgctccgccaaaacacaaatcacaacaacacaatggttcggcacctaga

SEQ ID NO: 198360 - DNA, 601 bp, Human
attgccacctaccattctctctctccgaggttacctacctctcacctaccttgcacaataatctttttatttttcagaagctttaagacaatgaattgagtagttccagcatgtccccatgaaataaagcataagatcaaattgttccattttccttgtaacccagtgatgagagttatcatccacaacctcactgtgattatagaatcagcaaagtacacaggttcagtgagccagaaataaatacattaatgcgagaagacacctttcctgaaatttgttttatgtttgcaatattttaaaaaacttttcaaacagatttttacacttcacaggggactcatggctgtgatagaaaacccaagtgagatatggatacgttaatgaattaatacctgcttcatttaccaaagtaaatatcctttccttgtaaccgcaattgtctgagtccttgacacgttactcagctaacttcaaagtgaacaatcatacagtcccatcctcactactgcgtcctgctccgccaaaacacaaatcacaacaacacaatggttcggcacctagaactttctcaccgggaaacaatccaccgtgatggggc

SEQ ID NO: 198361 - DNA, 601 bp, Human
agctttaagacaatgaattgagtagttccagcatgtccccatgaaataaagcataagatcaaattgttccattttccttgtaacccagtgatgagagttatcatccacaacctcactgtgattatagaatcagcaaagtacacaggttcagtgagccagaaataaatacattaatgcgagaagacacctttcctgaaatttgttttatgtttgcaatattttaaaaaacttttcaaacagatttttacacttcacaggggactcatggctgtgatagaaaacccaagtgagatatggataygttaatgaattaatacctgcttcatttaccaaagtaaatatcctttccttgtaaccgcaattgtctgagtccttgacacgttactcagctaacttcaaagtgaacaatcatacagtcccatcctcactactgcgtcctgctccgccaaaacacaaatcacaacaacacaatggttcggcacctagaactttctcaccgggaaacaatccaccgtgatggggcaaacccccactttaatcaaagtacttccctaaagggcattttgtggtgatttcaaagctaaaccaaccagaaagtctt

SEQ ID NO: 198362 - DNA, 601 bp, Human
ttgtctgagtccttgacacgttactcagctaacttcaaagtgaacaatcatacagtcccatcctcactactgcgtcctgctccgccaaaacacaaatcacaacaacacaatggttcggcacctagaactttctcaccgggaaacaatccaccgtgatggggcaaacccccactttaatcaaagtacttccctaaagggcattttgtggtgatttcaaagctaaaccaaccagaaagtctttacactcatttcatttccaaattttcctagatcacatttttaaagaaaaaaagtttttttycctttttattaatctggattgaagaaaagcacacatttcatttattgtctggattacagattcttattaaacaaaccggagctcattataaaatcaatatcaacttaaccaccatgccctcaggaggaacagcaaaaaggtcactccaagaaattcaaacaattttcctgctggaagggcatgattttaattacagatactattaattagagctgtcactgggaaggcttttttttttctgttaattatcacaaactcagtcctaagtatgcattttcaacctgcagtttttttttcaaa

SEQ ID NO: 198363 - DNA, 601 bp, Human
cagaaagtctttacactcatttcatttccaaattttcctagatcacatttttaaagaaaaaaagtttttttccctttttattaatctggattgaagaaaagcacacatttcatttattgtctggattacagattcttattaaacaaaccggagctcattataaaatcaatatcaacttaaccaccatgccctcaggaggaacagcaaaaaggtcactccaagaaattcaaacaattttcctgctggaagggcatgattttaattacagatactattaattagagctgtcactgggaaggcttttttttttctgttaattatcacaaactcagtcctaagtatgcattttcaacctgcagtttttttttcaaattagtcatttctgcatgcaagtccaacctttccattctatcaatattttatatttgaatttcaaagtatatcaaagggcgccacgctttctaaaaatctctgcctgtatgatcttccgtctctcacgcatggaacagaactggtgtgataatttatttatgtactgacacagacttggcctgaagacctggcatcctacattgaaggtcttgctcaatggaatttctgg

SEQ ID NO: 198364 - DNA, 601 bp, Human
aaaagtttttttccctttttattaatctggattgaagaaaagcacacatttcatttattgtctggattacagattcttattaaacaaaccggagctcattataaaatcaatatcaacttaaccaccatgccctcaggaggaacagcaaaaaggtcactccaagaaattcaaacaattttcctgctggaagggcatgattttaattacagatactattaattagagctgtcactgggaaggcttttttttttctgttaattatcacaaactcagtcctaagtatgcattttcaacctgcagkttttttttcaaattagtcatttctgcatgcaagtccaacctttccattctatcaatattttatatttgaatttcaaagtatatcaaagggcgccacgctttctaaaaatctctgcctgtatgatcttccgtctctcacgcatggaacagaactggtgtgataatttatttatgtactgacacagacttggcctgaagacctggcatcctacattgaaggtcttgctcaatggaatttctggataaattcttactagtttatgtgacatttttttcaggctgcttcttcaaacgtgatttt

SEQ ID NO: 198365 - DNA, 601 bp, Human
atttatgtactgacacagacttggcctgaagacctggcatcctacattgaaggtcttgctcaatggaatttctggataaattcttactagtttatgtgacatttttttcaggctgcttcttcaaacgtgattttccttttgctttgaagcaaagctatgcactgcaactgaaatgccagcctcaacacatttgaagttgccatttctttgtaagaaaaagatcgtcctgaccgggctggtgaccctctccagaaaactggaggcttcctccattcaatggcaataccaggaattttgaaaygggaggaaaagctgtcttgtggtcaatctcttttaagcatagagattgtgtaaattccttatgtgggggagggtcctgagagctcacagagtatagaaaagctagctccaaggagctcaggcagcaggagggtatggtgctggagggcgctttgtggagagagcttgagagcccacccatgtaactctgatgatggaataataatatttactttacatacgactgtaaaaatgatgaattatttacaagacgtattgcacactgtaatcatgtgactagagaaaacaaaggatccagtcc

SEQ ID NO: 198366 - DNA, 601 bp, Human
ttctttgtaagaaaaagatcgtcctgaccgggctggtgaccctctccagaaaactggaggcttcctccattcaatggcaataccaggaattttgaaatgggaggaaaagctgtcttgtggtcaatctcttttaagcatagagattgtgtaaattccttatgtgggggagggtcctgagagctcacagagtatagaaaagctagctccaaggagctcaggcagcaggagggtatggtgctggagggcgctttgtggagagagcttgagagcccacccatgtaactctgatgatggaataatmatatttactttacatacgactgtaaaaatgatgaattatttacaagacgtattgcacactgtaatcatgtgactagagaaaacaaaggatccagtccaatgaggaaatcttacacatgtactgaccaaacttttaaaacagtggttaaggagtcatcctaccttcccagatgggaatatcttctcggaattaaatgatattttatatgcaaaggaatcaaacgccttgactggtgtaagtattctgggcttatgctgctgttaaaaccgaaggcctatgttcattacaggacaatactaa

SEQ ID NO: 198367 - DNA, 601 bp, Human
atggcggaggcagtagatgaggccagaggccaggaggacgcccaggatgcaggcgagggagaccagggtgagcgcgatgaacttggtggagtcttcttgctccgcctgaggaggcaggaacttgagtttgcttttctgcagaacaaggagagaggggtgtgttagctcctgacaaagcatgacctcctaaaaacacacgtctccaaatgcaacttgaaagtggaaagctcagccccacaggacgctgtgctggccctggagccacaacgggagggccctgcggaacaacccccgtcaaagragaagcagaaatcatttgaaaatagcacatcgcagattgcagcgtgctcaagaggacagtcagaggcatcactttttccttcagtggtggctgtttttcaaatttatgtaacgtatttggcagctaatttgctgccttaagtaaagtatccatcccttcttctaaccgggcacagcagtttgtccagagcttgcacaatgattgtcgggggtgctggggggaggccaggcttggcggtggaggagggtgggcaggcccggagccttctgcagcttcaagtagccaccaagtccagcacat

SEQ ID NO: 198368 - DNA, 601 bp, Human
aaggtcaaagaaaaatgtcaaggagagcgattgcctggagagctcctggctctcctcccgggtccccgctgggtcccaggagtccccggaggggaagcaaggagccccagtgccctggagtcctgtctccaccaacctcgcccggctccctgctgcctaggcccgcgctgtcccagcagaggaggggtgggagccgccccaggcccacctccccgcgccggtccacaaggaggcccctcctgcaacctgggagaggccgggggaggcccggagggcgaccgcgcggggccgcgggacctgkacagccggggagtcgtgaccgcgggcagcgccggggctgagggcgaggagggtcttactgcagggaagggcgggacgctggacagagggaccgactggggtccaccggcctgacacagaagtcgctggatcccagggcccggctgggaaacccgcttcctacccgcccgcgggcgccgcagaagaaaccgaagaaagaggtcttccctccacgcccaggacggtttcaagtgtcccacccagcgctgagcaggagggtgatgcggagggaaaaactgttggctgcaagtcaggtcttagg

SEQ ID NO: 198369 - DNA, 601 bp, Human
gaggaggggtgggagccgccccaggcccacctccccgcgccggtccacaaggaggcccctcctgcaacctgggagaggccgggggaggcccggagggcgaccgcgcggggccgcgggacctggacagccggggagtcgtgaccgcgggcagcgccggggctgagggcgaggagggtcttactgcagggaagggcgggacgctggacagagggaccgactggggtccaccggcctgacacagaagtcgctggatcccagggcccggctgggaaacccgcttcctacccgcccgcgggcgccrcagaagaaaccgaagaaagaggtcttccctccacgcccaggacggtttcaagtgtcccacccagcgctgagcaggagggtgatgcggagggaaaaactgttggctgcaagtcaggtcttaggaatcccggaagaaacgaagatttaaagaatttttttctaagtgattgagttccaataactttacaatgacttgactccctttttgtggagttaaaaaaaatcttcaaactcctgctagccatggcctttaagagaaagaaatgagtttaaaagtgagtttgaggcacagtcttgaccc

SEQ ID NO: 198370 - DNA, 601 bp, Human
cattacaaaatcttttcagaagctattatcagagcaagaggcactgcggtctgaattcagggtgggagaagccctttgtgcaactgaaagctattgttcctccgtgcagatgaaattgtacttgcaaatctgccattcaagtggccaaaaaacccaaaaaagcaaaagaaaagaatcttcaaggaaaaattattcttaaatgtaaactttaatgaaaataagttgggatatactgttttaaaatgggctatttgttgagtttttccaggcatacacttaaaagtgaatatacaagaaaggyaataaattgtctatttgccatctttaagcactcctaaaacatcagttttaaagaaatactgtgttttaagacatcagggaagatttatgatactgatgtccaaagggggaagcacccttgtgcaaactaattctaaccagcagattgcctccggtgggagagagggacccagaggctgagcaggggaaggatgcccctgagaaagccgcccccagcctctttcagactctccgctggcgttttcatgacacccaaactcagactcagcggatcacacttaaggcaccggctcctgacccc

SEQ ID NO: 198371 - DNA, 601 bp, Human
tccctgcgcccgggacagctggagacggcggcccgcgccactcgacgcccctcccgccgcacacccggctgcccgcggcgcccgctcccggcccctccggggccaactcctccacaccccccacctccccaggccaggcccaggcggcgcttccacagtctcccctcccctcccttgcactctggcgctgcccctagacctgctcggtgcagagggccttgcctggcgcttttctctcacaaacctagttctgtaaaacctgggggcgagccccagggggcagggctcagaggcgggggtkgtccacagatatgagtacggtgccgtccgctgcaggcccctgtctaaaagtggccgaaggaccccgtttcctctgactgcaggcccaggctgagttccgcatttatttttgtatttatagggcaaggccagagcgcttcataaagctccagggcaaagaagtggcctcgcatcgggccatggttcccgcaggcctgagcgggctgcaggaggcccggtgcggctcggcgggggcgcgagaggcgagaaactgcggcgtcactggcgtcctctgcccatgagtgaacccctccagtaggcg

SEQ ID NO: 198372 - DNA, 601 bp, Human
caaggcggagcctagtacaggccagagagctggttttgctttcttcacagacatgacctgacagtgaatacacaaataaatacaattcttttcgttagtcccttcttccgttgtctcagtgtttcacttccaacatcaaagcaccgcattcctgatttgatcttaatttaatgacctgtctttctagtgctttgaggaaagatgggtgggaggtggcaccaattcagttcaatttgggtcactttaaaaatcgtgagagggcctgaaaggttccatgcgggttcaccagcagaacagcacmcttcctcgtccacgccttggtgcacctgcggcaatatattctgggtggcagacggttatttatgtctgagagcctccaactcactccccttcctcccaccacccctcctctaaggtgcggcctgacctcagtggggctgcagaactggcctcgccaaagctgaaggcggacccacactctaagccctagagtctaggggggtcatgagaagaacgcgtttgtatttgaggtgctggttcttttagtctattgcttcagaaactggtaagttactcgccagatttccattctatttttctt

SEQ ID NO: 198373 - DNA, 601 bp, Human
atactgggtcttggcagagccctcaccatctacccatgcatactggatcttagtagagccctcaccatctacccatgcatactggatcttagtagagccctcaccatctacccatgcatactgggtcttagtagagccctcaccatctacctatgcatactggatcttggcagagccctcaccgtctacccatgcatactgggtcttagcagagccctcaccgtctacccatgcatactggatcttggcagagccctcaccatctacccatgcatactggatcttggcagagccctcaccrtctacccatgcatactgggtcttggcagagccctcactgtctacccatgcatactggatcttggcagagccctcaccgtctactcatgcatactgggtcttggcagagccctcaccatctactcatgcatactgggtcttggcagagccctcaccatctacccatgcatactggatcttagcagagccctcaccatctacccatgcatactgggtcttggcagagccctcaccatctacccatgcatactggaagcagagtttatcccacaggacaaattcatgaactgggaagattttt

SEQ ID NO: 198374 - DNA, 601 bp, Human
ggtcttggcagagccctcaccatctacccatgcatactggatcttagtagagccctcaccatctacccatgcatactggatcttagtagagccctcaccatctacccatgcatactgggtcttagtagagccctcaccatctacctatgcatactggatcttggcagagccctcaccgtctacccatgcatactgggtcttagcagagccctcaccgtctacccatgcatactggatcttggcagagccctcaccatctacccatgcatactggatcttggcagagccctcaccatctacmcatgcatactgggtcttggcagagccctcactgtctacccatgcatactggatcttggcagagccctcaccgtctactcatgcatactgggtcttggcagagccctcaccatctactcatgcatactgggtcttggcagagccctcaccatctacccatgcatactggatcttagcagagccctcaccatctacccatgcatactgggtcttggcagagccctcaccatctacccatgcatactggaagcagagtttatcccacaggacaaattcatgaactgggaagatttttaagata

SEQ ID NO: 198375 - DNA, 601 bp, Human
accatctacccatgcatactggatcttagtagagccctcaccatctacccatgcatactggatcttagtagagccctcaccatctacccatgcatactgggtcttagtagagccctcaccatctacctatgcatactggatcttggcagagccctcaccgtctacccatgcatactgggtcttagcagagccctcaccgtctacccatgcatactggatcttggcagagccctcaccatctacccatgcatactggatcttggcagagccctcaccatctacccatgcatactgggtcttrgcagagccctcactgtctacccatgcatactggatcttggcagagccctcaccgtctactcatgcatactgggtcttggcagagccctcaccatctactcatgcatactgggtcttggcagagccctcaccatctacccatgcatactggatcttagcagagccctcaccatctacccatgcatactgggtcttggcagagccctcaccatctacccatgcatactggaagcagagtttatcccacaggacaaattcatgaactgggaagatttttaagataagattttgccacattgct

SEQ ID NO: 198376 - DNA, 601 bp, Human
atactggatcttggcagagccctcaccgtctacccatgcatactgggtcttagcagagccctcaccgtctacccatgcatactggatcttggcagagccctcaccatctacccatgcatactggatcttggcagagccctcaccatctacccatgcatactgggtcttggcagagccctcactgtctacccatgcatactggatcttggcagagccctcaccgtctactcatgcatactgggtcttggcagagccctcaccatctactcatgcatactgggtcttggcagagccctcaccrtctacccatgcatactggatcttagcagagccctcaccatctacccatgcatactgggtcttggcagagccctcaccatctacccatgcatactggaagcagagtttatcccacaggacaaattcatgaactgggaagatttttaagataagattttgccacattgcttatgttagatataacataagcaatgcaaatgtaagcagtgcaaatgtaagatatagctataaaatcaatgcccttattttaaaattgagaaatgctaaaattattttttcaaattatttcactttatttcaa

SEQ ID NO: 198377 - DNA, 601 bp, Human
aaagcccggtcggtgctggtgtaactgacacgggctgtgggtttgtaagagagccgggtaggtgctggtgtaactgacgcgggctgtgcatttataagaaagcccggtcggtgctggtgtaactgacgcgggctgtgggtttgtaagagagccgggtaggtgctggtgtaactgacgcgggctgtgcatttataagaaagcccggtcggtgctggtgtaactgacgtgggctgtgcatttataagaaagcctggtcggtcctggtgtaactgttgcgggctctgcctttgtgtgaaagccyggtcggtcctggtgtaactgacacgggctgtgggtttgtaagagagccgggtaggtgctggtgtaactgacgtgggctgtgcatttatgagaaagcctggtcggtcctggtgtaactgacgtgggctgtgcatttataagaaagcctggtcggtcctggtgtaactgttgcgggctctgcctttgtgagaaagcccggtcggtgctggtgtaactatgagaaagcctggtaggtgctggtgtaactgacacgggctctgagtttatgagaaagcctggtcggtgctggtgaacatgggtg

SEQ ID NO: 198378 - DNA, 601 bp, Human
ccgtcctgctgctccgcgctgccgaatctgctcctctctcctctggccccgcgtccctcagaaggagctgaggtcagaaggaggtgtctccaggaaacactaggggaccttcatacctgaggggccaaaatagctgttttcaagctgctgctgttggagaccggtcttaggaaggggctgtgatagagctctttgtggaaagccttaaattaagatgaaggggagaaaaggaagtatcgaaagtttggaaaaatagagaaataagaagagctcctaaactgagcctgtggcaaagggagtrtcctgaaattgaacgggctcattcttgaaatgtcagtgtggccggcagcctctgagacggcccagggcctccgtcctcctggaattctctttcctgagcgccactggacctggtgactccactccgatgcctggaggacagcaaaggcagcagagatggctgctaaggacgcacactggggtccccgaccgactttcgagctccgagggatgtctgctgccaggtggtggcggctgatggggaaacctggtggacagggcccatggacaggggctaacagcacagagggcctggggctgc

SEQ ID NO: 198379 - DNA, 601 bp, Human
cagaaggagctgaggtcagaaggaggtgtctccaggaaacactaggggaccttcatacctgaggggccaaaatagctgttttcaagctgctgctgttggagaccggtcttaggaaggggctgtgatagagctctttgtggaaagccttaaattaagatgaaggggagaaaaggaagtatcgaaagtttggaaaaatagagaaataagaagagctcctaaactgagcctgtggcaaagggagtgtcctgaaattgaacgggctcattcttgaaatgtcagtgtggccggcagcctctgagayggcccagggcctccgtcctcctggaattctctttcctgagcgccactggacctggtgactccactccgatgcctggaggacagcaaaggcagcagagatggctgctaaggacgcacactggggtccccgaccgactttcgagctccgagggatgtctgctgccaggtggtggcggctgatggggaaacctggtggacagggcccatggacaggggctaacagcacagagggcctggggctgccgctgctgagctgagaggacaccctcagcacagcctatagggacgcagctggaacccc

SEQ ID NO: 198380 - DNA, 601 bp, Human
cagccaggcagaggcacctgcaggaggtgaaaggcaagttcccggccagcctggtggggttcctgcggtccaacccccacctcagcacgctcccctcactccccgcggccgcttgtcctctgccgctgctctggatttgggattccgagactggcaggtcaggaggcccggaaaactacatttgcctcactctggttctccggggctgtggtgaggctgcctctcccctgccctccactttctctttccctgtaatatttatgtagctgagtgcagcaaacattttgaatgcgtgatcacygtggggctcagggccctctgaagctctcactcgcccaaagctgacggcctctgttttttccagctgcagctccgggtgccatcctccgcggggtgaggtgccaccaggaatccctttccttagattgtctgatgctgtgagttagaagattcctgtttctactcacacgattgggtgcccagtatacactgccatggtttagaggaagctctgccactaactgtgtgactgaggcaagtggcttcactgccctgtgcctcagtttctctccctgaaaatgggaataaaatgtacttgact

SEQ ID NO: 198381 - DNA, 601 bp, Human
taaggacaattttttcacaattaaaaaaccctcatgaaatgacagtgactgttatcaaatgtctaactctgtgctcgagcactaacctccatgcttgcaggaaggctctttgtgaaactgacaataatcctgtgaggtgagcaccattaaaacctgtacttggccgggcgtggtggctcacgcctgtaatccagcactttgggaggcccagggggcggatcacgaggtcaggagttcgagaccagcctggccaatatggtgaaaccccgtctctactaaaaatacaaaaaaattagctggrcatggtggcatgcgcctgtagtcccagctactcaggaggctgaggcagaagaattgcttgaacccaggaggtggaggttgcagtgagccgagattgtaccactgcactccagcctgggtgacagagtgagactccaaaacaaaacaaaacacaacaaaacaaaaccctccattttccagacaggcaaatgaagcccagagtgacaaggtaacctgcttaaggtcacacagcaggaggcgaggcagggtatgaattgagtgaatctgacgccagagccttctggatcaacatgggccacat

SEQ ID NO: 198382 - DNA, 601 bp, Human
atcaatgtggaccacatccctccagaatgccgggaactgagcaaatctgacccaggtgccttctggatcaaggtggaacacatccttccagaatgccgggaactgagtgaatctgaccccggtgccttccggatcaaggtggaccacatccctccagaatgccagacagatgaaggacacagaaaacttaatagtaaaacatattttctgatacgcaggtacctgggaatctatagattcaggtttagtgctgtgggttgtccttttatacacagcacacataccacaaacacacacagayacagcatacacgcacacacacaaccacattcacatagacaagtacctcgcacacacatacacagaaacacacacaccacacatacacacagacacatacccagcatacttacacacacagcacacacacaaccacattcacacacacataggcatatagtaaacaccaactcaagcacacatcacacgtgcatggacaccccccccacacacgtggagatagagtcgacactatattagcttcccatgaattgatgtcataagctcagttaacatacgtgcccgctaagtacccttcagg

SEQ ID NO: 198383 - DNA, 601 bp, Human
ggtacctgggaatctatagattcaggtttagtgctgtgggttgtccttttatacacagcacacataccacaaacacacacagatacagcatacacgcacacacacaaccacattcacatagacaagtacctcgcacacacatacacagaaacacacacaccacacatacacacagacacatacccagcatacttacacacacagcacacacacaaccacattcacacacacataggcatatagtaaacaccaactcaagcacacatcacacgtgcatggacaccccccccacacacgtggrgatagagtcgacactatattagcttcccatgaattgatgtcataagctcagttaacatacgtgcccgctaagtacccttcagggatggcaatgctaacccgctgtagtttaaaagcttcagggaagacttgatcagtctcggcaggtattacaggcagaggcagatttctttttcctttttttttctttttttttgagacagagtctcactctgtcactaggctggactggagtgcagtgacacgatctctgctcactgcaacctccgcctcctgggttcaagtgattctcctgcctcag

SEQ ID NO: 198384 - DNA, 601 bp, Human
taaaacaaaagtagccacaagagttaacatttctagttttaactctcaaaaataaagtccttgtggattttatgatctcatttcagcaaatgtcactgcaaagtggagatgctatcatcccttagcagtgtgcatctgccttgggccgctggggccagccgctggctgctctgcaaggaagggtccctgtaagcaggacagtggccttccagggctgaggctggagaaaggtgctttgcctcggatgggcaccctttcttttagctctgattctgccccgtgccgtgtgcctctgagtgtygccttcccttctgaagctcaggcacatcctctcctctgctgccagctccctggtgccagttccctcctgcttccattccctgccttccaggcggggtgccaccctgtgtccccttacgattatctctctgcttgtgcaagcatcaccatctgcccacgacccttcagccaggacctgcagcactcagagctggccacagagactcgttccttccacagggactgtccagatcatcctaaaggttgggcagtggtgtgagtggctctcggccattcaggagtacctgcaggtggcagaagg

SEQ ID NO: 198385 - DNA, 601 bp, Human
tatcatcccttagcagtgtgcatctgccttgggccgctggggccagccgctggctgctctgcaaggaagggtccctgtaagcaggacagtggccttccagggctgaggctggagaaaggtgctttgcctcggatgggcaccctttcttttagctctgattctgccccgtgccgtgtgcctctgagtgttgccttcccttctgaagctcaggcacatcctctcctctgctgccagctccctggtgccagttccctcctgcttccattccctgccttccaggcggggtgccaccctgtgtccycttacgattatctctctgcttgtgcaagcatcaccatctgcccacgacccttcagccaggacctgcagcactcagagctggccacagagactcgttccttccacagggactgtccagatcatcctaaaggttgggcagtggtgtgagtggctctcggccattcaggagtacctgcaggtggcagaaggtactccagagttggacggaggggccgtcccagggctctcggtgagactgagaaggttcatgagctccgtgttcctgtctgagatgaccagaaccagggcaggcctcatgtgt

SEQ ID NO: 198386 - DNA, 601 bp, Human
ttccagggctgaggctggagaaaggtgctttgcctcggatgggcaccctttcttttagctctgattctgccccgtgccgtgtgcctctgagtgttgccttcccttctgaagctcaggcacatcctctcctctgctgccagctccctggtgccagttccctcctgcttccattccctgccttccaggcggggtgccaccctgtgtccccttacgattatctctctgcttgtgcaagcatcaccatctgcccacgacccttcagccaggacctgcagcactcagagctggccacagagactcrttccttccacagggactgtccagatcatcctaaaggttgggcagtggtgtgagtggctctcggccattcaggagtacctgcaggtggcagaaggtactccagagttggacggaggggccgtcccagggctctcggtgagactgagaaggttcatgagctccgtgttcctgtctgagatgaccagaaccagggcaggcctcatgtgtgccccaacttccgtaaaaccacacacgcatagtcacaagcggctccctgctttatgcattctaaagcaattcagcattccacatgaaaacgcag

SEQ ID NO: 198387 - DNA, 601 bp, Human
aagcatcaccatctgcccacgacccttcagccaggacctgcagcactcagagctggccacagagactcgttccttccacagggactgtccagatcatcctaaaggttgggcagtggtgtgagtggctctcggccattcaggagtacctgcaggtggcagaaggtactccagagttggacggaggggccgtcccagggctctcggtgagactgagaaggttcatgagctccgtgttcctgtctgagatgaccagaaccagggcaggcctcatgtgtgccccaacttccgtaaaaccacacaygcatagtcacaagcggctccctgctttatgcattctaaagcaattcagcattccacatgaaaacgcagccgtgacggcactgtgtgattgataatgctctccgtgagacttacgggtccataaaccaaagaatggctataatcacccacaggtccatcatttctttatcctttacatcaaacatgagatggtcatagtcacaattcaataacaagccacgtatggctccatgaaagccaccagtgagagctgaacgtgctctcccagctactcttctctactagagcctgcaccccaccg

SEQ ID NO: 198388 - DNA, 601 bp, Human
tcaggagtacctgcaggtggcagaaggtactccagagttggacggaggggccgtcccagggctctcggtgagactgagaaggttcatgagctccgtgttcctgtctgagatgaccagaaccagggcaggcctcatgtgtgccccaacttccgtaaaaccacacacgcatagtcacaagcggctccctgctttatgcattctaaagcaattcagcattccacatgaaaacgcagccgtgacggcactgtgtgattgataatgctctccgtgagacttacgggtccataaaccaaagaatggytataatcacccacaggtccatcatttctttatcctttacatcaaacatgagatggtcatagtcacaattcaataacaagccacgtatggctccatgaaagccaccagtgagagctgaacgtgctctcccagctactcttctctactagagcctgcaccccaccgactttgaaaagagataactgtcacctgggaaccgacactcctgctggggaggggaagccacctggggctggagactacagtctggaccctcaggcggcagaggagcgagccgagagagacaactgtggcttctgcc

SEQ ID NO: 198389 - DNA, 601 bp, Human
acttctggctcccagcactgtgggagaataaacgcctgttgtttgaaggcccctaggttcatggtacttggtgagggcggcctcgggcagctcacacatgggccacacagaacgtggctgtgggcgggattgttctgggtgagccatgcgcatcccctgctatcagcaacacagtggactcacactggctctaaaacccctgaggtcgtttccatctgatggtcgcacttgggcagggctcttctggtgccagcgggagaccttactcagaccctcatctccatccacccctcctcctccgagcactgcatggtccaaaagtttactcaacccaatgacgcatctttaattctattattgacaacatcgtggaatataacagaattgaggaatagccccacggcacgtttctagagaacccctttgcacttaatctattttctcctcattaagtaattatttaattaatagcctgtaagaatagtgtacgtaggtagaaatttatctaacggcatgatcgttccaagtctctatcttttcttttggatactttgtaaaaaaaaaaatcattaaaatctatacttgtgatgtcaacagccgt

SEQ ID NO: 198390 - DNA, 601 bp, Human
cgttcctccatctctcagcaagaaatgccatcagcaaagagacggtgtgacgcccggctccctccccgtcactgatacggcctaggatctcaccagggaccaaggcaagcacactggtctgcggttcccacaatctacctgtaaccctttctgaatgtttgtccaactctcttattccggcgtctttcccaactctgccaatccctcagacattcccgacagctgtggccagatccagctttgctacggacacggagccacagaactggtctggacatggagccacagaactggtgagagmcccacgaagcagctctcgtgggctgtgccctccagccctcacatggcacacacctgctgctctgcagagcacgcctcgctccccttcacgaaggagcggaaatacaatggcagccgcgaagctctggctactaagatgcattatctgctccaagctttcaattgagtgattatgtcttaaaagaatcacataaatgatacagctccacattttgaggtgtgtaaagccacgaaggcatcgtcttctatatcttattcttgctgactatatgacgatgacattcttaggtgagctcactac

SEQ ID NO: 198391 - DNA, 601 bp, Human
agaaatgccatcagcaaagagacggtgtgacgcccggctccctccccgtcactgatacggcctaggatctcaccagggaccaaggcaagcacactggtctgcggttcccacaatctacctgtaaccctttctgaatgtttgtccaactctcttattccggcgtctttcccaactctgccaatccctcagacattcccgacagctgtggccagatccagctttgctacggacacggagccacagaactggtctggacatggagccacagaactggtgagagccccacgaagcagctctcgtrggctgtgccctccagccctcacatggcacacacctgctgctctgcagagcacgcctcgctccccttcacgaaggagcggaaatacaatggcagccgcgaagctctggctactaagatgcattatctgctccaagctttcaattgagtgattatgtcttaaaagaatcacataaatgatacagctccacattttgaggtgtgtaaagccacgaaggcatcgtcttctatatcttattcttgctgactatatgacgatgacattcttaggtgagctcactacctcatggcatcaactctgca

SEQ ID NO: 198392 - DNA, 601 bp, Human
ggcctaggatctcaccagggaccaaggcaagcacactggtctgcggttcccacaatctacctgtaaccctttctgaatgtttgtccaactctcttattccggcgtctttcccaactctgccaatccctcagacattcccgacagctgtggccagatccagctttgctacggacacggagccacagaactggtctggacatggagccacagaactggtgagagccccacgaagcagctctcgtgggctgtgccctccagccctcacatggcacacacctgctgctctgcagagcacgcctckctccccttcacgaaggagcggaaatacaatggcagccgcgaagctctggctactaagatgcattatctgctccaagctttcaattgagtgattatgtcttaaaagaatcacataaatgatacagctccacattttgaggtgtgtaaagccacgaaggcatcgtcttctatatcttattcttgctgactatatgacgatgacattcttaggtgagctcactacctcatggcatcaactctgcagagacgtctcacaggtcacgttagaaggctatgaaaaattaaaacacataaaaaacaa

SEQ ID NO: 198393 - DNA, 601 bp, Human
cctcagacattcccgacagctgtggccagatccagctttgctacggacacggagccacagaactggtctggacatggagccacagaactggtgagagccccacgaagcagctctcgtgggctgtgccctccagccctcacatggcacacacctgctgctctgcagagcacgcctcgctccccttcacgaaggagcggaaatacaatggcagccgcgaagctctggctactaagatgcattatctgctccaagctttcaattgagtgattatgtcttaaaagaatcacataaatgatacagstccacattttgaggtgtgtaaagccacgaaggcatcgtcttctatatcttattcttgctgactatatgacgatgacattcttaggtgagctcactacctcatggcatcaactctgcagagacgtctcacaggtcacgttagaaggctatgaaaaattaaaacacataaaaaacaatgtttaaacctgtgtgcatcactgagtttgacagacacagtgtatggatgccagattagttcgttttactgtcagtatagtacagtccgttaaactgcgcatctttgatgagttactacctgtgg

SEQ ID NO: 198394 - DNA, 601 bp, Human
tgccctccagccctcacatggcacacacctgctgctctgcagagcacgcctcgctccccttcacgaaggagcggaaatacaatggcagccgcgaagctctggctactaagatgcattatctgctccaagctttcaattgagtgattatgtcttaaaagaatcacataaatgatacagctccacattttgaggtgtgtaaagccacgaaggcatcgtcttctatatcttattcttgctgactatatgacgatgacattcttaggtgagctcactacctcatggcatcaactctgcagagacrtctcacaggtcacgttagaaggctatgaaaaattaaaacacataaaaaacaatgtttaaacctgtgtgcatcactgagtttgacagacacagtgtatggatgccagattagttcgttttactgtcagtatagtacagtccgttaaactgcgcatctttgatgagttactacctgtggggtggcacctgacccaggccaggacagtctgagtggtccttcctttcgccctgtgcagggctgggcttgcgacctcagtctttcccggcagctctgcttggcagaattgagggatgtctccat

SEQ ID NO: 198395 - DNA, 601 bp, Human
aaagaatcacataaatgatacagctccacattttgaggtgtgtaaagccacgaaggcatcgtcttctatatcttattcttgctgactatatgacgatgacattcttaggtgagctcactacctcatggcatcaactctgcagagacgtctcacaggtcacgttagaaggctatgaaaaattaaaacacataaaaaacaatgtttaaacctgtgtgcatcactgagtttgacagacacagtgtatggatgccagattagttcgttttactgtcagtatagtacagtccgttaaactgcgcayctttgatgagttactacctgtggggtggcacctgacccaggccaggacagtctgagtggtccttcctttcgccctgtgcagggctgggcttgcgacctcagtctttcccggcagctctgcttggcagaattgagggatgtctccattttatccagggcgagctactataggaataacaatggaggcttaagatctgtagaaaaatctatgagtttaggaattgtgattcctgatttttattgagtaaaatgctcaccctaatttcttcaacagaaaatcaatattccaaaccctccagaa

SEQ ID NO: 198396 - DNA, 601 bp, Human
ctccttgctgcaggaccgctggctggggtggccggggcacgcagcaggcacatcccgacctgcgggccagcacctgcgccccatccctgttacacctgttctgaagccttcaagagcaaagactgatgttcatcatggccaaagcagctgggctctttactacggaaggagattaattgctaccccgcgtacctttcagaggtttatatgaagccatttttcggtatttctctaagtgactgaaacatgcgcagccatttcatgtatttctacgcgtgtgggcaggcggccagggccctgrgccacattccccagaaagccacgtctccactctggggaggggaatgcttcgtttttctgtgagtggtgaggtctctcttttaacctgttataaattaccttttgtaatctctcctaaaccattatatagaggagggaggggagacaaagaataaatacatctgtaataaatgtgggatttgggaaagatgataagatcagaacaatttgaatgaacgtggcaaatgaatttagagtttttgaactatcagctatttctgcaaataatgacttgtagaaggagaggctatttttaaaacaa

SEQ ID NO: 198397 - DNA, 601 bp, Human
ctacggtggcttcacagggcgtgtttggagagcgccttcctcctcccaaccctgcagtccccggcctggctccaggtctgccccgcagccctgaggtgagtctcagcatgtccaggcgtctgaggtgacactgcagcctctctccgtggccctgtggtgagtctcagcatgtccaggcatctgaggtgacactgcagcctctctcggtggccccgtggtgagtctcagcatgtccaggcatccgcggtgacactgcagccactctccatggccccagggtgagtctcagcacgtccaggcrtccgcggtgacactgcagccactctccatggccccggggtgagtctcagcacgtccaggcgtccgcggtgacactgcagccactcttggtttctcagctgccgcaatcggtccttccagtgtccgacctctggggccctcagacccccaaacccaccttgtcgctgtggcctctccgcctcctgcaggtggcagcgctactgtagcctgccatgccccaccccttgcctccatccccacacattgccctgtttcttgggcagccatcttctggacctctccctcctgcaggcgtctctgg

SEQ ID NO: 198398 - DNA, 601 bp, Human
cggtggcttcacagggcgtgtttggagagcgccttcctcctcccaaccctgcagtccccggcctggctccaggtctgccccgcagccctgaggtgagtctcagcatgtccaggcgtctgaggtgacactgcagcctctctccgtggccctgtggtgagtctcagcatgtccaggcatctgaggtgacactgcagcctctctcggtggccccgtggtgagtctcagcatgtccaggcatccgcggtgacactgcagccactctccatggccccagggtgagtctcagcacgtccaggcgtcygcggtgacactgcagccactctccatggccccggggtgagtctcagcacgtccaggcgtccgcggtgacactgcagccactcttggtttctcagctgccgcaatcggtccttccagtgtccgacctctggggccctcagacccccaaacccaccttgtcgctgtggcctctccgcctcctgcaggtggcagcgctactgtagcctgccatgccccaccccttgcctccatccccacacattgccctgtttcttgggcagccatcttctggacctctccctcctgcaggcgtctctggccc

SEQ ID NO: 198399 - DNA, 601 bp, Human
atctccggccttcccgcagttgcccgcgtactttcttcattcctcaaaggtctcattaatttacagtctaagtggaccaagagagatgttacatatgttaccaggaagctagcatgttcattaattaatttctgtctagtcatccaatatttattgagtccttaagtctgaggcattataatagttactgctgtggggtcatacagataaataagacatggttcctatttctcagactcatcacccactggtaagacagccaccgatggaaacgactccaatcgactggaaaatagagagraaattcctttggaatttaggggaaagaataagacttttggctggggtgtcagatattcgcttataggagcaatttcttctcagctgcatggcaccaccagggaccaggccccggggccagtccagatatctgcagtgttagcgagagacgctgttgacccttcttggcttatcatggaactgaatttccttaggttcagttggtagctaccctcgccccatcatgccgcggtgacactgcagccactcttggtttctcggctgccgcaatcggtcattccaatgtccgacctctggggcc

SEQ ID NO: 198400 - DNA, 601 bp, Human
catgttcattaattaatttctgtctagtcatccaatatttattgagtccttaagtctgaggcattataatagttactgctgtggggtcatacagataaataagacatggttcctatttctcagactcatcacccactggtaagacagccaccgatggaaacgactccaatcgactggaaaatagagaggaaattcctttggaatttaggggaaagaataagacttttggctggggtgtcagatattcgcttataggagcaatttcttctcagctgcatggcaccaccagggaccaggcccyggggccagtccagatatctgcagtgttagcgagagacgctgttgacccttcttggcttatcatggaactgaatttccttaggttcagttggtagctaccctcgccccatcatgccgcggtgacactgcagccactcttggtttctcggctgccgcaatcggtcattccaatgtccgacctctggggccctcagacccccaaacccaccttgtcactctggcttctccgcctcctgcagctcctgctctgtgtttgggaacgcgtgcggcccacaggacaaagccttgttgcacacccggg

SEQ ID NO: 198401 - DNA, 601 bp, Human
tgggaacgcgtgcggcccacaggacaaagccttgttgcacacccgggtcaagggcaaatcccagctgcacagccgggtgatccagcggccgaccctgcttccctgcgtaggaggcctgagccaaggacactgcggccccggctgcaccgatgcatgggtgtgcacgcggggaccgagggagtcacgtgaatcatgtggcttccacgagctacctcttcccacaccaggagcaggtgccctcgtctccatcaagcgctttctggggagaaactccttcaaggataacggcaaatggtgagcrtgcctcactctttataatagaaattacaaaaagatggagaaacaggcagaatcccacccattcctgtggcaaagccgagaccctcatttccagtctttctgggacagcggagccctgggcaggggacaccgtgtgactggctctagctctcctaaaacacgggacgcaggagtgtttcttaagtgtgacaaggtgaaagcccctcgcgagttgaggaaggtctcattacttctgacagaggccccatgttggggaggtaggtgtgggggctcggggaggtgtcaggacagcgggatggac

SEQ ID NO: 198402 - DNA, 601 bp, Human
tggggagaaactccttcaaggataacggcaaatggtgagcgtgcctcactctttataatagaaattacaaaaagatggagaaacaggcagaatcccacccattcctgtggcaaagccgagaccctcatttccagtctttctgggacagcggagccctgggcaggggacaccgtgtgactggctctagctctcctaaaacacgggacgcaggagtgtttcttaagtgtgacaaggtgaaagcccctcgcgagttgaggaaggtctcattacttctgacagaggccccatgttggggaggtargtgtgggggctcggggaggtgtcaggacagcgggatggacgtgggtccacagagctgactatcacagccgctcaggatgcagccgtggtgtgtgtgctctggcctattttaggtacagatataaaacagaagacttcggggcaaaaggaagtcttagaaaaatataaaggaatagaaagaaacagctgttccccggcacagaaaattcctgctaagaacacacaacgggcacggtgtaggcccattagtgttgctctgggtgctgcatccacaagggagatttgcttcttcagaaatgtc

SEQ ID NO: 198403 - DNA, 601 bp, Human
cattacttctgacagaggccccatgttggggaggtaggtgtgggggctcggggaggtgtcaggacagcgggatggacgtgggtccacagagctgactatcacagccgctcaggatgcagccgtggtgtgtgtgctctggcctattttaggtacagatataaaacagaagacttcggggcaaaaggaagtcttagaaaaatataaaggaatagaaagaaacagctgttccccggcacagaaaattcctgctaagaacacacaacgggcacggtgtaggcccattagtgttgctctgggtgcygcatccacaagggagatttgcttcttcagaaatgtcaggggtgcctggtctgcaaggggcttccctcgtcggaaagtctcccatccacatcccttcatgtgccatgttcgcatcatgagcaatgttgtaatgaacagccacgcacttcattctttgcacatctcaaagaattgtgtccttaggatgaagtgtcaggggacgagtgtccatgccaaagcatctccacacgtcgagagcttcggatgtgcacagctgcgttgcctcctgactgtcagccgagcccagcgtcccaccagcagg

SEQ ID NO: 198404 - DNA, 601 bp, Human
taagaacacacaacgggcacggtgtaggcccattagtgttgctctgggtgctgcatccacaagggagatttgcttcttcagaaatgtcaggggtgcctggtctgcaaggggcttccctcgtcggaaagtctcccatccacatcccttcatgtgccatgttcgcatcatgagcaatgttgtaatgaacagccacgcacttcattctttgcacatctcaaagaattgtgtccttaggatgaagtgtcaggggacgagtgtccatgccaaagcatctccacacgtcgagagcttcggatgtgcrcagctgcgttgcctcctgactgtcagccgagcccagcgtcccaccagcaggagccacagcaccgctgtctgttcccaccgatgcccagtgtcagcgtccactgagtcgcagctcccctctacactgggtgtgcccgagcttgctgcatgggaggaaggtggctgatggcaagggtgtatgtctccacactgtggctgcagcacggtttcctcacagatgtttggggagaggctgagaggacctgcctgccctggagagccgggtttctgcctagggctcctcctgtgctcctgctcccac

SEQ ID NO: 198405 - DNA, 601 bp, Human
gtgtaggcccattagtgttgctctgggtgctgcatccacaagggagatttgcttcttcagaaatgtcaggggtgcctggtctgcaaggggcttccctcgtcggaaagtctcccatccacatcccttcatgtgccatgttcgcatcatgagcaatgttgtaatgaacagccacgcacttcattctttgcacatctcaaagaattgtgtccttaggatgaagtgtcaggggacgagtgtccatgccaaagcatctccacacgtcgagagcttcggatgtgcacagctgcgttgcctcctgacygtcagccgagcccagcgtcccaccagcaggagccacagcaccgctgtctgttcccaccgatgcccagtgtcagcgtccactgagtcgcagctcccctctacactgggtgtgcccgagcttgctgcatgggaggaaggtggctgatggcaagggtgtatgtctccacactgtggctgcagcacggtttcctcacagatgtttggggagaggctgagaggacctgcctgccctggagagccgggtttctgcctagggctcctcctgtgctcctgctcccaccccaggggcctggggctcccg

SEQ ID NO: 198406 - DNA, 601 bp, Human
gtaatgaacagccacgcacttcattctttgcacatctcaaagaattgtgtccttaggatgaagtgtcaggggacgagtgtccatgccaaagcatctccacacgtcgagagcttcggatgtgcacagctgcgttgcctcctgactgtcagccgagcccagcgtcccaccagcaggagccacagcaccgctgtctgttcccaccgatgcccagtgtcagcgtccactgagtcgcagctcccctctacactgggtgtgcccgagcttgctgcatgggaggaaggtggctgatggcaagggtgtrtgtctccacactgtggctgcagcacggtttcctcacagatgtttggggagaggctgagaggacctgcctgccctggagagccgggtttctgcctagggctcctcctgtgctcctgctcccaccccaggggcctggggctcccgctggaggatggtggctttgcagacccttccattttattcatcgtgttacagagcattctaaacctccttccttctagagtagaggctcaggggttaagggatatgtgtcttcaaacgagaacacttcattcaacagacttttcccgaagaccacgtg

SEQ ID NO: 198407 - DNA, 601 bp, Human
acagccacgcacttcattctttgcacatctcaaagaattgtgtccttaggatgaagtgtcaggggacgagtgtccatgccaaagcatctccacacgtcgagagcttcggatgtgcacagctgcgttgcctcctgactgtcagccgagcccagcgtcccaccagcaggagccacagcaccgctgtctgttcccaccgatgcccagtgtcagcgtccactgagtcgcagctcccctctacactgggtgtgcccgagcttgctgcatgggaggaaggtggctgatggcaagggtgtatgtctcsacactgtggctgcagcacggtttcctcacagatgtttggggagaggctgagaggacctgcctgccctggagagccgggtttctgcctagggctcctcctgtgctcctgctcccaccccaggggcctggggctcccgctggaggatggtggctttgcagacccttccattttattcatcgtgttacagagcattctaaacctccttccttctagagtagaggctcaggggttaagggatatgtgtcttcaaacgagaacacttcattcaacagacttttcccgaagaccacgtgctgtgcg

SEQ ID NO: 198408 - DNA, 601 bp, Human
ccaatgcagatggtctcctagctatttttaatgagggaagatttgttggaagcacaaaattgaattaagtcacattcagaaattctccttcaaagaggaactcacacagtcaagctgagaaagccagcatctgaggatagcggagctgctctgtggtgaacatagaatgtggggccctgacggactgtccccttgccctgacgcctctcctggcctctgcccccacactctggcaccagaatgtccacggggacagctctggtctggcctggcctgagctgcaggctctcctgtcacagcrctggctgaatgcctcccctggtgtcccctggcctttccccggctggccacctgtcccccactgagctcacggcttctccctgaaccagcttctactccagtcccaaaccagctccacactgtggctctcggccccgtgcccctctccccacaccagcatgtcactgcgctcgccggctgtgttcccaagcactttctccctcctctcctttctctaccacagcccaggccttcctcacctcatgctcttcacccatccacctgtccatccttgtccccggagacgctgtcatcccaccca

SEQ ID NO: 198409 - DNA, 601 bp, Human
ggggacagctctggtctggcctggcctgagctgcaggctctcctgtcacagcactggctgaatgcctcccctggtgtcccctggcctttccccggctggccacctgtcccccactgagctcacggcttctccctgaaccagcttctactccagtcccaaaccagctccacactgtggctctcggccccgtgcccctctccccacaccagcatgtcactgcgctcgccggctgtgttcccaagcactttctccctcctctcctttctctaccacagcccaggccttcctcacctcatgctcytcacccatccacctgtccatccttgtccccggagacgctgtcatcccacccaagtgacctgccagccactgtggaagttctatgcactgcagatgttaaacgtgaggctttttcctactcagggatgtgcagtcaaattggtgctcagatggagtctgatgaaaggcaagctctggaaggaacacggaccctgagcaagtgtgagagacgtaagccagcaatgaagccatgccccaaagcgaatccaccaccatccaattcccgctcatacacagcaggccagaaagacttccacgctgc

SEQ ID NO: 198410 - DNA, 601 bp, Human
gcagtgattgagcccagacccccgcgaccagctctgctgctggccctgcctgaagctgcagcagcccctgcccttggacccctgagtctgtggggcctgcactgctgcatctctggctgccctgtgcccagaaacccaccctccatccttccacactcagagcctcctcccagctgagcaccctcccctctgctatggggcatctgtgggccccccagctcccaccctgcagacgtctgtgggctctgcctctcccgtctacacctggaggcccagaggggctcctgagggccacctggtrcccggtgggtacccagcgagggtctggcaaggaggtcagctcagctgggcagacacatgcagcccggaggcctggggtgtccgggtcccacgaagccaggagaacacagatggggccgactctgccgcgcggtctcctcactgtgcttcctgcaatcatgccttgtacagcctcctgacaggccaccctcagccccatgtggccagcagcaagggctgctgttgcaccccaagcctctccgtctaggggaagaaggcgcgtgaagatctttctcagaaaggacaagcccacagcatctgc

SEQ ID NO: 198411 - DNA, 601 bp, Human
cacagatggggccgactctgccgcgcggtctcctcactgtgcttcctgcaatcatgccttgtacagcctcctgacaggccaccctcagccccatgtggccagcagcaagggctgctgttgcaccccaagcctctccgtctaggggaagaaggcgcgtgaagatctttctcagaaaggacaagcccacagcatctgcgtcggtgcctcctgcctctgacagggctcctggcgcccatggcggctggggtttcacgggggcgaggggctgggccacacttgtctgcatcccggggcccttggytcagtggacaaaacagctttaaagttcaaggataactcaaattggattttagaaatacaaagtcttaaaacatttgtaccagactaagggattacactcttaacttatccacagaaaggcttttgaagaggtggggaaaggtagctcagattttaaattggggcctcaaaacctgcctgtctgcggctccttcctttgcctggctgctattatcaaaaggtaaaatgtcttagactattgaaaaaaggatttgcataaattgcttttacctgcttcttatatgaggttaatgaaattgga

SEQ ID NO: 198412 - DNA, 601 bp, Human
agcaagggctgctgttgcaccccaagcctctccgtctaggggaagaaggcgcgtgaagatctttctcagaaaggacaagcccacagcatctgcgtcggtgcctcctgcctctgacagggctcctggcgcccatggcggctggggtttcacgggggcgaggggctgggccacacttgtctgcatcccggggcccttggctcagtggacaaaacagctttaaagttcaaggataactcaaattggattttagaaatacaaagtcttaaaacatttgtaccagactaagggattacactcttawcttatccacagaaaggcttttgaagaggtggggaaaggtagctcagattttaaattggggcctcaaaacctgcctgtctgcggctccttcctttgcctggctgctattatcaaaaggtaaaatgtcttagactattgaaaaaaggatttgcataaattgcttttacctgcttcttatatgaggttaatgaaattggaacaaaaaggaatgaattcccaatcccagaccagaacctcaaatcccccagaagagacttccatgagccccactgagcccaggcatgaagaactctttctctgg

SEQ ID NO: 198413 - DNA, 601 bp, Human
agggattacactcttaacttatccacagaaaggcttttgaagaggtggggaaaggtagctcagattttaaattggggcctcaaaacctgcctgtctgcggctccttcctttgcctggctgctattatcaaaaggtaaaatgtcttagactattgaaaaaaggatttgcataaattgcttttacctgcttcttatatgaggttaatgaaattggaacaaaaaggaatgaattcccaatcccagaccagaacctcaaatcccccagaagagacttccatgagccccactgagcccaggcatgragaactctttctctgggtccaggagtggcaccaccttaatcagctctcctcataaatgtcccaaggagaccaggaaacagcctcgagggagacggcgctgacccggggccaggggagtttggctcacgtgatccagtcacacagaggtcggtcgttgtctggacacagacaatgggaatctgggctgataccgggcctttgaaaatagtcggggaggaaaacagaaaagatgcagaagttgataattgctttgatatacccatctctgtttttttttttggacagaattcctattaaata

SEQ ID NO: 198414 - DNA, 601 bp, Human
gtcccaaggagaccaggaaacagcctcgagggagacggcgctgacccggggccaggggagtttggctcacgtgatccagtcacacagaggtcggtcgttgtctggacacagacaatgggaatctgggctgataccgggcctttgaaaatagtcggggaggaaaacagaaaagatgcagaagttgataattgctttgatatacccatctctgtttttttttttggacagaattcctattaaatacaatatagagtatttcattttctgcatctgcccatctttgaatcttcatgtatttttwaaaaagaatgaatttaaaactctaatccacttggcccagatttgttttgggaggcaggtgggaacccatgagctgtcttgagcacagtggctggagtctgtgcggtggctggaaccctgggctctggagggctggatgccttcaggtcccggaccccccactctgctcccgtggacagctccatcttcagcagctccgtgcatagggactcctgggaagacttctctttgaggaaatgtttccgctgctaaaatgcaaagttccccgaaggcaggtgggcactgtgctggtgctgtccga

SEQ ID NO: 198415 - DNA, 601 bp, Human
gaaaacagaaaagatgcagaagttgataattgctttgatatacccatctctgtttttttttttggacagaattcctattaaatacaatatagagtatttcattttctgcatctgcccatctttgaatcttcatgtatttttaaaaaagaatgaatttaaaactctaatccacttggcccagatttgttttgggaggcaggtgggaacccatgagctgtcttgagcacagtggctggagtctgtgcggtggctggaaccctgggctctggagggctggatgccttcaggtcccggacccccmactctgctcccgtggacagctccatcttcagcagctccgtgcatagggactcctgggaagacttctctttgaggaaatgtttccgctgctaaaatgcaaagttccccgaaggcaggtgggcactgtgctggtgctgtccgagtggagcctctggtgagccggacaccatcaaacaacatcagagcttgcaaaaggagctctgcagtgcctgagacctgcaaagggccatcctggggtccgagggcttcctggtcctgacccagtcctgcagggaggtcctgggagggtcgctagggtgag

SEQ ID NO: 198416 - DNA, 601 bp, Human
atccacgtgtgtctgtgagtgtgactcggaggagtccagcattggattcagtgggccaggaacagggcattcttctctccagggagcagaaaccacaagatagacatggcccattgtgctcgagggtcactttcattggaagatttagagaaaatgatttttatacaataacgatatgggcttatagggtaaagtccacattcgcataaaattttaaccaagtagggacagagcctggcaattctgggttctgagacccctggggatggcacctgagtcccactcaggccaccacccctgccccccccccgggcactcggggtgaagctgtgtcactgtggctggacacatgtcctggaatcagagttgctctttaactgtgtctggctttaaggctcgtcttctacgccagacaaagtaaacttcctggaactgttttttgaaatgtggctactgtcctttcctcttctagaaaaacgaggatgaggagccaaaacagaggagggtgtcgcaagcggcagacatttgaaagcagcttaagcccctgagccccctttctggggttcctgggcaagaggtcgcacgcctggccgaggtggtg

SEQ ID NO: 198417 - DNA, 601 bp, Human
tcccatgtgcccagtgcagtcttccgtcccatgcgcccagtgcagttactcttccgtcccatgcacccagcgcagttactcttttccattccatgcacccagcacagtcataggcttccagggtaggtactgtcaatgtttgttccaggaaaacccaattcagcttttcaaacaagatttatacacaccttcaggagcaagcatgcttgaatataatgagtctacctttaaggtaaatttcagctctttgggtttgtaatggatggaaaaaggcaggcaaagaaacaatttcaacatcttycagccccagagatgtacaaatattttagcaacatcccagtgactaaatggtgattcagccgagacgccccaaataaacagtctctattcttaactctgctcccatcttactgaagcgttacaaggctgtacttacatctggggtcaagccattctcatttggcttcgaaatgataacacaaaactgttacaataacctggaactgtaagggtcctggggatcccacattcagtcccacccgtgtcatggatgaacccgggaccagcagggcagccagccagaggcaaacccacaccagga

SEQ ID NO: 198418 - DNA, 601 bp, Human
gggatcccacattcagtcccacccgtgtcatggatgaacccgggaccagcagggcagccagccagaggcaaacccacaccaggacctggcgctcggccatgtgcctgcgttttccaatattgatgtcgacgtgggaggcaagttgctatggaggaaacgcgcacacacatctgagattattaaatagcagccgctaactgcctcgatgcaggagtcccatctccccaaacaaattctggctgtgatgccaactgcagcaggacggttagtggtgccgctggcaccgagagcacctggcctsgtggacctgtctcccagacctgctggggagcgccgtgtgctcagctgaacacggctcctgtggccacagtcctgtgttgctcccgtggttcggccggcgaagctccgtgttcatgtgcacagccacattggccattttgacccaacagacactcaagcaactcttgcgtgaatttggtgggaagatccatcgaatgtattgtttttggactaacctgatgagtccctttggtaaagcagtcccactgactatgcctgtggacccagctgggtgcagccatctctgactgtatggtgtcca

SEQ ID NO: 198419 - DNA, 601 bp, Human
gaacccgggaccagcagggcagccagccagaggcaaacccacaccaggacctggcgctcggccatgtgcctgcgttttccaatattgatgtcgacgtgggaggcaagttgctatggaggaaacgcgcacacacatctgagattattaaatagcagccgctaactgcctcgatgcaggagtcccatctccccaaacaaattctggctgtgatgccaactgcagcaggacggttagtggtgccgctggcaccgagagcacctggcctggtggacctgtctcccagacctgctggggagcgccrtgtgctcagctgaacacggctcctgtggccacagtcctgtgttgctcccgtggttcggccggcgaagctccgtgttcatgtgcacagccacattggccattttgacccaacagacactcaagcaactcttgcgtgaatttggtgggaagatccatcgaatgtattgtttttggactaacctgatgagtccctttggtaaagcagtcccactgactatgcctgtggacccagctgggtgcagccatctctgactgtatggtgtccatcctgagctccaagtcatcagagagcggccaggag

SEQ ID NO: 198420 - DNA, 601 bp, Human
ggggatacatcacccgatcacaccagcccgagaaccttccctttcccaccaccattcaaaggaggctgctcttagccagaaggcctctgtgttccaggcttaaatctgggcgagattcagggtttaactctggccttgcagttttagaggttgttataggctgaattgtgaccccccaaatccatccattgaagctctgatccccatgtgcctatatttggagacaggacctccaaggagctaattaaggttcaatgaggccaaaagggcggccccgatcctacaggactggtgtccttayaagaagagtgagagacaccccgtgcctgcaccagggaaaggccgtgtgaggacatggggagaagatgctgtccacaagcccgggagagaggtcacaggaagaaccgcccccacccccgccgccccccacagcttggtctgggactgtcagagctgtgagaacagacgtgtcctgcagtttaatgcacccagtctgtggtcctgggcacggccacccgtgatgacttacacacagatgcacgcagacggcttggggagcatggccagtgcttgtcttagtgtgggaggcttggtgtccgcc

SEQ ID NO: 198421 - DNA, 601 bp, Human
gtggccgtacacaataagctccacgtgacccagggggacgtatctgtgtgctctgggaaggctgacatttcaacattcctggcgtctgaattcgacatctctcccaccaccgggaaggaggcgccccagaggggagggaggtgctggggagcgggattgagagcctgatactggcgtgaagttcatcagcagaggagcgaagggaggagggcagggtcaagaccagggactcatggaagcatttggcatcctgtgaagtttctcagcctctggaggctcctctctgatgggagccttatcygagaggtgggtgggagggacgcaggctgccggtgctggtcccgggttgtttgtggtgcagccagcggctggtcactcacatgcagactgagctgacgcttaggacaaaatccatgttttttcattttgaataaaatcactcgatatttgacattttaggcattgaagtcgtcatcacggctcatcacaggagaaatcagagctctgtgctgttgtttctggatacgtgcttgttttagggttttgtatgtattatttcagagctccgtgctgtttctggacacgtgttttagggttttgt

SEQ ID NO: 198422 - DNA, 601 bp, Human
aatccatgttttttcattttgaataaaatcactcgatatttgacattttaggcattgaagtcgtcatcacggctcatcacaggagaaatcagagctctgtgctgttgtttctggatacgtgcttgttttagggttttgtatgtattatttcagagctccgtgctgtttctggacacgtgttttagggttttgtatgtattatttctagttccatgaaggggtaggggcatcatgtccttaggatgctcacaggtcaaattagggctgtcccaccagccacccacacatccccagcgacttkggtttggaggaagatggaaaagagtcaggagagaggggtgcagcccaggagacagagcacctggaaggatttgattttaagatttaacttcgcattaggggttttcttcataggctcctgcaattcagatagtatctttattccaaggagctttgagtggtttctgcatcagttttcatttcttgttcccaaatctctgtgacatagggagacaggcctttctctaaaacccactgcagacatgaagagccacagccgggggggactcacccaaggtcacacggttaatcctccatgttc

SEQ ID NO: 198423 - DNA, 601 bp, Human
tctagttccatgaaggggtaggggcatcatgtccttaggatgctcacaggtcaaattagggctgtcccaccagccacccacacatccccagcgactttggtttggaggaagatggaaaagagtcaggagagaggggtgcagcccaggagacagagcacctggaaggatttgattttaagatttaacttcgcattaggggttttcttcataggctcctgcaattcagatagtatctttattccaaggagctttgagtggtttctgcatcagttttcatttcttgttcccaaatctctgtgasatagggagacaggcctttctctaaaacccactgcagacatgaagagccacagccgggggggactcacccaaggtcacacggttaatcctccatgttccggagattaaagcaaactccatggctctcagtctcgtctgaaacttcatgcctctgaattgcccctgaattacccacataacagcagctggacacaaatataagcagcagcagatgtgatgttggctgggacagccgagggaaactggtaaaatgcctcttcttcctgactactctctcaccccggcatctgcctccagagtc

SEQ ID NO: 198424 - DNA, 601 bp, Human
catcatgtccttaggatgctcacaggtcaaattagggctgtcccaccagccacccacacatccccagcgactttggtttggaggaagatggaaaagagtcaggagagaggggtgcagcccaggagacagagcacctggaaggatttgattttaagatttaacttcgcattaggggttttcttcataggctcctgcaattcagatagtatctttattccaaggagctttgagtggtttctgcatcagttttcatttcttgttcccaaatctctgtgacatagggagacaggcctttctctamaacccactgcagacatgaagagccacagccgggggggactcacccaaggtcacacggttaatcctccatgttccggagattaaagcaaactccatggctctcagtctcgtctgaaacttcatgcctctgaattgcccctgaattacccacataacagcagctggacacaaatataagcagcagcagatgtgatgttggctgggacagccgagggaaactggtaaaatgcctcttcttcctgactactctctcaccccggcatctgcctccagagtctcgcagcctttggagatgggtttg

SEQ ID NO: 198425 - DNA, 601 bp, Human
ccaccagccacccacacatccccagcgactttggtttggaggaagatggaaaagagtcaggagagaggggtgcagcccaggagacagagcacctggaaggatttgattttaagatttaacttcgcattaggggttttcttcataggctcctgcaattcagatagtatctttattccaaggagctttgagtggtttctgcatcagttttcatttcttgttcccaaatctctgtgacatagggagacaggcctttctctaaaacccactgcagacatgaagagccacagccgggggggactcrcccaaggtcacacggttaatcctccatgttccggagattaaagcaaactccatggctctcagtctcgtctgaaacttcatgcctctgaattgcccctgaattacccacataacagcagctggacacaaatataagcagcagcagatgtgatgttggctgggacagccgagggaaactggtaaaatgcctcttcttcctgactactctctcaccccggcatctgcctccagagtctcgcagcctttggagatgggtttgcggcccaggggcacctgcgttgtagcttattcgtctatgagg

SEQ ID NO: 198426 - DNA, 601 bp, Human
ccaaatctctgtgacatagggagacaggcctttctctaaaacccactgcagacatgaagagccacagccgggggggactcacccaaggtcacacggttaatcctccatgttccggagattaaagcaaactccatggctctcagtctcgtctgaaacttcatgcctctgaattgcccctgaattacccacataacagcagctggacacaaatataagcagcagcagatgtgatgttggctgggacagccgagggaaactggtaaaatgcctcttcttcctgactactctctcaccccggcayctgcctccagagtctcgcagcctttggagatgggtttgcggcccaggggcacctgcgttgtagcttattcgtctatgaggggaggaaaagatggtctcctgtaaaaaatgttaaagtgccagcaagaaattgagggtagtatcttggagtgttgtgagaagagccgtcctgagttctgacggtcaccatacaggcagagtgacacctgtgccttcagctgccccgaggtcaactcaatgccaactgccatctgggactcttggagagctctttctccccaggtgtgaccagacaaggttg

SEQ ID NO: 198427 - DNA, 601 bp, Human
aacccactgcagacatgaagagccacagccgggggggactcacccaaggtcacacggttaatcctccatgttccggagattaaagcaaactccatggctctcagtctcgtctgaaacttcatgcctctgaattgcccctgaattacccacataacagcagctggacacaaatataagcagcagcagatgtgatgttggctgggacagccgagggaaactggtaaaatgcctcttcttcctgactactctctcaccccggcatctgcctccagagtctcgcagcctttggagatgggtttgyggcccaggggcacctgcgttgtagcttattcgtctatgaggggaggaaaagatggtctcctgtaaaaaatgttaaagtgccagcaagaaattgagggtagtatcttggagtgttgtgagaagagccgtcctgagttctgacggtcaccatacaggcagagtgacacctgtgccttcagctgccccgaggtcaactcaatgccaactgccatctgggactcttggagagctctttctccccaggtgtgaccagacaaggttgttatggaatcaaataccaaattatggcagatgctaattt

SEQ ID NO: 198428 - DNA, 601 bp, Human
gaagagccacagccgggggggactcacccaaggtcacacggttaatcctccatgttccggagattaaagcaaactccatggctctcagtctcgtctgaaacttcatgcctctgaattgcccctgaattacccacataacagcagctggacacaaatataagcagcagcagatgtgatgttggctgggacagccgagggaaactggtaaaatgcctcttcttcctgactactctctcaccccggcatctgcctccagagtctcgcagcctttggagatgggtttgcggcccaggggcacctkcgttgtagcttattcgtctatgaggggaggaaaagatggtctcctgtaaaaaatgttaaagtgccagcaagaaattgagggtagtatcttggagtgttgtgagaagagccgtcctgagttctgacggtcaccatacaggcagagtgacacctgtgccttcagctgccccgaggtcaactcaatgccaactgccatctgggactcttggagagctctttctccccaggtgtgaccagacaaggttgttatggaatcaaataccaaattatggcagatgctaatttcagtcatcttgcacac

SEQ ID NO: 198429 - DNA, 601 bp, Human
caccccacgcctccttccacaggctccatgacggcaaaggccctgtccaccagccctatggaaaagagcctggctccagcacctttcctgggacttgatttcctcactttttaaaatgacttgccaatcaattatcaattgataatgactactgattgcaacatatctttagtaagtaaaatgaaaggtgtgtcttactactgctggctgtttccggccaacaagcccaagactgagaattggtgaaggaaggcattgcctgtggacctccctcccatgggtgcccggcctgctcttagtyccccactgaaggctcttcggcacctagagccccatcatcccttccccgtgtgtttgctaacgctgttcatcttgtctaggatgcttctcctccatcaaaaccacttcaagaatcagtccctcctggaaccctccccggagacgctctcttcctcacctctctctggacatttgcaggaagaagcaagacccgtccacatgacccatgcacgattcagtggctctcctccctctgggaggtcagttttactggttgtacgtggagtcctctaagctatgagggaagaaggggacaactgtt

SEQ ID NO: 198430 - DNA, 601 bp, Human
tttgctcttcatgtccccggcatttttaactcctagctcagttacttctctgctcatctttcctcttagacttggggtccttgagggccagctctatgtctggttcatctttgcattctccatcagattgcagaagttgtgtcaacgacgaaccaataaatgaatgtgtgcagtcgggtgtggcagggaccaacaatctgaccagcgctctttctgtgtggatggtctggccctgtgttgacaaacacctaaataatccagcacgattcccttctagatgtatctctctacggtgactgastgtgctcaatgcttacaactaggctttttccaatcacctgtaactcatgtgaatgtggtcactgatttgagcatcaaaagggccaaagttatcgagggcttttgcatatgtagatggagaacaggtgactggggtaacgcgttatttacctgtatttagatgggcagtctccagatgtttttaaacaggtgactggggtaaccagctacttaactgtatttagacggggcagtctccagagatttttgaaaaggaagaaggaagtaaattcagttacttggatacaagtaggacagaaaa

SEQ ID NO: 198431 - DNA, 601 bp, Human
tgaatgtggatggcagggcagcattttggaggtgaagccatctgcagatgcgtgtaccccacgagggtgagaagctccaagcacacccagaatctagggtgggggactgttcgcctgagcagcaccaactccatctcaagatgtgtgtctgctgtctgttgctgttctttgtttgagctttgaactcctcacataaccccttaactgtcctcttgatcttttattcatgagcttgacacattgggcagaaagacacagtctcagtgagatgataccaacttggagcttagtttcttcttcytaataccttttgcttgtaattccaaagtattgatattaaatactcataagtagccaaggaagaggaccatcccactactcagtttaatctgtcttgaaaatgcttcggtattgcatgaacgtgatgcatgatccaacccaatgctctgtgctaaggctgtgcttgtgttatctgtggtgaagagaaccttgtaatgaatggaccactcactgagccaggctgtgcttgtgttatctgtggtggagagaaccttgtaatgaacggaccactcactgagcctgggcagctccctgcatctga

SEQ ID NO: 198432 - DNA, 601 bp, Human
tgctctgtgctaaggctgtgcttgtgttatctgtggtgaagagaaccttgtaatgaatggaccactcactgagccaggctgtgcttgtgttatctgtggtggagagaaccttgtaatgaacggaccactcactgagcctgggcagctccctgcatctgacttctggagagttctagagatactcacaggtcaggaggtctcttggggtgagggcaggggaggcagctctgggaaccgaccatcagcaaaggtcagagacttagatgcccatccagtgggttcgaatgtcagccgccttccrcagcgaggtctggtaatgggcttggacctgcctgaatcctcctggctaagctgtggagtggagccaggagtgctgtctgctcacggtgggaccagcctgcaatcggtgcggcgggctatgcttagggcctaagaattaggcttcccacctgccagcgatacaggcacgggataggccacattaccctgcttttgtgactcatccttcctccatttaagtgggacccacacttgtggctgggataacaatttccaggttggctgagttgggctcctggcaagccatggctgggatagctat

SEQ ID NO: 198433 - DNA, 601 bp, Human
gtaatgaacggaccactcactgagcctgggcagctccctgcatctgacttctggagagttctagagatactcacaggtcaggaggtctcttggggtgagggcaggggaggcagctctgggaaccgaccatcagcaaaggtcagagacttagatgcccatccagtgggttcgaatgtcagccgccttccacagcgaggtctggtaatgggcttggacctgcctgaatcctcctggctaagctgtggagtggagccaggagtgctgtctgctcacggtgggaccagcctgcaatcggtgcggygggctatgcttagggcctaagaattaggcttcccacctgccagcgatacaggcacgggataggccacattaccctgcttttgtgactcatccttcctccatttaagtgggacccacacttgtggctgggataacaatttccaggttggctgagttgggctcctggcaagccatggctgggatagctatctccaggttggctgagttgggctcctggcaagccatggctgggatagctatctccgggttggctgagttaggttcctggcaaggccatggctggggtaacgatctccaggtt

SEQ ID NO: 198434 - DNA, 601 bp, Human
ataggccacattaccctgcttttgtgactcatccttcctccatttaagtgggacccacacttgtggctgggataacaatttccaggttggctgagttgggctcctggcaagccatggctgggatagctatctccaggttggctgagttgggctcctggcaagccatggctgggatagctatctccgggttggctgagttaggttcctggcaaggccatggctggggtaacgatctccaggttggctgagctgggcttctggcaagtccgtggctgggatagctatctctgggttggctgakttgggctctcggcaaggctgtggctgggataacaatctccaggttggctgagctgggcttctggcaaggccgtggctgggatagttatttccaggttggctgaattaggttcctggcatggctgtgaaagtgctgccccatttctttgccaccagccacggaagtcgcagctccctgtgtcctctttgcacgttgcatgtgtcgtggtgggagctgtgaggcggtgccgtgacggggcgatgctgctgcaggagacgtgctccggggcacgactctgacgcagcttagaagagctaatgc

SEQ ID NO: 198435 - DNA, 601 bp, Human
tagctatctccgggttggctgagttaggttcctggcaaggccatggctggggtaacgatctccaggttggctgagctgggcttctggcaagtccgtggctgggatagctatctctgggttggctgagttgggctctcggcaaggctgtggctgggataacaatctccaggttggctgagctgggcttctggcaaggccgtggctgggatagttatttccaggttggctgaattaggttcctggcatggctgtgaaagtgctgccccatttctttgccaccagccacggaagtcgcagctcsctgtgtcctctttgcacgttgcatgtgtcgtggtgggagctgtgaggcggtgccgtgacggggcgatgctgctgcaggagacgtgctccggggcacgactctgacgcagcttagaagagctaatgcttgacaccatctggatccccttcatgctttctgtttttatgggaagtcctaattcaacacatgtttcctgaggtgctactacgtgctaggttactgggtacagcaagaccatggaggaatcagagcgtaaacaagcgggcgcgaggtggtccaggcatggagggcacagaagcc

SEQ ID NO: 198436 - DNA, 601 bp, Human
agtgtggagatcacgggactccctacaccctacagtactcacggggccctgagcaaggagatcacgggactccctgcaccccacagtccacacggggccctgagtgtgatcacgggactccctacaccccacagtcctcacggggccaagggcgtggagatcacgggcctccatacaccccacagtcctcacggtgccaacagcatagagatcacgggcctctatacaccccacagtcttcacggggccctgagtatggagatcacgggactgccctgcacccacagtcctcagcagtttytagagcagaagatgcccattaaaggcagatctcttccgttcagctgcctggtctgctgagcagttgagggggatggtgaggcagtgtgggaatccgcatgtgttgaggcctgcatccctgagctgcgggcagttgaggtgattctgaggcctgtgtccctgagctgtgggctgttgaggtgattctgaggcctgcgtccctgagctctgggctgtccgggtgattctgaggcctgcgtctctcagctgtgggctgttgaggcgattctgaggcctgtgtccctgagctgtgggctgttga

SEQ ID NO: 198437 - DNA, 601 bp, Human
gcaatgaggctggccggatgtagggagtgaggcgtagaggatgagctgctactactgcacaggaatgtcccagcctgctgccagctccttggggaagcagcaagatgccacccaggtgagctgcttcctccgcacctatgagaggcaggaagtggcaggtaacatggagctgctggagacccagccccagggaccccctgccaatatctgagtgaacagttcttgcaagctaggaaggctggcccgaggatggcagttgtatctggcatttcttggagtgtctccagtttattttggaaayaggttttggcaaaagttcaaaatgtcaaactcctgaggctttcagttgtcctctccctccggctccagtgtcgagtacccagtgagctgttgagagagaaattcttaaatgtaccgcagcgttcagctcctcagtgggttcggaaacagctggaaggaagggtgtaaagcccgcctgagatggcttcctcagggtttgcctcccagagacaccgtggcattggagcagggtgcagctgcattctggggtgggccagctcggcaccatcggccgatcttcctggacgagccagggctcgct

SEQ ID NO: 198438 - DNA, 601 bp, Human
ctgtccaggcatcacgcccacacctgccaccaggcccagcatcttgctccctcctcatcctggcaccagctgaccccatccttgggaggccttggtctctggttccccgctcccctatctgaagtgggtgctggtgagaggctgggaggaccaggcgttgtggctgggatctgtggcaacccaggaaggagctgcaactccgaggagttggggtgtgaaaacaatcgtccactgtgggctcaggaagagcagggcctggtgcgggcccttcccgaggaagcctgtggggcctgagtcctgrgagaagcaaactcaggcctggaggctgagtccgtgtggggaatgtggcctgtgctgctgctcctgtggactcacgagccgtcaggacactgagccacgttacctggtgcttctccagcatgggcctgtctagcaaagcagtggcagtgctctgagctgggggcaggcggacatgccccgacactcggcttccaccaaacagggtggtccaagcactgagttctagaaagaaaaccgggaggaggcggtgtgggaccgtgggcagacatcaacctagaccagcccctgtccccccttggct

SEQ ID NO: 198439 - DNA, 601 bp, Human
cttgggaggccttggtctctggttccccgctcccctatctgaagtgggtgctggtgagaggctgggaggaccaggcgttgtggctgggatctgtggcaacccaggaaggagctgcaactccgaggagttggggtgtgaaaacaatcgtccactgtgggctcaggaagagcagggcctggtgcgggcccttcccgaggaagcctgtggggcctgagtcctgggagaagcaaactcaggcctggaggctgagtccgtgtggggaatgtggcctgtgctgctgctcctgtggactcacgagccrtcaggacactgagccacgttacctggtgcttctccagcatgggcctgtctagcaaagcagtggcagtgctctgagctgggggcaggcggacatgccccgacactcggcttccaccaaacagggtggtccaagcactgagttctagaaagaaaaccgggaggaggcggtgtgggaccgtgggcagacatcaacctagaccagcccctgtccccccttggctgtgtcagaggtgacagtgacagtggccttccattctctgcacccactgcactcacgggactccctctgcaactctgccag

SEQ ID NO: 198440 - DNA, 601 bp, Human
gcagtggtttacttggcatctgactaccctgacattttatgggtaggatttgtaccactgcacaaaaatagttttaaccaaaaatatacttgtgaaaaacagtaggaaatgccagaaagaccagacttctttacaatcaaagaattacgtgtatgtgtttttaagtggaattatctggaagagtggcacttccaaaagagtttccatgaatgagtgaataatgaagttctaggttaggatctcggctctgtaatttattatctgggtaaaccagggcaaattttttaatcttttaattaattttttttttttttgagacaggatctgtcgcccaggctggagtgcagtggcgcgatctcggctcactgcagcctctgcctctcaggttgaagtgattctcctgcctcagcctcccgaagtacctgggattacaggtgtccgtcaccacgcccagctaatttttgtatttttaatagagacgggttgcaccatgttggccaggttggtctcagctgcccacctcagcctcccaaagtgctgggattacaggtgtgagccactgcgcccagcctttaaccttctaaagctcagcctcctgttt

SEQ ID NO: 198441 - DNA, 601 bp, Human
gactaccctgacattttatgggtaggatttgtaccactgcacaaaaatagttttaaccaaaaatatacttgtgaaaaacagtaggaaatgccagaaagaccagacttctttacaatcaaagaattacgtgtatgtgtttttaagtggaattatctggaagagtggcacttccaaaagagtttccatgaatgagtgaataatgaagttctaggttaggatctcggctctgtaatttattatctgggtaaaccagggcaaattttttaatcttttaattaattttttttttttttgagacagkatctgtcgcccaggctggagtgcagtggcgcgatctcggctcactgcagcctctgcctctcaggttgaagtgattctcctgcctcagcctcccgaagtacctgggattacaggtgtccgtcaccacgcccagctaatttttgtatttttaatagagacgggttgcaccatgttggccaggttggtctcagctgcccacctcagcctcccaaagtgctgggattacaggtgtgagccactgcgcccagcctttaaccttctaaagctcagcctcctgttttgtggagtagcagtatctgcg

SEQ ID NO: 198442 - DNA, 601 bp, Human
ctgggattacaggtgtccgtcaccacgcccagctaatttttgtatttttaatagagacgggttgcaccatgttggccaggttggtctcagctgcccacctcagcctcccaaagtgctgggattacaggtgtgagccactgcgcccagcctttaaccttctaaagctcagcctcctgttttgtggagtagcagtatctgcgcctgcgctgctctcactgcgcaatggaagcaatacagcacggagcttagcagggaaaggcatgagaagctgctagcgtggggactcaaggaacatcagcartgtccttaccttcataggaattaaggccaaaccatttatgggtgactatgtcaggagaagggaggaaaaaaaaaaaaaaaccctgttcctgatagacgagaaactgctcaggggaaagaggacgtcgctttccatgtcattattcctcagccagggttgtgcggatgggagcgctggtcacttaagcacatgaagaagaaaaagtctttctgcgaaacatggacggagcctggaacatgcagggccacgcgtgagggacgggccgaagtcagggatgtggggccaggagccgccgtgtgg

SEQ ID NO: 198443 - DNA, 601 bp, Human
ccatgttggccaggttggtctcagctgcccacctcagcctcccaaagtgctgggattacaggtgtgagccactgcgcccagcctttaaccttctaaagctcagcctcctgttttgtggagtagcagtatctgcgcctgcgctgctctcactgcgcaatggaagcaatacagcacggagcttagcagggaaaggcatgagaagctgctagcgtggggactcaaggaacatcagcagtgtccttaccttcataggaattaaggccaaaccatttatgggtgactatgtcaggagaagggaggaaaaaaaaaaaaaaaccctgttcctgatagacgagaaactgctcaggggaaagaggacgtcgctttccatgtcattattcctcagccagggttgtgcggatgggagcgctggtcacttaagcacatgaagaagaaaaagtctttctgcgaaacatggacggagcctggaacatgcagggccacgcgtgagggacgggccgaagtcagggatgtggggccaggagccgccgtgtggggtggacccctgccagaaaagcaaacgggcagtggatggactatggtatgctatgcggctcacaag

SEQ ID NO: 198444 - DNA, 601 bp, Human
aggacgtcgctttccatgtcattattcctcagccagggttgtgcggatgggagcgctggtcacttaagcacatgaagaagaaaaagtctttctgcgaaacatggacggagcctggaacatgcagggccacgcgtgagggacgggccgaagtcagggatgtggggccaggagccgccgtgtggggtggacccctgccagaaaagcaaacgggcagtggatggactatggtatgctatgcggctcacaagataaaagtttttttttaaaacctcccccaccccctaaagagatcattattgtkacgacatagaaaaacctagccttgcagctgaggctgcaccgtgcaggcagagaccgtcgaggaacccacagcagaattggccatgggtgaaggctgagtctgcaccgtgcaggcagagaccgtcgaggaacccacagcagaagtggcccacggaggaggagcactgagccgcctcctatggcagcgacacagaagccaggcctggaaggcagagcgggagagcagagagacatgctccacgccgcaggcccagctcaccctccgactgaggcaggagtgctggagctctcggcggccggt

SEQ ID NO: 198445 - DNA, 601 bp, Human
ctgtggctcacaagatacaagtttttttttttaaacctcccccaccccctaaataaattattattgcaatttaaaaacctagccttgcaaaacagcttttgaagaacaagggaaataattgctcaaagcccacttgctctacaaacaggtgatttcagagacctttgaaaagagccccagctgctgaacttaacctggggccccgcgaatgaaccaggctccgcccctgacgcccgagacaccgcgcacaagaaggcagtgctggatctcccgcagggccctgaagcagctctctggtgcrctgaaaaggcagcaccacgtggtggatcatccacggggcagccccagggcaaacgtggtgaagccaggggtttgcgggagggacagccttgccggtgcgggggacgcggtctcgggactgacggcgcaggggacgcgcgggattgacggagcgggagatgcggtcgcgggatgggatgtgctccccgtagctcccggcgtggctgcagtgggccggttgcggggaagaaaagggccggtgtcgtaattgactggacaggtactaatgccgaccacatccaaatatggatgatgacgagcg

SEQ ID NO: 198446 - DNA, 601 bp, Human
acctggggccccgcgaatgaaccaggctccgcccctgacgcccgagacaccgcgcacaagaaggcagtgctggatctcccgcagggccctgaagcagctctctggtgcactgaaaaggcagcaccacgtggtggatcatccacggggcagccccagggcaaacgtggtgaagccaggggtttgcgggagggacagccttgccggtgcgggggacgcggtctcgggactgacggcgcaggggacgcgcgggattgacggagcgggagatgcggtcgcgggatgggatgtgctccccgtagckcccggcgtggctgcagtgggccggttgcggggaagaaaagggccggtgtcgtaattgactggacaggtactaatgccgaccacatccaaatatggatgatgacgagcgtggtgttgcccacagtccaggcctgtccaggcgccattccccgtggcctgcacgctcctgggtcatgctccgctcaggcggctccttcagtgaagttgcacagcagtcagggtaacctccatgtccccaaagggcaagaccggctcagaggcgaggtaggtggcacgaggccacacagctggtcagctcagc

SEQ ID NO: 198447 - DNA, 601 bp, Human
taacctccatgtccccaaagggcaagaccggctcagaggcgaggtaggtggcacgaggccacacagctggtcagctcagccgggctgggacgcgggccccagaccgtggcccccgtgcagctctgggtccagctggccaaggtggactttgcacaaggtttgggaggctaaagggagccgaggcaggtggcagctgctgtgctgggaaggctgcgtgcgcggggcatcctctcttggcccgggtgggcggacgcaggggtccctggaggacgggactggcatgtctcctgcatcccgcggygtccttgctttgtgtccaggtccctcctgacccccgcccatccaccctactggctcagagacgtggaggcagtggtcccttccccagctccccacgctaccccccaacccttgctgcacagcagaaggccctgctcagaaaatccctgatttcacgggactcctagtggctctgcctcccggatggagccctgcctgcgtggctgctctgtggctaacaaacagcgtgctcctggtttccctgccacggtacgcccctccagccacgtcaggccattgctcaactggaggagtgacatcg

SEQ ID NO: 198448 - DNA, 601 bp, Human
atgtggggtgctggtgctttggggcaccagcccctgcccctctcttggggaggagctggatggaacacaagtccagcactcacagaggctcatcctgagttgtctgcccagggaacatcagtgagaaccatagtgtaggaagagaccgggcgggcaaagtgggaccatccagcagcccctacctgtcagggggacccaccccttccttccagccttccctgttcacagagggtgctgcaggccgccagggtgctgtccccccaacgccatatcggcattcagaacagatgccatactctgytctaggggcctccttctgcccccacatcacccactgaatctctctaacaaacatcccccacgtggtgatcagtttcccacgtgctcagggggttctgcgccctgccccaaatcttacagctgatgtggggtagagacagaatcccacccaggtttggctcccaggagtgtgacccaggatgggacagcgatttgtgctttgcagagaagtgaactcagcagtcgggatgcagggtgcacgttctcggtgtccccacgttcagctctacatgcacgaccccaaacttcctaaaggctcatg

SEQ ID NO: 198449 - DNA, 601 bp, Human
tgccatactctgctctaggggcctccttctgcccccacatcacccactgaatctctctaacaaacatcccccacgtggtgatcagtttcccacgtgctcagggggttctgcgccctgccccaaatcttacagctgatgtggggtagagacagaatcccacccaggtttggctcccaggagtgtgacccaggatgggacagcgatttgtgctttgcagagaagtgaactcagcagtcgggatgcagggtgcacgttctcggtgtccccacgttcagctctacatgcacgaccccaaacttcytaaaggctcatgacgcaaataaaaccacaagtcctgccctcgagagatcattatctgggcccagagcagctgctccacagaagtgcgaaggagaatgagcagagccagtccttcctgtcctctccctgtcctccctcccatcctccccacctcccacatcttccctgtgctccccgagtcttctccatgcccctcagccctcttctggccagatccagcctcaccccatcaccattgctattcagcggtcacagtctccactgacacctgctggggtacttgccttttaacaaggcatcc

SEQ ID NO: 198450 - DNA, 601 bp, Human
cagagcaccacggtgcccaccttttgttttcagagaagcaacaacacctcatattcagtctaacctgtgaccattttccaaacactctcatgttcgtttgatcttcatgatgtccgtgaacacagggaagctttagtcgcagccacatgagtggagcatgtggaggctaggagaggccatgcacgcaccctctaggatggccgtaactaaacacacacacacaacaaaaacgtgctggcgagaatgctgaggaatcgtaactggcacactctgcagggaggaatatagcatgatgcagtcrctgttagtgggtcctcaaaaaactaaccacagaatcagcccaggacccagcagttccaccaggggcatatgcccaaaagcaccgaatgcagtgactcagagagagattcgcacgcccatgttcatagcagcagcgctcacagaagccaagaggtgaggccacccaagcgtccaccaatggaagaaaagataaacatcatgtggtccacccacacatgggaatattactcagcactgaaaaggcagagattttggatgcaggctacaacatggatgaaccttgaagatgttatgctaagtg

SEQ ID NO: 198451 - DNA, 601 bp, Human
aggagaggccatgcacgcaccctctaggatggccgtaactaaacacacacacacaacaaaaacgtgctggcgagaatgctgaggaatcgtaactggcacactctgcagggaggaatatagcatgatgcagtcgctgttagtgggtcctcaaaaaactaaccacagaatcagcccaggacccagcagttccaccaggggcatatgcccaaaagcaccgaatgcagtgactcagagagagattcgcacgcccatgttcatagcagcagcgctcacagaagccaagaggtgaggccacccaagygtccaccaatggaagaaaagataaacatcatgtggtccacccacacatgggaatattactcagcactgaaaaggcagagattttggatgcaggctacaacatggatgaaccttgaagatgttatgctaagtgaaataagccagtcacaatatgataaacactgtgtgattccactcgtatggggtccttagagtcatcagatccatagagacagaatgtaggacagtgggtcctgggggctggggagttagtgtttaatggggacagacttccagtgtggaaagatggaaagagttttag

SEQ ID NO: 198452 - DNA, 601 bp, Human
ggcacactctgcagggaggaatatagcatgatgcagtcgctgttagtgggtcctcaaaaaactaaccacagaatcagcccaggacccagcagttccaccaggggcatatgcccaaaagcaccgaatgcagtgactcagagagagattcgcacgcccatgttcatagcagcagcgctcacagaagccaagaggtgaggccacccaagcgtccaccaatggaagaaaagataaacatcatgtggtccacccacacatgggaatattactcagcactgaaaaggcagagattttggatgcaggytacaacatggatgaaccttgaagatgttatgctaagtgaaataagccagtcacaatatgataaacactgtgtgattccactcgtatggggtccttagagtcatcagatccatagagacagaatgtaggacagtgggtcctgggggctggggagttagtgtttaatggggacagacttccagtgtggaaagatggaaagagttttagaagcagatagtgatgatggttgcacagtattttgaatgtaaatactaccactaaattgtacatttaaaggttaaaaatcacaaatgttatatat

SEQ ID NO: 198453 - DNA, 601 bp, Human
gtctccatctctgatataaaactaatcccacctgctgccagttcatgcccttctgtggcttgcagcagctgacactgacacctctttgccaactcaatttaacagccacccaccatgtcacgggtgcagagtgctggatctgggactccacagagcagtgagacacagcccctgccctcagggagcttacaactgagtggaggagaaagacacacacggcacagggaaaatgtgctggcaaagcagtgcaaagggcagtgcacacacacagtcagagacacacaaacacacagacacacaygcagacacacaaacacacagacacacacgaacacacacagacgcacaaacagacgcagatacagacacaaacagacacacatgcagacacagacacacactcacagacacagacacaaacacacagacacagacacagaaacacacagacacaagacacaaacagacacacacggagacacaggcacacatgaacacacacagacacagacacaaacacacacagacaaacacacagagacacacacagacacatacaaagacacacatacagacagacacacacacatacacacggaca

SEQ ID NO: 198454 - DNA, 601 bp, Human
gttgctggcctcaggccaagtaaaaatggctatgcaggagcccagcatggcctgggcatcatgcctgtcaagcctggtgaatcctagggtgggcctgcgagggtttagaagggataaaccacgtcaatattattcttcccaaccaagatttcactggaagttgagctgcagtgagtttaagaaaatggtaagccccccatctctgcacgcagttcataatctaggttgtgagaccacacaccggctcatgtgcacaagacagtgtgcgtggagggtgacagtgtcggcaaaagtgggctcrgggctcagagctgtaactgcggttaaggggttaggaagctggccttgggctggatccaggaccccagagtgactcagcctcatggtacagcagagggcacgcccgacaggggaggtcttcgagtcaacaatgggaagtagaaatctgcccaagatgaggggaccagtccgagtggggaggcttccaaagatgagaggaccagtccgacgggggaggcttcctctagaggaaccatgaggacaagtcagagtggaggtaaaaggcctgaaataataactggtcaaggaacatggtctcttc

SEQ ID NO: 198455 - DNA, 601 bp, Human
gggcacgcccgacaggggaggtcttcgagtcaacaatgggaagtagaaatctgcccaagatgaggggaccagtccgagtggggaggcttccaaagatgagaggaccagtccgacgggggaggcttcctctagaggaaccatgaggacaagtcagagtggaggtaaaaggcctgaaataataactggtcaaggaacatggtctcttcttctgctacttacatgccagagtctctgaaagttcttgatgagaacagtgacacaatgaaagcaaagtcagggaagatgagaaggtggccttgcrtcctaactgctgtcagcagagtctgagggcctgaaaacgtccacatgccagggagtccctcagtcctcaggaaggagaaacgtttcatgaaaacgcgaacagtctcggaacgcctcactccgtcacggcagtgtaggctcagatgtgacttgggaagatggcgccactctgcaggacgccgtgtgtggcaaccactcgctctcacccttcgggtctgcggcagctactgtcatatgagctgctctttagagggacagaaatccacaggaccccagtttccacccaaattcatgagccgca

SEQ ID NO: 198456 - DNA, 601 bp, Human
gcatcaaatgcccacgtaaacatgtacacaggtgaatgaatacaggtgttgggtgcccatgtaaacatgtacacgtgaatacaggtatcgaatgcctatgtaaacatgtacatgtgaatacaggtgttggatgcccacatacatgtgcattcaggtgttgaatgtccacataaacatgtacatgtgaatacaggtatcgaatgcctatgtagacatgtacacatgaatacaggcactggatgcccacgtaaacatgtccatgtgaatacatgcactgaacgcccatgtaaacatgtccacstgaatacaggtgccgaatgcccacgtaaacatgtccacgtgaatacgggtgccgaatgcccacataaacatgtccacgtgaatacaggtgccgccgaatgcccacataaacatgtccacgtgaatacaggcgctgaatgcccacatatgcaacaagtcaatgtcttcctatgccactgctctctggacagaccacattctgaaaacaatgatgaagccacacagtgctcagctcaagtcccaggaacttcctgctttatgctggaaacgggccacagcgctcaagcagagctccgctcac

SEQ ID NO: 198457 - DNA, 601 bp, Human
tcatgtcttgtaggcgaccccacagagagagaggcagaggagagtggccgtgacctggaggacaaggacatgcatttcacactgaccggggcctccctgggacaccctgaacacctgctctgtgggagacggggtggtgtttgagctggtgccatctgggtcccctggggtggtggctgggtgagcccagccccatctttccctcggacttcatttgtgctcatggctgggggaggcacctgggggccccgtccaagctgccaagggctggggtgggctgttcccctcttggcatctcccycacacctctgcacccccagtggataaaagctgctggcaacatcgacgtccccaagacactgacaggcctggaggtctggacaatggggagccagcaccgggtcccctgggaaccacgcagccggggcctggaggccgacacaagccagacccagcctctctgccattcgcaaatcccagtgttcaaacagagttctgccaaagaagagaagaaccagtaaaaagcagggaagaggctgggcgcggtggctcatgcctgtaatcccagcactttgggaggctgaggcgggcggatcacgag

SEQ ID NO: 198458 - DNA, 601 bp, Human
caagctgccaagggctggggtgggctgttcccctcttggcatctccctcacacctctgcacccccagtggataaaagctgctggcaacatcgacgtccccaagacactgacaggcctggaggtctggacaatggggagccagcaccgggtcccctgggaaccacgcagccggggcctggaggccgacacaagccagacccagcctctctgccattcgcaaatcccagtgttcaaacagagttctgccaaagaagagaagaaccagtaaaaagcagggaagaggctgggcgcggtggctcaygcctgtaatcccagcactttgggaggctgaggcgggcggatcacgaggtcaggagatcgagatcatcccggctaacatggtgaaactccgtctctactaaaagtacaaaaaagtagccaggtgtggtagcatgagcctgtagtcccagctactggggaggctgaggcaggagattcacttgaacctgggaggcggaggttgcagtgagctgagattgcaccactgcactccagcctgggaaacagaatgagactccatctcaaaaaaaaaaaaaaaaaaaaaaaaaaaagaaagtacagg

SEQ ID NO: 198459 - DNA, 601 bp, Human
agagagcgtcacaaaaattctaggaggtcagcaactttaggtaatgcccacacctgatgggggaaatcactgtcttccggcgggctggtcctctttggtgacagatgaagtcagatgcttccgggatgaatttggttcacctttgaaggacactttgaaagcaacacaacaaaactggctgggccttgtactctccgctccctcgagaagctccccgcccggtgccgctggcttctactgtttctaagctgcctgttgggcacgttccctcctggtggtcccggggcagccagacccaccmtgggacatccaggccccctgggcacagacatcttgtacaaggtcagagagactgggtttcgggcttcatgagcctcagaaattcagctctcaggaggctcgtgggaggcctccagggtcaggtctctgccggagagaaaaggggcggcctgggcttctcttcaaaagtgttacctgacaacaagggaattcagccacacaccaggtggctccgtggtcccctgaggtccccagcctttgacagtgtgtgtgtatgtggtgtgtggtgtgaaatgtgggtgtgatatgtgtgtgtggtatg

SEQ ID NO: 198460 - DNA, 601 bp, Human
gggaaatcactgtcttccggcgggctggtcctctttggtgacagatgaagtcagatgcttccgggatgaatttggttcacctttgaaggacactttgaaagcaacacaacaaaactggctgggccttgtactctccgctccctcgagaagctccccgcccggtgccgctggcttctactgtttctaagctgcctgttgggcacgttccctcctggtggtcccggggcagccagacccaccctgggacatccaggccccctgggcacagacatcttgtacaaggtcagagagactgggtttygggcttcatgagcctcagaaattcagctctcaggaggctcgtgggaggcctccagggtcaggtctctgccggagagaaaaggggcggcctgggcttctcttcaaaagtgttacctgacaacaagggaattcagccacacaccaggtggctccgtggtcccctgaggtccccagcctttgacagtgtgtgtgtatgtggtgtgtggtgtgaaatgtgggtgtgatatgtgtgtgtggtatgtgtgcatgtgtgtatgtgtgtgggggtatgtgtgtgtggtgtgtgtggtatggtgtgtgt

SEQ ID NO: 198461 - DNA, 601 bp, Human
ccttatgaagccccctccccgttcatgccgctcaatcgagtgactcttacagatcatcttgagctgcctcatggggtggggctcgcgttcccatctgccttctgcaaggtgtggcctctgacctgcagcccgcactgagccagcaagccgcgggagaggccaggcgcccgcagcggggcatctgcgcctggtgtgcagcgtacttgctatactcaggccagcccagccctgggccatctccctgagtttcagctccccggggccacctctcctgggtcccctctttgctgtggctctggckgacattagccagcagtggagagaagcccatctccacccccagggagctcagccgaggtctccgcgtcccagcaccagctgccttcagctcgagggtgtgttttcgggggtggggatcccacatggcacggctcctgcacgtccagggcatctgctagtcgtctttgcctgctccccagtgtcccaagcaactcagtaggaccttggggaagctgggtgctcacagaacaccttgtaagcgaatgaggaaagcaggcttgtccgctggccacactgcacgacagacgtctgcccaggctgg

SEQ ID NO: 198462 - DNA, 601 bp, Human
ctccccgttcatgccgctcaatcgagtgactcttacagatcatcttgagctgcctcatggggtggggctcgcgttcccatctgccttctgcaaggtgtggcctctgacctgcagcccgcactgagccagcaagccgcgggagaggccaggcgcccgcagcggggcatctgcgcctggtgtgcagcgtacttgctatactcaggccagcccagccctgggccatctccctgagtttcagctccccggggccacctctcctgggtcccctctttgctgtggctctggcggacattagccagcrgtggagagaagcccatctccacccccagggagctcagccgaggtctccgcgtcccagcaccagctgccttcagctcgagggtgtgttttcgggggtggggatcccacatggcacggctcctgcacgtccagggcatctgctagtcgtctttgcctgctccccagtgtcccaagcaactcagtaggaccttggggaagctgggtgctcacagaacaccttgtaagcgaatgaggaaagcaggcttgtccgctggccacactgcacgacagacgtctgcccaggctggggccgggggtctct

SEQ ID NO: 198463 - DNA, 601 bp, Human
ttttcgggggtggggatcccacatggcacggctcctgcacgtccagggcatctgctagtcgtctttgcctgctccccagtgtcccaagcaactcagtaggaccttggggaagctgggtgctcacagaacaccttgtaagcgaatgaggaaagcaggcttgtccgctggccacactgcacgacagacgtctgcccaggctggggccgggggtctctgctcctacagcccgcagatgggccacccggaggctgccccgtgatggctggacctgaggctttccagtgactaggagggcttgggyacttcttattcatgagctgtacgttctacagcgtggctggtcatttaatgtgtgcaatcgatgggcactgcgcttcaacttcaaagcatgaccgggcggatcaatctcccagggccgcgggtgccgagtttaaaactcatctctttttctaaagtggaggcaagggaccccagtttgggattaatcagcagtgatgagcttaaataaatgagataaattttctatctatcttgtaaggctttttttcagaattaatgggacccctctacaatgcgctgtgcccggggagaggaagggggc

SEQ ID NO: 198464 - DNA, 601 bp, Human
cagtaggaccttggggaagctgggtgctcacagaacaccttgtaagcgaatgaggaaagcaggcttgtccgctggccacactgcacgacagacgtctgcccaggctggggccgggggtctctgctcctacagcccgcagatgggccacccggaggctgccccgtgatggctggacctgaggctttccagtgactaggagggcttgggtacttcttattcatgagctgtacgttctacagcgtggctggtcatttaatgtgtgcaatcgatgggcactgcgcttcaacttcaaagcatgacygggcggatcaatctcccagggccgcgggtgccgagtttaaaactcatctctttttctaaagtggaggcaagggaccccagtttgggattaatcagcagtgatgagcttaaataaatgagataaattttctatctatcttgtaaggctttttttcagaattaatgggacccctctacaatgcgctgtgcccggggagaggaagggggcgcagctgcatctgcagctgcggttgtggtcgggagaatgagggcctggagctgcccaggacgggctcaggcacaggcgcccagccgagagtcc

SEQ ID NO: 198465 - DNA, 601 bp, Human
acttcaaagcatgaccgggcggatcaatctcccagggccgcgggtgccgagtttaaaactcatctctttttctaaagtggaggcaagggaccccagtttgggattaatcagcagtgatgagcttaaataaatgagataaattttctatctatcttgtaaggctttttttcagaattaatgggacccctctacaatgcgctgtgcccggggagaggaagggggcgcagctgcatctgcagctgcggttgtggtcgggagaatgagggcctggagctgcccaggacgggctcaggcacaggcrcccagccgagagtcccctgctgttccctctgcagagcaaatacagtttctgctgaaaagaatgtggcagatgaacaaaaattgtaaggttttctaaaggtgtttcattacgtgagatggcagaggttggtctccatgtcacagatgaccctcgcggcggtgataacctttacattttggggtgctctgtggaccccctgtgtaccctgtgagtatgcacgtttctagaggtggagtttgacccttgaattgttcaaattataagtagaatcacagaaattgggggaggaaaggatctgag

SEQ ID NO: 198466 - DNA, 601 bp, Human
tcacacctccctgctccacccaggctgcctgcacttccggttctgcgtctggccggcctacgggcactcgggcagtgcggtgaccaattatagcgtcgacgatggcagcttccctctgaaagcccattgtgtctgcccctattctttgaagcttcactgctttcggataagtatgaaaataggctctccctctctgagtcaaaggaggcaattatacaataggactatcaccctcactgtcactctccgctttgtttaaatgtggggatttcatttcttcatcgcctctgtgaacacccastaaaaccgtaagtgggaaaagtgggtgccttctgtattttacattttttattgtgtcacttactgcaaagcagctcaaggagcctgaagacacccagcctgaaaccacgataaatgtgtggagttgtggagacagctcaccagcagaacagtgagctaccttctctcccagtaaccttttccagaggaaacctctttgaaatatcacaagcaaaatttaaatcacaaaatacttcatatctgcctgcactcattgtcatgctaaagcacatcacctcggtcctcagagaggagggatttc

SEQ ID NO: 198467 - DNA, 601 bp, Human
gaggctcctggggctcaagctcaaagccccctcacctgtgcatctaggaggcacttcggcggggtcgggggcggggggggctcaagctaaaagcccctcacctgtgcacctgggtggcacctgggagggggactcaagctcaaagccccctcacctgtgcatctagggggcactttggcaggagggagggtgctcaaactaaaagcccctcacctatgcacctgggaggcccccaggagctgcagcaaagctgggccccagccacagcctgcaaaatctccgactccacatggggcctcakcaccgtctgtttgctcaccctccccagggggctgaggctgggaaccactgctctttaactctcaacctcttcccaaggtgctgtctatctgtggcccttggagttctgtactcggcagtcatttatttacaagtcgcatgagaaagtccttccagccactttctgtgcttgctctgacatttgcccaaactaacgttgctgaggttgacctcatgtttattcagggaacttgattcattttcaagctattgataacaacaaagtcctccccaaccaaggaacttccgccatggaggcgtt

SEQ ID NO: 198468 - DNA, 601 bp, Human
acttgattcattttcaagctattgataacaacaaagtcctccccaaccaaggaacttccgccatggaggcgttttcaaaagaaagtgcttgtgctcatccccagagggttcctgagcctgtggacgaggcgggaggcgggaggtggaggaggtggcacctggcagctcacctggtgtaccttctgtgagacccagccagcccatcggtcaccaaggggtgcatgtcacaccctgacctgcctgacggagggagcccatgaagcagaacaaacacatgtgatgctgacgccctcagaaaccyggggctaaggccacacctgatcaccgtgatggaggggggcaggcgccgaggcgaacttgggagaggccctatggtgcacacccctacccttcctggctggagaaaaatggcccgccccgtgaaacagcaaataaacacacgcgttccaggacgtgagatacggcctccacatcaatcagagggacctgcccagtcctgtcaattttccatctaaattacataactgtcctccttagagacgcggggatgcccaggcacaggcatgaaagatcggccttgaggttattttgtctctgcaag

SEQ ID NO: 198469 - DNA, 601 bp, Human
gctattgataacaacaaagtcctccccaaccaaggaacttccgccatggaggcgttttcaaaagaaagtgcttgtgctcatccccagagggttcctgagcctgtggacgaggcgggaggcgggaggtggaggaggtggcacctggcagctcacctggtgtaccttctgtgagacccagccagcccatcggtcaccaaggggtgcatgtcacaccctgacctgcctgacggagggagcccatgaagcagaacaaacacatgtgatgctgacgccctcagaaacctggggctaaggccacacstgatcaccgtgatggaggggggcaggcgccgaggcgaacttgggagaggccctatggtgcacacccctacccttcctggctggagaaaaatggcccgccccgtgaaacagcaaataaacacacgcgttccaggacgtgagatacggcctccacatcaatcagagggacctgcccagtcctgtcaattttccatctaaattacataactgtcctccttagagacgcggggatgcccaggcacaggcatgaaagatcggccttgaggttattttgtctctgcaagtattgatgcgaggactt

SEQ ID NO: 198470 - DNA, 601 bp, Human
gcttgtgctcatccccagagggttcctgagcctgtggacgaggcgggaggcgggaggtggaggaggtggcacctggcagctcacctggtgtaccttctgtgagacccagccagcccatcggtcaccaaggggtgcatgtcacaccctgacctgcctgacggagggagcccatgaagcagaacaaacacatgtgatgctgacgccctcagaaacctggggctaaggccacacctgatcaccgtgatggaggggggcaggcgccgaggcgaacttgggagaggccctatggtgcacacccctrcccttcctggctggagaaaaatggcccgccccgtgaaacagcaaataaacacacgcgttccaggacgtgagatacggcctccacatcaatcagagggacctgcccagtcctgtcaattttccatctaaattacataactgtcctccttagagacgcggggatgcccaggcacaggcatgaaagatcggccttgaggttattttgtctctgcaagtattgatgcgaggacttgtggcgcttttctttcccggtgaactttcccaactgctgatgttacgtgcactaagcacatgattttcc

SEQ ID NO: 198471 - DNA, 601 bp, Human
gaggacttgtggcgcttttctttcccggtgaactttcccaactgctgatgttacgtgcactaagcacatgattttcctattcattcccgaatctcacattttaccgggatggtgacatccctgtggggccttgtgggctctgagctcatctacacccaatcctagtcagctctgctgcccctgcggggtaaactggcagctctgagttcactgggtgctgtttactgaacgcctgcccatggaagccactgtcctcatcactgggaaaggcgcagagaagagaaggaaacgttaaaaatcyggttggagagaggaaacaaacttggaccatctttgacagtggtattagtccattctccatggctacaaagaaacacctgagactggatgattctaggaaagaggcttaatcggctcagagctctgcaggttgcacagggagcacggcagcttctgcttctggggaggcctcagggagcttccagtcacggtggaaggcgaaagggaagcaatctcgtcccacggtgggcgtaggcgcaaggtgggaggggctacccaggtttaaacacacgggtctcagaaaactcactatcatgagaac

SEQ ID NO: 198472 - DNA, 601 bp, Human
aggaaacaaacttggaccatctttgacagtggtattagtccattctccatggctacaaagaaacacctgagactggatgattctaggaaagaggcttaatcggctcagagctctgcaggttgcacagggagcacggcagcttctgcttctggggaggcctcagggagcttccagtcacggtggaaggcgaaagggaagcaatctcgtcccacggtgggcgtaggcgcaaggtgggaggggctacccaggtttaaacacacgggtctcagaaaactcactatcatgagaacagcaaggagarggtggtgcaaaaccattcaaaaatcacccccaagtccagtcaccaccccccaggccccacacccaacactggggattacggttcgacaggagattttggggcacactgatccaaccatctcaacagcaaagagtgatctgcctcgagttccgactcgccgctcagacgaactcacggctcagctgggagaatcacacgggaggggcccatgaacgggcactggggccacagccggggattcaactgcaccgaaatcccagccctcaacacggcccacggctgtgtcatcccggatttatc

SEQ ID NO: 198473 - DNA, 601 bp, Human
acttggaccatctttgacagtggtattagtccattctccatggctacaaagaaacacctgagactggatgattctaggaaagaggcttaatcggctcagagctctgcaggttgcacagggagcacggcagcttctgcttctggggaggcctcagggagcttccagtcacggtggaaggcgaaagggaagcaatctcgtcccacggtgggcgtaggcgcaaggtgggaggggctacccaggtttaaacacacgggtctcagaaaactcactatcatgagaacagcaaggagagggtggtgcwaaaccattcaaaaatcacccccaagtccagtcaccaccccccaggccccacacccaacactggggattacggttcgacaggagattttggggcacactgatccaaccatctcaacagcaaagagtgatctgcctcgagttccgactcgccgctcagacgaactcacggctcagctgggagaatcacacgggaggggcccatgaacgggcactggggccacagccggggattcaactgcaccgaaatcccagccctcaacacggcccacggctgtgtcatcccggatttatcactataaag

SEQ ID NO: 198474 - DNA, 601 bp, Human
aatcggctcagagctctgcaggttgcacagggagcacggcagcttctgcttctggggaggcctcagggagcttccagtcacggtggaaggcgaaagggaagcaatctcgtcccacggtgggcgtaggcgcaaggtgggaggggctacccaggtttaaacacacgggtctcagaaaactcactatcatgagaacagcaaggagagggtggtgcaaaaccattcaaaaatcacccccaagtccagtcaccaccccccaggccccacacccaacactggggattacggttcgacaggagatttkggggcacactgatccaaccatctcaacagcaaagagtgatctgcctcgagttccgactcgccgctcagacgaactcacggctcagctgggagaatcacacgggaggggcccatgaacgggcactggggccacagccggggattcaactgcaccgaaatcccagccctcaacacggcccacggctgtgtcatcccggatttatcactataaagcaaaaccaaaaacggacctcaggtttctctgcaatatgtaggatccgtgaaacctccaacgtgaaatgagaagtaggtagcctcgaat

SEQ ID NO: 198475 - DNA, 601 bp, Human
aaaacggacctcaggtttctctgcaatatgtaggatccgtgaaacctccaacgtgaaatgagaagtaggtagcctcgaatctgcacccaggcagccccaaaggctatctgatgacaacacacattttctcatgaagcggaggagagtccggccttgttgctgggcctgcaggacatcccatcgctcatcttaattctcctgagggtgatatttacacctgatatttacaaggtgtggcaagtgagaatttcatcccagcctcctgcctggcaggttacacaagctggccacagggatgctwatgggctgaggtcgtgggaggcatcccgtgagggtcacaggctgaggtcgtgggaggcatcccgtgagggtcacacaggcaaagactgtcagccaaaaggaattccaaggcccggacgggaggcggccacaggctcctgggtgtgctgtgggacgtaccactcggtggcagggcctggccagagagctgccctgcaggcctgtgggatccttcaacgcgaagcttgcattccaggagctccctgagccctgagaccatggtgaggggctgcgttgggccaggctgggtgtgcacctgtca

SEQ ID NO: 198476 - DNA, 601 bp, Human
gtaggtagcctcgaatctgcacccaggcagccccaaaggctatctgatgacaacacacattttctcatgaagcggaggagagtccggccttgttgctgggcctgcaggacatcccatcgctcatcttaattctcctgagggtgatatttacacctgatatttacaaggtgtggcaagtgagaatttcatcccagcctcctgcctggcaggttacacaagctggccacagggatgcttatgggctgaggtcgtgggaggcatcccgtgagggtcacaggctgaggtcgtgggaggcatcccrtgagggtcacacaggcaaagactgtcagccaaaaggaattccaaggcccggacgggaggcggccacaggctcctgggtgtgctgtgggacgtaccactcggtggcagggcctggccagagagctgccctgcaggcctgtgggatccttcaacgcgaagcttgcattccaggagctccctgagccctgagaccatggtgaggggctgcgttgggccaggctgggtgtgcacctgtcagttacattttcctatgtgtcctccttcctttctttggagcctgaatctttgtctttagcatcct

SEQ ID NO: 198477 - DNA, 601 bp, Human
atgacaaccccatcgggtcagagaggtagtggttgcagctgggcctggcccaccatcggggtggggccagcaggagcaggagcacgctgtgtgctcgtggggaggaagggctgggtgaggctggagcgtgggtgggaggtgctggacagggatgctgagggcaacgggccctccctgcaccgaggcttcagcagccctgctctctgctgtcagcctcggatccgggctggcctggccttcatctctccccaggctccaaagaccccacatcgccatctcttgccgtgagacctccccacgstgaacgtgtgttcctctagccacttactcaacgtctccactgcaggccccagtgtaacttggccaagcagacatttcattttccccaccagagcagacccagcccagggctccctcctcaccttgggacctacagcaggtcctgccccagctccatgtgcgggtccctcatctgactcgcacactgcccctccgactggcccagggcctccactccagcgtgtgctcctcaggcccagtgttctgagcgtggagtgaactttctaagtcacaatttaagtcacatccctctccctctgga

SEQ ID NO: 198478 - DNA, 601 bp, Human
accccatcgggtcagagaggtagtggttgcagctgggcctggcccaccatcggggtggggccagcaggagcaggagcacgctgtgtgctcgtggggaggaagggctgggtgaggctggagcgtgggtgggaggtgctggacagggatgctgagggcaacgggccctccctgcaccgaggcttcagcagccctgctctctgctgtcagcctcggatccgggctggcctggccttcatctctccccaggctccaaagaccccacatcgccatctcttgccgtgagacctccccacgctgaacrtgtgttcctctagccacttactcaacgtctccactgcaggccccagtgtaacttggccaagcagacatttcattttccccaccagagcagacccagcccagggctccctcctcaccttgggacctacagcaggtcctgccccagctccatgtgcgggtccctcatctgactcgcacactgcccctccgactggcccagggcctccactccagcgtgtgctcctcaggcccagtgttctgagcgtggagtgaactttctaagtcacaatttaagtcacatccctctccctctggaaatgtc

SEQ ID NO: 198479 - DNA, 601 bp, Human
cggcctcctccatccctcagaggcaccacaggcggcctccccatccctcagaggtaccacagatgccctcctccatccctcagaggcaccacagccagcctgcgtggcctctgtgtttctccccggggtctttccaggctgggcttcttctcgtcctaacgctcagaggcctctgcttagccccaccttccatcactgtgccctcttctcctttcttcacatcacaccttactagaaattacccggtcactatagtgcctgtcccttctccgcgacaaggggacccctagcgtgcttcccygctgcgctcccagctcctacaacagtgtctggcccctcaaagcgactcaacgaccctctgctgatccaaagactcggcatccatgtgcctcccaggccgccgcactcctcctcctgggaacaccctcgtacggacgttctgtggaaatagatgttgtgttttcacctcttgtaccttgttcacttaaaatttaatcaacatcttattagagaaagaaagaggttctttgctttttttaacttttaaaatatgaatacctgccgggtgcggtggctcaggcctgtaatcccagcactttgg

SEQ ID NO: 198480 - DNA, 601 bp, Human
atatgaatacctgccgggtgcggtggctcaggcctgtaatcccagcactttgggaggccgaggcgggcggatcacgaggtcaggagatcgagaccatcctggccaacacggtgaaaccccgtctctactaaaaatacaaaaaaccagccgggtgtggtggcgggcacctgtagtcccagctactcaggaggctgaggcaggagaatggcgtgaacccgggaggcggagcttgcagtgagccgagatcgcaccactgcactccagcctgggcaacagagagagactccgtttcaaaaaaaawatatatatacatatatatatatacacacacatatatatacacacatatacatatacacacacatatatatacacatatatatacacatatatacacatatatatacacatatatatacacacacacacacatatatatatgcacatatatatgaatacccaatacccaatccacagctttctctttgtggtgcttatgtggtgtcacaatgcgtcttgtgcctctcatctgattccgctacacggtgcaagttacgccagaccagaaactgaaccgacgctgaaagtatcaggccttccg

SEQ ID NO: 198481 - DNA, 601 bp, Human
gtggctcaggcctgtaatcccagcactttgggaggccgaggcgggcggatcacgaggtcaggagatcgagaccatcctggccaacacggtgaaaccccgtctctactaaaaatacaaaaaaccagccgggtgtggtggcgggcacctgtagtcccagctactcaggaggctgaggcaggagaatggcgtgaacccgggaggcggagcttgcagtgagccgagatcgcaccactgcactccagcctgggcaacagagagagactccgtttcaaaaaaaatatatatatacatatatatatayacacacacatatatatacacacatatacatatacacacacatatatatacacatatatatacacatatatacacatatatatacacatatatatacacacacacacacatatatatatgcacatatatatgaatacccaatacccaatccacagctttctctttgtggtgcttatgtggtgtcacaatgcgtcttgtgcctctcatctgattccgctacacggtgcaagttacgccagaccagaaactgaaccgacgctgaaagtatcaggccttccgcttagcgctgccttcgagatca

SEQ ID NO: 198482 - DNA, 601 bp, Human
ccgtctctactaaaaatacaaaaaaccagccgggtgtggtggcgggcacctgtagtcccagctactcaggaggctgaggcaggagaatggcgtgaacccgggaggcggagcttgcagtgagccgagatcgcaccactgcactccagcctgggcaacagagagagactccgtttcaaaaaaaatatatatatacatatatatatatacacacacatatatatacacacatatacatatacacacacatatatatacacatatatatacacatatatacacatatatatacacatatatatayacacacacacacatatatatatgcacatatatatgaatacccaatacccaatccacagctttctctttgtggtgcttatgtggtgtcacaatgcgtcttgtgcctctcatctgattccgctacacggtgcaagttacgccagaccagaaactgaaccgacgctgaaagtatcaggccttccgcttagcgctgccttcgagatcagtctctcgacccctgttaggagcaacggcggtgaggcaggatgaacggcctcatccacggagcactgctttgccgtctccagaaagagctgtcgag

SEQ ID NO: 198483 - DNA, 601 bp, Human
tgtggtggcgggcacctgtagtcccagctactcaggaggctgaggcaggagaatggcgtgaacccgggaggcggagcttgcagtgagccgagatcgcaccactgcactccagcctgggcaacagagagagactccgtttcaaaaaaaatatatatatacatatatatatatacacacacatatatatacacacatatacatatacacacacatatatatacacatatatatacacatatatacacatatatatacacatatatatacacacacacacacatatatatatgcacatatatakgaatacccaatacccaatccacagctttctctttgtggtgcttatgtggtgtcacaatgcgtcttgtgcctctcatctgattccgctacacggtgcaagttacgccagaccagaaactgaaccgacgctgaaagtatcaggccttccgcttagcgctgccttcgagatcagtctctcgacccctgttaggagcaacggcggtgaggcaggatgaacggcctcatccacggagcactgctttgccgtctccagaaagagctgtcgaggtttatttattcacggagaggctctgcatcacga

SEQ ID NO: 198484 - DNA, 601 bp, Human
ggaggctgaggcaggagaatggcgtgaacccgggaggcggagcttgcagtgagccgagatcgcaccactgcactccagcctgggcaacagagagagactccgtttcaaaaaaaatatatatatacatatatatatatacacacacatatatatacacacatatacatatacacacacatatatatacacatatatatacacatatatacacatatatatacacatatatatacacacacacacacatatatatatgcacatatatatgaatacccaatacccaatccacagctttctcttygtggtgcttatgtggtgtcacaatgcgtcttgtgcctctcatctgattccgctacacggtgcaagttacgccagaccagaaactgaaccgacgctgaaagtatcaggccttccgcttagcgctgccttcgagatcagtctctcgacccctgttaggagcaacggcggtgaggcaggatgaacggcctcatccacggagcactgctttgccgtctccagaaagagctgtcgaggtttatttattcacggagaggctctgcatcacgagagtgctgcgttaacccaggtgcgggggatatta

SEQ ID NO: 198485 - DNA, 601 bp, Human
gccgtctccagaaagagctgtcgaggtttatttattcacggagaggctctgcatcacgagagtgctgcgttaacccaggtgcgggggatattatcctccccgtgagagcagctgcatggatttttttaatgtcaaattccatatgaaacagcacaaatccccatttctgccccactgggttgagaaatctgtgggtgatagagtataggtaaaaacatcttagcctgcatgaaaacaaacatcatcttagaagaaggaaagagcaaatgttttaaaggcctaaaaataataattttctctmgggaaaaatttgatgggcacgctatgatttattgccaaatgatatttaagaaaaattcacaggagaggcggctgctgaatgcctccaccgagggttctgggaaggaaaacgcccgcttagtggaagaacagaacggccgcacagaaagtgcttggtccttggcttcctgtgtctcccccaaaacacacgtggcttatcagaaacctgcaggaaaacaacacagatttattctctcacaggaggccacggtccagatgggtttcactgagctgaagtcagggcttgggtgggccgcacgct

SEQ ID NO: 198486 - DNA, 601 bp, Human
taacccaggtgcgggggatattatcctccccgtgagagcagctgcatggatttttttaatgtcaaattccatatgaaacagcacaaatccccatttctgccccactgggttgagaaatctgtgggtgatagagtataggtaaaaacatcttagcctgcatgaaaacaaacatcatcttagaagaaggaaagagcaaatgttttaaaggcctaaaaataataattttctctagggaaaaatttgatgggcacgctatgatttattgccaaatgatatttaagaaaaattcacaggagaggcrgctgctgaatgcctccaccgagggttctgggaaggaaaacgcccgcttagtggaagaacagaacggccgcacagaaagtgcttggtccttggcttcctgtgtctcccccaaaacacacgtggcttatcagaaacctgcaggaaaacaacacagatttattctctcacaggaggccacggtccagatgggtttcactgagctgaagtcagggcttgggtgggccgcacgctctggggcggctcctgaccttttctggcttgtggcacctggctggacttctcggggtgcagctccttcgtc

SEQ ID NO: 198487 - DNA, 601 bp, Human
aaacagcacaaatccccatttctgccccactgggttgagaaatctgtgggtgatagagtataggtaaaaacatcttagcctgcatgaaaacaaacatcatcttagaagaaggaaagagcaaatgttttaaaggcctaaaaataataattttctctagggaaaaatttgatgggcacgctatgatttattgccaaatgatatttaagaaaaattcacaggagaggcggctgctgaatgcctccaccgagggttctgggaaggaaaacgcccgcttagtggaagaacagaacggccgcacagcaagtgcttggtccttggcttcctgtgtctcccccaaaacacacgtggcttatcagaaacctgcaggaaaacaacacagatttattctctcacaggaggccacggtccagatgggtttcactgagctgaagtcagggcttgggtgggccgcacgctctggggcggctcctgaccttttctggcttgtggcacctggctggacttctcggggtgcagctccttcgtccaccgtgaaacccgccccggcgtccctctccgactccgcttccttcatgggacttcacttccgtgtgctaagaac

SEQ ID NO: 198488 - DNA, 601 bp, Human
aattcacaggagaggcggctgctgaatgcctccaccgagggttctgggaaggaaaacgcccgcttagtggaagaacagaacggccgcacagaaagtgcttggtccttggcttcctgtgtctcccccaaaacacacgtggcttatcagaaacctgcaggaaaacaacacagatttattctctcacaggaggccacggtccagatgggtttcactgagctgaagtcagggcttgggtgggccgcacgctctggggcggctcctgaccttttctggcttgtggcacctggctggacttctcggsgtgcagctccttcgtccaccgtgaaacccgccccggcgtccctctccgactccgcttccttcatgggacttcacttccgtgtgctaagaacgtgtagcgaggcccaccgtgttgacacttccctgagtgtgcagcgtggtactgttggctctcaaccgtacggcagatgtcgagaccgcgttgaggccgcgtcgctgaaaccttgtgcccttggaacggccccttcccgtgcttcccccagcgccagacccggcagcctccatcctcctctcttcttcggtgcgttcaattgtcatagat

SEQ ID NO: 198489 - DNA, 601 bp, Human
ggccccttcccgtgcttcccccagcgccagacccggcagcctccatcctcctctcttcttcggtgcgttcaattgtcatagattccacgcttcagcgacgtcgtgcagcctctgtcctgggcctggcttttgtttcacttcacgtcatgtcatgcaggtttatccctgttgttgcagatggcaggttgtccgtcttgtcttaaggctgaagagcacccactgggtctatgcaccacgctttcctgcccgctcgtccctgggggacatgtgcttccatgtcttggctcctgtgaacaatgcygtgatgaactccggagcgcacccgtcacttcgaggtcctgatttaacttcctttggataaatatctggaagtgggattgctgaatcatatggtggctctatttttaattttttgagaaaacttcatactgttttccataatggttgcaccatttatattcccaccaacagcatgtaagtgttcagagtctacacatcctcaccaacacacgtctttttggtcacagcctcctgatgggtacagagacgtatctcatcgtggctctgatttgcatgttcctgatcattagtgatgttgagc

SEQ ID NO: 198490 - DNA, 601 bp, Human
acctttcgtgggctgccctctggatttgctgattgtttccctgctgatgcaggagctcactggtttgatgttgtcctgcatgttcacatttgcttctgttgcttgtgcctttggtgtcagatccaagaaacctttgcctagatgaatgtcatcatgcttcccccgtgttttcttctagtacgtttatggtttccagtcttatgtctcagtctttagcccatgttgagtgggtttttgtggatgtgaggtgagggtccgatgccgttcttttgcatgtggacatccagtttccccagcaccygtgaagaggcgacccttccctatggtgtattctcctcatgcttatgaaggagcacttggcagtgtatgagttgtttctggactctctgttccattgatctataagtctgtttttatgccagtagtgtattgttttaataaccatagctttgtaatatattttggaattgggaactgttgcatgattttttgtggagctctgggcaggtttttcatgatggcaaaatatgtcaacttttctttttggtgtaatttcttcattgctaacattttccctagacagtgaaataataaacatttt

SEQ ID NO: 198491 - DNA, 601 bp, Human
aggttaccctctcgccatgcagtgccctcactgcccttgctgcccctgagctctcagagggatgcgctgcctcagcgtggggtgggagtgccgctctgcacactagactcagtcctctctctgcctggaaatacccacaaaggccacaggatacagataatagctgtactggtgctctcagacacattttccatgaaaagaagaaaatagcaaattccagtaagcattaaggaaactccttctctgggagtctctgttcctctcccccacagtgcttcttatactgtgcatttgaaaggtsttttaaaaggacttgttgtttctttaagaagcatagaaaaaatatatatactcctgtgtgtgtgtgtgtgtgtgtgtgtgtgcgtgtgcaaatacatcatcaactgaaggtctgaagaaaagggaaaagatcgcagctcatcaggaatgaaaggtggcttgttctccagcatcctagttaaaagttcaaagcacatttttcttataaattaggctggagtaaaattcagggagatgggaaaaggaagacataaatttttaaaacatgcgaagaatttaaatgagcaccaggggtgaaaat

SEQ ID NO: 198492 - DNA, 601 bp, Human
agagggatgcgctgcctcagcgtggggtgggagtgccgctctgcacactagactcagtcctctctctgcctggaaatacccacaaaggccacaggatacagataatagctgtactggtgctctcagacacattttccatgaaaagaagaaaatagcaaattccagtaagcattaaggaaactccttctctgggagtctctgttcctctcccccacagtgcttcttatactgtgcatttgaaaggtgttttaaaaggacttgttgtttctttaagaagcatagaaaaaatatatatactccggtgtgtgtgtgtgtgtgtgtgtgtgtgcgtgtgcaaatacatcatcaactgaaggtctgaagaaaagggaaaagatcgcagctcatcaggaatgaaaggtggcttgttctccagcatcctagttaaaagttcaaagcacatttttcttataaattaggctggagtaaaattcagggagatgggaaaaggaagacataaatttttaaaacatgcgaagaatttaaatgagcaccaggggtgaaaattagacacatagaacatgtattcgacgtaaactcccggttgtttaaagtcattaac

SEQ ID NO: 198493 - DNA, 601 bp, Human
agaaaagggaaaagatcgcagctcatcaggaatgaaaggtggcttgttctccagcatcctagttaaaagttcaaagcacatttttcttataaattaggctggagtaaaattcagggagatgggaaaaggaagacataaatttttaaaacatgcgaagaatttaaatgagcaccaggggtgaaaattagacacatagaacatgtattcgacgtaaactcccggttgtttaaagtcattaacgttgtgtcgttatgtctagtgtcaggttatggctccacagcctgtttgccagttaagcggygggggcagggcaggccttggtcaatatttgagtaaaagaagaatcttaataaacccaagaaagtaacttcaataataagaccaggcagtgttttgcaaagcagaacagaagcaattcaaaagggagagagacacagccagaggccccaggagcccccaccttggggacatggagtgtctgtgtgagcctggctttgttctgaggcaggagggacccgagtgcttggggccagccctgtcctgttctgcgttagcgatggggtctggtgcttctccacacacaccgtggctgtgtgtgcac

SEQ ID NO: 198494 - DNA, 601 bp, Human
agccctgtcctgttctgcgttagcgatggggtctggtgcttctccacacacaccgtggctgtgtgtgcaccggctgggtgacggcccaggtggttttgtgccagctgctgatgctgagtgcacctgaaaggcccacttagcctctttgtgaagaggtgtgggaagatgtgcacacagtagagagcagactatcacaagccacaaaaatgtgtgtgtgtgtaatatatataaaggtcgaccattccttatctgaagtgattggaaccagaagtgtctcaaattttgcattttagaatatttrcatcacacttactggttgagcatcccaaatacaaaaatctgaaatccaagatgctccaaatcagcattttcctttagggtcaggcctatgctcaaaaagttttcgatttgggggcattttgggttttagatctgggatgctcaacctgtaggtgcatgtatatatgtgtatatatgtatatctacatatgtattcatgcatgtgtacaaaaatatgcacatatgtacatacagatgtatctgtatatatgtatatgtgtgcatgtatgtgtgcatatgtgtctatagatgtctggtatat

SEQ ID NO: 198495 - DNA, 601 bp, Human
gtcctgttctgcgttagcgatggggtctggtgcttctccacacacaccgtggctgtgtgtgcaccggctgggtgacggcccaggtggttttgtgccagctgctgatgctgagtgcacctgaaaggcccacttagcctctttgtgaagaggtgtgggaagatgtgcacacagtagagagcagactatcacaagccacaaaaatgtgtgtgtgtgtaatatatataaaggtcgaccattccttatctgaagtgattggaaccagaagtgtctcaaattttgcattttagaatatttacatcayacttactggttgagcatcccaaatacaaaaatctgaaatccaagatgctccaaatcagcattttcctttagggtcaggcctatgctcaaaaagttttcgatttgggggcattttgggttttagatctgggatgctcaacctgtaggtgcatgtatatatgtgtatatatgtatatctacatatgtattcatgcatgtgtacaaaaatatgcacatatgtacatacagatgtatctgtatatatgtatatgtgtgcatgtatgtgtgcatatgtgtctatagatgtctggtatatatgtat

SEQ ID NO: 198496 - DNA, 601 bp, Human
caaaaatgtgtgtgtgtgtaatatatataaaggtcgaccattccttatctgaagtgattggaaccagaagtgtctcaaattttgcattttagaatatttacatcacacttactggttgagcatcccaaatacaaaaatctgaaatccaagatgctccaaatcagcattttcctttagggtcaggcctatgctcaaaaagttttcgatttgggggcattttgggttttagatctgggatgctcaacctgtaggtgcatgtatatatgtgtatatatgtatatctacatatgtattcatgcaygtgtacaaaaatatgcacatatgtacatacagatgtatctgtatatatgtatatgtgtgcatgtatgtgtgcatatgtgtctatagatgtctggtatatatgtatatgtgcaggtgtaaatgtgtgcaatagatgcatatacgtgtatatgtgtgtatgtatgtatacatagatgcatatgtgtgtatacatgtatatgcgtgtacatctgtgtgcccataaagatatatgcatgtgtatgtgcatacgcatgtatgtgtgtgtgtgtgtacatcttctgtctctgcattcttactggca

SEQ ID NO: 198497 - DNA, 601 bp, Human
atatgcgtgtacatctgtgtgcccataaagatatatgcatgtgtatgtgcatacgcatgtatgtgtgtgtgtgtgtacatcttctgtctctgcattcttactggcaggattattgggaactattggatctttctgaggaggccaggatgatttccgtggcctgccagtttctcagagctatctgggttgaggcactgagaaccccctcagtccaggcagaccagggcccggtggtctgcatgaacaaagtgagtacttggagggccactggcatgggcccagcttcccgctctcctctgcrtgcacagcctctatcccatcagacctgcacctcagcagcaccaagctcaggggctgccctgggctcccctctgagcatcagctcctctgttccagggagagcctctgctcccctcagggcccacctccttctagcagaaagctgattcttccccagactgggccctcagttctctgctaggtttggccaggctggtgtctttgacatgatcttctgggaggagaggcagaaatggggcccttccgatgtagctggcaaagctgtaggtgaacggtttgtaccaccagggaactgtgcccg

SEQ ID NO: 198498 - DNA, 601 bp, Human
tgctgcacacacatggcagccagaacgagtgtgggttcagagagcaggaatagcactccctgcccttgtcatgctgtggccaaggtttaggactccacagggcccagatgtctcctctggtcccaggaggatggagcctcagacctggggccatggggagggaagaggtgttccttgggacaagcaggagcccagtgggcagatgcctttctgcacagccaggggactgctcctatttctactgtttgcctggcccaattcatcacaggagggtgagggcagggctgcatgcctgagagcygacaaatccttcacatcctggagctttgtactgaacactgcagggttccatacagctgtcagctgcagagactaggcaccgcccctgcaaatgcctggcctcctgctgtccagctgccttcactctggcccggaagtggttctggggacagtggcttccttccagggcagaagctgagatccagtgtctgtggagcctctcatggcacgtcaggctctgggatggatgtttacgtgggttaccctaccaaatccctgagaactgctgctatgattcccactttacagatgagaaaactga

SEQ ID NO: 198499 - DNA, 601 bp, Human
ccaaggtttaggactccacagggcccagatgtctcctctggtcccaggaggatggagcctcagacctggggccatggggagggaagaggtgttccttgggacaagcaggagcccagtgggcagatgcctttctgcacagccaggggactgctcctatttctactgtttgcctggcccaattcatcacaggagggtgagggcagggctgcatgcctgagagctgacaaatccttcacatcctggagctttgtactgaacactgcagggttccatacagctgtcagctgcagagactaggcaycgcccctgcaaatgcctggcctcctgctgtccagctgccttcactctggcccggaagtggttctggggacagtggcttccttccagggcagaagctgagatccagtgtctgtggagcctctcatggcacgtcaggctctgggatggatgtttacgtgggttaccctaccaaatccctgagaactgctgctatgattcccactttacagatgagaaaactgaggcttagaacattaagcactgtgagctgagatcattggctagtgagcagcagagctgaggtccaactccaagtgtgttt

SEQ ID NO: 198500 - DNA, 601 bp, Human
agtggttctggggacagtggcttccttccagggcagaagctgagatccagtgtctgtggagcctctcatggcacgtcaggctctgggatggatgtttacgtgggttaccctaccaaatccctgagaactgctgctatgattcccactttacagatgagaaaactgaggcttagaacattaagcactgtgagctgagatcattggctagtgagcagcagagctgaggtccaactccaagtgtgtttgcccccaaactcacactctgtaaaagtccatgggcatcccagatctcccacccatrtcttcccactggaccaggcatccccagcctctgggccacggactgacaccagtctgtggcctgttaggaactggggtgcacagcaggaggtgagtggtgggtgagtgagctgttgagtggccggtgagtggtgggtgagtgagcaggtgagtggcaggtaggtgagtgggtgagtggcgggagagtgagctgttgagtggccggtgagtggtgggtgagtgagtacgtgagtggcaggtaagcgggtgagtggcgggtgagtgagcgagtgaaactttgtcggtatttatagccagtccc

SEQ ID NO: 198501 - DNA, 601 bp, Human
aagcactgtgagctgagatcattggctagtgagcagcagagctgaggtccaactccaagtgtgtttgcccccaaactcacactctgtaaaagtccatgggcatcccagatctcccacccatgtcttcccactggaccaggcatccccagcctctgggccacggactgacaccagtctgtggcctgttaggaactggggtgcacagcaggaggtgagtggtgggtgagtgagctgttgagtggccggtgagtggtgggtgagtgagcaggtgagtggcaggtaggtgagtgggtgagtggcrggagagtgagctgttgagtggccggtgagtggtgggtgagtgagtacgtgagtggcaggtaagcgggtgagtggcgggtgagtgagcgagtgaaactttgtcggtatttatagccagtccccatggctcacagtactgcctgggctccacctcctgtcagctcagcagtggcatcagattctcataggagcttgagccctgttgtgaactgtgcatgtgagggatccaggttgcacgctccttatgaaaatctaatgcctgatgatctgtcactgtctcccatcacccccagatgggacc

SEQ ID NO: 198502 - DNA, 601 bp, Human
gaattgaccttgttgaaaacactcttttggattaagcatctataagattcagttgttgccttggacgattcacatttcacatggtcagtccctgcagcacctcccgaagtgtggtgtgtcacttgcttttatgtggaatgtgggcagttcttaaaactttattttaatgcacacgttcagtccctgcagcacctcccgaagtgtgctgtgtcacttgcttttatgtggaatgtgggcaatttttaaaactttattttaatgtgcacgagaaaaagcaaaatagtacatcaaaaacatgaatttgtgggtactgttgcttaggataagtaagaaggtttcgaaagctgagtcagtccaaagaggaacgtgttgcgacaagccagatgccttatggagccaggaggctgtgactctggccctggagggggctcagccctgagcgaggtgtggaaggagcccggcaccacccctgccgtgtgagctcccacgtaggcccagggttggatgagatgacaccgaggctgtggagccaggaggctgtgactctggccctggagggggctcagccctgagcgaggtgtggaaggagccccgcgccacc

SEQ ID NO: 198503 - DNA, 601 bp, Human
tttaatgcacacgttcagtccctgcagcacctcccgaagtgtgctgtgtcacttgcttttatgtggaatgtgggcaatttttaaaactttattttaatgtgcacgagaaaaagcaaaatagtacatcaaaaacatgaatttgtgggtactgttgcttaggataagtaagaaggtttcgaaagctgagtcagtccaaagaggaacgtgttgcgacaagccagatgccttatggagccaggaggctgtgactctggccctggagggggctcagccctgagcgaggtgtggaaggagcccggcrccacccctgccgtgtgagctcccacgtaggcccagggttggatgagatgacaccgaggctgtggagccaggaggctgtgactctggccctggagggggctcagccctgagcgaggtgtggaaggagccccgcgccacccccgccgtgtgagctcccgcgtaggcccagggttggatgagatgacaccaaggcactgtggcgagcagaaccgtttccccaaaaagacacgttcaactcctaacaccagcacagtgaatgccgccttctggacatagggtctctgtggatggagttagtaaa

SEQ ID NO: 198504 - DNA, 601 bp, Human
acacgttcagtccctgcagcacctcccgaagtgtgctgtgtcacttgcttttatgtggaatgtgggcaatttttaaaactttattttaatgtgcacgagaaaaagcaaaatagtacatcaaaaacatgaatttgtgggtactgttgcttaggataagtaagaaggtttcgaaagctgagtcagtccaaagaggaacgtgttgcgacaagccagatgccttatggagccaggaggctgtgactctggccctggagggggctcagccctgagcgaggtgtggaaggagcccggcaccaccccygccgtgtgagctcccacgtaggcccagggttggatgagatgacaccgaggctgtggagccaggaggctgtgactctggccctggagggggctcagccctgagcgaggtgtggaaggagccccgcgccacccccgccgtgtgagctcccgcgtaggcccagggttggatgagatgacaccaaggcactgtggcgagcagaaccgtttccccaaaaagacacgttcaactcctaacaccagcacagtgaatgccgccttctggacatagggtctctgtggatggagttagtaaagatgaggc

SEQ ID NO: 198505 - DNA, 601 bp, Human
gtgtggaaggagcccggcaccacccctgccgtgtgagctcccacgtaggcccagggttggatgagatgacaccgaggctgtggagccaggaggctgtgactctggccctggagggggctcagccctgagcgaggtgtggaaggagccccgcgccacccccgccgtgtgagctcccgcgtaggcccagggttggatgagatgacaccaaggcactgtggcgagcagaaccgtttccccaaaaagacacgttcaactcctaacaccagcacagtgaatgccgccttctggacatagggtctcygtggatggagttagtaaagatgaggcccttatccagtacggccggcatccttctaagaagagacagcacagacacgccccgaggacggagacggaacggagtgaggcgtctacctgccaaggagcccccggcattgccaggagccacagagagtcgcccgagagcttcctgagcacgtggccctgacaacacctggatctccagcttccggcccgcggtcccgtcagacaattcatttctgtggtttgaagccacccagtttgtggcactttgaccccaggatcctcacaggaaaccgtc

SEQ ID NO: 198506 - DNA, 601 bp, Human
ggcccagggttggatgagatgacaccgaggctgtggagccaggaggctgtgactctggccctggagggggctcagccctgagcgaggtgtggaaggagccccgcgccacccccgccgtgtgagctcccgcgtaggcccagggttggatgagatgacaccaaggcactgtggcgagcagaaccgtttccccaaaaagacacgttcaactcctaacaccagcacagtgaatgccgccttctggacatagggtctctgtggatggagttagtaaagatgaggcccttatccagtacggccggcrtccttctaagaagagacagcacagacacgccccgaggacggagacggaacggagtgaggcgtctacctgccaaggagcccccggcattgccaggagccacagagagtcgcccgagagcttcctgagcacgtggccctgacaacacctggatctccagcttccggcccgcggtcccgtcagacaattcatttctgtggtttgaagccacccagtttgtggcactttgaccccaggatcctcacaggaaaccgtctcactggcccagtcctgctgggccctgcccatgggatggacttgctg

SEQ ID NO: 198507 - DNA, 601 bp, Human
gcactgtggcgagcagaaccgtttccccaaaaagacacgttcaactcctaacaccagcacagtgaatgccgccttctggacatagggtctctgtggatggagttagtaaagatgaggcccttatccagtacggccggcatccttctaagaagagacagcacagacacgccccgaggacggagacggaacggagtgaggcgtctacctgccaaggagcccccggcattgccaggagccacagagagtcgcccgagagcttcctgagcacgtggccctgacaacacctggatctccagcttcyggcccgcggtcccgtcagacaattcatttctgtggtttgaagccacccagtttgtggcactttgaccccaggatcctcacaggaaaccgtctcactggcccagtcctgctgggccctgcccatgggatggacttgctgtccttgaacaggaggcaggttcggggaacaggactgtaatgggtcatggaaaataccaggctgatggcagagggtgcgtggggaggagatcagggaaccgccaggccggagctggaagccggggccaccgtccaactcacgagggctcggcagagaggacgg

SEQ ID NO: 198508 - DNA, 601 bp, Human
acctgccaaggagcccccggcattgccaggagccacagagagtcgcccgagagcttcctgagcacgtggccctgacaacacctggatctccagcttccggcccgcggtcccgtcagacaattcatttctgtggtttgaagccacccagtttgtggcactttgaccccaggatcctcacaggaaaccgtctcactggcccagtcctgctgggccctgcccatgggatggacttgctgtccttgaacaggaggcaggttcggggaacaggactgtaatgggtcatggaaaataccaggctgayggcagagggtgcgtggggaggagatcagggaaccgccaggccggagctggaagccggggccaccgtccaactcacgagggctcggcagagaggacgggggagctgcccctgctggctgaagtgggtggaggcgaacctggcccacaacaccctgagcttctgcggagccatgtgagggccacgtggagaacactgcagttccaccttcatcagataaagccaaccgttgttgtttaagcaaaggctgcggacagtgagcacagaacttcacaacacatcatggtcgcagcgcaccatccc

SEQ ID NO: 198509 - DNA, 601 bp, Human
ccggcccgcggtcccgtcagacaattcatttctgtggtttgaagccacccagtttgtggcactttgaccccaggatcctcacaggaaaccgtctcactggcccagtcctgctgggccctgcccatgggatggacttgctgtccttgaacaggaggcaggttcggggaacaggactgtaatgggtcatggaaaataccaggctgatggcagagggtgcgtggggaggagatcagggaaccgccaggccggagctggaagccggggccaccgtccaactcacgagggctcggcagagaggacrggggagctgcccctgctggctgaagtgggtggaggcgaacctggcccacaacaccctgagcttctgcggagccatgtgagggccacgtggagaacactgcagttccaccttcatcagataaagccaaccgttgttgtttaagcaaaggctgcggacagtgagcacagaacttcacaacacatcatggtcgcagcgcaccatcccccgtgatcccaaagcagcgatctagacgtgtggggtccacaggcgggcgccctggcactgggggctctgcaacttgacgaggctatgccaggctgg

SEQ ID NO: 198510 - DNA, 601 bp, Human
catcatggtcgcagcgcaccatcccccgtgatcccaaagcagcgatctagacgtgtggggtccacaggcgggcgccctggcactgggggctctgcaacttgacgaggctatgccaggctgggctagaggtgccgtgctgggcacaggctctccacgggatggcgggactgctgggcacaggctctccacggggacggcggggctgctgggcacaggctctccacggggacagcggggctgctgggcacagggtctccatggggacggcgggactgctgggagctgggttctccacggggayggggacggcgggactgctgggggctgggctctccatggggacagggacggggacggcgggactgctgggggctgggctctccatggggacggggacgggaacggcgggactgctgggggctgggctcttcacggggacggcgggacttctgggggctggctctccacggggacggcgggactgctggaggctggctctccacggggacggcgggactgctgggcacaggctctccacaaggacggcaggactgctgggcacaggctttccacggggacggcgggactgctggggtctgtg

SEQ ID NO: 198511 - DNA, 601 bp, Human
tgatcccaaagcagcgatctagacgtgtggggtccacaggcgggcgccctggcactgggggctctgcaacttgacgaggctatgccaggctgggctagaggtgccgtgctgggcacaggctctccacgggatggcgggactgctgggcacaggctctccacggggacggcggggctgctgggcacaggctctccacggggacagcggggctgctgggcacagggtctccatggggacggcgggactgctgggagctgggttctccacggggacggggacggcgggactgctgggggctggrctctccatggggacagggacggggacggcgggactgctgggggctgggctctccatggggacggggacgggaacggcgggactgctgggggctgggctcttcacggggacggcgggacttctgggggctggctctccacggggacggcgggactgctggaggctggctctccacggggacggcgggactgctgggcacaggctctccacaaggacggcaggactgctgggcacaggctttccacggggacggcgggactgctggggtctgtgctcctcaccccagggctcacgcttttcc

SEQ ID NO: 198512 - DNA, 601 bp, Human
gatctagacgtgtggggtccacaggcgggcgccctggcactgggggctctgcaacttgacgaggctatgccaggctgggctagaggtgccgtgctgggcacaggctctccacgggatggcgggactgctgggcacaggctctccacggggacggcggggctgctgggcacaggctctccacggggacagcggggctgctgggcacagggtctccatggggacggcgggactgctgggagctgggttctccacggggacggggacggcgggactgctgggggctgggctctccatggggacrgggacggggacggcgggactgctgggggctgggctctccatggggacggggacgggaacggcgggactgctgggggctgggctcttcacggggacggcgggacttctgggggctggctctccacggggacggcgggactgctggaggctggctctccacggggacggcgggactgctgggcacaggctctccacaaggacggcaggactgctgggcacaggctttccacggggacggcgggactgctggggtctgtgctcctcaccccagggctcacgcttttccatgagaccctcccca

SEQ ID NO: 198513 - DNA, 601 bp, Human
cggggacggcggggctgctgggcacaggctctccacggggacagcggggctgctgggcacagggtctccatggggacggcgggactgctgggagctgggttctccacggggacggggacggcgggactgctgggggctgggctctccatggggacagggacggggacggcgggactgctgggggctgggctctccatggggacggggacgggaacggcgggactgctgggggctgggctcttcacggggacggcgggacttctgggggctggctctccacggggacggcgggactgctggrggctggctctccacggggacggcgggactgctgggcacaggctctccacaaggacggcaggactgctgggcacaggctttccacggggacggcgggactgctggggtctgtgctcctcaccccagggctcacgcttttccatgagaccctccccagccacatcgggggctctgaagactgagcactgagggtcagcagcaggtaggagatgtctttgaagtttcatctgttatcttaaaaactcgtggatttttggggcggggcgctgtggctcatgcctgtaatcctagcactttggga

SEQ ID NO: 198514 - DNA, 601 bp, Human
actgcaggtatgatcacagcaagaccctgagagatgtcctggttactgcaggtatgatcacagcaagaccctgagagatgtcctggttactgcaggtacaaacagtcaaatcaagtatctgtttatgagacattcaacaaaaccaggtaaactgaaatctatggcaaagtaccaacttcctgccaaacagctgacaagtaagacagggtctgtctgtgttgccgactcccgaaaatgcccactttggctaaaaaggtccagtagtggagaattttaacaacgccactcagttttatttgcrtaaccccctataaaagtgacctccaagggcaagccgtttggagtcaccaattcaggaacgaagatggtgtcactgttttctccaactgtatttctttatgcatcatggtttttataattttctaagggaaattgatgacatccccatcttaaaaccaaacacaatttgaatttcaaatgcacttggagttcttccttccaggacacgtctgcgatgccagcgcggggcgcagccgggcgcgggatgctcgtgagccgtgagctttgattctgaaatatgtaatacatttttaataaggac

SEQ ID NO: 198515 - DNA, 601 bp, Human
tccacggagaggaaaggtgcagagaaagactctgaccccctgcacggaggagggggcggcgcaggcccctccacgtcgtgggtgtggaacgcaggcccctccacgtcgtggatgtggaacgcaggcccctccacatcgtgggtgtggaatgcaggcccctccacgtcgtgggtgtggaacgcaggccttttgaacataggagtgtgcaagccccacacacaggaggtggtgtgcagcacgtgtctctgcaggaaagggaacaggagggactggccttggcgggtggtgagacggccacacrctctctgaaggagattctacattcccacttctctgtagaagccgtccaggccccagccccatccccagcctgcaccctccaggcagctgaaggcctgggcacagctagcgaggccactggcgtgtgggagatggaggacagtggggagaagaaagaacactagagctgaaattcgaggaagaaaccggacatctggggcagaggaacgacccaaagccactgaggaaactgccaggtgagggccaggaggagagggtgaggctgacacggggacaggagcccagcgtgaccagcctgggg

SEQ ID NO: 198516 - DNA, 601 bp, Human
cccgcacaccggactcacccagcctccagccgctcctgtgcctttctgcctaataaatatctgtgataattaccaacccccaaaaagggttctctaacgagggtgcattttatcagtcccttaacgaggctgtttgggttcctgcctcctatagagtggcggttaatgcttaatcagcaaatgcactgtttaaataataacaagaatatcagcagagaatctaaattatcccttaacttctcaaaataatcataacaggcatttgaacattcatacaaatatggctcatgaataaaaatgygctttctttaatacaaatatagtctgatggaaagtctctgaaacccaacctatggaggcccctccctgtcatctcctggtgcacggaacagcgactttgccatcactgaggttccgggcacagaacctgcctcagtccagcgtccctatccgctgtaagaaagggtgaaggatccagtatgggagatggagattgtccatatcccgagggagggactggccagggcacacccgccaagggcaccttgtgtccctgctctgcagagaccgcccagctctaggtgcctgagtgttttctgct

SEQ ID NO: 198517 - DNA, 601 bp, Human
taaatatctgtgataattaccaacccccaaaaagggttctctaacgagggtgcattttatcagtcccttaacgaggctgtttgggttcctgcctcctatagagtggcggttaatgcttaatcagcaaatgcactgtttaaataataacaagaatatcagcagagaatctaaattatcccttaacttctcaaaataatcataacaggcatttgaacattcatacaaatatggctcatgaataaaaatgcgctttctttaatacaaatatagtctgatggaaagtctctgaaacccaacctayggaggcccctccctgtcatctcctggtgcacggaacagcgactttgccatcactgaggttccgggcacagaacctgcctcagtccagcgtccctatccgctgtaagaaagggtgaaggatccagtatgggagatggagattgtccatatcccgagggagggactggccagggcacacccgccaagggcaccttgtgtccctgctctgcagagaccgcccagctctaggtgcctgagtgttttctgctctccacatttgaaaccctaacaaaatccctgagcaatcaggccgtgtggaggc

SEQ ID NO: 198518 - DNA, 601 bp, Human
aagggttctctaacgagggtgcattttatcagtcccttaacgaggctgtttgggttcctgcctcctatagagtggcggttaatgcttaatcagcaaatgcactgtttaaataataacaagaatatcagcagagaatctaaattatcccttaacttctcaaaataatcataacaggcatttgaacattcatacaaatatggctcatgaataaaaatgcgctttctttaatacaaatatagtctgatggaaagtctctgaaacccaacctatggaggcccctccctgtcatctcctggtgcayggaacagcgactttgccatcactgaggttccgggcacagaacctgcctcagtccagcgtccctatccgctgtaagaaagggtgaaggatccagtatgggagatggagattgtccatatcccgagggagggactggccagggcacacccgccaagggcaccttgtgtccctgctctgcagagaccgcccagctctaggtgcctgagtgttttctgctctccacatttgaaaccctaacaaaatccctgagcaatcaggccgtgtggaggcaaagagcctctcctgtaacagtgtggtcctt

SEQ ID NO: 198519 - DNA, 601 bp, Human
gatggaaagtctctgaaacccaacctatggaggcccctccctgtcatctcctggtgcacggaacagcgactttgccatcactgaggttccgggcacagaacctgcctcagtccagcgtccctatccgctgtaagaaagggtgaaggatccagtatgggagatggagattgtccatatcccgagggagggactggccagggcacacccgccaagggcaccttgtgtccctgctctgcagagaccgcccagctctaggtgcctgagtgttttctgctctccacatttgaaaccctaacaaaayccctgagcaatcaggccgtgtggaggcaaagagcctctcctgtaacagtgtggtccttccagccttctctcacatgcggaatttggcagacagtgatgtgagacgctcacatggcaaactttcttttctgtttctctttggcacaaagcctcagcgctcccgcgcctgccctaccactgaacaaaacagcctcttccgggcccagctcacttgtgcctccgcccacctcgctgcgggcaacacccgttttcctaaagattgacaagaggacgtgttactcaaataaccacccgctcagaa

SEQ ID NO: 198520 - DNA, 601 bp, Human
cagcgactttgccatcactgaggttccgggcacagaacctgcctcagtccagcgtccctatccgctgtaagaaagggtgaaggatccagtatgggagatggagattgtccatatcccgagggagggactggccagggcacacccgccaagggcaccttgtgtccctgctctgcagagaccgcccagctctaggtgcctgagtgttttctgctctccacatttgaaaccctaacaaaatccctgagcaatcaggccgtgtggaggcaaagagcctctcctgtaacagtgtggtccttccagscttctctcacatgcggaatttggcagacagtgatgtgagacgctcacatggcaaactttcttttctgtttctctttggcacaaagcctcagcgctcccgcgcctgccctaccactgaacaaaacagcctcttccgggcccagctcacttgtgcctccgcccacctcgctgcgggcaacacccgttttcctaaagattgacaagaggacgtgttactcaaataaccacccgctcagaagaaaaaccctctgtgcagagccttttgtgttgaaaacgacaccttcacgttatcagccttaga

SEQ ID NO: 198521 - DNA, 601 bp, Human
gcaatcaggccgtgtggaggcaaagagcctctcctgtaacagtgtggtccttccagccttctctcacatgcggaatttggcagacagtgatgtgagacgctcacatggcaaactttcttttctgtttctctttggcacaaagcctcagcgctcccgcgcctgccctaccactgaacaaaacagcctcttccgggcccagctcacttgtgcctccgcccacctcgctgcgggcaacacccgttttcctaaagattgacaagaggacgtgttactcaaataaccacccgctcagaagaaaaamcctctgtgcagagccttttgtgttgaaaacgacaccttcacgttatcagccttagaggcgggtctgtttgcagcggtgcccgccgaggagtctggatttttaaaatacgccagaaatgacttagggtctcagccaacagaaccaaggaaagttatatttatgtgggaattattttgtcaaaaaagttccaaaatgttggcaaactctgctcaattatataagctttcacctgaaggcacagtatttttttaaaagtcagtttgtgtatctctgttgaaaacaattatgaaaacaagcatt

SEQ ID NO: 198522 - DNA, 601 bp, Human
ctctcacatgcggaatttggcagacagtgatgtgagacgctcacatggcaaactttcttttctgtttctctttggcacaaagcctcagcgctcccgcgcctgccctaccactgaacaaaacagcctcttccgggcccagctcacttgtgcctccgcccacctcgctgcgggcaacacccgttttcctaaagattgacaagaggacgtgttactcaaataaccacccgctcagaagaaaaaccctctgtgcagagccttttgtgttgaaaacgacaccttcacgttatcagccttagaggcrggtctgtttgcagcggtgcccgccgaggagtctggatttttaaaatacgccagaaatgacttagggtctcagccaacagaaccaaggaaagttatatttatgtgggaattattttgtcaaaaaagttccaaaatgttggcaaactctgctcaattatataagctttcacctgaaggcacagtatttttttaaaagtcagtttgtgtatctctgttgaaaacaattatgaaaacaagcattaaataacctgactaaaaaaagtagaatgaggttcacttccatggaaataattttattaac

SEQ ID NO: 198523 - DNA, 601 bp, Human
cagtgatgtgagacgctcacatggcaaactttcttttctgtttctctttggcacaaagcctcagcgctcccgcgcctgccctaccactgaacaaaacagcctcttccgggcccagctcacttgtgcctccgcccacctcgctgcgggcaacacccgttttcctaaagattgacaagaggacgtgttactcaaataaccacccgctcagaagaaaaaccctctgtgcagagccttttgtgttgaaaacgacaccttcacgttatcagccttagaggcgggtctgtttgcagcggtgcccgcygaggagtctggatttttaaaatacgccagaaatgacttagggtctcagccaacagaaccaaggaaagttatatttatgtgggaattattttgtcaaaaaagttccaaaatgttggcaaactctgctcaattatataagctttcacctgaaggcacagtatttttttaaaagtcagtttgtgtatctctgttgaaaacaattatgaaaacaagcattaaataacctgactaaaaaaagtagaatgaggttcacttccatggaaataattttattaacaaaattcagaagaccaagctgaga

SEQ ID NO: 198524 - DNA, 601 bp, Human
aatccaacaagacgggggtccttatcaaaggcggagatgcggacacggggcagccacagggaacaccgcgtgaagacggagacggcacccacaagccgaggagagagatctgggacagattcttctccgagggcctcagaagaaaccagccctgcccacacattgaccctggactcccagcctgtgagtggtgggcgatgaatctgcggtttgcgccgccccgtctgctatgctgtcacagcagccaaggccactggctctgtgcatttccctgcctccgcctccctctcccatcactgaygatgcagcactgactccctggacagggcctacattgggtgctgctgatggcgagactgtcatcccccgacatgaaggcaagggctgggctcagaagcctggataccgtggctgcctctgccccaccctcagctctgggacaaaccttcagtcccagcctgtctgcccacgtctctccagctgtgcaatcggcacacccacgtccacgtggctcctcatggggccaaagagcagccgtggccaggaaagcagtcagagaggcccagggttgaacccaaggtcactgcccttgtggttgagc

SEQ ID NO: 198525 - DNA, 601 bp, Human
cgtctctccagctgtgcaatcggcacacccacgtccacgtggctcctcatggggccaaagagcagccgtggccaggaaagcagtcagagaggcccagggttgaacccaaggtcactgcccttgtggttgagcaaaatgaagacagttcctcttcttaaatccggctctgtgcctatgaagacggaagcagcagcattccgcttgcaggtttttgaaaaaacaaatggggcaagagaggccaggaccacgcctgactcaggcgatcggacgggcagggaggctgcaaggcatggcatgagcrggtggagctgtcaggactgccccagcccctggctcaaagatgcccgaccccaggaccctgcctcgctggatggtgaaggccaacttcccctctgttggagctggcctgggcgttgtgggaagggctgggaggaggcccaggacaatgcagaacagacaggacgtttcacagagcaggctgccatgtccctcggggccttgggggctgctgaggccctgagaaaggtatggatcggggaggctggctgtgctgttgcagggatgtgtgtggggctggatcggggaggatggctgtgccgtt

SEQ ID NO: 198526 - DNA, 601 bp, Human
aagagaggccaggaccacgcctgactcaggcgatcggacgggcagggaggctgcaaggcatggcatgagcgggtggagctgtcaggactgccccagcccctggctcaaagatgcccgaccccaggaccctgcctcgctggatggtgaaggccaacttcccctctgttggagctggcctgggcgttgtgggaagggctgggaggaggcccaggacaatgcagaacagacaggacgtttcacagagcaggctgccatgtccctcggggccttgggggctgctgaggccctgagaaaggtatgsatcggggaggctggctgtgctgttgcagggatgtgtgtggggctggatcggggaggatggctgtgccgttgtaggggtgtgtgtggggctggatcggggaggatggctgcaccattgcaggggtgtgtgtggggctggatcagggaggctggctttgctgttgcaggggtgtgtgtggggctggatcggggaggatggctgtgccgttgcagggatgtgtgtggggccggatcggggaggatggctgcacggttgcaggggtgtgtgcggggccggatcggggaggatggctgcaccatt

SEQ ID NO: 198527 - DNA, 601 bp, Human
acccgttcacccacacaagggccaggagcatcccctagggaggaggagatggcagatctgcacaggctctgcgctcctctctctccggagcgtcctctcctctgtgtggcaggctcggcgcgtgatggaggagccccttctgcagggctctgtttagagggtgcccgccccacagcctgtggctgctcctactcatgccaggtgaggctcctacacccaccagtggccaccggggagtcacagctccttctgcatcatccgcctgacctgtttcctcatctgggatgacaaccagatccakctctgaggtccgtgccctgagtagaaaagttcacacagcaaagtttccggagccttccctgacgcgccacgtgtccgtccataactggtcatcctccacatcctgtgaggcacgtctcagcacctcttcgtgcaagcgcccgcactagacgtttgagaaacagatgtgagcaggcgtggtcctgacctccatcccgaggttgggggtggaatcacaaagcaggagtgtctgccaggagcacgtgtgcccacacagcaggcctggccccagtggctcagatcaggaacagacacgtactca

SEQ ID NO: 198528 - DNA, 601 bp, Human
ggagccccttctgcagggctctgtttagagggtgcccgccccacagcctgtggctgctcctactcatgccaggtgaggctcctacacccaccagtggccaccggggagtcacagctccttctgcatcatccgcctgacctgtttcctcatctgggatgacaaccagatccatctctgaggtccgtgccctgagtagaaaagttcacacagcaaagtttccggagccttccctgacgcgccacgtgtccgtccataactggtcatcctccacatcctgtgaggcacgtctcagcacctcttygtgcaagcgcccgcactagacgtttgagaaacagatgtgagcaggcgtggtcctgacctccatcccgaggttgggggtggaatcacaaagcaggagtgtctgccaggagcacgtgtgcccacacagcaggcctggccccagtggctcagatcaggaacagacacgtactcaaagacggcgggtatgagaaagccttgtgagggaagggagccctttgtcggggggcctgaaaagaaacacggcctttgctggttctctgagtcagccccccagctaccacccacactcctgcagggagaa

SEQ ID NO: 198529 - DNA, 601 bp, Human
ccgtcaccacccacactcctgcagggagagcctcccagccaccacccacactcctgcagggagagcctcccagctaccacccacactcctgcagggagagccccgtcaccacccacactcctgcagggagaaccccgtcaccacccacactcctgcagggagaaccccgtcaccacccacacccctgcagggagagcctcccagccaccacccacactcctgcagggagagccccgtcaccacccacactcctgcagggagagcctcccagccaccacccacactcctgcagggagagccycccagccaccacccacactcctgcagggagagccccgtcaccacccacactcctgcagggagagcctcccagccaccacccacactcctgcagggagagccccgtcaccacccacactcctgtagggagagccccggccaccacccacactcctgcagggagagccccccagccaccacccacactcctgcagggagagtcccccagccaccacccacactcctgcagggagagccccagctactgtacacactcctgcagggagagccccagccactgtacacactcctgcagggagag

SEQ ID NO: 198530 - DNA, 601 bp, Human
ccacgtggttttgatccaaaagcatttgaaagctgctctgaagatgcagaaaagctgagtcccggcatcgctgctccttccaagcgactgttcacacacagggtgtgagtgcgtccccccatccagggtccagcctggcctaaggctcactgggcaccatccagatctgtgactgggtccccccatccagggtccagcccacccgaggttcactgggcaccatccagaggccccagatgccgacacctggggacgggctgtatcaggcagatgtttcctcccgggctccacctggggacgkgccccggatgctgacacctggggatgggctgtattaggcagatgttcctcccgggctctagttttccaggccgacaggaggaagtcctgttggggccaggggaggcattggggatgagattgagaggatggtggggtcgcaaaggtttacattgcctgtgccactttctccaaggtctggggccgccaccctgtggtgcctctggaagctgccatgtggggctggcccacggtgactggccacggcggggctgtgtgtggtatgcacctgtgagctgctgaaacgcagcctggcggccag

SEQ ID NO: 198531 - DNA, 601 bp, Human
cctggcggccaggaaccagctgccccatcctctctgcaggaggtcaggtttgagcacgtattccctcaaacgctcatagacgtcagtatctcaggacaaagtgcttgtctgagacccaggtttgggccccaaggtggtaccatcgagggaggcatgttctggcaggtgacagcccctcctctgtgcctgaacctgcagtttctgcccccgcataaaatgccgccatctcaggccctccctgacccccaacctgcacaagggctcacagctggcaggcacctgtgtggggtcgtggtaggayctgtgtctctgaggtccagcccaaggctgtgccacataggcccaaatccaagcactcccctcctgggcacgtggctgtgtgtgcatgtgtggctgggtgggcaggggggttgactctggccaccgaaatggagaggagcggtgcactccctgggtctggcccacgcaggctccttcccaagtgctgctgccgggaaatggaggtccctaggtgagacgggagccgggcactgtgggggtggcccctgaggggctgcaggttggcactgcccagctgacgcattccgcagtcctgcaccag

SEQ ID NO: 198532 - DNA, 601 bp, Human
cctgcagtttctgcccccgcataaaatgccgccatctcaggccctccctgacccccaacctgcacaagggctcacagctggcaggcacctgtgtggggtcgtggtaggacctgtgtctctgaggtccagcccaaggctgtgccacataggcccaaatccaagcactcccctcctgggcacgtggctgtgtgtgcatgtgtggctgggtgggcaggggggttgactctggccaccgaaatggagaggagcggtgcactccctgggtctggcccacgcaggctccttcccaagtgctgctgcygggaaatggaggtccctaggtgagacgggagccgggcactgtgggggtggcccctgaggggctgcaggttggcactgcccagctgacgcattccgcagtcctgcaccaggggatgaacgaggaatcggcttctgctctgctgaacatcccactggttcatgtccacttgtttgggtgatcctaactgatctgctacctgagtttgaatctcagcgctattattagtcaggggtcctggaggtgggtgaccccacctcacctaaaccacagagatgctcatcctcatgcatgcacacgtcc

SEQ ID NO: 198533 - DNA, 601 bp, Human
tccgcagtcctgcaccaggggatgaacgaggaatcggcttctgctctgctgaacatcccactggttcatgtccacttgtttgggtgatcctaactgatctgctacctgagtttgaatctcagcgctattattagtcaggggtcctggaggtgggtgaccccacctcacctaaaccacagagatgctcatcctcatgcatgcacacgtccatctcagcttcagctcgcaagcaggaccctcaccgtggggccacgacggaccctgcaaagctggtctgactgtgccgagcctgtcgggggtygggggaaggaaggcgggagctcggcatctggagggcagtggagaccctcagcgagtgccaggaggatctgctgtcttcccagtgttgtcttcacagtggagagatgagttcacacagccttatctgtgtttccagtggcctctgtgtgcaagacgggccacgggttttgtgcggtatttgcctgtgggtcacagccaggtgaatgggccctcctggggctgcagccccaggtcctgatgttacttgtgccagcctggccacagtgcccggcctccagaagctgctgtcagaggagcagac

SEQ ID NO: 198534 - DNA, 601 bp, Human
gcccctgacgctctggatacagggccaccaccctgtccctgacgccctggatacacggccacctggatacacggccaccaccccgcccctgacgctctggatacacggccaccaccctgtccctgacgccctggatacacggccaccaccctgtccctgacgccctggatacacggccaccaccccgcccagactgaagggtgacaccagaggcaaaaagagtgaactagattcacgtaaatcaacatgaataaacttcaaaacagaacagatggaaagactggaaaagtccacgcactartgttcattcaggcagaaagagtgagggtccctcccagaatccagtccagggagactccttctcttcctttctgcatgggcccgaggagctggtccctagactgctcagatccaatccacagtccgtgagcaaagggccgcaggcgtggtggaggtgtgcccaggcccagcatgcccccagagtccacaagagcaggactgggggcaccgtgcctgcgccagcccaagctgcccagacttcctctggacagcaggcctcctgagccctggagattaactcactgccgcaggtaggatcacc

SEQ ID NO: 198535 - DNA, 601 bp, Human
ctgaacagggctctctgcaggcagccccaggcctggagtttgccaagtgatgagttttcctgtctgagcttgtttccatcatctccacgatgaacgtaggacaccaggacattggatctctgcggggcagcagctcatggcccagctgtaggaaagcagacccagcctctggattaaaaccatgcctggaggaaactggccttgtgagtgtcagggctgcgctgctgtcttccaggtcctccctggtttaatttagcaaaactaccaatgccaagaactggttaaattttttaaagggaaraaagtatgacacatggagaaaaaggtgcagcccatttcccagcctgaggactggccggggaaataactctgagccctcgagatgaggggctatgccttcccttgctcactccctccctcacccacctgcccactcgcccatccactcaacagcggtcgttcttcattgtattgtgagctccctctgggctgtgcactccgggccatgcgtggctggtaactgggaaatgctcgacatggaaaattctgcttgatcatctgagatgccacctcagtcttggggaactcaaggccaggaggg

SEQ ID NO: 198536 - DNA, 601 bp, Human
ttcctgtctgagcttgtttccatcatctccacgatgaacgtaggacaccaggacattggatctctgcggggcagcagctcatggcccagctgtaggaaagcagacccagcctctggattaaaaccatgcctggaggaaactggccttgtgagtgtcagggctgcgctgctgtcttccaggtcctccctggtttaatttagcaaaactaccaatgccaagaactggttaaattttttaaagggaagaaagtatgacacatggagaaaaaggtgcagcccatttcccagcctgaggactggcyggggaaataactctgagccctcgagatgaggggctatgccttcccttgctcactccctccctcacccacctgcccactcgcccatccactcaacagcggtcgttcttcattgtattgtgagctccctctgggctgtgcactccgggccatgcgtggctggtaactgggaaatgctcgacatggaaaattctgcttgatcatctgagatgccacctcagtcttggggaactcaaggccaggagggtcacacaacccatttagcattgcctagcaccagtggtgaggccaggcctcccgcgc

SEQ ID NO: 198537 - DNA, 601 bp, Human
ttggactcaaggtcgcgttcatcggcagctgtgatgtaggaggcaccctaggtgtttgccaatggcatttgtctctattggccgacaccaccccagggcccctgaagagcaaccgggactcactggcacaacttcaccctcctccttttatttttttttgtaatacaaaggcttgaggtacagtattatttttggagggattttttcctattataaactagtaatgtcttagggttaacatttccctaacacacatatacacatacatacacatatgccttcccacacatatgcacacatacacacacacacacagacccctaaatacctacacacccacacacccacaaaaatgcacacacacccatgtctacacatgtgcactcagctccagaacacaggatgtggccacgcatacccagcacctccccacacacaaatacccagcgtccttcccatacctgcatacccagcactttcccacacacatacccagcgcttccccacacacacatacccagtgtcctccccacacacacatacccagtgtcctccccacacacacatacccagcgcctccccacacacacccagtgtcctc

SEQ ID NO: 198538 - DNA, 601 bp, Human
ccacaaaaatgcacacacacccatgtctacacatgtgcactcagctccagaacacaggatgtggccacgcatacccagcacctccccacacacaaatacccagcgtccttcccatacctgcatacccagcactttcccacacacatacccagcgcttccccacacacacatacccagtgtcctccccacacacacatacccagtgtcctccccacacacacatacccagcgcctccccacacacacccagtgtcctccccacacacacatacccagcgcctccccacacacacccagtgtsctccccacacacacatacacagcgcttctccacacacacatacccagcgcctccccacacacacccagtgtcctccccacacacacatacacagcgcctccccacacacacatacccagcgcctccccacacacccatacccagtgtcctccgcatacacacatacccagtgtcctccccacacacacatatccagtgtcctccccacacacacatacccagtgtcctccccacacacgcatacccagtgtcctccccacacacccatacccagtgtcctccccccacacacatacccag

SEQ ID NO: 198539 - DNA, 601 bp, Human
gtcctcaaggtctgtctcgtcgtgggggccgggaggagaacgtactgtcctcaaggtctgtctcgtcgtgggggccgggaggagaacgtactgtcctcaaggtctgtctcgtcgtgggggccgggaggagaacgtactgtcctcaagcagaatttcctgcgctggtctctgggatgggcagagggccctgctttcaggtactgaggagagcgcagcactcggcatcacactgggggcacaggtcagcagggggcacctgggagagaagaggaggtggaaagcggaggaggagggatggacraccagctgggcacaagaggggcttcagggcacggcaggagggccgtccggggaaagttgtttcctgtcccactgactttgacggctctaggtctgccacaactccggcaaagtcccaggaccctgagcagcctcgggaagagctctcgggacctcgggggagtgaggtggcccaggcctggcacagctcagtggtggcacgtcacatcacacatcttcagaccaggccttctgcaacgattctctggcctctctgctgctctgcctagctccagccttgtcctgcggaaggtgctgaagc

SEQ ID NO: 198540 - DNA, 601 bp, Human
tgttcacaaggaagttcatgtcccccttaactcgagcttttatttcagtgaagcttcggggtcacctgcacggcctctcgtgagtagggggatttcctactcgctccacagacagctcccggggtccggggagaagcggaggggggcagagaaggccgtgccacccagcagcacaaggcaggggtttgcttgcaggtagcaaagtaacccaagcagacacacactcatgcacacacacacagagacacactcatgcacatacacagacacacactcatgcacacacacacgaacacactcatacacatatacacacagagacacactcatggacacacacagagacacactcatgcacatatacacacggagacacactcgtgcacatacacacacggagacacactcgtgcacatacacacacactcatgcacatacacagagaaacacttgtgcacggagacacacttgtgcacatacacagagacacaggcacacacaggcagacgcaaacgtgcatgcacacagacacacagacacacgcagacacacacacgcgcacacacagacacacacacacacacgctcactcacaggcaaa

SEQ ID NO: 198541 - DNA, 601 bp, Human
cttaactcgagcttttatttcagtgaagcttcggggtcacctgcacggcctctcgtgagtagggggatttcctactcgctccacagacagctcccggggtccggggagaagcggaggggggcagagaaggccgtgccacccagcagcacaaggcaggggtttgcttgcaggtagcaaagtaacccaagcagacacacactcatgcacacacacacagagacacactcatgcacatacacagacacacactcatgcacacacacacgaacacactcatacacatatacacacagagacacactcatggacacacacagagacacactcatgcacatatacacacggagacacactcgtgcacatacacacacggagacacactcgtgcacatacacacacactcatgcacatacacagagaaacacttgtgcacggagacacacttgtgcacatacacagagacacaggcacacacaggcagacgcaaacgtgcatgcacacagacacacagacacacgcagacacacacacgcgcacacacagacacacacacacacacgctcactcacaggcaaacagatgcccttgggtagacttgtgg

SEQ ID NO: 198542 - DNA, 601 bp, Human
taactcgagcttttatttcagtgaagcttcggggtcacctgcacggcctctcgtgagtagggggatttcctactcgctccacagacagctcccggggtccggggagaagcggaggggggcagagaaggccgtgccacccagcagcacaaggcaggggtttgcttgcaggtagcaaagtaacccaagcagacacacactcatgcacacacacacagagacacactcatgcacatacacagacacacactcatgcacacacacacgaacacactcatacacatatacacacagagacacactcatggacacacacagagacacactcatgcacatatacacacggagacacactcgtgcacatacacacacggagacacactcgtgcacatacacacacactcatgcacatacacagagaaacacttgtgcacggagacacacttgtgcacatacacagagacacaggcacacacaggcagacgcaaacgtgcatgcacacagacacacagacacacgcagacacacacacgcgcacacacagacacacacacacacacgctcactcacaggcaaacagatgcccttgggtagacttgtggtc

SEQ ID NO: 198543 - DNA, 601 bp, Human
cagcaccttgggcctcgggggtcaggaggggctgagtccccaggtcaggcatccccaggggggcacggggctgcagagggtcaggaggggccgagcccccaggccaggcatccccagggtgggcaccgggctgcagagggtcaggaggggccgagcccccaggccaggcgtccccagggcaggcacggggctgcagagggtcaggaggggccgagccccaaggccaggcatccccagggtgggcaccgggctgcagagggtcaggaggggccgagcccccaggccaggcatccccagggcrggcacggggctgcagagggtcagcagggcaggtatgccttggccatcaccactgcagtggcctagaggtgttcctggctgtctccatctggggcagcacctgcagctccttggacagtgtcagaattcacgactccttgcaaacaatgcagtccacgctcaccctccctcctctccacgagacctcagtgccctggaccatggactgggtgcccgagtgggctcatccaagccctgtttttgtgttggtctcctgttgtgacccatcccctgctatttctgctgggcctgaggtaaggcg

SEQ ID NO: 198544 - DNA, 601 bp, Human
actcaccgaggagctctcggattccgtggggctggacgggtcagtgtgataccgtgcacccacacttactcaccgaggagctctcggattccgtggggctggaagggtcagtgtgataccgtgcacccacacttactcaccgaggagctcttggattctgtgttttcaagcctgcccatgtgtaggaaaagcacagcctccatgagaacagcaggaacacaccccccaacacgcacacccaaacacacacgcatgcacgtgcatgtgcacacacacacactcgtgcacgcacacgtgcacrcacacacacacagagcaacgtcctgcagctcccatcttttctttttaaaatcatacatatttcattaagctccatgcagagtgtcttctgatttatggtaattgtcaacaaaagcaaaaacacagacaattttaaccctgcagtagctgggagttaaccggcatgaaatcatattttttttttcctttaaaaagggagggggctccaagcactcccttgcattaaactctgaggatgctgaaccaagagagacagtgtgaaccccagcattggtggctgttgtctaagaggcccatgcca

SEQ ID NO: 198545 - DNA, 601 bp, Human
acagacaattttaaccctgcagtagctgggagttaaccggcatgaaatcatattttttttttcctttaaaaagggagggggctccaagcactcccttgcattaaactctgaggatgctgaaccaagagagacagtgtgaaccccagcattggtggctgttgtctaagaggcccatgccagaagcgacatctgatagagtggccacctcaccccacgtgagcccggcttactcgtggcctggaggactttgagtgagactaatttccatatcaaacccaatttagatgaaacgtctttgttaaaaaaaaaaaaaaaaaaagccagagcttcaatagccccttgattagattttcatctcctgagcagacaaatatgaatatttattaccatgaatgcatatttttctctttccattgctctgatcttgagtattatccactgctaatttttatgaaaatttgggcaacataatgttttcacataaactgacagtccttgagataatcccgttattgtctggttgaaaatgacagcttccgcttattcatgtgttaacgagggattaaatattgtttttcatccccgtaatctaagacggact

SEQ ID NO: 198546 - DNA, 601 bp, Human
gcccacaccttgatcttggacttcagccaccaggattgtgagcaataaaggtttgtgactgaagccccccactctgcagtattctgttgtggcagccagagaggacgcacatggtcaacatggcaacaccccctcagtacaccctagacatctgaggccaagcccctgtgactgcagggatgcgtctctgcctacgagaaaggagaggatttcctgttttcgtggaacgttaagtccaagtgcttgtcaacagaagaaagttacttcttaagaatgttctttttgctttatgatctcattaaaaaaaaaaaaatagattggcacttcagtaaaagggtttgcacacacacaaccctaattagacttttaatagatcctttgtttcacaggaatgaaagtgaaggtaaagtttgtgcctgtaaactactaaagagctactagggcccagtgtctagggccctccaccatccatcagtttctaatgtaggagatgagaacacatcaccccaaaaatgactgtcatacatcagaacatgccaccccaaaaacaactgtcgaagaacagaacatgccgccccaaaaatgactgtcatacatcagc

SEQ ID NO: 198547 - DNA, 601 bp, Human
caccaccgcaaaatgactgtcagagaccagaacacaccaccccaaaaagactgtcagagaaaagaacacaccaccccaaaaatgactgtcggagaacagaatacaccaccccaaaaaactgttgaagaacagaacacaccaccccaaaatgactgtcggagaacagaacacaccaccccaaaaatgactatcagagaccagaacacaccaccccccaaaatgactgtcggagataaaaacatgccacccccaaaatggctgttggagatcagaacacaccaccccaaaaatgattgttggmgatcagaacataccaccccaaaaatgactgttggagaacagaacacaccaccccaaaacgactgttggagaacagaacatgccaccccaaaaatgactgtcagagaacagaacatgacaccacaaaaatgactgttggagatcaaaacacaccacctcaaaatgactgttgttggagaccagaacacaccaccccaaaatgactgtcaggacaccaccccaaaatgactgtcagggatcagaacacaccaccccaaaaatgactgtcggagatcagaacacatcaccccaaaaatgactg

SEQ ID NO: 198548 - DNA, 601 bp, Human
gaccagaacacaccacccgaaaatgactgtcagagaacagaacacaccaccccaaaatgattgttggagatcagaacacaccaccccaaaatgactgttggaaaccagaacacaacaccccaaaaatgactgttggagaagagaacacaccacccaaaaaatgattgtcggagatcagaacacaccaccccaaaaatgactgttggagatcggaatgcaccaccccaaaaatgactgtcagagaccagaacacaccaccccaaaaatgactgttggagatcagaacacgtcaccctaaaamcgactgtcagagaacagaacacaccaccccaaaatgactgttggagaccagaacacaccaccccaaaatgactgttggagaccagaacatgccaccccaaaatgactgtcagaaaccagaacacaacaccccaaaaatgactgtcagagaccagaacacaccaccccagaaaagactgtcggagattggaacacaccaccccaaaaatgactgtcagagatcggaacgcaccacccaaaaaatgactgtcagagactagaacacaccaccccaaaaatgactgtcagagatcagaacaca

SEQ ID NO: 198549 - DNA, 601 bp, Human
tgttggagaagagaacacaccacccaaaaaatgattgtcggagatcagaacacaccaccccaaaaatgactgttggagatcggaatgcaccaccccaaaaatgactgtcagagaccagaacacaccaccccaaaaatgactgttggagatcagaacacgtcaccctaaaaccgactgtcagagaacagaacacaccaccccaaaatgactgttggagaccagaacacaccaccccaaaatgactgttggagaccagaacatgccaccccaaaatgactgtcagaaaccagaacacaacacyccaaaaatgactgtcagagaccagaacacaccaccccagaaaagactgtcggagattggaacacaccaccccaaaaatgactgtcagagatcggaacgcaccacccaaaaaatgactgtcagagactagaacacaccaccccaaaaatgactgtcagagatcagaacacatcaccccaaaaacgactgtcagagactagaacacaccaccccaaaatgactgttggagatcagaaaacaccaccccaaagtgactgttggagaccagaacacgccaccccaaaatgactgtcagaaacca

SEQ ID NO: 198550 - DNA, 601 bp, Human
gatggtgctgaagcctgagtctacacacctctttgtgattgacccgtttctctgggtatggctcatggatgcaggaggtgcacatgtgaatccacttcggcttgtttatctcttgtgaatcggttttttgttacaggagtccacccctcgtaggaactcagaagaacagagacactactttttcttccccacacagagtagtagcttgaggccactggctcaagcaaaaggggtacctgagttggcctggatgctcagtggctgccctgataagtgattatggaaaatgtgatgccagggyggtctcaaggctggaacgacagcccccaccagggtgggcttggctccatgttcactgtctcgggagcaaggctgcccttacacctgcagcacgttcctccactccacagtgcccaggtgggcctgggctgggggcattggacacaatgcatcctggcagccacccaggcctagcctctccagggcacctgatgcccacctgggcagagaaaggcacctgagcagaagggcatggggctttcagaaggagggtccctgaaggggatgcagatgcacccgcctgacgctggaaacaagccaa

SEQ ID NO: 198551 - DNA, 601 bp, Human
catgagatgtagggttcagtggtccccccaggcttctatccttggtgtgacccagcattaccatcaaacgcactgttaccttcgcaagctcagctcagtcaccttacccaaggaaccctgtgaactctgacacctcaggctttttagatccactgtccagagcctcaggagctgtgatctcttccttcagatactgctgaacccaccgctttcgctccattctgacaaacctacctctgaccacgtgagcttctcttcctcctgggagctgctcctccaagctcctgctccaggggccccrtcaggaacgtgtggccgtgctctctgccccaccagcccatcctgcgcccccccaccccccaacatccaatgccccttctcttgaatccccaaacacaggccctcatctaaaggccagcagtgattttaaacctttgtcatgtactggcctatgcgcagcaccatgccacgcagaatcttcacggatgtctgatgactttcgttactgtgagcgtttcccacagcaaccacggtcaatgggtgacgggggccgccatgtcccagatggtggctgctcccctcaggtccccacatttgctaa

SEQ ID NO: 198552 - DNA, 601 bp, Human
ggccgtgctctctgccccaccagcccatcctgcgcccccccaccccccaacatccaatgccccttctcttgaatccccaaacacaggccctcatctaaaggccagcagtgattttaaacctttgtcatgtactggcctatgcgcagcaccatgccacgcagaatcttcacggatgtctgatgactttcgttactgtgagcgtttcccacagcaaccacggtcaatgggtgacgggggccgccatgtcccagatggtggctgctcccctcaggtccccacatttgctaatgtgtgtgtaaaygcctttcctttggttacatattttctctttatttaggttgtaaaaaatggtactaaaggtaaaatgagatagaactagacacacacattgttccaatatcaatctcctggttttgccataattggcttttataattacccagacgtaaccaccaggggaaaacctcactgggtaagggatacatgagacttctttgttataactttgcaattccctgtgaatctataatggtttcaaaataagaagtcagaaatcatataaaaacttttggacaaaggaaaaaactcacttgcaattcca

SEQ ID NO: 198553 - DNA, 601 bp, Human
tggctgctcccctcaggtccccacatttgctaatgtgtgtgtaaacgcctttcctttggttacatattttctctttatttaggttgtaaaaaatggtactaaaggtaaaatgagatagaactagacacacacattgttccaatatcaatctcctggttttgccataattggcttttataattacccagacgtaaccaccaggggaaaacctcactgggtaagggatacatgagacttctttgttataactttgcaattccctgtgaatctataatggtttcaaaataagaagtcagaaatmatataaaaacttttggacaaaggaaaaaactcacttgcaattccactgagaaaaataaagtccgaagccccaactgacggaatgacctactcttgaccaagaggaccccagagaaaccttaaaactgagttgggaccgtgacaggatgaaggtcagacccgcctggttacccgcccccatcattaatcatcaccaggcttccttccctgggttcagacccgcctggttaccgcccccctctcaactaatcaccaccaggcttccttctctgagggctgaacagaaaccagcccttttaaa

SEQ ID NO: 198554 - DNA, 601 bp, Human
gacttctttgttataactttgcaattccctgtgaatctataatggtttcaaaataagaagtcagaaatcatataaaaacttttggacaaaggaaaaaactcacttgcaattccactgagaaaaataaagtccgaagccccaactgacggaatgacctactcttgaccaagaggaccccagagaaaccttaaaactgagttgggaccgtgacaggatgaaggtcagacccgcctggttacccgcccccatcattaatcatcaccaggcttccttccctgggttcagacccgcctggttaccrcccccctctcaactaatcaccaccaggcttccttctctgagggctgaacagaaaccagcccttttaaaagactccattcctgatatccaccaagtgcctgaaactgctcttccttttatggtttcgacccaacaaccaatcagcattccctcctcataagagaccccattcacggagtgcctctggctagtctgtggaggctgcacagggagggccttcatgtcctcagcttcaccttttgatgcagaatgcctaactgtaatctgtttacatgttaagtctccatgccccagtgaacat

SEQ ID NO: 198555 - DNA, 601 bp, Human
attactgagccaaaggggaagagtttttgtttgttggtttgcagatgaccactgctgtcctgccttctaaagagttagactcattcaccctgcctaccatggagtgtacgtatatgagttttatcacatttggtctttatttataaaaccaaaactgttgttctcaagcaaccttcagtactaatcttaaaaataagacttcaggctgggcacggtggctcaggcttgtaatcccagcactttgggaggccaaggcaggcggatcatgaggtcaggacatcaaaaccatcctggctaacayggtgaaaccccgtctctactaaaaatacagaaaaattagctgaacatggtggcagaggcctgtagtcccagctactcgggaggctgaggcaggagaatggcgtgaacctgggaggcagagcttgcagtgagctgagattgcgccactgcactccagcctgggcgacagagcgagactgtgtctcaaacaacaacaacaaaataataggactttagacttaggatgtgattggaacatctacggatttctcaccccactgtagctctgacatttcacctgcccccagcaccacagggcctc

SEQ ID NO: 198556 - DNA, 601 bp, Human
gccttcagaggaaacaatgggccttattcctcgatacacctccagcttcacctggaatgggagctcgtgatggaagggtttgtctgttttagtcactgctgtagtttcagttcttaaaacctgcctgacgcatataaatacctaggaatgaatgaacgaacagctcactaaactgaggctgagcagggaccctcgcacacgcacatcgaaatcccgcatgacgcatggcatcaactctgaggggcacaaagccgagagcacaggaagaaagtggatctccagactccaaaactgagaggarcaatcaaaaccgggcgtgactgggagctgctgctgaagtggctcctggacgtttggcatctttctgtggatccaagtgtgtggaagctgagagctggggtgtgagttcctgtggaagctgagagctggggtgtgagttcctgtggaagctgagagctggggtgtgagttcctgtggaagctgagagctggggtgtgagttcctgtggacagctgagagctggggtgtgagttcctgtggaagctgagagctggggtgtgagttcctgtggaagctgagagctggggtgtgagttcctgtg

SEQ ID NO: 198557 - DNA, 601 bp, Human
acctaggaatgaatgaacgaacagctcactaaactgaggctgagcagggaccctcgcacacgcacatcgaaatcccgcatgacgcatggcatcaactctgaggggcacaaagccgagagcacaggaagaaagtggatctccagactccaaaactgagaggagcaatcaaaaccgggcgtgactgggagctgctgctgaagtggctcctggacgtttggcatctttctgtggatccaagtgtgtggaagctgagagctggggtgtgagttcctgtggaagctgagagctggggtgtgagttyctgtggaagctgagagctggggtgtgagttcctgtggaagctgagagctggggtgtgagttcctgtggacagctgagagctggggtgtgagttcctgtggaagctgagagctggggtgtgagttcctgtggaagctgagagctggggtgtgagttcctgtggaagctgagagctggggtgtgagttcctgtggaagctgagagctggggtgtgagttcctgtggaagctgagagctggggtgtgagttcctatagtcacacgaggacagcccatgtggccttggggtggatggagatggg

SEQ ID NO: 198558 - DNA, 601 bp, Human
atcgaaatcccgcatgacgcatggcatcaactctgaggggcacaaagccgagagcacaggaagaaagtggatctccagactccaaaactgagaggagcaatcaaaaccgggcgtgactgggagctgctgctgaagtggctcctggacgtttggcatctttctgtggatccaagtgtgtggaagctgagagctggggtgtgagttcctgtggaagctgagagctggggtgtgagttcctgtggaagctgagagctggggtgtgagttcctgtggaagctgagagctggggtgtgagttcctgtggacagctgagagctggggtgtgagttcctgtggaagctgagagctggggtgtgagttcctgtggaagctgagagctggggtgtgagttcctgtggaagctgagagctggggtgtgagttcctgtggaagctgagagctggggtgtgagttcctgtggaagctgagagctggggtgtgagttcctatagtcacacgaggacagcccatgtggccttggggtggatggagatggggactccacatgaagcccaggaccttgaggacctgcctccctcaagattgaagcccaggaacagac

SEQ ID NO: 198559 - DNA, 601 bp, Human
gaaatcccgcatgacgcatggcatcaactctgaggggcacaaagccgagagcacaggaagaaagtggatctccagactccaaaactgagaggagcaatcaaaaccgggcgtgactgggagctgctgctgaagtggctcctggacgtttggcatctttctgtggatccaagtgtgtggaagctgagagctggggtgtgagttcctgtggaagctgagagctggggtgtgagttcctgtggaagctgagagctggggtgtgagttcctgtggaagctgagagctggggtgtgagttcctgtgtacagctgagagctggggtgtgagttcctgtggaagctgagagctggggtgtgagttcctgtggaagctgagagctggggtgtgagttcctgtggaagctgagagctggggtgtgagttcctgtggaagctgagagctggggtgtgagttcctgtggaagctgagagctggggtgtgagttcctatagtcacacgaggacagcccatgtggccttggggtggatggagatggggactccacatgaagcccaggaccttgaggacctgcctccctcaagattgaagcccaggaacagaccac

SEQ ID NO: 198560 - DNA, 601 bp, Human
gggcacaaagccgagagcacaggaagaaagtggatctccagactccaaaactgagaggagcaatcaaaaccgggcgtgactgggagctgctgctgaagtggctcctggacgtttggcatctttctgtggatccaagtgtgtggaagctgagagctggggtgtgagttcctgtggaagctgagagctggggtgtgagttcctgtggaagctgagagctggggtgtgagttcctgtggaagctgagagctggggtgtgagttcctgtggacagctgagagctggggtgtgagttcctgtggamgctgagagctggggtgtgagttcctgtggaagctgagagctggggtgtgagttcctgtggaagctgagagctggggtgtgagttcctgtggaagctgagagctggggtgtgagttcctgtggaagctgagagctggggtgtgagttcctatagtcacacgaggacagcccatgtggccttggggtggatggagatggggactccacatgaagcccaggaccttgaggacctgcctccctcaagattgaagcccaggaacagaccacctaccagctggggaagtggggagggggctgaacc

SEQ ID NO: 198561 - DNA, 601 bp, Human
ccttgaggacctgcctccctcaagattgaagcccaggaacagaccacctaccagctggggaagtggggagggggctgaaccccagatctgtgcatgtgccagagcacggtccacactttattgaatgaagcagaaactcccaggtgggcaattgacaggaaagtggatcggctgggacactgagggcagaacttcttatccagaaactctcacatagaaattcacacttcagtatcaccaatccctgctgagggtaagctcacaattctaaaaaaagacttcatcaaccacaaaagaggacccctcccccacaggagggggtcagcagatgtgatgagcaggagctgtagaaagcgaagactaggaaacggccagagggtctgaacgagaccataaaataagccagagggtctgaacaagaccataaaataagccagaggatctggacgagaccataaaataagccagaggatctggacgaaaccataaaataagccagagggtctggacgagaccataaaataagccagaggatctggacgagaccataaaataagccagaggatctggacgagaccataaaataagccagagggtctga

SEQ ID NO: 198562 - DNA, 601 bp, Human
gaggacctgcctccctcaagattgaagcccaggaacagaccacctaccagctggggaagtggggagggggctgaaccccagatctgtgcatgtgccagagcacggtccacactttattgaatgaagcagaaactcccaggtgggcaattgacaggaaagtggatcggctgggacactgagggcagaacttcttatccagaaactctcacatagaaattcacacttcagtatcaccaatccctgctgagggtaagctcacaattctaaaaaaagacttcatcaaccacaaaagaggaccccccccccacaggagggggtcagcagatgtgatgagcaggagctgtagaaagcgaagactaggaaacggccagagggtctgaacgagaccataaaataagccagagggtctgaacaagaccataaaataagccagaggatctggacgagaccataaaataagccagaggatctggacgaaaccataaaataagccagagggtctggacgagaccataaaataagccagaggatctggacgagaccataaaataagccagaggatctggacgagaccataaaataagccagagggtctgaacga

SEQ ID NO: 198563 - DNA, 601 bp, Human
gggtctgaacgagaccataaaataagccagaggatctggacgagaccataaaataagccagaggatctggacgagaccataaaataagtaggtttaaaatgattgaaaagataaaagaagatatcaaacacataatcaaagtagaaggcaaaataacagatttgataaattactaaataaaaatttttttctaagtgaaaaatacagtaaccaagagaaaagtacccagcatttgagttttacagcagattagacagaggaggaaggaacgtgggagacaatttcaggaaataatctgtcrtgtagcatcgagggagggagaggtgaaggcgcgacagagggtgctgagacagggtggatggaacaagaaggtccaaccctgcctaatcaaatgctgtggaggcgtcaggaccgtgatgggaatgagagtgaatgtttacgcgtgcccactcatccgcactctgccaccccagaaacctgcacacgacccagtggtgcgggtcctgggatgacccccatttgacaacacaggaagcagagtcacagggtgagcacagagactgcaggaggcccgcgtgaaagagatggcgaggggtagctc

SEQ ID NO: 198564 - DNA, 601 bp, Human
agaggatctggacgagaccataaaataagccagaggatctggacgagaccataaaataagtaggtttaaaatgattgaaaagataaaagaagatatcaaacacataatcaaagtagaaggcaaaataacagatttgataaattactaaataaaaatttttttctaagtgaaaaatacagtaaccaagagaaaagtacccagcatttgagttttacagcagattagacagaggaggaaggaacgtgggagacaatttcaggaaataatctgtcatgtagcatcgagggagggagaggtgaaggcgcgacagagggtgctgagacagggtggatggaacaagaaggtccaaccctgcctaatcaaatgctgtggaggcgtcaggaccgtgatgggaatgagagtgaatgtttacgcgtgcccactcatccgcactctgccaccccagaaacctgcacacgacccagtggtgcgggtcctgggatgacccccatttgacaacacaggaagcagagtcacagggtgagcacagagactgcaggaggcccgcgtgaaagagatggcgaggggtagctctgcagagtcaagaaggggcctgagtgaa

SEQ ID NO: 198565 - DNA, 601 bp, Human
cgtgatgggaatgagagtgaatgtttacgcgtgcccactcatccgcactctgccaccccagaaacctgcacacgacccagtggtgcgggtcctgggatgacccccatttgacaacacaggaagcagagtcacagggtgagcacagagactgcaggaggcccgcgtgaaagagatggcgaggggtagctctgcagagtcaagaaggggcctgagtgaaagggagcaccaagtatagcacaaaacccagaccccccgatccaagcagggagtgcctggacatcacaggtgcccaggggaggaygggaggagctgggaagatgaaacccagatcccccaatccaagcagggagtgcctggacatcacaggtgcccagcggaggacaggaggagctgggaagatgaaacccagatcccccaatccaagcagggagtgcctggacatcacaggtgcccagcagaggacaggaggagctgggaagatgaaacccagatcccctgatccaagcagggagtgcctggacattacaagtgcccagcagaggacaggaggagctgggaggctgaagccacagcgaccaggccctgtggctcctccagcgtg

SEQ ID NO: 198566 - DNA, 601 bp, Human
actgttaggaaaaatcagaaagcacaagagtcaggttggagaggtcctcagtctccgggcacctctgagtattttcctccattgaaaatttcaattacatgactgcttgacccgcctaccttaatggaagggtcatgaacaggcacagaattagaacctgcacgaggccccattttcccactgacccagtgtgcgtccacctcgggccggcacaactgtgcgcttttggtttcatctagaaaggggtgtcccacccgggtccccaggactgctatgaatcactgatgagaaatatgtagasacattctgcaaactgcaacgtcttattttaaaattacgtaatcgtttctagctgtataattactgggaaatatgtttcattaaccagcattaggtgttgataaaagactccgtagaaggcaaagctgaatgtgtgtatttctgccatcagcaccgccagctattttgcagcctcttgttcatgccctgacaggaacatcctataataatttcgctccaataaaagcctcaccctggttttctcctgatgtagaatgaggaagactttcagagaatgaattgcactcgatggcaaaccaag

SEQ ID NO: 198567 - DNA, 601 bp, Human
tgaattgcactcgatggcaaaccaagggaaatgagctctggaaacaattagcagatggaaatgaaaccccagtaatcctagcaccaacacagcaaacccacctgccccacttcacagagaggacgggtgtcacaaggcaattgaccttggcttacgactctgtggaaatatgcgtttgcataaagcccttgtcactttggagatgaaaaccagaaaaaaatggaatttcactgcaaaccctatgaatgaagagtgccttgcaattgtgattaatacaggatgagatagcaggaaaatatcrattactctcaccccttattgtaacgcccctgtgttaatctggggtaatgaaattattcctttcggagagggacgcgatgagatcttgttacagcctgccctccctgctgttggggcctctccattgtcttatggaaagtttttccctttgagcaaatgcatactattttctacatataactaattacctactgcgctgaaagaacaagacagacagaaaacagtctgggctaaagcaaaactcctttaatactttatgatggggtagagccccaggggaggggaggacacaaatgtaagc

SEQ ID NO: 198568 - DNA, 601 bp, Human
gctctagtccattctccacactgtgcccagggtgtcacgagcagtgagtctaagggtgtctgtccatccttgacctcaacatccagacctctggctccaaatccagacacttcggtggcccttcaaagcctttcaatggtgtcccctgcaggcatggagaacttgccttgctggccctgaggtccaggtggcactccttgcccagatattgggcttttcagcacatttcaggcattctccgtcccctgccaggatgctctgagctcctcagtctgacgaaaacgcagtcctcctcccaggmagctcaggccctacatgtgctcaggggcaccccctccctcaacatcctcagcacggccctctgtgtctcacagttcatggtgtgcaggctgcctgtcccctgcataacagaattgtaaattatggcactgggtaatttctgctctgtgtaaatgctcccatcacagttgactttagtgctcatgtgacactactaaagggaatggggagagatactgtcttagtccatttgtgttgctgtaaaggaacacccaaagctgggcaatttacaaggaaaagaggtttatttggctcacagtcc

SEQ ID NO: 198569 - DNA, 601 bp, Human
aaggaaaagaggtttatttggctcacagtcctgcaggctgcacaagaagcatggcacaggtgtctgcatctgaggatgccccaggctgcttccacttgcagtggaaggtgaagggagccatgcagtgtgcagagctcacatggggagagaggaagcaggagagggcggagggagggccaggctcttgttaacaatcagctctcacaggagttaagagagcgagaagtcgctcacctccaccctgggagggcatgaatccattcacgagggatctgccccgccccatctgtccctcccccasatccaaagccctcccaccaggctgcacctccaacatggggaccaaatttcaacatgaggcatggcggggccgaaccaaccagatgcagagtcacacatggggaccgaatttcaacatgaggcatggcggggccgaaccaaccagatacagagttgcaggcgtgcggggaagagttcccaccatgcagacgtggaggacagaaataatctcaagggtgccgatgacagtaaaatgtagaaaaccagttataaaatggtgagctttagtatggatcgcctctgctcttaacatagtttattt

SEQ ID NO: 198570 - DNA, 601 bp, Human
tatgactgcactttgatgcttaggggcctgtgttctttcttcaacaaatacatccacgttgctgcaaaggacacaatttggggccaccatcctaagcaaattaacgcaaaagcagaaagccacacgctgccacacactctcacacggaagcaggaaccagacatcatcagagagccacacgctgccacacactctcgcacggaagtgggaactacactcatcagagaaccacatgcgctcacatggaagtggggaccagacatcgggtacttacagccatagagatgggaacaacagacaygtaagagggaatgtgagagggaatgtgagagggaggtgggagaaaagggctgaaactccctctgggggacgtgctcactacctgcaagacgggagcaagcaagacggtaccccaaacctcagcatcaccagtatgcccaggtcacaagtgtaccccaaacctcagcaccaccagtatacccaggtcacaagcctgcacatgtactcccagattctaaaataaaagctgaaaattaaaaatacggataagtgaacagatgtgccaccgacaaccctcccacatgccccacggtgctgcctc

SEQ ID NO: 198571 - DNA, 601 bp, Human
aagcaagacggtaccccaaacctcagcatcaccagtatgcccaggtcacaagtgtaccccaaacctcagcaccaccagtatacccaggtcacaagcctgcacatgtactcccagattctaaaataaaagctgaaaattaaaaatacggataagtgaacagatgtgccaccgacaaccctcccacatgccccacggtgctgcctctcgaaactgactggaccttttaaaatgtagttcagtcggtttaaatcagcgattgaagcaaacaacctgaattagtgtttggttttttctttttccttttttttttttatactaaaaggttttaagagagtacaagggacagtttcattctcgagctaatctgagactgcagtgtaagtcaaaatcgaagtcacagagtaaaataattgaaaagtaatgaagctggcagtggctacattcctgccacacaccaagtgccggcgcaagcgcttcccacacttcaatccgtctccccatccaggctgtggatttccatgcacgcttcacaagcagctgtgaggaccacgtgggagcctctgagccagcatggcccaggtctcagcacacagcaagcgac

SEQ ID NO: 198572 - DNA, 601 bp, Human
accccaaacctcagcatcaccagtatgcccaggtcacaagtgtaccccaaacctcagcaccaccagtatacccaggtcacaagcctgcacatgtactcccagattctaaaataaaagctgaaaattaaaaatacggataagtgaacagatgtgccaccgacaaccctcccacatgccccacggtgctgcctctcgaaactgactggaccttttaaaatgtagttcagtcggtttaaatcagcgattgaagcaaacaacctgaattagtgtttggttttttctttttccttttttttttttrtactaaaaggttttaagagagtacaagggacagtttcattctcgagctaatctgagactgcagtgtaagtcaaaatcgaagtcacagagtaaaataattgaaaagtaatgaagctggcagtggctacattcctgccacacaccaagtgccggcgcaagcgcttcccacacttcaatccgtctccccatccaggctgtggatttccatgcacgcttcacaagcagctgtgaggaccacgtgggagcctctgagccagcatggcccaggtctcagcacacagcaagcgactaatccatgtgc

SEQ ID NO: 198573 - DNA, 601 bp, Human
tttggttctgggacctctaacatgtcttaacatcaaacacgtgcagtgacacttcagtcttcatttcagaaccaaagactctcactcagcaaatcctgagatcccgagatcctgacaccctgacacctgttggaaaggtttggaagcagccatggaagctgtcaccagtgttttatgctcagatctgtgctgatgtcacactttggacagccaagggggcgggaagatgaagcataaaaccaccttcaaggtgggtgtggtggcatctggggtaccccgtgaccgagcagtgtggcccgarggtgagaacgtgggctcggagaggaccaggccacagctctgtgcggccactggccagctgggcaccacgggaacatttacccctgtgtgtggtgtgtcctgcgtggcagtatctccttgtcccgtgtgtggggtgtcccgggcggtggtgtctccctgtcccctgcgtgtggggtgtcccgggtggcagtatctccctgtcccctgcatgtggggtgtcccgggtggcagtatctccttgtcctctgcgtgtggggtgtcccgggtggcagtatctccctgtcccctgcgtgtggggtgt

SEQ ID NO: 198574 - DNA, 601 bp, Human
gggctcctggaaatgattcctctcaccaactcagatgactttctcttgaaagttagaagttttggggttaatttgtaattcaaaaatattaatattttatatttatattccattaaatattaggaagataccaaagaatattataaaatatgtgttggttccaaagaataataagacagcaaacatccaggatacctgacactctgaaaagagataaaacattaaaattatctttgatactctctgtgagctcttctcggtcctatcaaagctaataactttcatgaattctgggtgcatagtttctgtatgtagactttttttttcacctatgtgtgtatccctaaacaaaatactgcataagatgacataataacatacacgttctgtgatgtgccttccgtcttctgctaaccctgtgttctgagactcagattcggttttgcatgtcatggtggctcatgcattttcattgctgtgtgactgcattctatacacatggagcatcacgctttatttttccaatcacttacccagtccggtgggaaactgggttcttatttttccctccatatctgaaacagtatagccatgaaccttc

SEQ ID NO: 198575 - DNA, 601 bp, Human
cccttcctaaactatctaattccattagtttacctggatcttcttctgtctcttctgagtaaataatgaggccgtctgtgaataatgacaggcttgctccttctctcctaagtgcaccctttatctctccttcctgcttcactgcctgctgaacggatcctcctacaaatgcttgtaagggtgagagcccacatccctgtcttatttctggtgttcaagagaatatttccagtgttttgctgggaagcatgatgtttctgtagggtctttaaaaaatcaaaataagaacaaactagtcttactttattcaacatttttattatgaatgaatgttaatatttagcaaatgtttttacctgtatctattgagataataatttttttctcttttcattaatgtgatagactacattaattacagctttaattgctcatgacattttttaaaaataaattgctggattttaatttgctattatttggcttttacacctatgtttttgaggaaatttctctctaattgtcattccctgtactgtaattactgagttttggtatcaagtttatgctaacctcatgagctgtgtagtctgggatgttt

SEQ ID NO: 198576 - DNA, 601 bp, Human
ttgctattatttggcttttacacctatgtttttgaggaaatttctctctaattgtcattccctgtactgtaattactgagttttggtatcaagtttatgctaacctcatgagctgtgtagtctgggatgttttgtgtatgagtgcatgtgtttggatgtatggaataacttgcttataaaatatgtgggcctgatattttctttgtgggaagacttttaactattaactcaagttcttccttggctacagggctattggagtttttcattctggtattttggtcatgttatctaacatttsaaatatatggccataaattgttcatgatgaccccttgttattcttttatatgccaaagcatctatattagcattccaattttaattctcaatattgtttatgattccctcctctcttttttaaaatcacttatgacaaaggaggtttctcaattttgtaagctttttttaaaaagacaaaaaattttgctttttaaacaaacagagagattctctgtctttgagattctccaacttcactgtcaggaatcgaggtgtagagcctttttcactccataggcttctggaatctgagtactgg

SEQ ID NO: 198577 - DNA, 601 bp, Human
ttgaggaaatttctctctaattgtcattccctgtactgtaattactgagttttggtatcaagtttatgctaacctcatgagctgtgtagtctgggatgttttgtgtatgagtgcatgtgtttggatgtatggaataacttgcttataaaatatgtgggcctgatattttctttgtgggaagacttttaactattaactcaagttcttccttggctacagggctattggagtttttcattctggtattttggtcatgttatctaacatttcaaatatatggccataaattgttcatgatgamcccttgttattcttttatatgccaaagcatctatattagcattccaattttaattctcaatattgtttatgattccctcctctcttttttaaaatcacttatgacaaaggaggtttctcaattttgtaagctttttttaaaaagacaaaaaattttgctttttaaacaaacagagagattctctgtctttgagattctccaacttcactgtcaggaatcgaggtgtagagcctttttcactccataggcttctggaatctgagtactggtgtcttacatcagtggtggaaatttttctgc

SEQ ID NO: 198578 - DNA, 601 bp, Human
cttagttctatactttacttctctaattctctcttcaactatatctaatctgctattaaactcatacccttagtttagaatttctattattatatctttcattaaaatatatttcttcaaaaattgtggtctcttttaagactattgatctgtaggttatatttagcttcctcctatgttcctttaatcatattaaaatatttaaatttatgatctatgtccaatagttacaatatctgaggctttcttttgttgtccattctttcaattaacttttgtcctgttacctggtatgttttamaattttttattgtggactcaaatttcttggaattttacttgcaggtattctttatgagtagaaggggaaagaaaggattcctccagagaggatctgcctttccctctgccaggcatctggaggcccgtgcacctgggagcgtttgaagctgaattccctgcttgagatgttgtggctgtccaggcagcatgcagtgggattgtacatccctgtgaagcttggctgtggttaatgtcctaagggaaaatgccacccccccacccccgccttccccgccacacacacacacatccaggaaca

SEQ ID NO: 198579 - DNA, 601 bp, Human
aaggattcctccagagaggatctgcctttccctctgccaggcatctggaggcccgtgcacctgggagcgtttgaagctgaattccctgcttgagatgttgtggctgtccaggcagcatgcagtgggattgtacatccctgtgaagcttggctgtggttaatgtcctaagggaaaatgccacccccccacccccgccttccccgccacacacacacacatccaggaacagcgctgaacgcaagcagtttaccatcctccagcccaatggagagctgagaagacactctatcatcggtcaccrttaccctgcagtcatggttcttgggggtcccagctccatgtggcatgtcttctattagccttaccatatcaggatttcctagtgcctcctgccctctatagaccacaagatcatgaatgctgaagttcaggtttacccggtgtggagaagattctcagaataaaggccaacatcagtcatccactgatgtccccgggttcctgctctcacttggcttgggatctccaataatttaattattgccagatgtctgatgtgttaaaattatctctatgtcctcatattctcgtagttttgttt

SEQ ID NO: 198580 - DNA, 601 bp, Human
gaaaggtcaatttgtcaaactccactcctcagggttccaagaaaggttcttcagcccttgttttccagccataacagggtaaataaatgagactctcatctgcgggtctcctgtggattctgccggggggcggggcttcggtggaaagggagcatggctgcgcagtaataatagcggcaggctgggaaaagctaatgtcagctccaatttccaagtcatttttcaaattattttaattagatattgtttcaatctcacttacattaatttaatatctgatatcaacatttcagttttcaattgttcaaatgattttttttcagtctgcctggttgcctggagtaatttaaaatacaatgtttatcttcagcaattttcaacgcgtggtcctggacaaactgctatgttcaataaaagtgacaaggaagggacggccccaggtcctgcgtggcgacgaggaaaaatggaaattgtctccttattgttcatctctagacatcagagtcagcaggccgagctggggctggggctgggataataagattttccacccatttcacgatgtaattggctttcccaacgcaaatttcagtgaaatttg

SEQ ID NO: 198581 - DNA, 601 bp, Human
gacggccccaggtcctgcgtggcgacgaggaaaaatggaaattgtctccttattgttcatctctagacatcagagtcagcaggccgagctggggctggggctgggataataagattttccacccatttcacgatgtaattggctttcccaacgcaaatttcagtgaaatttgactaagatttttttgtattaaaaggcatctgaataaatggccacattcccccatctacacattttctgagaattttcagtcacagccctcaaacctacccctaaaagattcttcctggacgcactgccrcaaatagccttaggttctgcgttttcttagtttgtccttttcttcagacattagcacggatgctggtaaagacgtgccttctgaaatggtaaatgtaaagctgaaccaggccttcacctccccgtttataaaatgtgggagaaatgaggtatcctgaagtgttcttctaagacaaggaaattagtattgttcttgaagttgataatgagaaatctgaagatccttactgcttttgaaaagtgtgaagaacttaaaacaaattacctgggaacaacataaaaccaaactataacatcatcc

SEQ ID NO: 198582 - DNA, 601 bp, Human
cttcacctccccgtttataaaatgtgggagaaatgaggtatcctgaagtgttcttctaagacaaggaaattagtattgttcttgaagttgataatgagaaatctgaagatccttactgcttttgaaaagtgtgaagaacttaaaacaaattacctgggaacaacataaaaccaaactataacatcatccacatggcaacaggtaaaccatcgaaggaacaggagggaagctgaggagctggaaggcgtgggccggtgtgattaacgagaaacacacacagtgaggacgacgcgtgggagcmggggaagtcatcttcctaggacaggtgccttcactcgcatcaaactactcattatctacaagcaacatatcgaaaacaacgccgtccagaaagattacaaactgacgcggccgggaaaatctatcagacatacgaatggaaggagagaaggcgtcatggcgtcgacaccaagaaaatgtgcaatttgtttaaaagttattgattaaagtggaataaatagactaatgttagattagattataaaattccagacaacgatatagggttaatgaactggtgtgtgccaagaaataaacatcg

SEQ ID NO: 198583 - DNA, 601 bp, Human
aaccaaactataacatcatccacatggcaacaggtaaaccatcgaaggaacaggagggaagctgaggagctggaaggcgtgggccggtgtgattaacgagaaacacacacagtgaggacgacgcgtgggagcaggggaagtcatcttcctaggacaggtgccttcactcgcatcaaactactcattatctacaagcaacatatcgaaaacaacgccgtccagaaagattacaaactgacgcggccgggaaaatctatcagacatacgaatggaaggagagaaggcgtcatggcgtcgacaycaagaaaatgtgcaatttgtttaaaagttattgattaaagtggaataaatagactaatgttagattagattataaaattccagacaacgatatagggttaatgaactggtgtgtgccaagaaataaacatcgaaattaataaggaagaagtgatcacagtacaaagagatgccactcgcagcctgagggacggaagggcctgacggcggccatcctccaccagccacgttccggggctgcgcttggcactttaactgcacccggcactaacccccacaacagccacctgaggtgcggact

SEQ ID NO: 198584 - DNA, 601 bp, Human
caggggaagtcatcttcctaggacaggtgccttcactcgcatcaaactactcattatctacaagcaacatatcgaaaacaacgccgtccagaaagattacaaactgacgcggccgggaaaatctatcagacatacgaatggaaggagagaaggcgtcatggcgtcgacaccaagaaaatgtgcaatttgtttaaaagttattgattaaagtggaataaatagactaatgttagattagattataaaattccagacaacgatatagggttaatgaactggtgtgtgccaagaaataaacatmgaaattaataaggaagaagtgatcacagtacaaagagatgccactcgcagcctgagggacggaagggcctgacggcggccatcctccaccagccacgttccggggctgcgcttggcactttaactgcacccggcactaacccccacaacagccacctgaggtgcggactttaaatgcccccatcttattgataaagaggactgagttttccagggggttaagcaacttacctaaagtcacagggctagtaaaacacagagccttattagaaacaagtctccctagctcccacaagggtcc

SEQ ID NO: 198585 - DNA, 601 bp, Human
atcgaaattaataaggaagaagtgatcacagtacaaagagatgccactcgcagcctgagggacggaagggcctgacggcggccatcctccaccagccacgttccggggctgcgcttggcactttaactgcacccggcactaacccccacaacagccacctgaggtgcggactttaaatgcccccatcttattgataaagaggactgagttttccagggggttaagcaacttacctaaagtcacagggctagtaaaacacagagccttattagaaacaagtctccctagctcccacaagggycctacagcgggcccgagaacatgacaaagagaattcaatagcgactgatcaagctctatggtctagaaaccagaatggaaccgatcagatattaagcctcaaaaaaggacttcatgttttttaaatcataaaaatcataaatgttgcattctctaagcaaaatctaataaattagaaattaataaacacagaaaacaaaactctctcatcatttgggtattaaaaatattattttcaataattcttaggttaagaaggaaatggaaactaaattacaaaatagttagagaataataaagg

SEQ ID NO: 198586 - DNA, 601 bp, Human
catcctccaccagccacgttccggggctgcgcttggcactttaactgcacccggcactaacccccacaacagccacctgaggtgcggactttaaatgcccccatcttattgataaagaggactgagttttccagggggttaagcaacttacctaaagtcacagggctagtaaaacacagagccttattagaaacaagtctccctagctcccacaagggtcctacagcgggcccgagaacatgacaaagagaattcaatagcgactgatcaagctctatggtctagaaaccagaatggaacygatcagatattaagcctcaaaaaaggacttcatgttttttaaatcataaaaatcataaatgttgcattctctaagcaaaatctaataaattagaaattaataaacacagaaaacaaaactctctcatcatttgggtattaaaaatattattttcaataattcttaggttaagaaggaaatggaaactaaattacaaaatagttagagaataataaaggctgtgggagataccgaaatgattccccggaggtgggtttcgaatactgagagcttccatgatgataagagagaaggacagta

SEQ ID NO: 198587 - DNA, 601 bp, Human
ggcccgagaacatgacaaagagaattcaatagcgactgatcaagctctatggtctagaaaccagaatggaaccgatcagatattaagcctcaaaaaaggacttcatgttttttaaatcataaaaatcataaatgttgcattctctaagcaaaatctaataaattagaaattaataaacacagaaaacaaaactctctcatcatttgggtattaaaaatattattttcaataattcttaggttaagaaggaaatggaaactaaattacaaaatagttagagaataataaaggctgtgggagrtaccgaaatgattccccggaggtgggtttcgaatactgagagcttccatgatgataagagagaaggacagtaaacaaagtaggcactccatttatgacgtcaaagtaaataggtaacaaaaaacttgagggaagaaattaagtaataaaaatataaattaaactataaaagggaatacaggattggtgaataaacccaagagcttgattttaggggaaaaaatcataaactcttagaggtaatcaagaaaagtaaaacacctcaaattctaaaattatcaaaaattaataattaggagga

SEQ ID NO: 198588 - DNA, 601 bp, Human
cccgagaacatgacaaagagaattcaatagcgactgatcaagctctatggtctagaaaccagaatggaaccgatcagatattaagcctcaaaaaaggacttcatgttttttaaatcataaaaatcataaatgttgcattctctaagcaaaatctaataaattagaaattaataaacacagaaaacaaaactctctcatcatttgggtattaaaaatattattttcaataattcttaggttaagaaggaaatggaaactaaattacaaaatagttagagaataataaaggctgtgggagatrccgaaatgattccccggaggtgggtttcgaatactgagagcttccatgatgataagagagaaggacagtaaacaaagtaggcactccatttatgacgtcaaagtaaataggtaacaaaaaacttgagggaagaaattaagtaataaaaatataaattaaactataaaagggaatacaggattggtgaataaacccaagagcttgattttaggggaaaaaatcataaactcttagaggtaatcaagaaaagtaaaacacctcaaattctaaaattatcaaaaattaataattaggaggaca

SEQ ID NO: 198589 - DNA, 601 bp, Human
gtaacaaaaaacttgagggaagaaattaagtaataaaaatataaattaaactataaaagggaatacaggattggtgaataaacccaagagcttgattttaggggaaaaaatcataaactcttagaggtaatcaagaaaagtaaaacacctcaaattctaaaattatcaaaaattaataattaggaggacacataatcacagatgcagtggaaatttaagacttataagcccttaagaccatttatatatctatttatagtcatgcaccacgtactaacgttttggtcagtgatgaaccacrtacacccacaagtggtggtcccataagagtatgacggagctgacaaattcctgtcaccttgcgacgtcacagccatcgtaaagccacagtgcaaagcattaccttttctatgtgcaaatgatacacaaatgcctaccgctgtgttacacctgcctacagtattagtatagtaacatgttgtgcaggtttgtagcctagcagcgctgtcccatacaacctgggtgtgtaggaggctgtagcatctacaggttttgtaagtgcaccctgtgatgctcgcacaacgacgaaattgccagatga

SEQ ID NO: 198590 - DNA, 601 bp, Human
aagtaaaacacctcaaattctaaaattatcaaaaattaataattaggaggacacataatcacagatgcagtggaaatttaagacttataagcccttaagaccatttatatatctatttatagtcatgcaccacgtactaacgttttggtcagtgatgaaccacatacacccacaagtggtggtcccataagagtatgacggagctgacaaattcctgtcaccttgcgacgtcacagccatcgtaaagccacagtgcaaagcattaccttttctatgtgcaaatgatacacaaatgcctacygctgtgttacacctgcctacagtattagtatagtaacatgttgtgcaggtttgtagcctagcagcgctgtcccatacaacctgggtgtgtaggaggctgtagcatctacaggttttgtaagtgcaccctgtgatgctcgcacaacgacgaaattgccagatgaaacatttatctgaaggcagcctcgtcattaagcaacgcatcgctgtctaagaatttggaactccaagaaattgaactatgaacaaagaaaataaaaattactaacctggctaagaatgaagaaagaaatattaatag

SEQ ID NO: 198591 - DNA, 601 bp, Human
aattgccagatgaaacatttatctgaaggcagcctcgtcattaagcaacgcatcgctgtctaagaatttggaactccaagaaattgaactatgaacaaagaaaataaaaattactaacctggctaagaatgaagaaagaaatattaatagatgaatatgaaaatacaaaacgtttttcaaagaaacttccttccagaaaagcacaaggccctaagtgtgactggaaagttctctcaaaactttgaggaataaaagattctcaagtcagcacctcccaggagcgccagcaccaagcgcagtycacagtttacaaggacacgcttggcaatccattggtgggtctgaggatacagcaaaggctctgagcctacaccaaggccccccatgttgtctgaacgtcctgcctgcttcttcttttgaacacgaagttctagccagcgaggacaaatgctgaaatgtttgagacttcccaaaccacttgtgttttatcaatacattttataagccaaaagttaagagtcagctgcacaaacagagctgcccaatccttggcaaagcagcaagggaactcaatggggaagggaccagcttttcagcagat

SEQ ID NO: 198592 - DNA, 601 bp, Human
taagaatgaagaaagaaatattaatagatgaatatgaaaatacaaaacgtttttcaaagaaacttccttccagaaaagcacaaggccctaagtgtgactggaaagttctctcaaaactttgaggaataaaagattctcaagtcagcacctcccaggagcgccagcaccaagcgcagttcacagtttacaaggacacgcttggcaatccattggtgggtctgaggatacagcaaaggctctgagcctacaccaaggccccccatgttgtctgaacgtcctgcctgcttcttcttttgaacaygaagttctagccagcgaggacaaatgctgaaatgtttgagacttcccaaaccacttgtgttttatcaatacattttataagccaaaagttaagagtcagctgcacaaacagagctgcccaatccttggcaaagcagcaagggaactcaatggggaagggaccagcttttcagcagatggtgctggaccaatgggatactcacatgcaaaaagtgaatccagacatcaaccctataccctccacagaaattaatgcaaagttagatgtaaaatgccaaactatacaacttctagaagatac

SEQ ID NO: 198593 - DNA, 601 bp, Human
atatgaaaatacaaaacgtttttcaaagaaacttccttccagaaaagcacaaggccctaagtgtgactggaaagttctctcaaaactttgaggaataaaagattctcaagtcagcacctcccaggagcgccagcaccaagcgcagttcacagtttacaaggacacgcttggcaatccattggtgggtctgaggatacagcaaaggctctgagcctacaccaaggccccccatgttgtctgaacgtcctgcctgcttcttcttttgaacacgaagttctagccagcgaggacaaatgctgaratgtttgagacttcccaaaccacttgtgttttatcaatacattttataagccaaaagttaagagtcagctgcacaaacagagctgcccaatccttggcaaagcagcaagggaactcaatggggaagggaccagcttttcagcagatggtgctggaccaatgggatactcacatgcaaaaagtgaatccagacatcaaccctataccctccacagaaattaatgcaaagttagatgtaaaatgccaaactatacaacttctagaagatacaaagaaaatctaggtgaccttgggtttggtg

SEQ ID NO: 198594 - DNA, 601 bp, Human
aaagttctctcaaaactttgaggaataaaagattctcaagtcagcacctcccaggagcgccagcaccaagcgcagttcacagtttacaaggacacgcttggcaatccattggtgggtctgaggatacagcaaaggctctgagcctacaccaaggccccccatgttgtctgaacgtcctgcctgcttcttcttttgaacacgaagttctagccagcgaggacaaatgctgaaatgtttgagacttcccaaaccacttgtgttttatcaatacattttataagccaaaagttaagagtcagcygcacaaacagagctgcccaatccttggcaaagcagcaagggaactcaatggggaagggaccagcttttcagcagatggtgctggaccaatgggatactcacatgcaaaaagtgaatccagacatcaaccctataccctccacagaaattaatgcaaagttagatgtaaaatgccaaactatacaacttctagaagatacaaagaaaatctaggtgaccttgggtttggtgatgactttttagagatacaacaccaaaagcacagttcatgaaaaaaacaactgataggtaggacttcatg

SEQ ID NO: 198595 - DNA, 601 bp, Human
gataggtaggacttcatgaaaattaaaaactgaatatattattagtatatgacccagcagtcatgccctttggtatttgctaaatagagttgaaaacttatgtccatacaaaattatgcacgtggatgtttattgcagcttagttcataattgcccaaacttggaagcaaccatgatgtccttcagtagatgaatggatcaaccgtggtgtatccatataataggatatcattcagggctaaaacggaatgagccgtcaaaccatgacacagggcttgcaggaaccttaaatgcctcttgmtaagtgaaagaagccatcctggaaaggctacacactgcatgattccaacgctaagacgttctggaaaagaacaaaggatggagacagtgtaagttgtggtggaggtaatgaggagttgggggaagagagaggtaccagcagagcacagaggctttcatgacagggaaaccactctgtttgacgctatgatgatggatacgtgtcatcatacacttgcccaaacccacagaatgtaccatcctgctgtggctcaaatatggtttataccatctgaaactcatgctgaaatttgattaccat

SEQ ID NO: 198596 - DNA, 601 bp, Human
tcagtagatgaatggatcaaccgtggtgtatccatataataggatatcattcagggctaaaacggaatgagccgtcaaaccatgacacagggcttgcaggaaccttaaatgcctcttgctaagtgaaagaagccatcctggaaaggctacacactgcatgattccaacgctaagacgttctggaaaagaacaaaggatggagacagtgtaagttgtggtggaggtaatgaggagttgggggaagagagaggtaccagcagagcacagaggctttcatgacagggaaaccactctgtttgaygctatgatgatggatacgtgtcatcatacacttgcccaaacccacagaatgtaccatcctgctgtggctcaaatatggtttataccatctgaaactcatgctgaaatttgattaccattgtggcagtgttggaggtggggcctttaagaggtgattaggtcattaagagggactgatggtttcttgcaggagtgtgataattcttgtgggagtgggctgccgcaggcagggagggctgctgtaaggcgagcccagcccctcatgcttgtcgtctcattatacatgctcattggcccttct

SEQ ID NO: 198597 - DNA, 601 bp, Human
ctaagacgttctggaaaagaacaaaggatggagacagtgtaagttgtggtggaggtaatgaggagttgggggaagagagaggtaccagcagagcacagaggctttcatgacagggaaaccactctgtttgacgctatgatgatggatacgtgtcatcatacacttgcccaaacccacagaatgtaccatcctgctgtggctcaaatatggtttataccatctgaaactcatgctgaaatttgattaccattgtggcagtgttggaggtggggcctttaagaggtgattaggtcattaagarggactgatggtttcttgcaggagtgtgataattcttgtgggagtgggctgccgcaggcagggagggctgctgtaaggcgagcccagcccctcatgcttgtcgtctcattatacatgctcattggcccttcttccagggcatggcgcagtaagaaagcccttgtcagagctgctgccatgccctcggacttcccagcctccacaactgtgagctaaataaacttcttttcttataaactaccctgtctcaggaattttattatagcaacaaaaatccacctaagagaacagcaggagtgaa

SEQ ID NO: 198598 - DNA, 601 bp, Human
ctctgtttgacgctatgatgatggatacgtgtcatcatacacttgcccaaacccacagaatgtaccatcctgctgtggctcaaatatggtttataccatctgaaactcatgctgaaatttgattaccattgtggcagtgttggaggtggggcctttaagaggtgattaggtcattaagagggactgatggtttcttgcaggagtgtgataattcttgtgggagtgggctgccgcaggcagggagggctgctgtaaggcgagcccagcccctcatgcttgtcgtctcattatacatgctcaytggcccttcttccagggcatggcgcagtaagaaagcccttgtcagagctgctgccatgccctcggacttcccagcctccacaactgtgagctaaataaacttcttttcttataaactaccctgtctcaggaattttattatagcaacaaaaatccacctaagagaacagcaggagtgaaccctgatgtaaaccatggaatgaatgtgggctcatcaactgtgacaaacagaccatcctaatacagatgggagcaatggggagacggggtgtggagtggaaggcagggcacgtgggaaccc

SEQ ID NO: 198599 - DNA, 601 bp, Human
aaggagtggtgacttgcagaaggaagtctttcctgggcgatggggccagcactgcatcctgacttggaacagagtgcgtggaaagggaaatgggggtctgggtctcagtcctgcagtcctgcagtcctacagtgggtgagaccacacctgcggcaaagctggaattgcactgaaattggaattgaattgaaaattatgcagaattggaattgcattgaaaattatggatggaaaacaagagcaaacttaccactgctaagtgctgatttaaacaagataaatgttctctttagttggacacaaactagcaagaatgactttgttcccatgggtttctcaatataagctccttttgctgggaaggaaaaagggcatctgcagtaaggttggttcttttccttccacatcaccagcggcaatcgtctttattattcattagcaagctcgatgtcacggcacgctgcggcaccgctgaaaccagcctgagttgggaaaatactttcaatatttcaactgactgctttctaagtcacaaataacacagctaatcctgaggtcactcgcttacaaaaacctatttgctgtgcttcagagcaaaatg

SEQ ID NO: 198600 - DNA, 601 bp, Human
tgcggcaaagctggaattgcactgaaattggaattgaattgaaaattatgcagaattggaattgcattgaaaattatggatggaaaacaagagcaaacttaccactgctaagtgctgatttaaacaagataaatgttctctttagttggacacaaactagcaagaatgactttgttcccatgggtttctcaatataagctccttttgctgggaaggaaaaagggcatctgcagtaaggttggttcttttccttccacatcaccagcggcaatcgtctttattattcattagcaagctcgaygtcacggcacgctgcggcaccgctgaaaccagcctgagttgggaaaatactttcaatatttcaactgactgctttctaagtcacaaataacacagctaatcctgaggtcactcgcttacaaaaacctatttgctgtgcttcagagcaaaatgaaaatatatattacaaatgatgccaccagtggcaagcctgctctgggaccagccatccttccactgtctcctaccactggcagctaaaaacatccctccttctccttaaagccattttaataaagaccccagaggctgtttactcagg

SEQ ID NO: 198601 - DNA, 601 bp, Human
ctctttagttggacacaaactagcaagaatgactttgttcccatgggtttctcaatataagctccttttgctgggaaggaaaaagggcatctgcagtaaggttggttcttttccttccacatcaccagcggcaatcgtctttattattcattagcaagctcgatgtcacggcacgctgcggcaccgctgaaaccagcctgagttgggaaaatactttcaatatttcaactgactgctttctaagtcacaaataacacagctaatcctgaggtcactcgcttacaaaaacctatttgctgtrcttcagagcaaaatgaaaatatatattacaaatgatgccaccagtggcaagcctgctctgggaccagccatccttccactgtctcctaccactggcagctaaaaacatccctccttctccttaaagccattttaataaagaccccagaggctgtttactcaggtgaacacatttatttgtaaccagtgtttaatgtaaaatttagcctaggctgtgtgtgtcaataaaggtctataaataaaacatcactctgggttttttatctttatcccaacaccctacactgcatgcttttagaga

SEQ ID NO: 198602 - DNA, 601 bp, Human
acaccctacactgcatgcttttagagacgccgttccactgggcctttttattcttaaccctgacctataaaaatcacttaagtcaccagaagcttttcctatgagccagtcagtgcaggtgaggtgggagcagctagccataagttatgatgcttgtgactgagaaaacaacaggtgggtgtgttctggcagggcaagaaggcagccagccccctgggaccatccaaccatgctccacctgcctgagcctcgggaaacgccacctgcgcgctggcctgtggaggggagctctttcccctcrcgaggcagagcacgtgtcactacatcacattgagttggaaaaatccaaagaacatcatccccgtctttccacctgtgtcagttccttcaaagacaggcccgagacctcctttggaagactttgctcaaattatttgggggcaaacgtccaaatgtcagaccattgatggcttccatcccattccctcaactgacggataaaaccccagaaactcagagaggctgtcactgctgcaaatggtccaggaagaaactctgatcccagaaaccaacaagaggaaattttcctgagataaagaga

SEQ ID NO: 198603 - DNA, 601 bp, Human
atgcttttagagacgccgttccactgggcctttttattcttaaccctgacctataaaaatcacttaagtcaccagaagcttttcctatgagccagtcagtgcaggtgaggtgggagcagctagccataagttatgatgcttgtgactgagaaaacaacaggtgggtgtgttctggcagggcaagaaggcagccagccccctgggaccatccaaccatgctccacctgcctgagcctcgggaaacgccacctgcgcgctggcctgtggaggggagctctttcccctcgcgaggcagagcacrtgtcactacatcacattgagttggaaaaatccaaagaacatcatccccgtctttccacctgtgtcagttccttcaaagacaggcccgagacctcctttggaagactttgctcaaattatttgggggcaaacgtccaaatgtcagaccattgatggcttccatcccattccctcaactgacggataaaaccccagaaactcagagaggctgtcactgctgcaaatggtccaggaagaaactctgatcccagaaaccaacaagaggaaattttcctgagataaagagaaatctctgccttta

SEQ ID NO: 198604 - DNA, 601 bp, Human
tttagagacgccgttccactgggcctttttattcttaaccctgacctataaaaatcacttaagtcaccagaagcttttcctatgagccagtcagtgcaggtgaggtgggagcagctagccataagttatgatgcttgtgactgagaaaacaacaggtgggtgtgttctggcagggcaagaaggcagccagccccctgggaccatccaaccatgctccacctgcctgagcctcgggaaacgccacctgcgcgctggcctgtggaggggagctctttcccctcgcgaggcagagcacgtgtcrctacatcacattgagttggaaaaatccaaagaacatcatccccgtctttccacctgtgtcagttccttcaaagacaggcccgagacctcctttggaagactttgctcaaattatttgggggcaaacgtccaaatgtcagaccattgatggcttccatcccattccctcaactgacggataaaaccccagaaactcagagaggctgtcactgctgcaaatggtccaggaagaaactctgatcccagaaaccaacaagaggaaattttcctgagataaagagaaatctctgcctttagataa

SEQ ID NO: 198605 - DNA, 601 bp, Human
caagaaggcagccagccccctgggaccatccaaccatgctccacctgcctgagcctcgggaaacgccacctgcgcgctggcctgtggaggggagctctttcccctcgcgaggcagagcacgtgtcactacatcacattgagttggaaaaatccaaagaacatcatccccgtctttccacctgtgtcagttccttcaaagacaggcccgagacctcctttggaagactttgctcaaattatttgggggcaaacgtccaaatgtcagaccattgatggcttccatcccattccctcaactgayggataaaaccccagaaactcagagaggctgtcactgctgcaaatggtccaggaagaaactctgatcccagaaaccaacaagaggaaattttcctgagataaagagaaatctctgcctttagataagaaatgtgttttcaggaatcgacagtgttagtgtaggatgttagcggtcacacccgagatggttcttttgctaaactcagggagattttagttgaatttgcaaaatggttgctaacatatctacctgttcctgagcagaatttaaaaaagcaacctgtcctgaattagaggaggc

SEQ ID NO: 198606 - DNA, 601 bp, Human
ctgagtgtttcagaaggcagggtggggccatcacatccatggcctcttcacttggacaggatgagggggcgcggccacaggcaggtagaggggtggcagaggaggtctatgtggcttcctggggctggctccattgaagccacactcgttctccttttctcctccacctgtaaggaaacactgtccattggaacatcagaaagggcggccctgggctcaaagctgaggacgccccctctgacctgcagctggcgaggtgcacagcccctggaggagaaccgaggccaccagccctgttgcyagagctcagctgctcctcccgacactggttctgagtcatggaatctccctaccctggacgcctccaaaggccccatccacagggccctgctcaccactggcccaggtgccacccagagtcagagctggttcctgacctctgccagggatagcaattcccattcttgagctggaaaacaggtcatgtggaatctacaggatgcacggggaggacacctcgctttatttcaggtacacagggtaagaagtccgctgcaggtggattaaagacttgccgagtcagccaggaggccactgccta

SEQ ID NO: 198607 - DNA, 601 bp, Human
cccattcttgagctggaaaacaggtcatgtggaatctacaggatgcacggggaggacacctcgctttatttcaggtacacagggtaagaagtccgctgcaggtggattaaagacttgccgagtcagccaggaggccactgcctatgccacttggcacggtaccctctgctcacccaactcccatgactgagatgcacagttctcaccagctttaggtgatgaaaacacctccactgaagctcaaacaggcaaatgcagttattgaaatgtagtcaggatgcaggcacctgcatttagcacrtcaggcaaatgcagttattgaaatgtagtcaggatgcaggcacctgcatttagcacgtcaggcaaatgcagttattgaaatgtagtcaggatgcaggcacctgcatttagcacgtcaagcaaatgcagttattgaagtgtagtcaggatgcacctgcatttagcacgtcaggcaaatgcagttattgaaatgtagtcaggatgcaggcacctgcatttagcacgtcaggcaaatgcagttattgaaatgtagtcaggatgcaggcacctgcatttagcacgtcaggcaaatgcagttatt

SEQ ID NO: 198608 - DNA, 601 bp, Human
tcaggatgcaggcacctgcatttagcacatcaggcaaatgcagttattgaaatgtagtcaggatgcaggcacctgcatttagcacgtcaggcaaatgcagttattgaaatgtagtcaggatgcaggcacctgcatttagcacgtcaagcaaatgcagttattgaagtgtagtcaggatgcacctgcatttagcacgtcaggcaaatgcagttattgaaatgtagtcaggatgcaggcacctgcatttagcacgtcaggcaaatgcagttattgaaatgtagtcaggatgcaggcacctgcrtttagcacgtcaggcaaatgcagttattgaaatgtagtcaggatgcaggcacctgcgtttagcacgtcaggcaaatgcagttattgatatgtagtcaggatgcaggcacctgcatttagcacgttgctttagtaggttaaatcccctccagaatcttccagaatccccaaaatctaaatgcccacatttgctacgtccaaatcacggctgtcacaatagcccttcatgggttcaccttcctcgtggtcccgggtcccaacctggcctggcccctctccctccagcttcctttggctgcag

SEQ ID NO: 198609 - DNA, 601 bp, Human
caggcacctgcatttagcacgtcaggcaaatgcagttattgaaatgtagtcaggatgcaggcacctgcatttagcacgtcaagcaaatgcagttattgaagtgtagtcaggatgcacctgcatttagcacgtcaggcaaatgcagttattgaaatgtagtcaggatgcaggcacctgcatttagcacgtcaggcaaatgcagttattgaaatgtagtcaggatgcaggcacctgcatttagcacgtcaggcaaatgcagttattgaaatgtagtcaggatgcaggcacctgcgtttagcaygtcaggcaaatgcagttattgatatgtagtcaggatgcaggcacctgcatttagcacgttgctttagtaggttaaatcccctccagaatcttccagaatccccaaaatctaaatgcccacatttgctacgtccaaatcacggctgtcacaatagcccttcatgggttcaccttcctcgtggtcccgggtcccaacctggcctggcccctctccctccagcttcctttggctgcaggcaaacactgcctgttctgaggtggtcagcagtggactcggtcaggccacgtggaaaccgcatgg

SEQ ID NO: 198610 - DNA, 601 bp, Human
cgtcaggcaaatgcagttattgaaatgtagtcaggatgcaggcacctgcatttagcacgtcaggcaaatgcagttattgaaatgtagtcaggatgcaggcacctgcatttagcacgtcaggcaaatgcagttattgaaatgtagtcaggatgcaggcacctgcgtttagcacgtcaggcaaatgcagttattgatatgtagtcaggatgcaggcacctgcatttagcacgttgctttagtaggttaaatcccctccagaatcttccagaatccccaaaatctaaatgcccacatttgctaygtccaaatcacggctgtcacaatagcccttcatgggttcaccttcctcgtggtcccgggtcccaacctggcctggcccctctccctccagcttcctttggctgcaggcaaacactgcctgttctgaggtggtcagcagtggactcggtcaggccacgtggaaaccgcatggggccacagagtgatgggcctcagatgggcagcacacccaggagccgctggggaccctgttaaaatgcagaccctgatgcagaaggtccagctgttcaagccagcttgcaggtgaacccagagctgtggg

SEQ ID NO: 198611 - DNA, 601 bp, Human
tgaaatgtagtcaggatgcaggcacctgcatttagcacgtcaggcaaatgcagttattgaaatgtagtcaggatgcaggcacctgcatttagcacgtcaggcaaatgcagttattgaaatgtagtcaggatgcaggcacctgcgtttagcacgtcaggcaaatgcagttattgatatgtagtcaggatgcaggcacctgcatttagcacgttgctttagtaggttaaatcccctccagaatcttccagaatccccaaaatctaaatgcccacatttgctacgtccaaatcacggctgtcasaatagcccttcatgggttcaccttcctcgtggtcccgggtcccaacctggcctggcccctctccctccagcttcctttggctgcaggcaaacactgcctgttctgaggtggtcagcagtggactcggtcaggccacgtggaaaccgcatggggccacagagtgatgggcctcagatgggcagcacacccaggagccgctggggaccctgttaaaatgcagaccctgatgcagaaggtccagctgttcaagccagcttgcaggtgaacccagagctgtgggtcagggtcagtcctagagac

SEQ ID NO: 198612 - DNA, 601 bp, Human
ccttcctcgtggtcccgggtcccaacctggcctggcccctctccctccagcttcctttggctgcaggcaaacactgcctgttctgaggtggtcagcagtggactcggtcaggccacgtggaaaccgcatggggccacagagtgatgggcctcagatgggcagcacacccaggagccgctggggaccctgttaaaatgcagaccctgatgcagaaggtccagctgttcaagccagcttgcaggtgaacccagagctgtgggtcagggtcagtcctagagacgcgtcacagagaaacgacgcygaatcaccagccaccgagacaatcaggaaccagtgacgtgatggtaaacagaggaaaacacgggccactcttcaaagcgcggtgcctcagaaaacacttccacagacacctcttcttctgtgtcgttctaaaacccttctcccagagataaggaaactagttccctgcaaaatatattttatggttttgttatcattttcagtatttgcactgtaattatggaaaattagtttagactttattaagcttttgagtctacatgtgaggcgaatggatgaatttaatttttatccatgcatt

SEQ ID NO: 198613 - DNA, 601 bp, Human
gaaagggcagggcagagggtgggagagagggcagtgcagaggataggatgggggggtgggacagggggcaggagggagggcagcacagaaggccaggcagagggctgggacagaaggcagcacacaaggcaggacaggctgcagatgatgctcagaatgcagccaccccacgtccagaacgtcagggcaggaggggacatggagatggtttaacctcacatgcccactttagaggcaggagagtggggtcccggggtgccaggtgtcttgctgaaggttgtgaaataaggatcagtgaaayggtgagaccattccttccacccttgtgtttccctggcatatgtgtcagccagctggtcaacacatgctgcgttagcaaatgctgaaggcagggtcgtccctggcatgaccccctccccataacccacagcccctcttccccagtacgccgtggcagcctgccatccgctctctgctcctctgactaccttcagcaaccctgccttacggtggggatgctggacaggcattcaggagacacaaatgtcaactcctctgtgggttcctgcagcaccgggagaccctggcgcgactcctgagg

SEQ ID NO: 198614 - DNA, 601 bp, Human
cctcacaggggtgaggagctctgtgctgctgttgagatgaatggtgccagaagggagtctttccaagtgccctgtaatgcagaacctttcccagtgcccactggtggtgttcccgggacaccaggcactggaggtcggcacgcttattgtaatgaatctgaaggcagcccccaccaacgcgctggctgccttggggccaggcatgaagcgaattcagtccacatcagcgggtccaagcctggacctagacacccgtcccagctcagacgctcagctctgggccatcacccgtcgctcagcmtgggtgacgcagactgtaataatcatgccatcgtgcacactgtttttcggagcctgttgaatcacatcacaaatgcaatttatagtttgcctcaagatgttttccggaaccttcctgcagagatagcacgaggcccacagaggggtgtcttggggcacctggcaggttccagggtgggagctataaactagaagtcccacgcttctcctcccccaggttcacttgaccacaattctaaaatattaatagcatacagcgtgttaagtgatggcaatgaaagtctggttcactcttatttta

SEQ ID NO: 198615 - DNA, 601 bp, Human
ggcatgaagcgaattcagtccacatcagcgggtccaagcctggacctagacacccgtcccagctcagacgctcagctctgggccatcacccgtcgctcagcctgggtgacgcagactgtaataatcatgccatcgtgcacactgtttttcggagcctgttgaatcacatcacaaatgcaatttatagtttgcctcaagatgttttccggaaccttcctgcagagatagcacgaggcccacagaggggtgtcttggggcacctggcaggttccagggtgggagctataaactagaagtcccrcgcttctcctcccccaggttcacttgaccacaattctaaaatattaatagcatacagcgtgttaagtgatggcaatgaaagtctggttcactcttattttatcacaaacgttgcataataaaacattcctggtgcccctcgtgattcgcagcctcctgagagggggtctctgttcagggtctctcagctgctgcttttagctcctttgtggggtgcaatcatttcccaggatgctggagtcaggtttctgcactggcaccagctgaagtgttttccatttcctgtgtgaagctcaggggg

SEQ ID NO: 198616 - DNA, 601 bp, Human
gtccagtgaggaggcgtttggcccgggaaagggcaggcccaatcaggcctgagcagagccgtcagcacaacagaggcacggaacccagtctacttccgatcacacgctgagtaggcactgaaagaaaagtgactgaaatgtgagctcaattcttaatctaaccctgttctcaggaggcacatgccttcgtgtggggctagagcattaactctaaaactgtttcacaagcctctgggggcttcagaggcatctcagtgagtcacaaatgcatcagaaaaatgcaggtaagctctggctcttacatgacgaggggacattttcagtgagttaccgagacagttagaggtgtagctttggtaagctaaattgaataaatgactagagcttagcatagactgcggtctgggcttcagtaggaattacggctgccgtgcagggcggggcaacatggcagagcttctcctgagcatgagcatgtgcacaaaattgggattctaccaccgccaggagaaattattttaggttggtcatggctttctattgttactctaagttgcttcccctcccccctttaaaaatatgttattttaacatacgtcag

SEQ ID NO: 198617 - DNA, 601 bp, Human
cacacgctgagtaggcactgaaagaaaagtgactgaaatgtgagctcaattcttaatctaaccctgttctcaggaggcacatgccttcgtgtggggctagagcattaactctaaaactgtttcacaagcctctgggggcttcagaggcatctcagtgagtcacaaatgcatcagaaaaatgcaggtaagctctggctcttacatgacgaggggacattttcagtgagttaccgagacagttagaggtgtagctttggtaagctaaattgaataaatgactagagcttagcatagactgcgktctgggcttcagtaggaattacggctgccgtgcagggcggggcaacatggcagagcttctcctgagcatgagcatgtgcacaaaattgggattctaccaccgccaggagaaattattttaggttggtcatggctttctattgttactctaagttgcttcccctcccccctttaaaaatatgttattttaacatacgtcagatttatagaaaagttgtaagactatcatacaagaatctcagacactcgtcacccgattctccaaatggtaacattttaggctttactctcacctgcaaaa

SEQ ID NO: 198618 - DNA, 601 bp, Human
tgactgaaatgtgagctcaattcttaatctaaccctgttctcaggaggcacatgccttcgtgtggggctagagcattaactctaaaactgtttcacaagcctctgggggcttcagaggcatctcagtgagtcacaaatgcatcagaaaaatgcaggtaagctctggctcttacatgacgaggggacattttcagtgagttaccgagacagttagaggtgtagctttggtaagctaaattgaataaatgactagagcttagcatagactgcggtctgggcttcagtaggaattacggctgcygtgcagggcggggcaacatggcagagcttctcctgagcatgagcatgtgcacaaaattgggattctaccaccgccaggagaaattattttaggttggtcatggctttctattgttactctaagttgcttcccctcccccctttaaaaatatgttattttaacatacgtcagatttatagaaaagttgtaagactatcatacaagaatctcagacactcgtcacccgattctccaaatggtaacattttaggctttactctcacctgcaaaatctctctctatatttatatttacactgat

SEQ ID NO: 198619 - DNA, 601 bp, Human
tcaggaggcacatgccttcgtgtggggctagagcattaactctaaaactgtttcacaagcctctgggggcttcagaggcatctcagtgagtcacaaatgcatcagaaaaatgcaggtaagctctggctcttacatgacgaggggacattttcagtgagttaccgagacagttagaggtgtagctttggtaagctaaattgaataaatgactagagcttagcatagactgcggtctgggcttcagtaggaattacggctgccgtgcagggcggggcaacatggcagagcttctcctgagcaygagcatgtgcacaaaattgggattctaccaccgccaggagaaattattttaggttggtcatggctttctattgttactctaagttgcttcccctcccccctttaaaaatatgttattttaacatacgtcagatttatagaaaagttgtaagactatcatacaagaatctcagacactcgtcacccgattctccaaatggtaacattttaggctttactctcacctgcaaaatctctctctatatttatatttacactgatatttgtgctttattattctgaactatttgagagaaactta

SEQ ID NO: 198620 - DNA, 601 bp, Human
gtagctttggtaagctaaattgaataaatgactagagcttagcatagactgcggtctgggcttcagtaggaattacggctgccgtgcagggcggggcaacatggcagagcttctcctgagcatgagcatgtgcacaaaattgggattctaccaccgccaggagaaattattttaggttggtcatggctttctattgttactctaagttgcttcccctcccccctttaaaaatatgttattttaacatacgtcagatttatagaaaagttgtaagactatcatacaagaatctcagacactygtcacccgattctccaaatggtaacattttaggctttactctcacctgcaaaatctctctctatatttatatttacactgatatttgtgctttattattctgaactatttgagagaaacttatggacatgattttcccttagttctaaatacttcagtgcttatttcctaaaaacaaaggcattctcctacataatgagagtacagttatgaaaaccaaaaattcacactgatatggtactaatatctaatcaacagaacttacacgatttgtctacttctcccaagaacatttctagaa

SEQ ID NO: 198621 - DNA, 601 bp, Human
tttagagtaggggtgagtcacttggacatttttagagtagggtgagtcactctgacagttttacagtagggttgggtcattctgacagtttgagagtggggtgagtcactctgattgacatctttagaggaggagtgtcattctgattgacagtttaagaggaggggtgagtcactcggacagttttagaggaggggtgagtcactcacagttttagaagagggatgagtcactccgatggacagctttagagaagtgactcactttgactgacatttatagagtaagggtgagtcattcygattgacagttttagaggaggggtgaatcactccgattgacagttttagagaaggggtgagtcgctctgattgacagttttagaggaggggtgagtcactcattgacagttttagaggaggggtgagtcactctgactgacagttttagaggaggggtgagtcatcctgattgacagttttagtggcggggtgagtcagtctgactggcatttttagaggagggatgagtcactctgactgacagttttagaggaggggtgagtcactcattgacagttttagaggaggggtgagtcact

SEQ ID NO: 198622 - DNA, 601 bp, Human
tcattctgattgacagtttaagaggaggggtgagtcactcggacagttttagaggaggggtgagtcactcacagttttagaagagggatgagtcactccgatggacagctttagagaagtgactcactttgactgacatttatagagtaagggtgagtcattctgattgacagttttagaggaggggtgaatcactccgattgacagttttagagaaggggtgagtcgctctgattgacagttttagaggaggggtgagtcactcattgacagttttagaggaggggtgagtcactctgaytgacagttttagaggaggggtgagtcatcctgattgacagttttagtggcggggtgagtcagtctgactggcatttttagaggagggatgagtcactctgactgacagttttagaggaggggtgagtcactcattgacagttttagaggaggggtgagtcactctgattgacagttttagaggaagggtgagtcactctgattgacagttttagaggaagggtgagtcactctgattgacagttttagaggaggggtgagtcactcattgacagttttagaggaggggtgagtcactctg

SEQ ID NO: 198623 - DNA, 601 bp, Human
actacagcaaatgcagacacattctccccactttccctccctgccatggttctctagtacaagatgcttgaattttttctcactgagcttcactgctgccactggaggtctgaattgattttgcctcaactagttagagaagactgagactgactgagccgaagctctctgctttcttgaggtgacgagatgctatcgattatgggctctgtgcccctgtcacgttcacacgacatcccaaaccagactctactgggctcattcctcccctctgcctgtgtccctcactccaccaggcccygcgagcatcctccctgtagctctctggccaccccacctgtttctcttccacggaggcacctctgtctcctggattcccaccacctctccctgttctcccgagcaccactcaatctcacttctagtgtctcctccactcggaagccagggtgggggtctacagtgcaggtcggacacctcccgtgtctcctccactcggaagccagggtggggttctacagtgcaggtctgacacctcccgtgtctcttccactcggaagccagggtgggggtctacagtgcaggtctgacacctcccgtg

SEQ ID NO: 198624 - DNA, 601 bp, Human
cctccactcggaagccagggtggggttctacagtgcaggtctgacacctcccgtgtctcttccactcggaagccagggtgggggtctacagtgcaggtctgacacctcccgtgtctcctccactcggaagccagggtggggttctacagtgcaggtctgaacacatgtgcagccctgtgcaaagctcttcagaggctcctcatgccctctggagaattttcaagttcgcagggagtgtatgaggccatcctttcggtcattcatgccattttcccacctctcccctgtctttccgccatgsccagtcatgggaattttcctaaacatagcctctttctcatctgtaaaaagtattctttctgcaatattctgtaaaaagtattttttctcttgtagaatgtctttctgcctgcccctctcacccgcatgtcaacccccttcactggggcaatttctcttcatctcccagacttggcctgggccaccttctctgggaagccctccggacccctgaacaccgtgggtctgacaatatctttatgctccttctgcatctgggcacctggaacttgccgtgagcatggctgtggtgggtccttag

SEQ ID NO: 198625 - DNA, 601 bp, Human
gccctctggagaattttcaagttcgcagggagtgtatgaggccatcctttcggtcattcatgccattttcccacctctcccctgtctttccgccatggccagtcatgggaattttcctaaacatagcctctttctcatctgtaaaaagtattctttctgcaatattctgtaaaaagtattttttctcttgtagaatgtctttctgcctgcccctctcacccgcatgtcaacccccttcactggggcaatttctcttcatctcccagacttggcctgggccaccttctctgggaagccctcyggacccctgaacaccgtgggtctgacaatatctttatgctccttctgcatctgggcacctggaacttgccgtgagcatggctgtggtgggtccttagcccgagtgaccacgtgaacttgcagctggcacacataggtgagtaaaggtccacacggggctggaccacctagaaaaacagcttttgcttatttacccaaagtaagctgtgctggggaaaggaagaggaaggttttgaaggtggatacagaatttccgtctaactgagcacgtggggactggagcaattcactgaagaaatga

SEQ ID NO: 198626 - DNA, 601 bp, Human
gagaattttcaagttcgcagggagtgtatgaggccatcctttcggtcattcatgccattttcccacctctcccctgtctttccgccatggccagtcatgggaattttcctaaacatagcctctttctcatctgtaaaaagtattctttctgcaatattctgtaaaaagtattttttctcttgtagaatgtctttctgcctgcccctctcacccgcatgtcaacccccttcactggggcaatttctcttcatctcccagacttggcctgggccaccttctctgggaagccctccggaccccygaacaccgtgggtctgacaatatctttatgctccttctgcatctgggcacctggaacttgccgtgagcatggctgtggtgggtccttagcccgagtgaccacgtgaacttgcagctggcacacataggtgagtaaaggtccacacggggctggaccacctagaaaaacagcttttgcttatttacccaaagtaagctgtgctggggaaaggaagaggaaggttttgaaggtggatacagaatttccgtctaactgagcacgtggggactggagcaattcactgaagaaatgaaaggtgcg

SEQ ID NO: 198627 - DNA, 601 bp, Human
gtttttgagtaaaaagaaccaccctttggggtgttggtgcttatgtaggatgatccaaccctggcagtaaaagggagggttttaaatctaccggagtggcccacagaaaacaacctgccggtgtcaagatgctcatatcagtgctgaagtaaggagtggggctctttgggagcatcagagcaaacttcttgtccatgatccacacgggctacgagcccctgcagtgccttgtgcatggtggcagccacatcaactcacacccaaattccgaattacagtcagataaagtaaagtaaagcaygcaggtccccacctcaacagcaaggtttccagcacccaaattccgaattacagtcagatacagtaaagcaaagcacgcaggtccccacctcaatagcaaggtttccagcacgcaaattctgaattacagtcagataaagttaagtaaagcacgcaggtccccacctcaatagcgaggtttccagtatccaaattctgaattacaataagataaaataaagcacgcaggtctcctgtctcactagcaaggtttccatcactgagcggccacaggggctggtggctgtcctgcaggacagca

SEQ ID NO: 198628 - DNA, 601 bp, Human
gggttttaaatctaccggagtggcccacagaaaacaacctgccggtgtcaagatgctcatatcagtgctgaagtaaggagtggggctctttgggagcatcagagcaaacttcttgtccatgatccacacgggctacgagcccctgcagtgccttgtgcatggtggcagccacatcaactcacacccaaattccgaattacagtcagataaagtaaagtaaagcatgcaggtccccacctcaacagcaaggtttccagcacccaaattccgaattacagtcagatacagtaaagcaaagcaygcaggtccccacctcaatagcaaggtttccagcacgcaaattctgaattacagtcagataaagttaagtaaagcacgcaggtccccacctcaatagcgaggtttccagtatccaaattctgaattacaataagataaaataaagcacgcaggtctcctgtctcactagcaaggtttccatcactgagcggccacaggggctggtggctgtcctgcaggacagcacacatgtgggccattctgttgccacagaaagtgctagaacagagctgctctagagaccaggcctctggctgcagga

SEQ ID NO: 198629 - DNA, 601 bp, Human
taccggagtggcccacagaaaacaacctgccggtgtcaagatgctcatatcagtgctgaagtaaggagtggggctctttgggagcatcagagcaaacttcttgtccatgatccacacgggctacgagcccctgcagtgccttgtgcatggtggcagccacatcaactcacacccaaattccgaattacagtcagataaagtaaagtaaagcatgcaggtccccacctcaacagcaaggtttccagcacccaaattccgaattacagtcagatacagtaaagcaaagcacgcaggtccccayctcaatagcaaggtttccagcacgcaaattctgaattacagtcagataaagttaagtaaagcacgcaggtccccacctcaatagcgaggtttccagtatccaaattctgaattacaataagataaaataaagcacgcaggtctcctgtctcactagcaaggtttccatcactgagcggccacaggggctggtggctgtcctgcaggacagcacacatgtgggccattctgttgccacagaaagtgctagaacagagctgctctagagaccaggcctctggctgcaggagaggagagctgg

SEQ ID NO: 198630 - DNA, 601 bp, Human
ataaagtaaagtaaagcatgcaggtccccacctcaacagcaaggtttccagcacccaaattccgaattacagtcagatacagtaaagcaaagcacgcaggtccccacctcaatagcaaggtttccagcacgcaaattctgaattacagtcagataaagttaagtaaagcacgcaggtccccacctcaatagcgaggtttccagtatccaaattctgaattacaataagataaaataaagcacgcaggtctcctgtctcactagcaaggtttccatcactgagcggccacaggggctggtgkctgtcctgcaggacagcacacatgtgggccattctgttgccacagaaagtgctagaacagagctgctctagagaccaggcctctggctgcaggagaggagagctggacagccatctgcagaccaggtcactctcagtgctgtgtgttgtgggtggagctcaccaagtgccaggattcaccctgtggacacagccacatccccagtggggccatcatctgcatatgaacctaatttgccaaaacccataatcttgggttagcaaaggtgaggccctgaggcctcaaccccatcgtccagtg

SEQ ID NO: 198631 - DNA, 601 bp, Human
gtaaagcatgcaggtccccacctcaacagcaaggtttccagcacccaaattccgaattacagtcagatacagtaaagcaaagcacgcaggtccccacctcaatagcaaggtttccagcacgcaaattctgaattacagtcagataaagttaagtaaagcacgcaggtccccacctcaatagcgaggtttccagtatccaaattctgaattacaataagataaaataaagcacgcaggtctcctgtctcactagcaaggtttccatcactgagcggccacaggggctggtggctgtcctgcwggacagcacacatgtgggccattctgttgccacagaaagtgctagaacagagctgctctagagaccaggcctctggctgcaggagaggagagctggacagccatctgcagaccaggtcactctcagtgctgtgtgttgtgggtggagctcaccaagtgccaggattcaccctgtggacacagccacatccccagtggggccatcatctgcatatgaacctaatttgccaaaacccataatcttgggttagcaaaggtgaggccctgaggcctcaaccccatcgtccagtgtctactgaaa

SEQ ID NO: 198632 - DNA, 601 bp, Human
attacaataagataaaataaagcacgcaggtctcctgtctcactagcaaggtttccatcactgagcggccacaggggctggtggctgtcctgcaggacagcacacatgtgggccattctgttgccacagaaagtgctagaacagagctgctctagagaccaggcctctggctgcaggagaggagagctggacagccatctgcagaccaggtcactctcagtgctgtgtgttgtgggtggagctcaccaagtgccaggattcaccctgtggacacagccacatccccagtggggccatcatmtgcatatgaacctaatttgccaaaacccataatcttgggttagcaaaggtgaggccctgaggcctcaaccccatcgtccagtgtctactgaaactcagcaccagacagacagagttggcctcagaactcctcagtccagcttccctctggcgtatcttacaacctgtgttaataccagggcttttaagatgtgtttgcctagcagttggttttgctaggcccttggataggtgcatttggctgggtactgggcacccgagaaggagaaggttgctacgtatgtgtctacaaatgccacag

SEQ ID NO: 198633 - DNA, 601 bp, Human
cttgaaaccagagcagccacagcaagccactgtgtaagagttagcagagaggggctcctggccatctgtgcagggacatacgtccatgcatgtgtataaaagatctctgtaatttttatcagggctaggaccatcctgaaagtgcaggtctcccagagccagccacactccctatgctgggctctgcatggagtggggtcagcatgtggccagctgctgccaaggtctccctcccaatagccctcccagaggcctctgcccaccttcaccacctaatctccatgctcaagcctcactgtgyggccaggctgagtgcccatctcctcacaggacacagcgctctctgcaggacttttgctaagtggttggtcccctgcagcaacacacaggggtccacggcacaccctccacacacgggggtccccagcacaccttcaaatatgggggtccttagcacaccttcgcacacgggggtcctcggcccaccctccacacatgggggtctgcagtgcaccttcactcatgggagtccttggcctaccctccacacacgagggtcctcagcatgccttccacacgcacaggggtcctcggcccaccc

SEQ ID NO: 198634 - DNA, 601 bp, Human
aaaagatctctgtaatttttatcagggctaggaccatcctgaaagtgcaggtctcccagagccagccacactccctatgctgggctctgcatggagtggggtcagcatgtggccagctgctgccaaggtctccctcccaatagccctcccagaggcctctgcccaccttcaccacctaatctccatgctcaagcctcactgtgcggccaggctgagtgcccatctcctcacaggacacagcgctctctgcaggacttttgctaagtggttggtcccctgcagcaacacacaggggtccacrgcacaccctccacacacgggggtccccagcacaccttcaaatatgggggtccttagcacaccttcgcacacgggggtcctcggcccaccctccacacatgggggtctgcagtgcaccttcactcatgggagtccttggcctaccctccacacacgagggtcctcagcatgccttccacacgcacaggggtcctcggcccaccctccacacacaggggtcctcggcccaccctccacacacaggggtcctcggcccaccctccacacacgggagtcctcggcacgcctttccagaggaggt

SEQ ID NO: 198635 - DNA, 601 bp, Human
tgacgaggatctgcaagagccgagctctgtgatgggcagcaggtgtgcacagcaggagggccgggcctggtgctcccagcatcttcaggcttaaaaatttggccccaggaagcctttgcattcataactgtagctaccactattcactgctccaaaattcaaaggaggagttctcgagacccaagaacacacaacacacattccactagcctcgaagccgcatcctcgcacatctcacagcctggggaagcgatgcagaatctcaccagaggataaacaggcaaagaactttggggctttkctaggaaaatgtcttactctgcggacccccagagggtctcagggacttcccatgccccctcccatgccccagacggtcctttctgaatggccgacttagacaaaggctacaccctttaaattcagtgacagccaacagaatcacttcctgcccttgaaatccaacaatgtctccacaggaagcatctgctggctcagcacagcaccagcttcagcccccacctcctccccatccctgctcctggacctgttggttccgaggaggccctggacaccaagacacccaccccagatgcccaga

SEQ ID NO: 198636 - DNA, 601 bp, Human
gggtcaaactatgtccacagaggctggaacaccaaaatagaggcaaaagtcctgagaagggagttgtttttagtcaccaggccagtgaccactgtccagcaggtccacgtgcatggatgagagctgtgcccctctcttctctaagccaaggggctgttgggacaggcagccgcacctggccagctctgcccttgctcatcagctgggaagcagcatgcttcttggggggcaggcattgtctacaacacagactacacagtccacagtccacaactcctgaatcctgcctagtatttatacrgtaaacagagactctgaaataaacaccgtgccgaatggagcctgtgcagctcccagtgctgtgaccccaccatgatcgctcatctgctccagctggagcactctgcctctctacccattttcctgctctcaccgagtcaggcctcggaccagcccctgtgtgagatggagatgtgtttagtgtgggaggaacacggtgagaggtcagagacagagcagggatccgtgcagggatgcggaggccccagtgctgggtgttcagggctgactcctccctccccaggcacctcctgccagagtg

SEQ ID NO: 198637 - DNA, 601 bp, Human
acagactacacagtccacagtccacaactcctgaatcctgcctagtatttatacagtaaacagagactctgaaataaacaccgtgccgaatggagcctgtgcagctcccagtgctgtgaccccaccatgatcgctcatctgctccagctggagcactctgcctctctacccattttcctgctctcaccgagtcaggcctcggaccagcccctgtgtgagatggagatgtgtttagtgtgggaggaacacggtgagaggtcagagacagagcagggatccgtgcagggatgcggaggccccrgtgctgggtgttcagggctgactcctccctccccaggcacctcctgccagagtgacctcatgagccctcatggtttcaaccccacccattcgcagcagccacatccccacctgcactgggttctccttccagactcacagcctccgcctgctagctgctcccggccaacccccatgggcacactgaccccgtgtgtcccgaagaccccccgcctgcctctgaaggcccttccatcctactgctcctccatcctggcgtctgacaaatcaatgtatctttccccgtggatgtttctccaac

SEQ ID NO: 198638 - DNA, 601 bp, Human
accccgtgtgtcccgaagaccccccgcctgcctctgaaggcccttccatcctactgctcctccatcctggcgtctgacaaatcaatgtatctttccccgtggatgtttctccaacccattcactcttctcccgctcagtgacctggcccctgaacctgccgttcccaactcagacaaagccgtctccaactcggacaatggcgcctccaactcgaacaatgccacctccaacttggacaatgtcgcctccacctcagacaatggcgcctccagcttggacgatgccgcctccaagtcagamgatgccgcctccagcttggacgatgccgcctccagcttggacgatgtcacctccaacttggatgatgccacctccagcttggacaatgccacctccagcttggacaatgccgcctccagcttggacagtgccgccttcccacctccacaaagtctgcttcctaaagagcaagtccagccacaccacttcctggcttcagttgtcccatcagacgacgggtcaccaacagctggggcattctcaggagccaagctgggtgccttcccccttcctggacatccctaccctgcttgctgggcc

SEQ ID NO: 198639 - DNA, 601 bp, Human
tttgtgtgcttttgaagctaagttggtataaattcaaactacattgtgataaatgtggggtgttaattgtaattcccatggtaaccactaagaaaataacaaaaagaaatgtgcaggaaaagaaaatgagaagggaatcaaaacagtacactaaaaattaaatcaaagaaacaaaaaaaggcaatatttgaggaactgaggaggaaaaaaggtgtaagacatacagaaaccagcagcaaagtggcagaagtaaatccttccttaacagaaattactgtaaatgaaaagggatcaaactcamcaattaaaagagagactgacagaatacatttttaaaagtatgaccaactacgggttgaatatccctaatccaaaagtccaaaatctaaaatgctccaaaatctgaaaatttttgagtgcctacatgatgttcaaaataaatgcccattgaagtattttggatttcatatttttggattatggaagctcaactggtgagtccggttggccttaaaacaagatgtgtttgaatcatgcaggtccacttatatgcagatttttttcaaccaaatgtgaattgaaaatatagtactcgtgggat

SEQ ID NO: 198640 - DNA, 601 bp, Human
ttgaagtattttggatttcatatttttggattatggaagctcaactggtgagtccggttggccttaaaacaagatgtgtttgaatcatgcaggtccacttatatgcagatttttttcaaccaaatgtgaattgaaaatatagtactcgtgggattcaaaacccatgtatacggagagctgacttttataaatgtgggttctgcagggccaactttgagacttgagtatgcgtgaattttggtacacattgcagggggcgggtgtcttagaaccaatcatctgcatatatgagatgaccacraatgttccaaaatttgaaaagatccaaaatctgaaatacctctgtcccaagcatttaagataaggtatactttgtatgtaagataagggatatatgctgtcggttagggactcacgtaggatccaaagttgaaagtaaaatgatgcattttgggatggtgaaaatgttacatacaggtggcagttgcacaatgttgtgaatgtaccaagtgccactgaattgttcatttttaagtggttaattttatgctatgttaattttatctcaattttttaaaaagactccctcaatttagttttg

SEQ ID NO: 198641 - DNA, 601 bp, Human
accaaatgtgaattgaaaatatagtactcgtgggattcaaaacccatgtatacggagagctgacttttataaatgtgggttctgcagggccaactttgagacttgagtatgcgtgaattttggtacacattgcagggggcgggtgtcttagaaccaatcatctgcatatatgagatgaccacaaatgttccaaaatttgaaaagatccaaaatctgaaatacctctgtcccaagcatttaagataaggtatactttgtatgtaagataagggatatatgctgtcggttagggactcacgtmggatccaaagttgaaagtaaaatgatgcattttgggatggtgaaaatgttacatacaggtggcagttgcacaatgttgtgaatgtaccaagtgccactgaattgttcatttttaagtggttaattttatgctatgttaattttatctcaattttttaaaaagactccctcaatttagttttgtttcattcatctattccctatttatttgcctctctagattataaaattgttgagaatatggacaggagtttattcctctttgtgctacccagcacagtgcctggaataataaatattt

SEQ ID NO: 198642 - DNA, 601 bp, Human
gattcaaaacccatgtatacggagagctgacttttataaatgtgggttctgcagggccaactttgagacttgagtatgcgtgaattttggtacacattgcagggggcgggtgtcttagaaccaatcatctgcatatatgagatgaccacaaatgttccaaaatttgaaaagatccaaaatctgaaatacctctgtcccaagcatttaagataaggtatactttgtatgtaagataagggatatatgctgtcggttagggactcacgtaggatccaaagttgaaagtaaaatgatgcatttygggatggtgaaaatgttacatacaggtggcagttgcacaatgttgtgaatgtaccaagtgccactgaattgttcatttttaagtggttaattttatgctatgttaattttatctcaattttttaaaaagactccctcaatttagttttgtttcattcatctattccctatttatttgcctctctagattataaaattgttgagaatatggacaggagtttattcctctttgtgctacccagcacagtgcctggaataataaatatttactgaaggcatcactaagcatggagttgaacat

SEQ ID NO: 198643 - DNA, 601 bp, Human
aagataaggtatactttgtatgtaagataagggatatatgctgtcggttagggactcacgtaggatccaaagttgaaagtaaaatgatgcattttgggatggtgaaaatgttacatacaggtggcagttgcacaatgttgtgaatgtaccaagtgccactgaattgttcatttttaagtggttaattttatgctatgttaattttatctcaattttttaaaaagactccctcaatttagttttgtttcattcatctattccctatttatttgcctctctagattataaaattgttgagaayatggacaggagtttattcctctttgtgctacccagcacagtgcctggaataataaatatttactgaaggcatcactaagcatggagttgaacatcattgaggggctcagacactggcggctgagtcaatgccatgcttgctgcaggacagcctgcccaggccatctcagtctcaggtatttcttcatagcagtatacgaatggactaatacaggcccatattccaagacccttaggaacaagtggtaattgtttactatctagacgggactctcctacttgataaaagtctcctgctcta

SEQ ID NO: 198644 - DNA, 601 bp, Human
gttttgtttcattcatctattccctatttatttgcctctctagattataaaattgttgagaatatggacaggagtttattcctctttgtgctacccagcacagtgcctggaataataaatatttactgaaggcatcactaagcatggagttgaacatcattgaggggctcagacactggcggctgagtcaatgccatgcttgctgcaggacagcctgcccaggccatctcagtctcaggtatttcttcatagcagtatacgaatggactaatacaggcccatattccaagacccttaggarcaagtggtaattgtttactatctagacgggactctcctacttgataaaagtctcctgctctatagctccacaaacagtaaatttatttgaaatcaataaatgaatgattaagcactgtgactggagagggccgaacagggttccatttccagatgtttcccaggcactgatgattcacttcctggggccgggcaagttccgaggctcctcagggtctcctcaaacaattcaggcttctttaagcctccagcttgcaactatctgactcattaagttgaagttggcaggaaagttataaag

SEQ ID NO: 198645 - DNA, 601 bp, Human
gaaacactgttcttgtgtgttcagtatctgtgtgcatgttaatcttcctgtgagatcataaagctctgtaagggaaagggtccaattgtctcaccttgaaaattccaaacctagcaaacgcctggtgggaaatacaaacccgcaggcgtttctgagtgaacggaggttgtgccaggtcaaatgctcactgctggtcccgtcctgctctaaaatgttcagatgcataatgggttatttttgttggtatttgggtgggtcgaatgctcactgctggtcctgtcctgctctaaaatgttcagayatgtaatgggttatttttgttggtatttgggtgggtcaaatgctcactgctggtcttgtcctgctctaaaatgttcagatatgtaatgggttatttttgtcggtatttgggtggtatttttgctctatgacctcccatttctctgacgtctctagattcctttgttatttgtgatttctgcttctggtggtgacaacaaaatctgccattgctgtgcagccgcctcacccatggagcaggcttatcctctacaactattctacagaaaagacaagcaaggtctgcgtggagtgaaagcgc

SEQ ID NO: 198646 - DNA, 601 bp, Human
ggtatttgggtgggtcaaatgctcactgctggtcttgtcctgctctaaaatgttcagatatgtaatgggttatttttgtcggtatttgggtggtatttttgctctatgacctcccatttctctgacgtctctagattcctttgttatttgtgatttctgcttctggtggtgacaacaaaatctgccattgctgtgcagccgcctcacccatggagcaggcttatcctctacaactattctacagaaaagacaagcaaggtctgcgtggagtgaaagcgccttctttccatatcggatgctrgaagctgtgatgttggcaaacggctctttgcatgaagtactgtgtactgaaccaggaaagtgaggtgcagacgcggaagtcaggtgcagatgtgttgggcagatgagctatggtgatggcgggtggccattccctataagagagtggctcctctattattaacaaaataaaaattaaagaaggtttccattgagtttgctagttcttcactagcaatattcccagctggttgaccttcatttgttttagtttgatttcatccaacacagctttatcttacctgctgcccacaccctactc

SEQ ID NO: 198647 - DNA, 601 bp, Human
accctactcttgagagcacgtactcctggcaggaccccaacccaggaaaccctcccatgccccaggtgccgtcccctgaccaaccagcctcactctcagagacaaggatgaaacgcatatgaatatccactctaatacggttcagagaaggatgatctgttatctgaaacttttactgcaaaagctcttttaatcaaaaccttcagaaaatttgaattttactccttgcaaagattatttggttaaaaaaaaaggacactcacaacaattaacatatgactggggatgtgtaagaacagcraagagaactggacaggctgtgtcctgggaacagcgcccggtgcacacacccctttccatcttccctattggcaccttcagtccccggaggcgctgctgatgctcataggaagggactaaggccttcacagtctgtcaacaggagggtcccatggggctccatcacggtctctgggaccccccttccactgcagcaaagtggacaggtgcactgcatcaacatctcaacaccgggtgaaaagggaaacgccttactaaacgatgttcccgtgatcagaatcacgggctaacgtccctccgc

SEQ ID NO: 198648 - DNA, 601 bp, Human
cggtgctggagaaatgtaagcaaatccgcatttcgaagcagaaatcgctggtttaaatattctctcctttccctcaccatggaatgcacaaacgcttgaagatgcatgtgtgttagagtctcttccacagaactctctggaaaggccattccaagagcttcaggtgttcagattcatatctgaggctgcaacaggcagagccacttccagtttcctgactaaaaagtgaaagttccagaagcattcctagatctgtggtgtgtgtggtgcacgtgtgctgtgtggtgtgtgtagtctctgyatgtgtgtccatgtgggtggtgcctgtgtactgtgtgtgctgtgtggtgtgtgtgtggtgcacgtgtgctgtgtggtgtgtgtagtctctgcatgtgtgtctatgtgggtggtgcctgtgtactgtgtgtggtgtgtgtgtgtggtgtgggttgtggtgcctgtgtgagagaagtggtctcagccggggtgatattaaggcctgcagtacagctccagaccccagagcgaggccccgcctccctgccgagccccagaaacccccttttcaggggtggaagtcggggtggcctctcccatg

SEQ ID NO: 198649 - DNA, 601 bp, Human
gaaatgtaagcaaatccgcatttcgaagcagaaatcgctggtttaaatattctctcctttccctcaccatggaatgcacaaacgcttgaagatgcatgtgtgttagagtctcttccacagaactctctggaaaggccattccaagagcttcaggtgttcagattcatatctgaggctgcaacaggcagagccacttccagtttcctgactaaaaagtgaaagttccagaagcattcctagatctgtggtgtgtgtggtgcacgtgtgctgtgtggtgtgtgtagtctctgtatgtgtgtcyatgtgggtggtgcctgtgtactgtgtgtgctgtgtggtgtgtgtgtggtgcacgtgtgctgtgtggtgtgtgtagtctctgcatgtgtgtctatgtgggtggtgcctgtgtactgtgtgtggtgtgtgtgtgtggtgtgggttgtggtgcctgtgtgagagaagtggtctcagccggggtgatattaaggcctgcagtacagctccagaccccagagcgaggccccgcctccctgccgagccccagaaacccccttttcaggggtggaagtcggggtggcctctcccatgcagttgagtg

SEQ ID NO: 198650 - DNA, 601 bp, Human
tcgaagcagaaatcgctggtttaaatattctctcctttccctcaccatggaatgcacaaacgcttgaagatgcatgtgtgttagagtctcttccacagaactctctggaaaggccattccaagagcttcaggtgttcagattcatatctgaggctgcaacaggcagagccacttccagtttcctgactaaaaagtgaaagttccagaagcattcctagatctgtggtgtgtgtggtgcacgtgtgctgtgtggtgtgtgtagtctctgtatgtgtgtccatgtgggtggtgcctgtgtacggtgtgtgctgtgtggtgtgtgtgtggtgcacgtgtgctgtgtggtgtgtgtagtctctgcatgtgtgtctatgtgggtggtgcctgtgtactgtgtgtggtgtgtgtgtgtggtgtgggttgtggtgcctgtgtgagagaagtggtctcagccggggtgatattaaggcctgcagtacagctccagaccccagagcgaggccccgcctccctgccgagccccagaaacccccttttcaggggtggaagtcggggtggcctctcccatgcagttgagtgtcctgggagggaaagcacagaa

SEQ ID NO: 198651 - DNA, 601 bp, Human
gactgaaaccgtagtcaaaaacctcccaaagaaaatcctgcagtcgctggtttgatggataaattttaccaaacatttaaagaaggattagcaccactcctcctcaaacttttccaaaatattgaagaggaaacaatttctaactaatcctgtgagtccagcattactctgacacgaaagccagacagacactacaagcaaacaaaactaagaaccaatatcccttataaatactgatgcaaaaaatcttcgacaaaatactagtagacaaaattcggaagttcagaagcatattaaaacrattgctgtaccatgaccaagtgggatgtattcctagaatgcaagaatggttcaacacataaaaaataataaacgcaatacaccccactaacagaatgaaggaaaggacccatatcatcatctcaactgatccagaaaaagcatctgacaaaattcaaccctctttcatgataaaaacgctcaacgaactaggagtaacagaaaatcacctcaacataataaaggccatatatgaaaaatctgcagctaatgtaacactccagggtaaaagatggaaggcttttcctttaagactaggaac

SEQ ID NO: 198652 - DNA, 601 bp, Human
gttgctacatttctcaaacttaatttctatcattaaatccttttgttttgttttatttttggacagacgagttctccctatgttgctcaggctggtctcaaactcctggccttggcctcccaaagtgctgggatttataggtatgagccactgcacccagtcattaagtcctaattacatgttatttgccctgttcaagttcaagcagtattttttttaataaagattattcccaatagatcttagtcttcatctgtaagaggctgttgagggcacgaccacctcgcagtgacctccctcwgtgtgggacccccgttcccactggcacaccatggggacagctgggtggggtagtgttgagttctggtcctggtcccaccgacctgggctggagctcccagatgctccacacacccacgtctacagaaacactaggccagactggggtccgccccacacgcacagaggatcactgggggcgatgtagagatgtggaagctggaccccaccccccaggctaattcatcagcaagatgttggcaactgctgggctggatggttattagcatattaggatgacatttgaccctaacattccagt

SEQ ID NO: 198653 - DNA, 601 bp, Human
tcattaagtcctaattacatgttatttgccctgttcaagttcaagcagtattttttttaataaagattattcccaatagatcttagtcttcatctgtaagaggctgttgagggcacgaccacctcgcagtgacctccctctgtgtgggacccccgttcccactggcacaccatggggacagctgggtggggtagtgttgagttctggtcctggtcccaccgacctgggctggagctcccagatgctccacacacccacgtctacagaaacactaggccagactggggtccgccccacacgyacagaggatcactgggggcgatgtagagatgtggaagctggaccccaccccccaggctaattcatcagcaagatgttggcaactgctgggctggatggttattagcatattaggatgacatttgaccctaacattccagttttgtgctaccaaaaaaaaaaaaatcacctgaatgagtcaagacagttaaacttgagggtgatttgggaatgaggggaattcatccatttgaggttaaatgtttgccaatctaatttggtcaaaacagttcatccacaaccccgtgcaggccacaacaca

SEQ ID NO: 198654 - DNA, 601 bp, Human
gatccccatggcctgttctttcgacgatcctcctcttgccccaatttctccaccgcacagactcgccagggctttggtttgtgagtgccctgcactctgtcagttgggccatggtataatttatgttcaacagagacctttgggagtgagtgtcagtgccgtagcggaacacagggatctgaggcacaaggcagggctgtcccaggcaaacagggacaccggccccttcatcagtaggtgacatgctttcattcaataggaaattccagaacaccaagaaagggatctccagacagggacytgaaaacaggatatggaggtagatttgtgggagagagttggaaagggagctagcactctttgagtacccactttgtgctaaatacttagtttttgactccatatgtatgaagattaccatatttcatcaatttcaagacgaaccctttttcacagtgtaacccctctgaagtcaagatgcctcttatgaacactggcaagagagtttagctggagcatagccctttcctgatagcacataaagagacggtgcccctcaccagggttcctggcttggactggacagacgacagcaccgcaa

SEQ ID NO: 198655 - DNA, 601 bp, Human
aatcaaagtcagcactaataaaaatttctaggtttccaaccctacacacccatttgggtcccactcaaacatcaccacagggtggctctccccagtcacccctcaggcctggcccagtgccatgagaactgggacctcaggagggtcagagccccagcaggttccagctctcagatcaaggtgttcttttcttatcatcttctttcttctctttcccctctcctaaatcactgctcactctctgccccacacccaactcaacatttagatgctcagatagcatttcagagtcttattttaygactttctgaagaattgtgctgcttcaaaaataagagccccctcattaccaaaaacttaacccaaaagtgcacttcccaaaatgcctccaaataagtgtgggaaatccaggaagccctcgagagccactgaacgcctctgtgcccagcactttgaccagcaccgtggaatcagcttcccaaagcatgcatggggcactggaatcccagtttcacagacacagagacacagaaagcttgattcacaggcaggtgccaggagaactgcagttttatccctgtaaagtctaattccaacagga

SEQ ID NO: 198656 - DNA, 601 bp, Human
ggaatcccagtttcacagacacagagacacagaaagcttgattcacaggcaggtgccaggagaactgcagttttatccctgtaaagtctaattccaacaggagtactcagccacatcgaacttcttctcactaagaaaagttatctcggtggcctataaactctttggaaattgctttgaaaacatgttctaggctggtgttttattatttatgaagcaacactgctgtcctggtttaactgccttcctgtgaaagaaaaggcttcctgttttgtttcctgagactcctctttctccttcmtgtcatcaccatcaccaccatcatcttcattaccaccatcatcttcaccaccaccatcattttcattatcaacatcttcatcaccatcattaccatcatcttcatcactatcaccatcatcgccatctttatcatcacctttatctttattatcaccatcaacatcttcatcaccatcatcatctttatcatcacaatccccattatcaccatcatcaccatcatcttcatcaccaccatcatcttcattatcaccatcacaattatcactatcatcatcaccatcatcttcatcattac

SEQ ID NO: 198657 - DNA, 601 bp, Human
aaaaaggattgcattctaaaaagttctgtgtttgaaagtatatttgttttctttggctgctgttgtaacaaatcaccacaaacttagtggcttaaaaaacccacaggctggctgggtgcagtggctcatgcccataatcccaacactttgtgaggctgagacaggaggattgcttgagaccaggagtttgagaaccacctgggcaacatattgagatcctatctctattaaattttttttaaaaattagccagatgtggtggctcacacttacagtcccagctacttgggaggaccccttragcctaggaggtcgaggctgcagtgcactgtgattgtgccactgcactccagcctgggcgacagagtgagaccctatctcttcagaacaaacagacaaacttattgttctgcaggttagaagtccagcccgggtctcactgggctgaagtcaaggtgtcggctgagctgcactcctttctgaatgcggatgacggtaaatgggatggaaggtgcaggtagagactctgtgtggcaggttctatctcatttacgtggctgggagttgtaaatgccatgagtttcttctgtttgttggaccg

SEQ ID NO: 198658 - DNA, 601 bp, Human
gagctttcagaatggtgtccattccactcactgcatttcagcctctgtggccttgggcagcacctgtgatgcctgtgctgactggcatcatctgcagtaagtgaggagggcacagagccttccatcaatctgttcagggcatgatttgctgcaaagtgagttgtgaaaacttttggttttcaagagtttctgggtctcggggttgtgtgaatggatgtgaaccagcctccttctgtttttccaggggatctaacaaggcttgaacgctggagccgcgtgtctgcgaccactcagcaggtgccggctggggctgggctcctcagacctgaaacactgacttctctatttggcacatctccagggtcatccttgcagatgaagaatccagcctgggtgtctcctgacccatcatacagcctagaagggtttgtgttttgttttttccaagtaaattcctgctatcattttacttattttattgctgtgtgtagagtgaagaagatgctgaaaaaaaagagtgagagaaaaaaatcccgttgatcctggtagatgggatatatgggaactaattttatatccatgcatgagttaaaacgagcag

SEQ ID NO: 198659 - DNA, 601 bp, Human
gtttgtgttttgttttttccaagtaaattcctgctatcattttacttattttattgctgtgtgtagagtgaagaagatgctgaaaaaaaagagtgagagaaaaaaatcccgttgatcctggtagatgggatatatgggaactaattttatatccatgcatgagttaaaacgagcagtaggcacatttcccatgggcgatggaagtgacctctgtcggctcagtggaaggtgccgaagaaacagcaagagacctccttgtccaggtagccacaaaggaatttccttttgaaatgtatactcrttgaaatttttaatccaggataaattatgagagtctgtactgcacatgtcagatgctgcacatgaagggttaacatcttgcaatatccatggcatcaatgtttccttttttttttcatcttgctctgtcactcaggctggagtgcaatggtacaaccatagctcactgcagccaccacttcccaggctaaagcgatctgcctgcctcaacctcccaggtagctgggaccacaggtgcataccaccatgcccagcttatttctgtattctttgtagagacgggatctcaccatgttgccca

SEQ ID NO: 198660 - DNA, 601 bp, Human
tcccgttgatcctggtagatgggatatatgggaactaattttatatccatgcatgagttaaaacgagcagtaggcacatttcccatgggcgatggaagtgacctctgtcggctcagtggaaggtgccgaagaaacagcaagagacctccttgtccaggtagccacaaaggaatttccttttgaaatgtatactcgttgaaatttttaatccaggataaattatgagagtctgtactgcacatgtcagatgctgcacatgaagggttaacatcttgcaatatccatggcatcaatgtttccttttttttttcatcttgctctgtcactcaggctggagtgcaatggtacaaccatagctcactgcagccaccacttcccaggctaaagcgatctgcctgcctcaacctcccaggtagctgggaccacaggtgcataccaccatgcccagcttatttctgtattctttgtagagacgggatctcaccatgttgcccaggctggtctcaaactcctaagctcaagtgatccacccacctcagcctcccaatgtgctgggattacaggcatgagccactgtgcctggctgccagtatttcctctt

SEQ ID NO: 198661 - DNA, 601 bp, Human
tatgggaactaattttatatccatgcatgagttaaaacgagcagtaggcacatttcccatgggcgatggaagtgacctctgtcggctcagtggaaggtgccgaagaaacagcaagagacctccttgtccaggtagccacaaaggaatttccttttgaaatgtatactcgttgaaatttttaatccaggataaattatgagagtctgtactgcacatgtcagatgctgcacatgaagggttaacatcttgcaatatccatggcatcaatgtttccttttttttttcatcttgctctgtcacycaggctggagtgcaatggtacaaccatagctcactgcagccaccacttcccaggctaaagcgatctgcctgcctcaacctcccaggtagctgggaccacaggtgcataccaccatgcccagcttatttctgtattctttgtagagacgggatctcaccatgttgcccaggctggtctcaaactcctaagctcaagtgatccacccacctcagcctcccaatgtgctgggattacaggcatgagccactgtgcctggctgccagtatttcctctttgcacacatcctgcacttgtcagtgg

SEQ ID NO: 198662 - DNA, 601 bp, Human
agctgggaccacaggtgcataccaccatgcccagcttatttctgtattctttgtagagacgggatctcaccatgttgcccaggctggtctcaaactcctaagctcaagtgatccacccacctcagcctcccaatgtgctgggattacaggcatgagccactgtgcctggctgccagtatttcctctttgcacacatcctgcacttgtcagtggccacttgcccacctctgatttctcaagtgaaatcatcatgagaagggcatgagtggggagctgggaggtggtggcaggctgggtgctkcctgggtttcatcagaacctcctgaggtgggggccaggggtagccatggagttgggagttgtggaggaggcgagatgcttggaaggaagctgtggacagggtctgaatgggggtggctgagcctgaagctggagttgagtcctggtgggagcagaaaccttgggcacctgggagtttggcttagacagattgggctgtgcatggtggagaaaggcccaagcagaaaagctcctgaacaggcctggagcttgcacaggagaaaggctggagtcacagacctggatgttgactctcctgatc

SEQ ID NO: 198663 - DNA, 601 bp, Human
gcctggctgccagtatttcctctttgcacacatcctgcacttgtcagtggccacttgcccacctctgatttctcaagtgaaatcatcatgagaagggcatgagtggggagctgggaggtggtggcaggctgggtgctgcctgggtttcatcagaacctcctgaggtgggggccaggggtagccatggagttgggagttgtggaggaggcgagatgcttggaaggaagctgtggacagggtctgaatgggggtggctgagcctgaagctggagttgagtcctggtgggagcagaaaccttgrgcacctgggagtttggcttagacagattgggctgtgcatggtggagaaaggcccaagcagaaaagctcctgaacaggcctggagcttgcacaggagaaaggctggagtcacagacctggatgttgactctcctgatctcctaagggagagaggagaggaagaaatgaacggagggtcttgggggaaattccccaagaaataagtgagtagcaaaaacaaacactgccagactcctgaggccaacgggatccctgaaggtgcagggacttaacacagccaccaagaaaatgcaggtgagag

SEQ ID NO: 198664 - DNA, 601 bp, Human
gaaaagctcctgaacaggcctggagcttgcacaggagaaaggctggagtcacagacctggatgttgactctcctgatctcctaagggagagaggagaggaagaaatgaacggagggtcttgggggaaattccccaagaaataagtgagtagcaaaaacaaacactgccagactcctgaggccaacgggatccctgaaggtgcagggacttaacacagccaccaagaaaatgcaggtgagaggatgagtccaggaaaaacatcactgggctggcctggggaaattggtggccctggcaaggragttgcagaggctcagttccaggaacacacagggaaaggtaaaagacatttgtttcccacagggccagggctctaccagctcagttttgtattagacactggggccacactgttggaaataataatttagggataactgcacaatatacttgccacctttgccctatgaactccccaagagctcaggacacacattgagaaacaccagcacacaagtacccaaggtcatctgcaggcaaatagaaagcatcgtggaagcaatgctcattagacccacacactgtcccaggtgctctgctc

SEQ ID NO: 198665 - DNA, 601 bp, Human
gctggagtcacagacctggatgttgactctcctgatctcctaagggagagaggagaggaagaaatgaacggagggtcttgggggaaattccccaagaaataagtgagtagcaaaaacaaacactgccagactcctgaggccaacgggatccctgaaggtgcagggacttaacacagccaccaagaaaatgcaggtgagaggatgagtccaggaaaaacatcactgggctggcctggggaaattggtggccctggcaagggagttgcagaggctcagttccaggaacacacagggaaaggtwaaagacatttgtttcccacagggccagggctctaccagctcagttttgtattagacactggggccacactgttggaaataataatttagggataactgcacaatatacttgccacctttgccctatgaactccccaagagctcaggacacacattgagaaacaccagcacacaagtacccaaggtcatctgcaggcaaatagaaagcatcgtggaagcaatgctcattagacccacacactgtcccaggtgctctgctcagcagaaccgggggacagagacagcatcccaactagcaggg

SEQ ID NO: 198666 - DNA, 601 bp, Human
ctggatgttgactctcctgatctcctaagggagagaggagaggaagaaatgaacggagggtcttgggggaaattccccaagaaataagtgagtagcaaaaacaaacactgccagactcctgaggccaacgggatccctgaaggtgcagggacttaacacagccaccaagaaaatgcaggtgagaggatgagtccaggaaaaacatcactgggctggcctggggaaattggtggccctggcaagggagttgcagaggctcagttccaggaacacacagggaaaggtaaaagacatttgtttmccacagggccagggctctaccagctcagttttgtattagacactggggccacactgttggaaataataatttagggataactgcacaatatacttgccacctttgccctatgaactccccaagagctcaggacacacattgagaaacaccagcacacaagtacccaaggtcatctgcaggcaaatagaaagcatcgtggaagcaatgctcattagacccacacactgtcccaggtgctctgctcagcagaaccgggggacagagacagcatcccaactagcagggaggtgacaatcccag

SEQ ID NO: 198667 - DNA, 601 bp, Human
aaggtgcagggacttaacacagccaccaagaaaatgcaggtgagaggatgagtccaggaaaaacatcactgggctggcctggggaaattggtggccctggcaagggagttgcagaggctcagttccaggaacacacagggaaaggtaaaagacatttgtttcccacagggccagggctctaccagctcagttttgtattagacactggggccacactgttggaaataataatttagggataactgcacaatatacttgccacctttgccctatgaactccccaagagctcaggacacacaytgagaaacaccagcacacaagtacccaaggtcatctgcaggcaaatagaaagcatcgtggaagcaatgctcattagacccacacactgtcccaggtgctctgctcagcagaaccgggggacagagacagcatcccaactagcagggaggtgacaatcccaggggaagaaagaaggggaaagtctctattccagcacaagggtctgaagtcatgaaaatagagcagagcagggagtgaagctgtgccagagccacgctgatggcgtcctcaccattggtgcgggtgggtggccagatgcag

SEQ ID NO: 198668 - DNA, 601 bp, Human
gggaaagtctctattccagcacaagggtctgaagtcatgaaaatagagcagagcagggagtgaagctgtgccagagccacgctgatggcgtcctcaccattggtgcgggtgggtggccagatgcagctgcgcagatggcaggggcatgtttcctcctctcactgtaactggcagcagtgtgcttcattgtcacgctcagagcggacccccccccccacaggttgcccaccccagggcaagacctagatcctggtgagccttggtgggacctgtgcccagcacaacacacatggacagcccrgcaggggtagctgtgcagccagtggagtggcttctgtgcccagcatgccctctctggggctcattctcgtgtttcctaccctaattctaagctcattcttcagagctcacagtgcccctgacactccctggtccccctctctgcccagtgaccaaagctggcttgtccctgcacgcacgaggcaccactccatcacatgacttccatctgcctggcaaatctgcaccatttttggaagcagctgaaatcccatttacccagtaaagtcagctgaaataatcctagagaaagttcaccacc

SEQ ID NO: 198669 - DNA, 601 bp, Human
ccttcaataaaaaaggttatttttttcttatccatcacgaatccgtatttgaagatttctggaagaaaaatgaatcagaaaattcagaatatccaggtgagtctggggatattccaccccagtgcagcatagacacacctcaggacagagaaattgaagttggtggggtttcttaaagctcttgctgtaatgagcgccacttggaagtaatggcttaatcgttattaatttctttggtatttcctatgataacattaatcacagcaaactcatttgatgtaatggagaccaggaacccccytggaacgttccccagcaattccgtgctaattaactgaagcatcttgtaaaactgccaccctgttttacgattaagtgcatttcttgcacactttgattaagacacaaatcccaagccaataaaaaaaaaagtgggaaagaaagaaagaaaaaaaacccaccgttttagaatgcagtaatgagagcattggtaaagtaacagagacttcactgccagaggcgacaatagctactacttgaagtgaagcaaaaagaactccctagggatggtgtagactgagaaaccttcttctgtacctta

SEQ ID NO: 198670 - DNA, 601 bp, Human
cagcaaactcatttgatgtaatggagaccaggaacccccctggaacgttccccagcaattccgtgctaattaactgaagcatcttgtaaaactgccaccctgttttacgattaagtgcatttcttgcacactttgattaagacacaaatcccaagccaataaaaaaaaaagtgggaaagaaagaaagaaaaaaaacccaccgttttagaatgcagtaatgagagcattggtaaagtaacagagacttcactgccagaggcgacaatagctactacttgaagtgaagcaaaaagaactcccyagggatggtgtagactgagaaaccttcttctgtaccttaatttatccactgcatatgtacagaagcaattttaaaatgcatattaaacactccagtgaaagaaaagagaataattcacaaagatgtcagttctgcatacccaagtgagaactatgaaagcagagagtcctatgcaaacttatatcaaggtatggaaaacaccttttaccacttaaggtaaatgttcaatttccagagggcaaatcgtgcgctgcctcattcagcagcagaatttttctccccaatgattggcatttggct

SEQ ID NO: 198671 - DNA, 601 bp, Human
gacacaaatcccaagccaataaaaaaaaaagtgggaaagaaagaaagaaaaaaaacccaccgttttagaatgcagtaatgagagcattggtaaagtaacagagacttcactgccagaggcgacaatagctactacttgaagtgaagcaaaaagaactccctagggatggtgtagactgagaaaccttcttctgtaccttaatttatccactgcatatgtacagaagcaattttaaaatgcatattaaacactccagtgaaagaaaagagaataattcacaaagatgtcagttctgcatacmcaagtgagaactatgaaagcagagagtcctatgcaaacttatatcaaggtatggaaaacaccttttaccacttaaggtaaatgttcaatttccagagggcaaatcgtgcgctgcctcattcagcagcagaatttttctccccaatgattggcatttggctatcaaggcagaagaaaatggagcatatcacaagattgcacagcttggaagtgtaaaaggcgttcactagaacaggttctctggcacccagcatgccaaggtcctaacgaaaatcgtgtcaaaactcacgtcagtcattct

SEQ ID NO: 198672 - DNA, 601 bp, Human
aaaaaagtgggaaagaaagaaagaaaaaaaacccaccgttttagaatgcagtaatgagagcattggtaaagtaacagagacttcactgccagaggcgacaatagctactacttgaagtgaagcaaaaagaactccctagggatggtgtagactgagaaaccttcttctgtaccttaatttatccactgcatatgtacagaagcaattttaaaatgcatattaaacactccagtgaaagaaaagagaataattcacaaagatgtcagttctgcatacccaagtgagaactatgaaagcagasagtcctatgcaaacttatatcaaggtatggaaaacaccttttaccacttaaggtaaatgttcaatttccagagggcaaatcgtgcgctgcctcattcagcagcagaatttttctccccaatgattggcatttggctatcaaggcagaagaaaatggagcatatcacaagattgcacagcttggaagtgtaaaaggcgttcactagaacaggttctctggcacccagcatgccaaggtcctaacgaaaatcgtgtcaaaactcacgtcagtcattctgtgttttttctccactggttcaaa

SEQ ID NO: 198673 - DNA, 601 bp, Human
ctgccagaggcgacaatagctactacttgaagtgaagcaaaaagaactccctagggatggtgtagactgagaaaccttcttctgtaccttaatttatccactgcatatgtacagaagcaattttaaaatgcatattaaacactccagtgaaagaaaagagaataattcacaaagatgtcagttctgcatacccaagtgagaactatgaaagcagagagtcctatgcaaacttatatcaaggtatggaaaacaccttttaccacttaaggtaaatgttcaatttccagagggcaaatcgtgygctgcctcattcagcagcagaatttttctccccaatgattggcatttggctatcaaggcagaagaaaatggagcatatcacaagattgcacagcttggaagtgtaaaaggcgttcactagaacaggttctctggcacccagcatgccaaggtcctaacgaaaatcgtgtcaaaactcacgtcagtcattctgtgttttttctccactggttcaaatgcacatcattctaaggatgacagacacatgcagaggcacctggaatgaggcaaatgggacctcgggtcttaaaggatgaaacca

SEQ ID NO: 198674 - DNA, 601 bp, Human
agcaaaaagaactccctagggatggtgtagactgagaaaccttcttctgtaccttaatttatccactgcatatgtacagaagcaattttaaaatgcatattaaacactccagtgaaagaaaagagaataattcacaaagatgtcagttctgcatacccaagtgagaactatgaaagcagagagtcctatgcaaacttatatcaaggtatggaaaacaccttttaccacttaaggtaaatgttcaatttccagagggcaaatcgtgcgctgcctcattcagcagcagaatttttctccccartgattggcatttggctatcaaggcagaagaaaatggagcatatcacaagattgcacagcttggaagtgtaaaaggcgttcactagaacaggttctctggcacccagcatgccaaggtcctaacgaaaatcgtgtcaaaactcacgtcagtcattctgtgttttttctccactggttcaaatgcacatcattctaaggatgacagacacatgcagaggcacctggaatgaggcaaatgggacctcgggtcttaaaggatgaaaccagagcacatgggcattaacctgctgactgacagcag

SEQ ID NO: 198675 - DNA, 601 bp, Human
agaagcaattttaaaatgcatattaaacactccagtgaaagaaaagagaataattcacaaagatgtcagttctgcatacccaagtgagaactatgaaagcagagagtcctatgcaaacttatatcaaggtatggaaaacaccttttaccacttaaggtaaatgttcaatttccagagggcaaatcgtgcgctgcctcattcagcagcagaatttttctccccaatgattggcatttggctatcaaggcagaagaaaatggagcatatcacaagattgcacagcttggaagtgtaaaaggcrttcactagaacaggttctctggcacccagcatgccaaggtcctaacgaaaatcgtgtcaaaactcacgtcagtcattctgtgttttttctccactggttcaaatgcacatcattctaaggatgacagacacatgcagaggcacctggaatgaggcaaatgggacctcgggtcttaaaggatgaaaccagagcacatgggcattaacctgctgactgacagcagctcaggacgagagaatgcctatgtcacccaagagaagggggtccaggccctgtgggagagaccacaggaactccaca

SEQ ID NO: 198676 - DNA, 601 bp, Human
aatgaggcaaatgggacctcgggtcttaaaggatgaaaccagagcacatgggcattaacctgctgactgacagcagctcaggacgagagaatgcctatgtcacccaagagaagggggtccaggccctgtgggagagaccacaggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggmactccacaccacgagagcagggcttcagagaccacgggcactccacaccacgagagcagggcttcagagaccacgggcactccacaccacgagagcagggcttcagagaccatgggcactccacaccacgagagcagggcttcagagaccatgggaactccacaccatgagaacagggcttcagagaccgcagaaactccacaccacgagaacagggcttcagagaccagagtaactccacaccatgagaacagggcttcagagaccacaggaactccacaccacgagagcaggcttcag

SEQ ID NO: 198677 - DNA, 601 bp, Human
atgcctatgtcacccaagagaagggggtccaggccctgtgggagagaccacaggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggcactccacaccacgagagcagggcttcagagaccacgggcactccacaccaygagagcagggcttcagagaccatgggcactccacaccacgagagcagggcttcagagaccatgggaactccacaccatgagaacagggcttcagagaccgcagaaactccacaccacgagaacagggcttcagagaccagagtaactccacaccatgagaacagggcttcagagaccacaggaactccacaccacgagagcaggcttcagagaccgtaggaattcacaccacgagaacaggacttcagagactgcaggaactccacaccacaagaacaggcttcagagacctcaggaatt

SEQ ID NO: 198678 - DNA, 601 bp, Human
tccaggccctgtgggagagaccacaggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggcactccacaccacgagagcagggcttcagagaccacgggcactccacaccacgagagcagggcttcagagaccatgggmactccacaccacgagagcagggcttcagagaccatgggaactccacaccatgagaacagggcttcagagaccgcagaaactccacaccacgagaacagggcttcagagaccagagtaactccacaccatgagaacagggcttcagagaccacaggaactccacaccacgagagcaggcttcagagaccgtaggaattcacaccacgagaacaggacttcagagactgcaggaactccacaccacaagaacaggcttcagagacctcaggaattccacactgtgatagcagggccccactg

SEQ ID NO: 198679 - DNA, 601 bp, Human
gggagagaccacaggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggcactccacaccacgagagcagggcttcagagaccacgggcactccacaccacgagagcagggcttcagagaccatgggcactccacaccaygagagcagggcttcagagaccatgggaactccacaccatgagaacagggcttcagagaccgcagaaactccacaccacgagaacagggcttcagagaccagagtaactccacaccatgagaacagggcttcagagaccacaggaactccacaccacgagagcaggcttcagagaccgtaggaattcacaccacgagaacaggacttcagagactgcaggaactccacaccacaagaacaggcttcagagacctcaggaattccacactgtgatagcagggccccactgaagccaggggtg

SEQ ID NO: 198680 - DNA, 601 bp, Human
agaccacaggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggcactccacaccacgagagcagggcttcagagaccacgggcactccacaccacgagagcagggcttcagagaccatgggcactccacaccacgagarcagggcttcagagaccatgggaactccacaccatgagaacagggcttcagagaccgcagaaactccacaccacgagaacagggcttcagagaccagagtaactccacaccatgagaacagggcttcagagaccacaggaactccacaccacgagagcaggcttcagagaccgtaggaattcacaccacgagaacaggacttcagagactgcaggaactccacaccacaagaacaggcttcagagacctcaggaattccacactgtgatagcagggccccactgaagccaggggtgacata

SEQ ID NO: 198681 - DNA, 601 bp, Human
tttgtaatggcaatgtaaaatttaaaaagatgaaagcatagcaacaaagataaaataaatagcatgcttttagaagaccacgcggcatggaaagcagtctctagcgctgtctttcttccgttagggtggactggaaccacagggtatgaaaagtggcctctcgcgctgtcctccttctgttggggggactggaaacacatttctccattcattgtcagtggtgttacaagccattggtgagcttccttccagagtgaatgccaaatgatacatttatattagatctctctgaccactgctrttgacgttggcggggtagcaggtgtggccgtaacatggagcacaggctgagctgcctgacttgcactgctggacggtgggttggcggtgttgacgctgcacaggtcatgagcgccggccctgcggatccggcgatgatcattgtggaaagaatggacagcaccctggttgatgtgcagagtgaccctgcagtcaagtctgtttgcctcccactagcattttctcatctccagcacggtgtcaatggtgccactccagccgggccaccctgcccacaaggtcttccacggggctcctcccc

SEQ ID NO: 198682 - DNA, 601 bp, Human
ccacgcggcatggaaagcagtctctagcgctgtctttcttccgttagggtggactggaaccacagggtatgaaaagtggcctctcgcgctgtcctccttctgttggggggactggaaacacatttctccattcattgtcagtggtgttacaagccattggtgagcttccttccagagtgaatgccaaatgatacatttatattagatctctctgaccactgctgttgacgttggcggggtagcaggtgtggccgtaacatggagcacaggctgagctgcctgacttgcactgctggacggygggttggcggtgttgacgctgcacaggtcatgagcgccggccctgcggatccggcgatgatcattgtggaaagaatggacagcaccctggttgatgtgcagagtgaccctgcagtcaagtctgtttgcctcccactagcattttctcatctccagcacggtgtcaatggtgccactccagccgggccaccctgcccacaaggtcttccacggggctcctccccagctcacggggaaatcccctttaatttcaaacagggcccttccacctgcccttgattccctgtggcaccttgggagc

SEQ ID NO: 198683 - DNA, 601 bp, Human
gaatggacagcaccctggttgatgtgcagagtgaccctgcagtcaagtctgtttgcctcccactagcattttctcatctccagcacggtgtcaatggtgccactccagccgggccaccctgcccacaaggtcttccacggggctcctccccagctcacggggaaatcccctttaatttcaaacagggcccttccacctgcccttgattccctgtggcaccttgggagcatggggctgccctactgtggagttagtgggtccacttcgagaagacagagacagagtgaagcctcaagaacartgttcactggcagtgggaaccgtcggtcctgccatgggacgatgtgactgggggctcgtccgtgccttgtcgtggacatctctggtctcagccggcaggggtgggtgggacctcagacctcagcgggtgatggcagtgggagcctgggcaggggcgggcagggctctgtggtaagacacagagggcaggggctggggtgggcagggctccatgggaagacacaggtagcgggtcaggtgctggggaggtgttgctgggcatggtggatttgcaaatttccagggcggtggggggtctggc

SEQ ID NO: 198684 - DNA, 601 bp, Human
cggtggggggtctggcaagtgtagacacagggcagaagtgggcgcagtgtctgtgggtgaagagctgtgcgggcgggcactgagaagaggtgcccacgtccatccccagcccctcaggcatgttcaccatcatggcgcacatgtctgggagtgagcagaggaccagggtatggaacaagccctagtcagaaatgcctcctgacgcctgtgacctctgggcagggctagtgaggggctggggagagcagagggtgtttctggataagaactcacactaaaggcctggcccggaccctgcctycatcagcagggtgcagcccaggcccagcacattctcctcctcctgggacctcgatcttggcttcccctaggcctttctggggccccccagttcctgccaacactgctgtccacgctggggccctccagttcctgccaacactgctgtccactctcttgtccaccccatgattccaaccactggatccgagcatctgcaccctgtatccgtttctctaacccagatttccttcaagtttcaatcctgtactttcggataaggactggatgccagcccctgtctcctcatgtctgagagcct

SEQ ID NO: 198685 - DNA, 601 bp, Human
agagctgtgcgggcgggcactgagaagaggtgcccacgtccatccccagcccctcaggcatgttcaccatcatggcgcacatgtctgggagtgagcagaggaccagggtatggaacaagccctagtcagaaatgcctcctgacgcctgtgacctctgggcagggctagtgaggggctggggagagcagagggtgtttctggataagaactcacactaaaggcctggcccggaccctgcctccatcagcagggtgcagcccaggcccagcacattctcctcctcctgggacctcgatcttgrcttcccctaggcctttctggggccccccagttcctgccaacactgctgtccacgctggggccctccagttcctgccaacactgctgtccactctcttgtccaccccatgattccaaccactggatccgagcatctgcaccctgtatccgtttctctaacccagatttccttcaagtttcaatcctgtactttcggataaggactggatgccagcccctgtctcctcatgtctgagagcctctccatctccagacaccccaatctcctcgtccctgtgatgtcggctcaggtcaccattgt

SEQ ID NO: 198686 - DNA, 601 bp, Human
agaactcacactaaaggcctggcccggaccctgcctccatcagcagggtgcagcccaggcccagcacattctcctcctcctgggacctcgatcttggcttcccctaggcctttctggggccccccagttcctgccaacactgctgtccacgctggggccctccagttcctgccaacactgctgtccactctcttgtccaccccatgattccaaccactggatccgagcatctgcaccctgtatccgtttctctaacccagatttccttcaagtttcaatcctgtactttcggataaggacyggatgccagcccctgtctcctcatgtctgagagcctctccatctccagacaccccaatctcctcgtccctgtgatgtcggctcaggtcaccattgtgtcctcttgctctcctgggtcaggcacctaggagtccctgaatgcaggcaaatcattcctcagctgtcagctattcatattcccacggccccacgaggagacgtgcttcattctacacaaacttgggcgagctccctagacccgaactgtgcttttcagtgagtgtcatagatgtcacatgggtgtcagattcaaggatgaggc

SEQ ID NO: 198687 - DNA, 601 bp, Human
tctggggccccccagttcctgccaacactgctgtccacgctggggccctccagttcctgccaacactgctgtccactctcttgtccaccccatgattccaaccactggatccgagcatctgcaccctgtatccgtttctctaacccagatttccttcaagtttcaatcctgtactttcggataaggactggatgccagcccctgtctcctcatgtctgagagcctctccatctccagacaccccaatctcctcgtccctgtgatgtcggctcaggtcaccattgtgtcctcttgctctccygggtcaggcacctaggagtccctgaatgcaggcaaatcattcctcagctgtcagctattcatattcccacggccccacgaggagacgtgcttcattctacacaaacttgggcgagctccctagacccgaactgtgcttttcagtgagtgtcatagatgtcacatgggtgtcagattcaaggatgaggccagcccttggtgccaggcttggcataaatcagccccaccagcccctgcctgccctccgtgtctggtattcatgttcaaaggagtctaaaacctcactgtcttttccatgtga

SEQ ID NO: 198688 - DNA, 601 bp, Human
ctgtgatgtcggctcaggtcaccattgtgtcctcttgctctcctgggtcaggcacctaggagtccctgaatgcaggcaaatcattcctcagctgtcagctattcatattcccacggccccacgaggagacgtgcttcattctacacaaacttgggcgagctccctagacccgaactgtgcttttcagtgagtgtcatagatgtcacatgggtgtcagattcaaggatgaggccagcccttggtgccaggcttggcataaatcagccccaccagcccctgcctgccctccgtgtctggtatycatgttcaaaggagtctaaaacctcactgtcttttccatgtgaatttacctttttttttttccattgcatgtcctttaaataaccaccaggtacctactgtgtgccctgggcactggggatgcagagggtcccaaccacaatgcctgtctgcaggagttcccagggtggaggtccagctgctctgagcctggtccaaggacagccacaaactagagataggctttggacaaagcagtgtggccgaggtggggtgttgtaccccatgcgatgtggagagagggaacttctgtcgaggatgg

SEQ ID NO: 198689 - DNA, 601 bp, Human
ctcagcctggcagccgagttccagcagagttgagacccagcggctcctctggctgttcctgtgttgggcattctcctgctcctggcaccggctggcactctcctctgtggcctctgttctctttattgttcagttatgaggcttcttcctcagttccatgggttaaaatccagatgcaagccccccccaccaattaccccttcattctacagagttcccaggttctcgcccactctgcccagcaccttactggagcctccaccatgaggcctcccgtgctgcctcctgggatagtcacgcrtgtgcctgtgcggctgccctaccagaccctggggcctccaagatcgcaaactggtccatccctctccctgcctccagcgtctgccgaccatgcttgcacgtagccgtggacttgtgccgcagattggggtaaataatcctagagcagataactaaggtacactcttcaaactgtaattcatcacaaaactaagtaatattttgtttttaaatgtacctaagcccatgttgtcttgttgatattaaactgtgggggtatagaggtgtggtagcattttactaagtcacagaggatataaac

SEQ ID NO: 198690 - DNA, 601 bp, Human
gttccagcagagttgagacccagcggctcctctggctgttcctgtgttgggcattctcctgctcctggcaccggctggcactctcctctgtggcctctgttctctttattgttcagttatgaggcttcttcctcagttccatgggttaaaatccagatgcaagccccccccaccaattaccccttcattctacagagttcccaggttctcgcccactctgcccagcaccttactggagcctccaccatgaggcctcccgtgctgcctcctgggatagtcacgcatgtgcctgtgcggctgmcctaccagaccctggggcctccaagatcgcaaactggtccatccctctccctgcctccagcgtctgccgaccatgcttgcacgtagccgtggacttgtgccgcagattggggtaaataatcctagagcagataactaaggtacactcttcaaactgtaattcatcacaaaactaagtaatattttgtttttaaatgtacctaagcccatgttgtcttgttgatattaaactgtgggggtatagaggtgtggtagcattttactaagtcacagaggatataaacacttctgcttaagctcc

SEQ ID NO: 198691 - DNA, 601 bp, Human
gaggtgggggcgggaggaagtgagaggtaggatctggtaccatctcgagaggctgcagcagggacacttgaagatctagtgacacctaagagctccctgttgctgctgctgggggagcaggaagggggatcaccctgacaagactggtggcagctgggacaagagtcgtggctgaggaggagggaaggaggtcagcttcccgatgtgtctgtgggccggcaggactcaccgccgcaggcagcaggctcaggcacctttggtaactaggcccacaacagatcctgaactccctgtacgtcgmatgcacatctacagactaaataccaaggagttttctaaaaaggccaatgacaggtcaggtggacctgaattgttaccactaattaggataaaagaggtttacagatgccttgggccagggcagtttcccggaaagtctgaaaccagctctcaggtgtgttttgtggaagacacggctcctctggcacagggctgtgaaactagctctcagacgtcggtgaaactctgcctgatctgcttctcaaacagctcccgtgtggtgctgccgccatctccgccgtcaggagtggctttgcaaaga

SEQ ID NO: 198692 - DNA, 601 bp, Human
ggccggcaggactcaccgccgcaggcagcaggctcaggcacctttggtaactaggcccacaacagatcctgaactccctgtacgtcgcatgcacatctacagactaaataccaaggagttttctaaaaaggccaatgacaggtcaggtggacctgaattgttaccactaattaggataaaagaggtttacagatgccttgggccagggcagtttcccggaaagtctgaaaccagctctcaggtgtgttttgtggaagacacggctcctctggcacagggctgtgaaactagctctcagacrtcggtgaaactctgcctgatctgcttctcaaacagctcccgtgtggtgctgccgccatctccgccgtcaggagtggctttgcaaagacgtcttatgctgaccgcatgtcttttggcctttcttttcaagagccaaacacttcctcctagacaagacacagcaagatactatggcttcacgtccttcctaagcaaagccagggaccattcgggaaattgtttagcaatgctctgagtcttttactcttttgaaagcttttgagctcaagacagtttctggcaaggcaagtccattcattca

SEQ ID NO: 198693 - DNA, 601 bp, Human
atttaacacatgacagtcctctaatgcagacactatgggagcccacattttgcagatagggaaactgaggcagctggtccagatgacttggtcactacacagaagagccatgcagcccggctccagagcgacgctgcctccggttcctttatctacctctggtgctcccggtggctgacaacgcctgcttatgtattctgctctctgcagggggtgccgctgaatgccggtccttggaggtatgggctggactttatgactcgcatccgttgcatagaatacagtgcgtgatgcacaggcrtaagaggtccctcagcttcctgctcaatcgcagcccaggccagcaagccaaccataccctcatgtgagtcccagagccagagcccccgactgggcagctgggggatctgtgacaacaggaacgaagctggtgagttcggggtagtgtgttgtatagcatcagataactaatagagtctatttcctcagcaatacaaggatcccccaaaagcctcataaagataatcactgaggactccttagtctttgaaatgtaatcctcatttcattaagtttcagtgaccatcacattttgatgact

SEQ ID NO: 198694 - DNA, 601 bp, Human
gctgagatgcaaacttcataggcaggctgcacaccagagggtaattcagtatctctgcatctgagtaagaaagttcttaaaccactgtctctttttatgtcaacttacagggaagaacattctccaaatatcttagaaattcagtcaagtgtttcaaagccaaactaaattactccagctatttgtcggagttggaaaagaaacttctaggactgagcagccataagatacagccatagataccctgtgattggccgggcacggtggctcacacctgtcatcccagcactttgggaggccraggtggggagtcacttgaggtcaggacttcgagaccagcctggccaacatggcaaaaccccgtctctactaaaactataaaaattagctgggcatggtggcacgtgcctgtagtcccagctacttgggagactgaggcaggagaatcacttgaacctggctgggcggaggttgcaagtgagccgagatcatgccactgcactccagcctgagcaacagagcaagactccatctcaaaaaaataaataaataaaagatactacgtgattgtattagcatcacatctgcccacagccttgga

SEQ ID NO: 198695 - DNA, 601 bp, Human
ggagaatcacttgaacctggctgggcggaggttgcaagtgagccgagatcatgccactgcactccagcctgagcaacagagcaagactccatctcaaaaaaataaataaataaaagatactacgtgattgtattagcatcacatctgcccacagccttggaaagtaggcagacgctcctccctttaagcctgaggaaacccaggcttaaagaagtgacatgatcagccagttcccaccaagccccacctcccacacgggcactggggacaggggagggataagtagccagttcccaccaarccccgcctcccacacgggctctggggacaggtggggggtaagtagccagttcccacggagccccgcctcccacacgggcactggtgatgccctgcgcactctggctgtgttgtcaggcactcacacagttagatcagtaacttgcagaaaggctcctcatataccaaagttgagtggataaacagccttttaccctaagagtgacctcagagtttgcaagaacccacacatttcttggtccttatacaaattcagaggaactgcagacagtggtgtcaccagaaccatttagacaataat

SEQ ID NO: 198696 - DNA, 601 bp, Human
gccaggctccaccccatcccacgccaggctccacccaatcccacgccaggctccaccccccacgccaggctccacccccccacgccaggctccaccccatcccacgccaggctccaccccccccacgccaggctccaccccccccacgccaggctccaccccatcccacgccaggctccacccaagccagcggcaccggttctggctggaaggttcccaaacctaggccagggtgtgaatgccaggggccctgtgagtggtgagtgatggttgctgggtgctgggggctggcgctgttccygccgcgccctccatgaagctgactctcagtcctgctctctgacaccgggctgtgctcagcagccacgagctgaccacgcggtgaggctgttcacttttctccctgactccagctctccccacatgcagctcatccccgacatgggctcttatcccaccaaccgcttctaaagacctgcagaagctccctagtcacaggacgtggcgagcccaatactcacgtctgcccctgacttctgcactaggccctgcctcagccactggcctcctgcccctcactgtcggcctcaggcccaggctc

SEQ ID NO: 198697 - DNA, 601 bp, Human
gcttctaaagacctgcagaagctccctagtcacaggacgtggcgagcccaatactcacgtctgcccctgacttctgcactaggccctgcctcagccactggcctcctgcccctcactgtcggcctcaggcccaggctctctgtgtagaggcctcctggcttccccaccccgtgctgctccccacccggtgctactcccctggctgagcgcccacacttctttccccttttccaaatcccacctgcaggtggtggtctctagcactcctcttggttcatgggccttgactgacagctttctsctgcagccatcctctccacaattctgggagcgtcgactgtgctcactcaacactccctttaacaaagtgacatcagatgtttgggccctacttgcatttaagccatccagtgcattccacataaaaagcgtgcacctggaggaaactaaataatcacaaccaatcactctttttttagaaaaaagcagcagctctctcaatgtagaccaatttatcggtctaaactagagagaccgggcaagccacttccatcttgcgagtttagcatatttgcctgttgacacctacacttggaggaag

SEQ ID NO: 198698 - DNA, 601 bp, Human
cactggcctcctgcccctcactgtcggcctcaggcccaggctctctgtgtagaggcctcctggcttccccaccccgtgctgctccccacccggtgctactcccctggctgagcgcccacacttctttccccttttccaaatcccacctgcaggtggtggtctctagcactcctcttggttcatgggccttgactgacagctttctgctgcagccatcctctccacaattctgggagcgtcgactgtgctcactcaacactccctttaacaaagtgacatcagatgtttgggccctacttgmatttaagccatccagtgcattccacataaaaagcgtgcacctggaggaaactaaataatcacaaccaatcactctttttttagaaaaaagcagcagctctctcaatgtagaccaatttatcggtctaaactagagagaccgggcaagccacttccatcttgcgagtttagcatatttgcctgttgacacctacacttggaggaagccattctgtgtgtgtggtgtgccttcacaagtaatttctatggaaaacagccgtcagacagtcatcctggcccaaggtgacctcattaccagaat

SEQ ID NO: 198699 - DNA, 601 bp, Human
tctcaatgtagaccaatttatcggtctaaactagagagaccgggcaagccacttccatcttgcgagtttagcatatttgcctgttgacacctacacttggaggaagccattctgtgtgtgtggtgtgccttcacaagtaatttctatggaaaacagccgtcagacagtcatcctggcccaaggtgacctcattaccagaatttgttctagttgtcattagacatatcacactatgtcactcaaaatgggaaagaaagagaagatactgacatgccgccccagtgattagagatgaaaatgyagttataccatatatgatccctgcttggagactatacggatagggtttaagattcaggcccccctcagatccatcactgtggtcctgaagcctctgtccttcttctgttcttttaaacttctctgtgtagatacagcaagtgtgttttctactcactgcacagccagcgctgctcttgaacaaactcctgagggaggtgcacggaaaccatgcatccaaatccggagagcagggagaccagccggatagcccacctggctgacgagacccggcctcgctcagaaagctcctccaagatgc

SEQ ID NO: 198700 - DNA, 601 bp, Human
ccactccacccctcctccaggaccctccagagtgaatctggagcgagggggcccagtgactttggggtcatttgcacggtatcagctatagccgcagtgagagggaggctgctggacacgctggggttcacctgtgtcccaggagaaccccgctttaggatataacgggttcatgcactggagtagctgccggtacacatctagggagtgatgatccccctccaccagccagtggggaatgagcccgtgaaggtcacagccagccatgaaacagctgcactgccccagcacgccgcccacrcttggtcggcaacacagagattccatttcttcctgggattaggaagcacgaagtgtccagatctgcttctgaaatctcttcctcccttaaggtaaggtgctgtgtggagcttactggaacctaaacgggggcaagatgaccggtcactaaagggggcgaggttaccagtcactaaagggaaagggggcgtgatgaccagtcactagtgggggtgagacaaccggtcactaacgggggcaatatgacccctcactaatggggtgatcggtcactaaacggggtgagatgacaggtcattaa

SEQ ID NO: 198701 - DNA, 601 bp, Human
tggggaatgagcccgtgaaggtcacagccagccatgaaacagctgcactgccccagcacgccgcccacgcttggtcggcaacacagagattccatttcttcctgggattaggaagcacgaagtgtccagatctgcttctgaaatctcttcctcccttaaggtaaggtgctgtgtggagcttactggaacctaaacgggggcaagatgaccggtcactaaagggggcgaggttaccagtcactaaagggaaagggggcgtgatgaccagtcactagtgggggtgagacaaccggtcactaaygggggcaatatgacccctcactaatggggtgatcggtcactaaacggggtgagatgacaggtcattaatgggggcgtagtgtccggtcactaatagggtgtgatgacctgtcagtcattatctcttgcataagagacttcccaggggcagagcagacccggtggacagcaggagctgcctggtcccactgctgagttttatgtctggatgctgaatagctggaggaagcggcctgctggttttgttcacactgggtgaacagttggaatacaggttcctcgggcctgtcctaaatgctat

SEQ ID NO: 198702 - DNA, 601 bp, Human
ccaggcgtgcccccagctctcctgaggctggtttgcagtggccgggcccagctaaagcaactgaacctccagagcagaggacagtgtcctgcctgcacgtcttgacatggccccacaggagggttccctgtctttcacgtgctgatagaccaaacacaccaaacgcattcccgggcaggtgtgtacatcagaacagtgatgaatcagggacccttcttagtgctactataagtaacaacagtgagtcagacgggtgcaaaccctttggaagactcagtctgcaagccccagggagcacagsggggctggagggaaccgggggagggatgcacaggcgagaaatgcccatgacccggtccacaggtcatgcacgtccacactttctaaaaaaccacctacaagaaaggggttgtttcctggcccccagtggggtgcagaatgtcagtgctgggctgcaccctgggcagggctgctctgggcagcatcgccacacccgtgtcccattcttggggtgcatccccttctcacatctgtgtctaaagccaggaatgggcagtgtgacctgaggaaaatcagggacaccctctgtgtcctcatatgc

SEQ ID NO: 198703 - DNA, 601 bp, Human
gagcagaggacagtgtcctgcctgcacgtcttgacatggccccacaggagggttccctgtctttcacgtgctgatagaccaaacacaccaaacgcattcccgggcaggtgtgtacatcagaacagtgatgaatcagggacccttcttagtgctactataagtaacaacagtgagtcagacgggtgcaaaccctttggaagactcagtctgcaagccccagggagcacaggggggctggagggaaccgggggagggatgcacaggcgagaaatgcccatgacccggtccacaggtcatgcaygtccacactttctaaaaaaccacctacaagaaaggggttgtttcctggcccccagtggggtgcagaatgtcagtgctgggctgcaccctgggcagggctgctctgggcagcatcgccacacccgtgtcccattcttggggtgcatccccttctcacatctgtgtctaaagccaggaatgggcagtgtgacctgaggaaaatcagggacaccctctgtgtcctcatatgcaaacatgtctctttcatgccagttaaatgaagaaaaaggcaagacctaaatcctgaactcctaccgctata

SEQ ID NO: 198704 - DNA, 601 bp, Human
ctcagagggcagaagaaagcggagtcttgtggggggcaccatctgtggctgggtcggagggaccagggctgctgtagccctttcctttctgcaccgctctgaccaagtgcgtctaaggggtggagggatgaggggggtgggtgccttcgtggctgcttagccatgattctgctggacaccatggtctgggggaggcagcgggggcgggtgccacctcaccttcgggtacctgacgggccggaatgacacatccttgtcacgtccaccccacttcacagatgggaaaccggggctcaggtarctcaagggaagcagcattgagaggtcagggcaggccttctgcccaatcccccgcctgctggctgtgttccttccacactcggccaaggtctctgcccccgcatcccaccccgccctgcccagggctgcgctgacctgccttctccccctcctcctcattagctgcaaagaaaactcttctgggggctgccaaatgcagagctgcttcgtgtcccttctttgacagtaaaagttgttttcttggaaataaatcaaatttgtatttctcaacaaaacctgccctccatccctctatgaagaa

SEQ ID NO: 198705 - DNA, 601 bp, Human
ggagtcttgtggggggcaccatctgtggctgggtcggagggaccagggctgctgtagccctttcctttctgcaccgctctgaccaagtgcgtctaaggggtggagggatgaggggggtgggtgccttcgtggctgcttagccatgattctgctggacaccatggtctgggggaggcagcgggggcgggtgccacctcaccttcgggtacctgacgggccggaatgacacatccttgtcacgtccaccccacttcacagatgggaaaccggggctcaggtagctcaagggaagcagcattgrgaggtcagggcaggccttctgcccaatcccccgcctgctggctgtgttccttccacactcggccaaggtctctgcccccgcatcccaccccgccctgcccagggctgcgctgacctgccttctccccctcctcctcattagctgcaaagaaaactcttctgggggctgccaaatgcagagctgcttcgtgtcccttctttgacagtaaaagttgttttcttggaaataaatcaaatttgtatttctcaacaaaacctgccctccatccctctatgaagaaaaatgcaagttgctcttctg

SEQ ID NO: 198706 - DNA, 601 bp, Human
gacgggccggaatgacacatccttgtcacgtccaccccacttcacagatgggaaaccggggctcaggtagctcaagggaagcagcattgagaggtcagggcaggccttctgcccaatcccccgcctgctggctgtgttccttccacactcggccaaggtctctgcccccgcatcccaccccgccctgcccagggctgcgctgacctgccttctccccctcctcctcattagctgcaaagaaaactcttctgggggctgccaaatgcagagctgcttcgtgtcccttctttgacagtaaaarttgttttcttggaaataaatcaaatttgtatttctcaacaaaacctgccctccatccctctatgaagaaaaatgcaagttgctcttctgcgctccaaatacaccgagacgaaaacaagcccaggtgaagctgcagctggggacacgagttaatgtgagtgcgagcccagggcagagcgggcccagataaataattcatgagcgccaccggggaagaccgggcactcgtggagttcaacagatcataagcaggatccagggtcgtgtagcgacacagcttcccaagcaggcgagtgacctg

SEQ ID NO: 198707 - DNA, 601 bp, Human
caaagaaaactcttctgggggctgccaaatgcagagctgcttcgtgtcccttctttgacagtaaaagttgttttcttggaaataaatcaaatttgtatttctcaacaaaacctgccctccatccctctatgaagaaaaatgcaagttgctcttctgcgctccaaatacaccgagacgaaaacaagcccaggtgaagctgcagctggggacacgagttaatgtgagtgcgagcccagggcagagcgggcccagataaataattcatgagcgccaccggggaagaccgggcactcgtggagtycaacagatcataagcaggatccagggtcgtgtagcgacacagcttcccaagcaggcgagtgacctggagcacagaggggagggacggggacaggtgcagcagagattgggcacgggccaggaatgcatcacggcacctgcgcacaggggtggcctccaggggctccaagtcctctgggatccaggttctccttccttcagggcacccccacccaccctctccccaaggcttgggccacactccatgccaccatgcccaacggtccccgccctgcacccacctctggcaagttctgggcag

SEQ ID NO: 198708 - DNA, 601 bp, Human
cagcagagattgggcacgggccaggaatgcatcacggcacctgcgcacaggggtggcctccaggggctccaagtcctctgggatccaggttctccttccttcagggcacccccacccaccctctccccaaggcttgggccacactccatgccaccatgcccaacggtccccgccctgcacccacctctggcaagttctgggcagggggagagcgacacaaggcaagggaggagacatcggtggatgggggagcagggcaggctgggggtcagggctcagggcggtgctgacagtaggacaygctggtccccttcccagtgaagtcccaggaaacagcctctcatgttgctgggccggtgctcaggagctggggctgcctggggcacaaagcacgtggactaggacactggaatgtcaccgagcttccctccgatacagtgggagggaggacttggcgcacagtgggtgagtgaatggacaggcaggagtgaccagcccagtcccagcgcttaccgaggaggactggggaggggggccgagtctccagtcaggcagagagagctgctggtgtcaaccctgccagcaagatgtgccccagatc

SEQ ID NO: 198709 - DNA, 601 bp, Human
gtggagatgggctacagggagtgttggggtgagagctgcacggggctgttctcagcagatcccagcaagtgacacacccaaggctggggacccaggacaaggccaagggcacctaagcaccaagcaagagtgagattagaccctcccagaagtgatgcacccaaggctggggacccaggacgaggccaagggcacctaagcgctgagcaggagtgagatcagaccctcccggggctcaaaaaaggctcccagcatcggtcacagcccgtgcccctcgcaggcctgcatgacagtcagggcytccatcaccatcaggccagcacaggcacagcccagacatgcaggaggctccagccagtatttgagaacagacgcctgagtgccgggactcggcccacagcccattcgcccagggagactggtggtccccatgtgccacccgagctgtcaggcactcagtatgtttttaaagcctcactttttaattatatcatctaatacatggaaaattgtgtatcactactgtaaatgaaaagcagaatcattgctgtgagaaggccaccctaaaggtgagttccatgaaaacaaaacacccaaattt

SEQ ID NO: 198710 - DNA, 601 bp, Human
tggggacccaggacaaggccaagggcacctaagcaccaagcaagagtgagattagaccctcccagaagtgatgcacccaaggctggggacccaggacgaggccaagggcacctaagcgctgagcaggagtgagatcagaccctcccggggctcaaaaaaggctcccagcatcggtcacagcccgtgcccctcgcaggcctgcatgacagtcagggcctccatcaccatcaggccagcacaggcacagcccagacatgcaggaggctccagccagtatttgagaacagacgcctgagtgccrggactcggcccacagcccattcgcccagggagactggtggtccccatgtgccacccgagctgtcaggcactcagtatgtttttaaagcctcactttttaattatatcatctaatacatggaaaattgtgtatcactactgtaaatgaaaagcagaatcattgctgtgagaaggccaccctaaaggtgagttccatgaaaacaaaacacccaaattttgttcatttaaacgtgatcaaagactgcatggcgacacgttctctggaaagaggggctgctcatggccccgagtctctcgctct

SEQ ID NO: 198711 - DNA, 601 bp, Human
ccagacatgcaggaggctccagccagtatttgagaacagacgcctgagtgccgggactcggcccacagcccattcgcccagggagactggtggtccccatgtgccacccgagctgtcaggcactcagtatgtttttaaagcctcactttttaattatatcatctaatacatggaaaattgtgtatcactactgtaaatgaaaagcagaatcattgctgtgagaaggccaccctaaaggtgagttccatgaaaacaaaacacccaaattttgttcatttaaacgtgatcaaagactgcatgrcgacacgttctctggaaagaggggctgctcatggccccgagtctctcgctctccaggatgagttgggagtggaatcgccatggccacggagtcccttgcagcctctgagcttctgcctgtgggaagagctggcaggttgggggaccggccacacggtctgtactgagtgggtctctcagcaccacctcattctaacaggagggctcctgaaatcagcgccttatggtgctaaggttttaataacacattagaatacacagaactaaataaaaataaaacaaaacaaaataaaacacaaaa

SEQ ID NO: 198712 - DNA, 601 bp, Human
ctgcctgtgggaagagctggcaggttgggggaccggccacacggtctgtactgagtgggtctctcagcaccacctcattctaacaggagggctcctgaaatcagcgccttatggtgctaaggttttaataacacattagaatacacagaactaaataaaaataaaacaaaacaaaataaaacacaaaagctgtagaggattttctgctctggaaaacaccagtgcacacaagcctttatctgggggtcccctggaggggttggggtggcccaacagagagcagggagcagaggcagatgtggggggtcacactccaccaggagcccccaggcaccgtggccacaggacagccgagcttgtggactgtcctccagagtccagctggaatcactgcccacgcctaaatctaagaagaagtatgcgatgggaagaccttttggctccttctgctcaggaagcatagacagtatcttcagttttgcccacgcaggccccttgaaggggacacacagacgccaggagacagacgcgtggcggccgggtcactcccagtggggagctgtggtttgggcgcctgagcctggagcccccgtcttactgg

SEQ ID NO: 198713 - DNA, 601 bp, Human
taaataaaaataaaacaaaacaaaataaaacacaaaagctgtagaggattttctgctctggaaaacaccagtgcacacaagcctttatctgggggtcccctggaggggttggggtggcccaacagagagcagggagcagaggcagatgtggggggtcacactccaccaggagcccccaggcaccgtggccacaggacagccgagcttgtggactgtcctccagagtccagctggaatcactgcccacgcctaaatctaagaagaagtatgcgatgggaagaccttttggctccttctgctsaggaagcatagacagtatcttcagttttgcccacgcaggccccttgaaggggacacacagacgccaggagacagacgcgtggcggccgggtcactcccagtggggagctgtggtttgggcgcctgagcctggagcccccgtcttactgggaggtgttcccttatgacggatcccacggggtctgcccaggtcacagtcccctcccacaggccacgcttcaggaggatcatcgcaggtgggtggcctctattgaggtgtgagttgcaactttccattttctgatcacgagctctaactcat

SEQ ID NO: 198714 - DNA, 601 bp, Human
gcttcaggaggatcatcgcaggtgggtggcctctattgaggtgtgagttgcaactttccattttctgatcacgagctctaactcattttcccacaacatattatgggcggctcataagattttctatcaaaacgtaaatagattcggatttctctgaagagcaggtttcctatatcggtgcgtacctgtccgtgttcacattaagaccaaggacaaaagaggaaaatagattttttcctaggttgtatgactttatgaaattaaaaaaaaaaaccacctaagcagccctgagcctccgcaraaaaagaccccacagggacatcccgtacccggtcagagccaggacataccccatgtgcttttttttcctcccctttcagaaatgtaatttccatgacgcgtccacccagggccaggaaccacagaagagaaagagcagtgggaagcttccagaaactcccatgagggctcaggaaacatggggaggtggcgatcggaatcatctgccaggcctggagagccagaggtcggccagccgggaggtgtcctgtccctgagtccccgccctggctccactttcatgcaagagaggggcagggtg

SEQ ID NO: 198715 - DNA, 601 bp, Human
actctacggtttctatctggttttattttcatccaactctctccaggcctgcctgtcactcagggagagatctcaccagtccagccacatctgggagataaaaatgcccaattcaatgagcatttgttaaacacaccccaaggtttgttgccatgaattgtaaattcctggaaggcagcaaacctgcagtcttagagtaggatggggcctttcagcccctgaacgtgcatctgggtgtggaccaagggcttgccagccccgcaaagggcatgggcagcctgctttgcctcagcgtccacaygagcaggcggcgtagcacctcctgtcagaggggaggatccacgtgtgcatgtggaggtgcagaaggaggggtcatccatggaaatctgacttctacggcaaactcaagtttaagcaaaagtagactacccttcggaaatgcacactggaacgatagcaaaacatgaaatcgacgtaagtgtccatcagtggatgaatggataaagaaaacgtggtgtgtccacacaatggaatactactcagctatgaaaaaggatgaagttctgtctgttgcgcacaatggaatactattcagccataa

SEQ ID NO: 198716 - DNA, 601 bp, Human
tctatctggttttattttcatccaactctctccaggcctgcctgtcactcagggagagatctcaccagtccagccacatctgggagataaaaatgcccaattcaatgagcatttgttaaacacaccccaaggtttgttgccatgaattgtaaattcctggaaggcagcaaacctgcagtcttagagtaggatggggcctttcagcccctgaacgtgcatctgggtgtggaccaagggcttgccagccccgcaaagggcatgggcagcctgctttgcctcagcgtccacatgagcaggcggsgtagcacctcctgtcagaggggaggatccacgtgtgcatgtggaggtgcagaaggaggggtcatccatggaaatctgacttctacggcaaactcaagtttaagcaaaagtagactacccttcggaaatgcacactggaacgatagcaaaacatgaaatcgacgtaagtgtccatcagtggatgaatggataaagaaaacgtggtgtgtccacacaatggaatactactcagctatgaaaaaggatgaagttctgtctgttgcgcacaatggaatactattcagccataaaaaaggatgaa

SEQ ID NO: 198717 - DNA, 601 bp, Human
caggcctgcctgtcactcagggagagatctcaccagtccagccacatctgggagataaaaatgcccaattcaatgagcatttgttaaacacaccccaaggtttgttgccatgaattgtaaattcctggaaggcagcaaacctgcagtcttagagtaggatggggcctttcagcccctgaacgtgcatctgggtgtggaccaagggcttgccagccccgcaaagggcatgggcagcctgctttgcctcagcgtccacatgagcaggcggcgtagcacctcctgtcagaggggaggatccacstgtgcatgtggaggtgcagaaggaggggtcatccatggaaatctgacttctacggcaaactcaagtttaagcaaaagtagactacccttcggaaatgcacactggaacgatagcaaaacatgaaatcgacgtaagtgtccatcagtggatgaatggataaagaaaacgtggtgtgtccacacaatggaatactactcagctatgaaaaaggatgaagttctgtctgttgcgcacaatggaatactattcagccataaaaaaggatgaagtcctgtctgttgcacacaatggaatactatt

SEQ ID NO: 198718 - DNA, 601 bp, Human
tggatgaatggataaagaaaacgtggtgtgtccacacaatggaatactactcagctatgaaaaaggatgaagttctgtctgttgcgcacaatggaatactattcagccataaaaaaggatgaagtcctgtctgttgcacacaatggaatactattcagccataaaaaaggatgaagtcctgtcttttgcacacaatggaatactattcagccataaaaaaggatgaaatcctgtcttttgcagcaacatggatggaactggagccattatcttgagtgaaacaatgcagaatcagaaagtyaaatactgcacattcacacatttaagtgggagccaaattacatgcgtgcatggatgtagcacatgggacaatggacgctgcagacccgggaggctgggaagggagaggagggtgagaattcgccgctcgggcccatctatgttattcagtgatggctacactcaaagcccagacttcaccactacacaacagatccacgtagtaagaccgcacttggaccccaaacattcatacagtaacaaatattactaagagaacctactggtcagatagatctttgctttcctgccagtcagtgcc

SEQ ID NO: 198719 - DNA, 601 bp, Human
tggagcttgcagtgagcagagattgcaccactgcactctagcctgggtgacagagactccatctcaaaaaaaaaaaaaaaaaaaactctacttcaagttgtaattctgagattttgaagcacgtttggctggactccatccttcatgccccacgtaagagggttgtgttctgggtagagaagtcatctttgtgcggggtgcgaggcatccgggggccaggggactgtgagctgcagcaacagtgacccctacagtgctgacagtgtggggcggtcccgggtccgatcctggctgttcctcygagcggccgtaggggtccgccctggcccctacactatgcccaccaagaggacctcctgtaaacgtgagcctcatgccagagaacccacagccagcccctcacacccctgcactgaccggcttttatttccagcctaaaagaagagaaggcagatttagttgcctgaacacaaaccctccttctccctcgctcaagccatcagggggttctagtcggcttgtccactctcatctcctttaaataaacagcaaaaccgttttcacaactcagctcccaatgtgaaattagtttcatggtgac

SEQ ID NO: 198720 - DNA, 601 bp, Human
gagattgcaccactgcactctagcctgggtgacagagactccatctcaaaaaaaaaaaaaaaaaaaactctacttcaagttgtaattctgagattttgaagcacgtttggctggactccatccttcatgccccacgtaagagggttgtgttctgggtagagaagtcatctttgtgcggggtgcgaggcatccgggggccaggggactgtgagctgcagcaacagtgacccctacagtgctgacagtgtggggcggtcccgggtccgatcctggctgttcctccgagcggccgtaggggtcygccctggcccctacactatgcccaccaagaggacctcctgtaaacgtgagcctcatgccagagaacccacagccagcccctcacacccctgcactgaccggcttttatttccagcctaaaagaagagaaggcagatttagttgcctgaacacaaaccctccttctccctcgctcaagccatcagggggttctagtcggcttgtccactctcatctcctttaaataaacagcaaaaccgttttcacaactcagctcccaatgtgaaattagtttcatggtgactgagcaccgtgtgctgcc

SEQ ID NO: 198721 - DNA, 601 bp, Human
aaaaaaaaaaaactctacttcaagttgtaattctgagattttgaagcacgtttggctggactccatccttcatgccccacgtaagagggttgtgttctgggtagagaagtcatctttgtgcggggtgcgaggcatccgggggccaggggactgtgagctgcagcaacagtgacccctacagtgctgacagtgtggggcggtcccgggtccgatcctggctgttcctccgagcggccgtaggggtccgccctggcccctacactatgcccaccaagaggacctcctgtaaacgtgagcctcrtgccagagaacccacagccagcccctcacacccctgcactgaccggcttttatttccagcctaaaagaagagaaggcagatttagttgcctgaacacaaaccctccttctccctcgctcaagccatcagggggttctagtcggcttgtccactctcatctcctttaaataaacagcaaaaccgttttcacaactcagctcccaatgtgaaattagtttcatggtgactgagcaccgtgtgctgcccgaatttctcaccaacctcagacgctctcgttttcacgtgccacggagctacaca

SEQ ID NO: 198722 - DNA, 601 bp, Human
aggcagatttagttgcctgaacacaaaccctccttctccctcgctcaagccatcagggggttctagtcggcttgtccactctcatctcctttaaataaacagcaaaaccgttttcacaactcagctcccaatgtgaaattagtttcatggtgactgagcaccgtgtgctgcccgaatttctcaccaacctcagacgctctcgttttcacgtgccacggagctacacaaagataaagcagcccaataaagacccggctgaaggcttttgtgttctctcactcttgcccacttaccctgcgtwttccaccaacacaggcaggggaaagcttggcctgggaacctgagttctgggacctgctccctggctggacttgctggcacccaccggagatgaggcctccaggaaacctgtcatcgggagactcgtccacacgacgagaccagggggaagaggtgctgtctgcagctgttctccgcgagtccctggcccacctgataacgagttccgtaactggaaacatcaaggtgggggtgtgggtctgagacttcactgcactttattaaatctcagccactcaaaggtggggtgcagactggggtt

SEQ ID NO: 198723 - DNA, 601 bp, Human
aattagtttcatggtgactgagcaccgtgtgctgcccgaatttctcaccaacctcagacgctctcgttttcacgtgccacggagctacacaaagataaagcagcccaataaagacccggctgaaggcttttgtgttctctcactcttgcccacttaccctgcgttttccaccaacacaggcaggggaaagcttggcctgggaacctgagttctgggacctgctccctggctggacttgctggcacccaccggagatgaggcctccaggaaacctgtcatcgggagactcgtccacacgacragaccagggggaagaggtgctgtctgcagctgttctccgcgagtccctggcccacctgataacgagttccgtaactggaaacatcaaggtgggggtgtgggtctgagacttcactgcactttattaaatctcagccactcaaaggtggggtgcagactggggttcgcagctccgacataccacacttgatctcagatgtttacctgatgaactctggcctctggtttttatttttactttttttttttatttttcattattattttttgagtcagagtctcactgtgtcacccaggctgg

SEQ ID NO: 198724 - DNA, 601 bp, Human
ttccaccaacacaggcaggggaaagcttggcctgggaacctgagttctgggacctgctccctggctggacttgctggcacccaccggagatgaggcctccaggaaacctgtcatcgggagactcgtccacacgacgagaccagggggaagaggtgctgtctgcagctgttctccgcgagtccctggcccacctgataacgagttccgtaactggaaacatcaaggtgggggtgtgggtctgagacttcactgcactttattaaatctcagccactcaaaggtggggtgcagactggggttygcagctccgacataccacacttgatctcagatgtttacctgatgaactctggcctctggtttttatttttactttttttttttatttttcattattattttttgagtcagagtctcactgtgtcacccaggctggagtgcaatggcaggatctcagctcactgcaacctccacctcccaggttcaagtgattctgatgcctcagcctcgcgagaagctgggattacaggtgagtgccaccatgcccggctaatttctgtatttttagtagggatggggcttcaccatgttggccaggctg

SEQ ID NO: 198725 - DNA, 485 bp, Human
gccttggcctcccgaagtgctgggattacaggcatgagtcaccttgcccaacctagtttttatttttttaattaactgcttgcctcactaataaaacttctcttttgccaaaggatgcttctcaggttgcattccccagtcaggggaataaccagaggattaaaacaaaaggttaaagtgatcacttcaaaaacaatcgccaaggcccgtaagagaagggtttaaaagccccagggccatgcatgcttggtttcaggccagagggttctcagctggaatcacccaacacgagaaagccgtsgagaggccgggatgaaagcacctggtcaccactaacgccctgcacacctttccttcttcctcctcctctttatttcttaacaggaagctgcctgacatttcggctttgaggtctactgggaagcatgactgaagttggggtgcagggtgggggctggtgtaccggccgcaggtggggagcaggg

SEQ ID NO: 198726 - DNA, 601 bp, Human
actgggactcctggagatcctcctccagccggaagctggccaagctgtctccaggtcctgggatcacgttgtttcagtggagacgatggccgccagcttcagattcagaaatggcacttagtgcctcttcccttggagtcacctcgggtgacatggggtggcccccatggccagcactgaccagctctgccccccaccgaggcgggagccacatctcaccaccaaatgcccttttatgggaactgaggtgcaaagcgggggcttgaggcaagcagcccccgcgggaaacacggcgtggtcrtcaggcgagtgctgccttagagacccgccccctgcagaggctgtgctctggatggtcactcactcacccctttattaagagttggttctacggaggatgagagaggcagggacgtgttttgggagaaggtcatatgaaaaattagtgccactgagtttcggcccctaaaaagcttccagtttcacggtgaggggaaatgttgtaaactaaaacctctggtggggagagtcacttttgttgcccgaatccccagtacagtggacggcgcctcgtgagccggatggcaacctggccagcatg

SEQ ID NO: 198727 - DNA, 601 bp, Human
atggggtggcccccatggccagcactgaccagctctgccccccaccgaggcgggagccacatctcaccaccaaatgcccttttatgggaactgaggtgcaaagcgggggcttgaggcaagcagcccccgcgggaaacacggcgtggtcgtcaggcgagtgctgccttagagacccgccccctgcagaggctgtgctctggatggtcactcactcacccctttattaagagttggttctacggaggatgagagaggcagggacgtgttttgggagaaggtcatatgaaaaattagtgccacwgagtttcggcccctaaaaagcttccagtttcacggtgaggggaaatgttgtaaactaaaacctctggtggggagagtcacttttgttgcccgaatccccagtacagtggacggcgcctcgtgagccggatggcaacctggccagcatgcagtgaaggaacaacggggccaaatgccgcaggtgtggatgagggagaaaacaaaagctcccactgcgcccctccctccctggagcttagggttcatctgaggggtgaagaggaggatgtgaaggacaccacgggggtcagggagcctggga

SEQ ID NO: 198728 - DNA, 601 bp, Human
accagctctgccccccaccgaggcgggagccacatctcaccaccaaatgcccttttatgggaactgaggtgcaaagcgggggcttgaggcaagcagcccccgcgggaaacacggcgtggtcgtcaggcgagtgctgccttagagacccgccccctgcagaggctgtgctctggatggtcactcactcacccctttattaagagttggttctacggaggatgagagaggcagggacgtgttttgggagaaggtcatatgaaaaattagtgccactgagtttcggcccctaaaaagcttccastttcacggtgaggggaaatgttgtaaactaaaacctctggtggggagagtcacttttgttgcccgaatccccagtacagtggacggcgcctcgtgagccggatggcaacctggccagcatgcagtgaaggaacaacggggccaaatgccgcaggtgtggatgagggagaaaacaaaagctcccactgcgcccctccctccctggagcttagggttcatctgaggggtgaagaggaggatgtgaaggacaccacgggggtcagggagcctgggaaatgtccaggaatcctggggccggggc

SEQ ID NO: 198729 - DNA, 601 bp, Human
atgagctgacctgtgtcccccaaaatccacaggggaagccctgaaccctcatgtgactgtacttggggacagggcctctaaagaggtaaaggtaaggccgggcgcggtggctcacgcctgtaatcccagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaaccygggaggcggagcttgcagtgagccgagatcccgccactgcactccaacctgggagacacagcgagactccgtctcaaaaaaaaaaaaaaaaaaaaatgaggtcctgagggggccccaatccaataggacctgtgttcttcaggaagaggaagagacacacagcctgcatgtacacagaaggacagcccctgaggacgtggccacgacgcagccaccgtgagccagggaatgcggccccaggaacaagccctgcccacaggcgtcccagacccaggccttggggactgcagaggatggatg

SEQ ID NO: 198730 - DNA, 601 bp, Human
ggggaagccctgaaccctcatgtgactgtacttggggacagggcctctaaagaggtaaaggtaaggccgggcgcggtggctcacgcctgtaatcccagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacccgggaggcggagcttgcagtgagccgagatcscgccactgcactccaacctgggagacacagcgagactccgtctcaaaaaaaaaaaaaaaaaaaaatgaggtcctgagggggccccaatccaataggacctgtgttcttcaggaagaggaagagacacacagcctgcatgtacacagaaggacagcccctgaggacgtggccacgacgcagccaccgtgagccagggaatgcggccccaggaacaagccctgcccacaggcgtcccagacccaggccttggggactgcagaggatggatgtctgccccacctgtggggcttcaccgtggcc

SEQ ID NO: 198731 - DNA, 601 bp, Human
atcgagaccatcttggctaacacggtgaaaccccgtttctactaaaaatacaaaaaattagccgggcgtgttggcgggcgcctgtagtcccagctacttgggaggctgaggcaggagaatggcatgaacccgggaggcggagcttgcagtgagccgagatcccgccactgcactccaacctgggagacacagcgagactccgtctcaaaaaaaaaaaaaaaaaaaaatgaggtcctgagggggccccaatccaataggacctgtgttcttcaggaagaggaagagacacacagcctgcatstacacagaaggacagcccctgaggacgtggccacgacgcagccaccgtgagccagggaatgcggccccaggaacaagccctgcccacaggcgtcccagacccaggccttggggactgcagaggatggatgtctgccccacctgtggggcttcaccgtggccacccgagctgactgacaggggtggggaagcacgccatccgggctccagccctgcggttggcgggatccaggtttcttggtggtggcgagcttctcacatgggcttggcggcacctcccaacacgccaaggccagtggta

SEQ ID NO: 198732 - DNA, 601 bp, Human
taaaaaaccagcagattaaaaaattaaccagcatctatttttaaagaactgcatgcattcctttgctataaataacaccttagtggactctaaaaaaagtaattcaaaacaatcctttttcactgggtttgctgcttgtttacgttatatttctctgagataacagaaagaggcacatcttatcactttcctgacagtttcattttcaggatctgataatgctatgtgtgcttatatggaaaatattgatcccactatactctgctcttcctaaatttttcattttttaaaaaattcatgccagtatttgattcccagaggttttacaaaccatctccttcaagcaaatgcatgtaaatttcacttctgtgactctgagttcatttttaaagaatggttttagaaaatcttcttctactttgccaaatttcatctttaaaatgcttgtttctgttcctctcatgataatggtaatgtttatgatggctgattttaaaacctcttagggtatgaagtgtgttgtagaaatgctaaatgctaatagatacataaacagtaagatggaagcgggagaaacacacacctccccctttcctcacaa

SEQ ID NO: 198733 - DNA, 601 bp, Human
gggtctgactggggccaccctggctgtacccacatttccaaaagtaaacctgtaacgcatcatgtctcaaagacaggaaaccccatggacaccccagctccatcatgcggtcatgacattttggaccaggagggcctcctgtgtggtcctctggcgggaagcctgctagtctccctagggctgccctaacaagcctcacagcctgagcggctcaaacaacagaaatgtactccgtcacggttctgggggctgaagtctgaggtccgggcttcggtttctcctgagactgcgcaggctggcrggcggccgtctcctcctgtgtcctcacgtggcttcttctccagtgtctcttctttcaaggacaccagtcctgctggagccaggcccaccccacgacctcacataacctcaatcgcctcctgaaagacactttctccaaatacagtcgccttatgcggccccgggtgttggcgcttcccaggtgaacttggggaacacacgtcagcccatcccaggtggagctgcggcagtgcggggtgtggctggtgctgggggtgggcaggaagggtaagcaggggacgagggatcagaggcaggaggt

SEQ ID NO: 198734 - DNA, 601 bp, Human
cagcccatcccaggtggagctgcggcagtgcggggtgtggctggtgctgggggtgggcaggaagggtaagcaggggacgagggatcagaggcaggaggtgtcctggccctaacatttcctttgcttctcgtaaacctcacctgagcccacccaacaccaaggccacatcaaggagagaggacaaggggagagtgatcacagggtgtgacagtgatggaggggacccagacgcagggactacggagggcagtggggcctcacagggcacctcccacagggagcagagagcggacgatggccrgtggtgatgagatgtggccctgctgtggaggaagcgccaggtgcatctgatgaaggcatgaagacacagaaggggacaggaaggggctagaaagaaaagtatcacagtcagcctggtccctatgctgtgtgcacgtgcatgtgtgtgtatgtatctgggtgtgtgcattgcatgtgtgtgagggtgtgtgtggctgtgctatgtgtgagggtgtgctgtgtgtggctgtgtgtgggtgggtgtgctgtatgtgtgtgggtatatacatgtgggggtgtgtgggtgtgtgtgtgctgcatg

SEQ ID NO: 198735 - DNA, 601 bp, Human
cactccctgcacttccccgaggtcactgcactcacagagcttcctatgtgatcagttccaccaggcatagcaggaattcttctcatttgtccaaacgaacagagccccaggaggccccacctggtgcccgtgaccgaccccctcagtgaacctgcaaaggttcccatgcacaaggcgacgcttcagacatttcaccatctcactctccaggtcggacttgaaaacgctctgatcaatgatcaaatctgcttccacccaattcaaatgcaagcagttctgaggcacgattatacacaatacrtgctatttattaaccgtcaccactcagctaggttctttgccaagaatttcccaaaagaagtcttcattctacatagcaacttgttcttatccatgggaaagatagtgtcttattttaaatgcaaatgaagccgattcagcatgtacaagcagaacccgcaaatgagagaaatgttggtatatgtgatttgtaaataacagcatattaaaaatataatagataaaatgtttccaatgataaggccaggattcttaataattggataatcttaatcaaaaatcttagatgagtaaaattttc

SEQ ID NO: 198736 - DNA, 601 bp, Human
cctgggagttccaaacctccttcctgcctgggcgcagctctttctgggtgtatagcacatgataaagagatcaatctttgagctttgttggaaacagcacacgaggtaacaccaaccaagcatttaaatttctgatttggatctatgagcattgctaatgacacactcactgcacacttgaaactcttggatttccacactcatcatcactgatctatgccacgccattcccagaattccccatgccatcctgccccaccatgggcaccagccaaacccactgagtaggcactgtctcccrcccatccttcaagaccaggctggcctttgcctgccccagaccctccaccctcacttccagccatgcccctgcaggaccccgtagagcacttcatcttgtccctgtccttgtggaggaggcaggggcctgtgtgaactgccctgcttactccggcatccccagcagccctcagcaagctcagcacaaggtaaagcctcaacacgggaggacggagttcattttcctccactaccacgagatcctggggggccaggatcctccaggtccgtcctttccttcctctgctcacccatccaccag

SEQ ID NO: 198737 - DNA, 601 bp, Human
ttgcctgccccagaccctccaccctcacttccagccatgcccctgcaggaccccgtagagcacttcatcttgtccctgtccttgtggaggaggcaggggcctgtgtgaactgccctgcttactccggcatccccagcagccctcagcaagctcagcacaaggtaaagcctcaacacgggaggacggagttcattttcctccactaccacgagatcctggggggccaggatcctccaggtccgtcctttccttcctctgctcacccatccaccagctcagcacctacttcaggcctcagacrttgtaggtgctacagagacatctagagagtgaacccacagacacacaaataacctgtgtttaaaagtgtgttaacagcattgggtggttcccagtggggtacacactacatcatttctacacttgaaaaagtaagaattccaagatggatggatttactcaaaacctcagaaacaccactgaccagctacttctacaaacatcagttctgttttgtcctgcccactgtgcatttaggctaacaggcaatgaagaaatcttgaaactatgagaaactatggaaaaaaattcaagttttaag

SEQ ID NO: 198738 - DNA, 601 bp, Human
catcttgtccctgtccttgtggaggaggcaggggcctgtgtgaactgccctgcttactccggcatccccagcagccctcagcaagctcagcacaaggtaaagcctcaacacgggaggacggagttcattttcctccactaccacgagatcctggggggccaggatcctccaggtccgtcctttccttcctctgctcacccatccaccagctcagcacctacttcaggcctcagacgttgtaggtgctacagagacatctagagagtgaacccacagacacacaaataacctgtgtttaaargtgtgttaacagcattgggtggttcccagtggggtacacactacatcatttctacacttgaaaaagtaagaattccaagatggatggatttactcaaaacctcagaaacaccactgaccagctacttctacaaacatcagttctgttttgtcctgcccactgtgcatttaggctaacaggcaatgaagaaatcttgaaactatgagaaactatggaaaaaaattcaagttttaaggaagatacagtagcaccccatttatatagcaccagttaaagttattccaaataaatatattttca

SEQ ID NO: 198739 - DNA, 601 bp, Human
gacagagtggtctctgctaggatctctgcggtgattttacccacacaaaaccccacctgggtctgtacgtcattgctaaagacatcagatgtgcctgtttgatgctgtgaaagtttttcacatcagcccgtcttctcacaacatagaaagaaggggaaatttacaaaagagcatgccagagtctatgtctcccggtgattgttaaaagttggtagaggcctcttctctatcatctttgtttcaaaatcccttatgattttaacaaataccaatggcctgaatcaaagatgcacaaaagatraacaggtgtttgatttcattccagtttgaagcatccattcaaccagaagagggagcacatgtttaaaagaaacccccaaaccgtcagaccatcgtcaccgacgatcaccatattaagtgatagaaaatggtacaaattaagaacatatcatgatgcttaggttcttaaggagctataagcaaaggaggatataaaattatataacactgaaagtgaaaatgaaagtaggaaactacaccttatattttgtcccctctgtggtttttgggaacttatcctacaaactaataatcggggaca

SEQ ID NO: 198740 - DNA, 601 bp, Human
acagagtggtctctgctaggatctctgcggtgattttacccacacaaaaccccacctgggtctgtacgtcattgctaaagacatcagatgtgcctgtttgatgctgtgaaagtttttcacatcagcccgtcttctcacaacatagaaagaaggggaaatttacaaaagagcatgccagagtctatgtctcccggtgattgttaaaagttggtagaggcctcttctctatcatctttgtttcaaaatcccttatgattttaacaaataccaatggcctgaatcaaagatgcacaaaagatamacaggtgtttgatttcattccagtttgaagcatccattcaaccagaagagggagcacatgtttaaaagaaacccccaaaccgtcagaccatcgtcaccgacgatcaccatattaagtgatagaaaatggtacaaattaagaacatatcatgatgcttaggttcttaaggagctataagcaaaggaggatataaaattatataacactgaaagtgaaaatgaaagtaggaaactacaccttatattttgtcccctctgtggtttttgggaacttatcctacaaactaataatcggggacaa

SEQ ID NO: 198741 - DNA, 601 bp, Human
catcagcccgtcttctcacaacatagaaagaaggggaaatttacaaaagagcatgccagagtctatgtctcccggtgattgttaaaagttggtagaggcctcttctctatcatctttgtttcaaaatcccttatgattttaacaaataccaatggcctgaatcaaagatgcacaaaagataaacaggtgtttgatttcattccagtttgaagcatccattcaaccagaagagggagcacatgtttaaaagaaacccccaaaccgtcagaccatcgtcaccgacgatcaccatattaagtgrtagaaaatggtacaaattaagaacatatcatgatgcttaggttcttaaggagctataagcaaaggaggatataaaattatataacactgaaagtgaaaatgaaagtaggaaactacaccttatattttgtcccctctgtggtttttgggaacttatcctacaaactaataatcggggacaaggggtttgaaaaaactgtcatctaattttctgtctcacagaggagttccctcggacccacagagaaagtgagagcagatatatgcgagatgagttttgtttttaaaaagagaaaaagaa

SEQ ID NO: 198742 - DNA, 601 bp, Human
tctcccggtgattgttaaaagttggtagaggcctcttctctatcatctttgtttcaaaatcccttatgattttaacaaataccaatggcctgaatcaaagatgcacaaaagataaacaggtgtttgatttcattccagtttgaagcatccattcaaccagaagagggagcacatgtttaaaagaaacccccaaaccgtcagaccatcgtcaccgacgatcaccatattaagtgatagaaaatggtacaaattaagaacatatcatgatgcttaggttcttaaggagctataagcaaaggargatataaaattatataacactgaaagtgaaaatgaaagtaggaaactacaccttatattttgtcccctctgtggtttttgggaacttatcctacaaactaataatcggggacaaggggtttgaaaaaactgtcatctaattttctgtctcacagaggagttccctcggacccacagagaaagtgagagcagatatatgcgagatgagttttgtttttaaaaagagaaaaagaacaatcttactcagaaaaaatccagctggattagttggtcatagatcgttattttacactgaggtgct

SEQ ID NO: 198743 - DNA, 601 bp, Human
ttcaaaatcccttatgattttaacaaataccaatggcctgaatcaaagatgcacaaaagataaacaggtgtttgatttcattccagtttgaagcatccattcaaccagaagagggagcacatgtttaaaagaaacccccaaaccgtcagaccatcgtcaccgacgatcaccatattaagtgatagaaaatggtacaaattaagaacatatcatgatgcttaggttcttaaggagctataagcaaaggaggatataaaattatataacactgaaagtgaaaatgaaagtaggaaactacacyttatattttgtcccctctgtggtttttgggaacttatcctacaaactaataatcggggacaaggggtttgaaaaaactgtcatctaattttctgtctcacagaggagttccctcggacccacagagaaagtgagagcagatatatgcgagatgagttttgtttttaaaaagagaaaaagaacaatcttactcagaaaaaatccagctggattagttggtcatagatcgttattttacactgaggtgctttttccccacagttctttcttggtcaaatcatggtttctttctttttttggt

SEQ ID NO: 198744 - DNA, 601 bp, Human
ggtttgaaaaaactgtcatctaattttctgtctcacagaggagttccctcggacccacagagaaagtgagagcagatatatgcgagatgagttttgtttttaaaaagagaaaaagaacaatcttactcagaaaaaatccagctggattagttggtcatagatcgttattttacactgaggtgctttttccccacagttctttcttggtcaaatcatggtttctttctttttttggttgaaaaactacaacaataagagatcaaatattccataactcaccaaagacttcagaatcaacttsggtgagaagagcttccttttctgaatgtggatgaagctgcgccgatcccgagtttgtaggagagccattcgtcctgaaattgttggataactgctccctcccactccttggctgagagagtcccacgtgtcgggggcaagaaccacacatctttgtgcactgttcttagtgtctgacacgtgcctttcggaagcagatgtttaaaacaatctgctcagtgagtgcgtgaataggtaaaaggttagggaatgaagggggaactgccgggggctgatacatagatgacacgacgctggcttt

SEQ ID NO: 198745 - DNA, 601 bp, Human
tgtcatctaattttctgtctcacagaggagttccctcggacccacagagaaagtgagagcagatatatgcgagatgagttttgtttttaaaaagagaaaaagaacaatcttactcagaaaaaatccagctggattagttggtcatagatcgttattttacactgaggtgctttttccccacagttctttcttggtcaaatcatggtttctttctttttttggttgaaaaactacaacaataagagatcaaatattccataactcaccaaagacttcagaatcaacttcggtgagaagagcwtccttttctgaatgtggatgaagctgcgccgatcccgagtttgtaggagagccattcgtcctgaaattgttggataactgctccctcccactccttggctgagagagtcccacgtgtcgggggcaagaaccacacatctttgtgcactgttcttagtgtctgacacgtgcctttcggaagcagatgtttaaaacaatctgctcagtgagtgcgtgaataggtaaaaggttagggaatgaagggggaactgccgggggctgatacatagatgacacgacgctggctttacacaccacatca

SEQ ID NO: 198746 - DNA, 601 bp, Human
agttccctcggacccacagagaaagtgagagcagatatatgcgagatgagttttgtttttaaaaagagaaaaagaacaatcttactcagaaaaaatccagctggattagttggtcatagatcgttattttacactgaggtgctttttccccacagttctttcttggtcaaatcatggtttctttctttttttggttgaaaaactacaacaataagagatcaaatattccataactcaccaaagacttcagaatcaacttcggtgagaagagcttccttttctgaatgtggatgaagctgcsccgatcccgagtttgtaggagagccattcgtcctgaaattgttggataactgctccctcccactccttggctgagagagtcccacgtgtcgggggcaagaaccacacatctttgtgcactgttcttagtgtctgacacgtgcctttcggaagcagatgtttaaaacaatctgctcagtgagtgcgtgaataggtaaaaggttagggaatgaagggggaactgccgggggctgatacatagatgacacgacgctggctttacacaccacatcacggtgagactgactccagcaagcttaca

SEQ ID NO: 198747 - DNA, 601 bp, Human
aaaaatccagctggattagttggtcatagatcgttattttacactgaggtgctttttccccacagttctttcttggtcaaatcatggtttctttctttttttggttgaaaaactacaacaataagagatcaaatattccataactcaccaaagacttcagaatcaacttcggtgagaagagcttccttttctgaatgtggatgaagctgcgccgatcccgagtttgtaggagagccattcgtcctgaaattgttggataactgctccctcccactccttggctgagagagtcccacgtgtygggggcaagaaccacacatctttgtgcactgttcttagtgtctgacacgtgcctttcggaagcagatgtttaaaacaatctgctcagtgagtgcgtgaataggtaaaaggttagggaatgaagggggaactgccgggggctgatacatagatgacacgacgctggctttacacaccacatcacggtgagactgactccagcaagcttacatcactcagacggcaaatatttcaaagaaaaaatccatagtgtttagtaagccacagaagaacattttaaagtaaggagtaacaaatctgt

SEQ ID NO: 198748 - DNA, 601 bp, Human
gagtgcgtgaataggtaaaaggttagggaatgaagggggaactgccgggggctgatacatagatgacacgacgctggctttacacaccacatcacggtgagactgactccagcaagcttacatcactcagacggcaaatatttcaaagaaaaaatccatagtgtttagtaagccacagaagaacattttaaagtaaggagtaacaaatctgtatggaagcatttccaaaattcacaaagcgtagaaagaagattgttaaaaagtatgtccagtgattgacttggagtgggtacggaggcaygggcagtggccctggactgctgcctctgctggcaccagctcttattaccaccgcttgaagaacatggtacatttgtttctcatataaaaatgtgaaagcaggcaggtcggggctaatatggggactcatccatgaagccctcctttctcccctcttgaaattcccaggtcacctcttggaccatggtgtagcatcagctccggccatcacatctgcattccaagagcagggatgagaaagagaaatgaaggagcaaaggcacatacctaaccttctagctgagatccactggccacacct

SEQ ID NO: 198749 - DNA, 601 bp, Human
aaaatgtgaaagcaggcaggtcggggctaatatggggactcatccatgaagccctcctttctcccctcttgaaattcccaggtcacctcttggaccatggtgtagcatcagctccggccatcacatctgcattccaagagcagggatgagaaagagaaatgaaggagcaaaggcacatacctaaccttctagctgagatccactggccacacctagatgaaagggagctggcaaatgcagattttactccaagtaggggtgactgtgacccaaatcaaaccctcagttctatctctccagwagaagaggaaagtagaccttaggctcagccacatctccatggagagtggaggtggtcagacagaagtagagatttagaaaagttcatgtgcccatccttccacccacagacgggatatcaagcacttccatgtttgtcctctcatatatgactcgtaaggccagtgaacacctgtaagaatctgaaggaaaatcaaccataaaggagaaaagttaatgttaccccctcaagcttaggagggcttccataagctgaagagcaggctccttgagggagatactgggttccttgaattccact

SEQ ID NO: 198750 - DNA, 601 bp, Human
gctccggccatcacatctgcattccaagagcagggatgagaaagagaaatgaaggagcaaaggcacatacctaaccttctagctgagatccactggccacacctagatgaaagggagctggcaaatgcagattttactccaagtaggggtgactgtgacccaaatcaaaccctcagttctatctctccagtagaagaggaaagtagaccttaggctcagccacatctccatggagagtggaggtggtcagacagaagtagagatttagaaaagttcatgtgcccatccttccacccacagrcgggatatcaagcacttccatgtttgtcctctcatatatgactcgtaaggccagtgaacacctgtaagaatctgaaggaaaatcaaccataaaggagaaaagttaatgttaccccctcaagcttaggagggcttccataagctgaagagcaggctccttgagggagatactgggttccttgaattccacttcagaatcatggccctgtgccttcttttcctgcttagccaggcagctccctgcacagacttggcaagtttccaagagagtgttcattaatcagagctattgcaattgctg

SEQ ID NO: 198751 - DNA, 601 bp, Human
ccatcacatctgcattccaagagcagggatgagaaagagaaatgaaggagcaaaggcacatacctaaccttctagctgagatccactggccacacctagatgaaagggagctggcaaatgcagattttactccaagtaggggtgactgtgacccaaatcaaaccctcagttctatctctccagtagaagaggaaagtagaccttaggctcagccacatctccatggagagtggaggtggtcagacagaagtagagatttagaaaagttcatgtgcccatccttccacccacagacgggatrtcaagcacttccatgtttgtcctctcatatatgactcgtaaggccagtgaacacctgtaagaatctgaaggaaaatcaaccataaaggagaaaagttaatgttaccccctcaagcttaggagggcttccataagctgaagagcaggctccttgagggagatactgggttccttgaattccacttcagaatcatggccctgtgccttcttttcctgcttagccaggcagctccctgcacagacttggcaagtttccaagagagtgttcattaatcagagctattgcaattgctgaatattc

SEQ ID NO: 198752 - DNA, 601 bp, Human
catcacatctgcattccaagagcagggatgagaaagagaaatgaaggagcaaaggcacatacctaaccttctagctgagatccactggccacacctagatgaaagggagctggcaaatgcagattttactccaagtaggggtgactgtgacccaaatcaaaccctcagttctatctctccagtagaagaggaaagtagaccttaggctcagccacatctccatggagagtggaggtggtcagacagaagtagagatttagaaaagttcatgtgcccatccttccacccacagacgggataycaagcacttccatgtttgtcctctcatatatgactcgtaaggccagtgaacacctgtaagaatctgaaggaaaatcaaccataaaggagaaaagttaatgttaccccctcaagcttaggagggcttccataagctgaagagcaggctccttgagggagatactgggttccttgaattccacttcagaatcatggccctgtgccttcttttcctgcttagccaggcagctccctgcacagacttggcaagtttccaagagagtgttcattaatcagagctattgcaattgctgaatattct

SEQ ID NO: 198753 - DNA, 601 bp, Human
gcaaatgttgcacaccatgcggcaggaataaaagctggctacgctgaatatgaaactgttaattgcattttcagagacatagctacaaggtgaaactaatcatacacatgataaccgggcttcaccacctacagtgccctgctgctgcactctcactaatctgtattaaaacagccccacacatccttgcaggaaaggaaaacattgcgtttggtataaccttccaattttaaagagaaaaaaagtgtgcctatgtgggaagcaatataaaggataattttcatttaaatcagattaatarcgttaacaaacgccatggcaaagggcccagtggtgcttcttgaaatgcattttttgctttaaaacgatagcaaggtgcatttgcaaatgaacgccagcacatgctgacaagagtggctcaaaatgaaggagcttgtttcagaagaaagggccatggtaattatagaccttggctttcccagctaggaacatcaaagaggccccgctggaatcactagagagaggcttcccagggagtccagtgctcctgaggttcccagtgcccagcccctccctggggaggggaggatgaggcccagga

SEQ ID NO: 198754 - DNA, 601 bp, Human
gttgcggacttctaaatggctagggaagggaatttaaaaggaccagcctgattcctcttcaaggaacgtgtggagctggagctaggccacatgcgctgctgaagtggtgggtaactggaacagtctgtgtgcttgttcacaggcgccgctggccatacaaattagcacaacaggacaggacgctgtctgcagaaggaaaaggctcttgcctgtatgatgtttctaacacacggctaaggtggccagagaagacaggcgtagcgtgcatgctctgatggaatttataaccgggagcatatamatccctgtttgtgacgtagaaaaccgtgaagctggatctgcctggaaatgctaacttctgggagcttcacatttttagcctatactagtgacgtgcacttaactttgaaatttgtttcagaaaatgaggcctctacaaggaaaatcatctcggcttgaaatggatctcttgtcccacagtggctgcctcggtgtactgttaccgtatgtggtagagacggttcctaaccaaacgttcagtttgtttctctttaagaatataagaaagtaggccaggcacagtggctcactcctgtaatcc

SEQ ID NO: 198755 - DNA, 601 bp, Human
aatataagaaagtaggccaggcacagtggctcactcctgtaatcccagcactttgggaggctgaggcgggaggatcacctgagatcaggagtttgagaccagcctggccaacatggtaaaaccctgtctctactaaaaatacaaaaattagctgggcgtcgtggtaggtgcctgtaatcccagctacttgggaggctgaggcaggagaatcatttgaacccaggggcagaggttgcagtgagccgagatcatgcgactgcactccagcctggcagacaagagggagactttgtttcaaaamcaaaaaaaaaaaaaaaaaaaaaaaaagagaatataagaaagtataaacagagtgaaattaattcattaacattaggaagtagaaactcactctaacgtgacccacgctagcatgagataccatgtaactgtactgggtctggatcccccacggaagcacttgcagccggaccaccgaagggctcacgcaggcccatcctcccaccacgggctcccagcactggcaaaatgccactcagaccacagctgcaggggcctccccgatcctggggctgtttctgtaatagagtgcgttttgtca

SEQ ID NO: 198756 - DNA, 601 bp, Human
actgcactccagcctggcagacaagagggagactttgtttcaaaaacaaaaaaaaaaaaaaaaaaaaaaaaagagaatataagaaagtataaacagagtgaaattaattcattaacattaggaagtagaaactcactctaacgtgacccacgctagcatgagataccatgtaactgtactgggtctggatcccccacggaagcacttgcagccggaccaccgaagggctcacgcaggcccatcctcccaccacgggctcccagcactggcaaaatgccactcagaccacagctgcaggggyctccccgatcctggggctgtttctgtaatagagtgcgttttgtcaccaaatgatatttattttgtttcaagcattatttccaatgaacaaatatatgctaaatcaatcggcatgtaattaaatagcacatggataggacatgcgatagaaggagggggcagaggccgtggtgtttctgacgccgcctctctttaagggtggctacaaggacgtgagctggagtgaccgtgtcagacagcgcggtagaggccagggatggggctgcacaggatgcccacaaggcctcgtgattaactgttt

SEQ ID NO: 198757 - DNA, 601 bp, Human
gtttcaaaaacaaaaaaaaaaaaaaaaaaaaaaaaagagaatataagaaagtataaacagagtgaaattaattcattaacattaggaagtagaaactcactctaacgtgacccacgctagcatgagataccatgtaactgtactgggtctggatcccccacggaagcacttgcagccggaccaccgaagggctcacgcaggcccatcctcccaccacgggctcccagcactggcaaaatgccactcagaccacagctgcaggggcctccccgatcctggggctgtttctgtaatagagtgygttttgtcaccaaatgatatttattttgtttcaagcattatttccaatgaacaaatatatgctaaatcaatcggcatgtaattaaatagcacatggataggacatgcgatagaaggagggggcagaggccgtggtgtttctgacgccgcctctctttaagggtggctacaaggacgtgagctggagtgaccgtgtcagacagcgcggtagaggccagggatggggctgcacaggatgcccacaaggcctcgtgattaactgttttttatttgtgcaattacttcttttccttccttagta

SEQ ID NO: 198758 - DNA, 601 bp, Human
agcacttgcagccggaccaccgaagggctcacgcaggcccatcctcccaccacgggctcccagcactggcaaaatgccactcagaccacagctgcaggggcctccccgatcctggggctgtttctgtaatagagtgcgttttgtcaccaaatgatatttattttgtttcaagcattatttccaatgaacaaatatatgctaaatcaatcggcatgtaattaaatagcacatggataggacatgcgatagaaggagggggcagaggccgtggtgtttctgacgccgcctctctttaagggtrgctacaaggacgtgagctggagtgaccgtgtcagacagcgcggtagaggccagggatggggctgcacaggatgcccacaaggcctcgtgattaactgttttttatttgtgcaattacttcttttccttccttagtatctttcttctaaaaaattcaaagaatgaaagagggcgcttaaattattttaaatcagcaggattttttgaggtcccatcatagacaagacctatattgagcaaaccaggctgtagagttagtgttcagtggaagatggtgagcgggctgtgtcccccccaagtc

SEQ ID NO: 198759 - DNA, 601 bp, Human
taagggtggctacaaggacgtgagctggagtgaccgtgtcagacagcgcggtagaggccagggatggggctgcacaggatgcccacaaggcctcgtgattaactgttttttatttgtgcaattacttcttttccttccttagtatctttcttctaaaaaattcaaagaatgaaagagggcgcttaaattattttaaatcagcaggattttttgaggtcccatcatagacaagacctatattgagcaaaccaggctgtagagttagtgttcagtggaagatggtgagcgggctgtgtccccyccaagtcccacctggtctcagggaccccacatctgcaggcctggctgtgcctggcaatgccgggggagccgcgcagcatgaaacggaccctgtgctcggtcttgaggccacagctcggccttggtgtggctggggccgcacagacacagcacagcggcccccggcatccgcaggacacggttttccactgttttaccagtccctcagcttcgccagacatccctggatcccagaccctgctcctcaggtccagccattggccgcggtcctgctccaaaccacaccggccatccaggaccc

SEQ ID NO: 198760 - DNA, 601 bp, Human
tgaggtcccatcatagacaagacctatattgagcaaaccaggctgtagagttagtgttcagtggaagatggtgagcgggctgtgtcccccccaagtcccacctggtctcagggaccccacatctgcaggcctggctgtgcctggcaatgccgggggagccgcgcagcatgaaacggaccctgtgctcggtcttgaggccacagctcggccttggtgtggctggggccgcacagacacagcacagcggcccccggcatccgcaggacacggttttccactgttttaccagtccctcagcttygccagacatccctggatcccagaccctgctcctcaggtccagccattggccgcggtcctgctccaaaccacaccggccatccaggacccagattcaatgcccagccctgaggcttctgcactgcagctcatcctcttggtgagagcccaagctggggccctgtgtccttgttgagcatggtttgaactcaggagcatctgtgtgatggccagagcccaggtggggtgaccccagccccagtgctgcccgttattgctgccactgtcattatcactgtggctctgtgagttacacctgtgc

SEQ ID NO: 198761 - DNA, 601 bp, Human
tcctcttgatgtgtgagggtcattttgtcttctatgacaatgccaaacacaccccagcaaagctctggggtagtgtgaacatgcccagtgcaccccaacaaagctccgggatgttgtgaacatgcccagtgcatcccagcaaagctctagagcggtgaggttccgagtcctcactgctattcagcacttgcacatcagaaacccaggcatctggatggccagtgctgacttaattgactggtcagtctcagcaaacctacagtcagttccttccaagaagcaaatcaatcagaagaacacrggttccctgagctgtccactcagctgaaataatcgctctgcagccctccgtaacttcaagatctctagtgaaacacacacatttagatttttaagaggaaaaaaatgccaaaatgattgccaagacatgcactgggcattccctgggcacacagggcacccgtgcagctgtgattctagggacactcgctgcccacgtcctccacaaggtcataggcattgtaagccaggagtgcatcctaggccctccaagaagacgaccaccaggatgtggctcctgaccccatggggctgatctgtg

SEQ ID NO: 198762 - DNA, 601 bp, Human
gggcacacagggcacccgtgcagctgtgattctagggacactcgctgcccacgtcctccacaaggtcataggcattgtaagccaggagtgcatcctaggccctccaagaagacgaccaccaggatgtggctcctgaccccatggggctgatctgtggggcagaaactaagacaccttgtgacaaacaagcaatggaagagaaaactgctttaggagcaggaagggggccaaggccagcttggcaggagctgatgaaggctttccagggaggataaggcatgagcaacttcagttgtgctctcaacattgacctcaattcctttccactgcctctttctgctactgcacttagaaaaatgtcatacacacaggaagttttcaataagcaacaaaatttacctaaaaaagaaaaaggaaaacagaaacgaaaagattgagtggggtttggggcctgcagagtccttgtctgcttgattgtgggcagtgggtggtttgtgaatgtcagaataagcttttcttctcagatgggtaagcgggcagctgggctttgcagtgacaggtgccccgaggaaagcaggcaaacatgcactggacaaagaca

SEQ ID NO: 198763 - DNA, 601 bp, Human
acaaagacacatgcagccctattctaagaaggacttgacctttgagtctgaaaaacaccctgcactttaggagctcagaagagaaaggcatcatttcagagtgggagagccgcgcctccttgtcagtgtgatggttggtaactagattggcaggtaaagccacaatgcagttgatgtaccctcatctgctctattattaaacatccaaaatacattgttaatattttaaaaagcagacaaaggcccccatggtatgatacaactggatgggtgtttgttctcggccatgctgagagatacygacatccccaagtctctcctggcacccccagcacggccgccttccccagaaaacaatgtcagattttagaggctgaattgtgtggccaacttggtttacttctttaatagccctgtgggaacacaactgcttatatgtgacaaggcctaactccacacagaacaaacacgagtatcaaataacctcacttaagctaaagaaacacacacatatgtgaccaccttgggggatgatggctggtgtatttgtatttccctgctcagcttatcagttggatatcggcaagtaagatttagaagc

SEQ ID NO: 198764 - DNA, 601 bp, Human
ttacgttctattgtccgggtcttatttttgctttcaattccttttgtaatggaggtagcagttgttattgacaattaataggggcttcaaaggcagtcatgtttggaaggggcagcggcttccctaagacccctcagctgctgctcaggtgcagctgctctgtatgccaagcacggcccatgccgggccccgtcgaggcagcacagatatcgatttagatggaaaccggggtcggcgcggagggaaggagctcggtgagcttcgcatgccaatgtattatttaggctttgtggtttcatcyggagtaagtgcctatttaggaaaaattacagaatcagtatctctgctactgatatattttccctaacagtaattcacaggtaaaataccagggatgatggaaggtatttgtgcaaaaattcaggaggagatggtctgatctggtgggctgggctcgctgggggggaccataataacgcaaagcaaacaacatccatgtgggaaggtccactggccgaggacgggcaccaaggctgccctcagatgccagccggacagcatggcgtggattttggcgaagctgagtgatgcatgctatatg

SEQ ID NO: 198765 - DNA, 601 bp, Human
actgaaagccacctcgtctcctggcttccactcagaagtggtggaggaaatactctcaaatgaaatcatgtgatcctgtttaaataaatggaaaattaaaaggcagggcactggctgacccttgatgccaggaggggcagatgtggattgacgtggctctcggcccccatgggctggtattgggcctccttgggagcagcctgagagtgctcattcttggccaaatcgtgagttccagagggaaagagatgggaccaaaaaccttagggagaaccttggggccagctgcagtgggaacacrtgggcaccctccacaatcctctatcctgacacgatgctccttttgtgtctccactgtgtttttcactcccatattttcacagttgtgattcaacctcaatgcttctggaacccacaagccacccagcctcactttctaaaaatatgattgagaaagcaagacagagtttgggacggaggtttctccagcggagcagagccctggcatcctgtggaacatattgtgagtgttcacagccgagaaagtaagatgactgggatgtcattttcaaagaggaaatgggccccaccccaacagggc

SEQ ID NO: 198766 - DNA, 601 bp, Human
agaaagccaccatggtgagttttaggcagagaccctcttgtgaataattcgtctatgatccaagatggccagacaagaatcagggcccaagctttttctccccagtgtcacatccacgctgctgtctcctctccagctcagaccaaaattctctggacattttcatggctgaaaaccccaccagaacgctggccctgacaggaccctctcctcaagtcctgaggacccggctgcggccagccagaatgtaaactacagctcgcagaagcagcaggcatggaggaagaggcaggagagcaaragcagaagctcgaaaccttcaaagggagcttgaagaacaaggccaggagaagcagcggccaggccccaccggtttcctcctttccctcctgaatctaggacagaggccatttcagacgagagaggaaagaacaacaaaatgaactgcaggagaagcagccggagcctgcaaggcccagccagagacggcagaggagagaaccgcaagccaggagcaaggaggagacaggtggactccactaaccaaccgacgcagcccagcggagacaggcggactccactgaccaaccgacgccacctg

SEQ ID NO: 198767 - DNA, 601 bp, Human
ccacatcaccaggctgaaggctggttaacctggtggaatcagctgtcttcatgttcaaaccagcacatggggctattttgctccagtcacctggtgtgacatgagccactgagactcgaacacccctgctctggagcaaagaagaacccacacctctgtcctgcctggcagcctccccaccactcgccgtgggcacggggtccgtatccactcgccgggggcacggggtccgtatccactcgccgggggcacggggtccgtatcctctcgccgggggcacggggtccgtatcctctcgccrggggcacggggtccgtatccacttgctagggcatggggttcatatcctgtcctctgtctcctctaagtgtcccttaaacttaaggccaatcctatgatttccctctaaaagcattcttccgaattctaccccaaagaaaccagtgacatttctcaacatcaggcttcctaatctctgcaggccgcctgaagaaaaagaagagatatgtgtatggccatgccatttggaaatagaagaaaagcctttaaccgccttctaccttcagctgtttttgccaagcagagaaggtccagaaagcac

SEQ ID NO: 198768 - DNA, 601 bp, Human
gaggctcctgtcctgcccatccacacagcaaacatagcaaccagaaataacacgttcacaggcttctcctccccactcccaactcagctgcaaaacagctgataaaatgaggatgggctctatgtaagtaaacagtactcgatctaccagtttacgacatcatcaaagacatgtagagagaaaatacatacacaggtaataataacaatgataattctaatactattttgttagattagaagcatttttcctggacagaagcaacatcacctggggtcccagtggaaagcacgggccaggygtgctccctgtgaccaggtcagagtgcagagcccgcctggtgacctcatttccttagggcaattgtaccttctgtctggagccaggtccctcttaaaggtagaagactgcagaaaataattcaccagaagcaggcatggtgcatccccaggacggatccttcaccgcacccgagaacccgcaggatgaggcagctctgcgcaagcacctgaccccctgcagagctgagatggctgctcggggactatgtcccccagcaaagcacagagctgagccagctgcttggggactatgtccccca

SEQ ID NO: 198769 - DNA, 601 bp, Human
cagtactcgatctaccagtttacgacatcatcaaagacatgtagagagaaaatacatacacaggtaataataacaatgataattctaatactattttgttagattagaagcatttttcctggacagaagcaacatcacctggggtcccagtggaaagcacgggccaggcgtgctccctgtgaccaggtcagagtgcagagcccgcctggtgacctcatttccttagggcaattgtaccttctgtctggagccaggtccctcttaaaggtagaagactgcagaaaataattcaccagaagcrggcatggtgcatccccaggacggatccttcaccgcacccgagaacccgcaggatgaggcagctctgcgcaagcacctgaccccctgcagagctgagatggctgctcggggactatgtcccccagcaaagcacagagctgagccagctgcttggggactatgtcccccaggaaagcacgtctgagtcttggctccagctcctgtgtatgggatgtgatttggaaatggtctccgaagagggaagccagttaaagatgaggccatcagagtggctcctaatccagggactggtgtccctaag

SEQ ID NO: 198770 - DNA, 601 bp, Human
cgacatcatcaaagacatgtagagagaaaatacatacacaggtaataataacaatgataattctaatactattttgttagattagaagcatttttcctggacagaagcaacatcacctggggtcccagtggaaagcacgggccaggcgtgctccctgtgaccaggtcagagtgcagagcccgcctggtgacctcatttccttagggcaattgtaccttctgtctggagccaggtccctcttaaaggtagaagactgcagaaaataattcaccagaagcaggcatggtgcatccccaggacrgatccttcaccgcacccgagaacccgcaggatgaggcagctctgcgcaagcacctgaccccctgcagagctgagatggctgctcggggactatgtcccccagcaaagcacagagctgagccagctgcttggggactatgtcccccaggaaagcacgtctgagtcttggctccagctcctgtgtatgggatgtgatttggaaatggtctccgaagagggaagccagttaaagatgaggccatcagagtggctcctaatccagggactggtgtccctaagaaggagacactggacagagaca

SEQ ID NO: 198771 - DNA, 601 bp, Human
tgctctgtgtggctgcacactgagaccccattaaaaactctgcatgctgaggcccaggtgagcatccctgcccagcaatgctgtgtgtgtggctggctgcacactgagacctcaatagaaactctgcactctgagacctgggcgagcgtccctggtcagcaatgctctgtgtggctgcacactgagaccccattaaaaactctgcatgctgaggcccaggtgagcatccctgcccagcaatgctctgcgtgtggctggctgcacactgagacctcaatagaaactctgcactctgaggccygggtgagcgtccctggtcagcaatgctctgcgtgtggctggctgcacactgagacctcaatagaaactctgcatgctgaggcccgggcaagcatccctggtcagcaatgctctgtgtgtggctggctgcacagtgatgtggtttggctgtgtccccactcaaatctcttcttgaattgtaactgccacaattcccatgtgtcatgggaagaccccagtgggaggtacctgaatcatgggggcaggtctttcccatgctgttcgtgtgatagtgaataggtctcacaagatctggtggttt

SEQ ID NO: 198772 - DNA, 601 bp, Human
caagcatccctggtcagcaatgctctgtgtgtggctggctgcacagtgatgtggtttggctgtgtccccactcaaatctcttcttgaattgtaactgccacaattcccatgtgtcatgggaagaccccagtgggaggtacctgaatcatgggggcaggtctttcccatgctgttcgtgtgatagtgaataggtctcacaagatctggtggttttataagggggagtttccctgcactttgcctgctgccatccatgtaagacgggacttgctcctccttgccttccaccatgattgtgagkcctccccagccacatggaactgtaagtccattaaacctctttattttgtaaactgcccagtctcagatatgtctttatcagcagtgtgaaaaaaaactaacacaggctgggaggggcccatgctaggccaagatctggaaatcagggcaggtgtgtgagtgtctcaccctgagtccagcacctcagtcccccaaacacaacagggctgagtcgagttgcatcgtagctgaggcctgggccacttggggtgtaagagctgggagctgctgacagggagcagtagcagaggcttcagctgcc

SEQ ID NO: 198773 - DNA, 601 bp, Human
gcctccccagccacatggaactgtaagtccattaaacctctttattttgtaaactgcccagtctcagatatgtctttatcagcagtgtgaaaaaaaactaacacaggctgggaggggcccatgctaggccaagatctggaaatcagggcaggtgtgtgagtgtctcaccctgagtccagcacctcagtcccccaaacacaacagggctgagtcgagttgcatcgtagctgaggcctgggccacttggggtgtaagagctgggagctgctgacagggagcagtagcagaggcttcagctgcmagagagtggcctgaattcggagaagcagactctacttttctggggtaggctttgtgtgtgcacacaggagcctgcctgtcagccaaaaccctatttgcaatgcttccctgctatctgccctgagcaaaacattagaaagctgggatcaatttagtaaattcttccaggctcactctccatttctttaaaactccaaatcagaacatgtggcctgagcttaggaggaacaaaatttgaaattgtactgcccagaaaacccagtgtggatagtcagtgtgtttacacgcatcgtcacgatag

SEQ ID NO: 198774 - DNA, 601 bp, Human
aactgtaagtccattaaacctctttattttgtaaactgcccagtctcagatatgtctttatcagcagtgtgaaaaaaaactaacacaggctgggaggggcccatgctaggccaagatctggaaatcagggcaggtgtgtgagtgtctcaccctgagtccagcacctcagtcccccaaacacaacagggctgagtcgagttgcatcgtagctgaggcctgggccacttggggtgtaagagctgggagctgctgacagggagcagtagcagaggcttcagctgccagagagtggcctgaattyggagaagcagactctacttttctggggtaggctttgtgtgtgcacacaggagcctgcctgtcagccaaaaccctatttgcaatgcttccctgctatctgccctgagcaaaacattagaaagctgggatcaatttagtaaattcttccaggctcactctccatttctttaaaactccaaatcagaacatgtggcctgagcttaggaggaacaaaatttgaaattgtactgcccagaaaacccagtgtggatagtcagtgtgtttacacgcatcgtcacgatagtgtgtttacacgcatcag

SEQ ID NO: 198775 - DNA, 601 bp, Human
tttattttgtaaactgcccagtctcagatatgtctttatcagcagtgtgaaaaaaaactaacacaggctgggaggggcccatgctaggccaagatctggaaatcagggcaggtgtgtgagtgtctcaccctgagtccagcacctcagtcccccaaacacaacagggctgagtcgagttgcatcgtagctgaggcctgggccacttggggtgtaagagctgggagctgctgacagggagcagtagcagaggcttcagctgccagagagtggcctgaattcggagaagcagactctacttttstggggtaggctttgtgtgtgcacacaggagcctgcctgtcagccaaaaccctatttgcaatgcttccctgctatctgccctgagcaaaacattagaaagctgggatcaatttagtaaattcttccaggctcactctccatttctttaaaactccaaatcagaacatgtggcctgagcttaggaggaacaaaatttgaaattgtactgcccagaaaacccagtgtggatagtcagtgtgtttacacgcatcgtcacgatagtgtgtttacacgcatcagcatgacaatatatgcactttta

SEQ ID NO: 198776 - DNA, 601 bp, Human
acacgcatcagcatgacaatatatgcacttttaaatactctcacttcatagtcaacaagtgtctcaagtataaaactataagaagagaagaaagtctagagatgtccatttcgagcacacattgtaaaaacagcacagaccctgctcccagtctaatgcataaatactgtaaataaaaagggacaggcacaaattttgaagcattagtaaacgtgaaaggaaggaaggagaaatcccagatgccagaacagagaaagcacagagctggggcaaagagcaggcaagggaggcagctgagtgyggcagtggcaggcaggggggtctgttagggcccagcaggctggggttggggtctgcccacaggagggcagggggcaggtgctggcagcgcacccccaaggactgtgcacacctgccctgcacaaaaggaatgccaacaacccgtccacaggcaggcgggcagaagagcctctctttctcaggctcttgatgaaaacacaaatgcctctcattagaaatagaagcctgaacctgtatcccacatgagtgtcaaatcctaatataataaaatactcatatatctaacataacacattgattt

SEQ ID NO: 198777 - DNA, 601 bp, Human
ttcgagcacacattgtaaaaacagcacagaccctgctcccagtctaatgcataaatactgtaaataaaaagggacaggcacaaattttgaagcattagtaaacgtgaaaggaaggaaggagaaatcccagatgccagaacagagaaagcacagagctggggcaaagagcaggcaagggaggcagctgagtgcggcagtggcaggcaggggggtctgttagggcccagcaggctggggttggggtctgcccacaggagggcagggggcaggtgctggcagcgcacccccaaggactgtgcayacctgccctgcacaaaaggaatgccaacaacccgtccacaggcaggcgggcagaagagcctctctttctcaggctcttgatgaaaacacaaatgcctctcattagaaatagaagcctgaacctgtatcccacatgagtgtcaaatcctaatataataaaatactcatatatctaacataacacattgatttgaattgctaattataaaatgttggaggaacctttccaacaatgagagttcttgggacttccacaggattctcataagaaaagaaagacatcaaagacaagcatgtaata

SEQ ID NO: 198778 - DNA, 601 bp, Human
cacaaattttgaagcattagtaaacgtgaaaggaaggaaggagaaatcccagatgccagaacagagaaagcacagagctggggcaaagagcaggcaagggaggcagctgagtgcggcagtggcaggcaggggggtctgttagggcccagcaggctggggttggggtctgcccacaggagggcagggggcaggtgctggcagcgcacccccaaggactgtgcacacctgccctgcacaaaaggaatgccaacaacccgtccacaggcaggcgggcagaagagcctctctttctcaggctctkgatgaaaacacaaatgcctctcattagaaatagaagcctgaacctgtatcccacatgagtgtcaaatcctaatataataaaatactcatatatctaacataacacattgatttgaattgctaattataaaatgttggaggaacctttccaacaatgagagttcttgggacttccacaggattctcataagaaaagaaagacatcaaagacaagcatgtaataaaaaattataaaccacgtagaaaacaatctgtaatgagaaagtgtgagcaaaatttaaaagaaaacgcaaactagaga

SEQ ID NO: 198779 - DNA, 601 bp, Human
aaccacaagaaactgcaacgcacaacagaaacgtaattggaagacataagtgaaatgaatcatttttaggaaaaaaaacaaaaacacaaaatgccagaattgaattgaaaggaatggtatctgactatacttgtaaccattagttaaatcagtattcaaaaaccaactctcataaacagcactaaagccaggtgacttaaacactgttactaaagcttcaagcaacatctgtttcctcctatgcggattttagatttttcagtctaggacacaatttactttatgagatgagtattacttygatactagcactgaaaaacagtaacacaatgaaaataagggaattccatttctcaaaaaataatagcaaccaaatataacagagggaaatcagtaaaacaaaaagtgaccaaaaaggtatatcccaaaaatgcaaaactggttctactccatgtaattcactttactaagagattaaagggagaaaaagtccagtaatatcttagagattcaagaataagatttggtccattcaaaattttttaaattttaagaaactaggaataaagcatccttaacccaataaaagttatctaataaa

SEQ ID NO: 198780 - DNA, 601 bp, Human
atgttgtgccaacatcacagagtgcacttacacacacccagctggcacagcccactgcacaccccacaacctgcacggcatatcactgtactgagtgctgtaggcaattgtaaccaatggtatgtatttgcgtatctaacctgcacagcttactgttactgttccgagtactgtaggcaacgctaacacaatggtatgtatttgtgtctgaacacatctaataaaaaaggtatagttaaagtatgtgattataatcttaggagaccaccctcatgtatgcagtcagtagttgactgaaacrctgttatgtggcaatgactgtacttttgtacagttttgtccaaactaaactatacattaaatcgaaattcaacaaaaaacccaatcagtcttttttcataaatttgacaagctcatctgaaaaatgattttagaataagggacatgtagataatttggggaaagaatgggggagggttgcaattcaccttgtcagaaagatttcacattgtcagaacgattgagacaccaagtgtctactctgtaccacagcaggtgagtatcacagatgtatggtgagttagagaagccagacacatgg

SEQ ID NO: 198781 - DNA, 601 bp, Human
acagttttgtccaaactaaactatacattaaatcgaaattcaacaaaaaacccaatcagtcttttttcataaatttgacaagctcatctgaaaaatgattttagaataagggacatgtagataatttggggaaagaatgggggagggttgcaattcaccttgtcagaaagatttcacattgtcagaacgattgagacaccaagtgtctactctgtaccacagcaggtgagtatcacagatgtatggtgagttagagaagccagacacatggagtgcatgatgtctgaatccgctaacctcycgctttgggtctcacttggggaggagatgctgaggggagggtctgggctgccaagggctctgtctggagctggatggtgactacacagcacagtcaacaggctctgcactaagatgtgcacactttgtatatgttatactccagtagaaattcatgtataaagtaagatgagaaagttgaattgagaaaagaaaatcatcaaggttttggaaagactgacaaacagaaccagtggaataaaactgaggagggagaaatataagtacacacatggggactggatagacaaccaatgtgaag

SEQ ID NO: 198782 - DNA, 601 bp, Human
gaaatataagtacacacatggggactggatagacaaccaatgtgaagacatacactgcaggagaaagggtatttcaacaattaaatacaagggccaggacaactccctatctaagtagaaaaagataaaattcaacccctgtctcacaacaacaaaaattcctgacagattaaagattctaaaacttcagaagaaaataagggcaaatatttttatgaaatcactagagaaagatgccatgatgaaacccaaagacttcaaatggaaaacactgattaaaaagacaccataaaaaagataraagataagctatatctctatttttataacatatataatgcactgaccaagaactagtattcaaatataattacatacattttataataaaatactatgctatatataacacatatagcatttctatataaatatggtctacatatatatttatatgtaacatgtatatttatattatataatatgtagtatttatattagataataaagtataaaatatagaaatataagattttattatacataatatgtaaaatatgtatttctagaataatgacacagatattaagaatccttacat

SEQ ID NO: 198783 - DNA, 601 bp, Human
atcaataccaacagggctcccacataatgacaggggattacagataaaagaactgcacacatcagactttatttaaggagaagtctctagggaaacccaaagaaaagtagggagataaaacaaggacaccagaagaaattttagcctctgacaattacagctccagcaaacagtaaacagcctaactcacagccaggtaaagataaaacctaatgctaaaggccaatctgcctcagtttcttttatccaatacagcatatctaggtttcaacaaaaaaattacaagccatgctaaaagggraaaaaatcacaaagagaaaaagaatcagactcagatatagcagagatattggaattatcagacaatgaatctcaaatacccatgatgaatatgagaagtgctctagtgagaaaacggacaatgtgtaggaacagatgggtgatttgagagctggaaactctaagaaaaaatcaaaaggaaatgttagaaatcaaaatcactgtaacagagatgaggaatgcctttgatgggctcattggtagagcagacatagctgaggaataatcagtgagaatgaggatctatcaataaaaactcccc

SEQ ID NO: 198784 - DNA, 601 bp, Human
cccacataatgacaggggattacagataaaagaactgcacacatcagactttatttaaggagaagtctctagggaaacccaaagaaaagtagggagataaaacaaggacaccagaagaaattttagcctctgacaattacagctccagcaaacagtaaacagcctaactcacagccaggtaaagataaaacctaatgctaaaggccaatctgcctcagtttcttttatccaatacagcatatctaggtttcaacaaaaaaattacaagccatgctaaaagggaaaaaaatcacaaagagamaaagaatcagactcagatatagcagagatattggaattatcagacaatgaatctcaaatacccatgatgaatatgagaagtgctctagtgagaaaacggacaatgtgtaggaacagatgggtgatttgagagctggaaactctaagaaaaaatcaaaaggaaatgttagaaatcaaaatcactgtaacagagatgaggaatgcctttgatgggctcattggtagagcagacatagctgaggaataatcagtgagaatgaggatctatcaataaaaactccccaagacaaaaagcaaagag

SEQ ID NO: 198785 - DNA, 601 bp, Human
cagccaggtaaagataaaacctaatgctaaaggccaatctgcctcagtttcttttatccaatacagcatatctaggtttcaacaaaaaaattacaagccatgctaaaagggaaaaaaatcacaaagagaaaaagaatcagactcagatatagcagagatattggaattatcagacaatgaatctcaaatacccatgatgaatatgagaagtgctctagtgagaaaacggacaatgtgtaggaacagatgggtgatttgagagctggaaactctaagaaaaaatcaaaaggaaatgttagaratcaaaatcactgtaacagagatgaggaatgcctttgatgggctcattggtagagcagacatagctgaggaataatcagtgagaatgaggatctatcaataaaaactccccaagacaaaaagcaaagagagagagaaaaaaaaaagaaaaagacaaaacagaatatccaaggactgtgggacaattacaaaaggtataacatatgcataataggaataccaggaagagataaagagaaaagggaacagaagaaatatttgaagtaataatggctgaatattttcaaaattaatgccagac

SEQ ID NO: 198786 - DNA, 601 bp, Human
acaaaaagcaaagagagagagaaaaaaaaaagaaaaagacaaaacagaatatccaaggactgtgggacaattacaaaaggtataacatatgcataataggaataccaggaagagataaagagaaaagggaacagaagaaatatttgaagtaataatggctgaatattttcaaaattaatgccagacaccaaatcacagatctaggaaactcagagaacaccaagaagggtaaatacaacacacacaaattcacactcacacacacagatgcacacacacggacacgcacacacatgcatayacacatgcacacacacacgtgcatacacatgtgcacacacttcacacacacacacacacaaacacactgcacatgcacacacgtgcacacacactgcagaaaaatcaaagacaggaatttttggacaaagccagagaggggggaaaaaccttaccttacccatagaaaagcacggagagaattatgctggacttctttttaggaagaagcgagtagagaatgaagtaaaatattgaaaatgttaaaagaaaacacccaacttaaaattctatgtccagtgaaataatacttcaaaactga

SEQ ID NO: 198787 - DNA, 601 bp, Human
agagaaaagggaacagaagaaatatttgaagtaataatggctgaatattttcaaaattaatgccagacaccaaatcacagatctaggaaactcagagaacaccaagaagggtaaatacaacacacacaaattcacactcacacacacagatgcacacacacggacacgcacacacatgcatacacacatgcacacacacacgtgcatacacatgtgcacacacttcacacacacacacacacaaacacactgcacatgcacacacgtgcacacacactgcagaaaaatcaaagacaggaawttttggacaaagccagagaggggggaaaaaccttaccttacccatagaaaagcacggagagaattatgctggacttctttttaggaagaagcgagtagagaatgaagtaaaatattgaaaatgttaaaagaaaacacccaacttaaaattctatgtccagtgaaataatacttcaaaactgaagaagaaataaagacttttttaggcaaacaaaaattaaaggaatttgtcagcagttgatctgcctttctttttttatttctttttttttttttttttttgagatggaatctcactcta

SEQ ID NO: 198788 - DNA, 601 bp, Human
aaatattgaaaatgttaaaagaaaacacccaacttaaaattctatgtccagtgaaataatacttcaaaactgaagaagaaataaagacttttttaggcaaacaaaaattaaaggaatttgtcagcagttgatctgcctttctttttttatttctttttttttttttttttttgagatggaatctcactctattgctcgggcctgaagtgcaatggcacaatctcagctcactgcaacctctgcctcccaggttcaagtgattctcctgcctcagcctcccgagtagctgggattacaggcrtgcaccaccacacctggctaatttttgtatttttagtaaagacagggtttcaccatgttggcaaggctggtcttgaactcctgacctcgtgatctgcccgcctcggcctcccaaagtgctgggatcacaggcgtgagccgccacgcccggtccacctgcttttcaagtagtgttaaaagaagctcttctgacagaaggaaagtgacacaggtccgacactcggatctaaacaagacacagcagataccagggaaagcattccaggcaccaccaggaagagccactgcagaggccctggaa

SEQ ID NO: 198789 - DNA, 601 bp, Human
gctaagcaagagagagggactatgtctccagaaaaaagagagagaaaacaaaaagaaaagaaaagaaacaattgaaggctacaaatagtcaatatttagtctcttgaaaaatctatggccaaagagaaacctgcgtgcttgggtccaaaaaagcgaaacgagtattgcatgatcttggtgattctgaggccagctctaagtctttgctgtcattgacatgtgacccttcccaatcacacttcttcctacccacggctgagtctgtggtgaaaggacagacttccttcagccatgtcaggcgcctttactatccttgtatcttgcaacactcttagtaatcacatcattttgaattctttatgtaaaaatgtacctgctttaagcctcagcaaagaccaatgtcaaaagaaagatgtctgtatcacaagaacgatcacaggcccagtagatcgtgcggctggacacgcactttctgcccacgaaagagcctgtgaggggcctccatctcttgatgcaatgcaccaagatgccacgggcactgaaacaccagcttttgggtgcatacttcatacccacagaaaccagagaatggatttccaaa

SEQ ID NO: 198790 - DNA, 601 bp, Human
atggccaaagagaaacctgcgtgcttgggtccaaaaaagcgaaacgagtattgcatgatcttggtgattctgaggccagctctaagtctttgctgtcattgacatgtgacccttcccaatcacacttcttcctacccacggctgagtctgtggtgaaaggacagacttccttcagccatgtcaggctcctttactatccttgtatcttgcaacactcttagtaatcacatcattttgaattctttatgtaaaaatgtacctgctttaagcctcagcaaagaccaatgtcaaaagaaagatrtctgtatcacaagaacgatcacaggcccagtagatcgtgcggctggacacgcactttctgcccacgaaagagcctgtgaggggcctccatctcttgatgcaatgcaccaagatgccacgggcactgaaacaccagcttttgggtgcatacttcatacccacagaaaccagagaatggatttccaaacgtccagaaaaaagaagtcaggggagtgaaacgcagagaccaggagctcatccgactgccccatcgtgcttgactcttccccagcagaggggtcgggagttccggtggattcag

SEQ ID NO: 198791 - DNA, 601 bp, Human
gctcatccgactgccccatcgtgcttgactcttccccagcagaggggtcgggagttccggtggattcagtgttcccatcaatggtgagccgcttcggagcaaagccaaacacagctcagaactgcacaagttcaggcaccagacacagggtaggatccacgtcactctctgcagcacagggtaatgcactctctaccacacgcatgaatcatttattcagaaagagatgagagatccatggaactgtgaactaatcctaaatataacatttccatttactttccccgcacttaacatcttygcagtatcccgtcacggctgagttcacgtttttgctgtgtgctgctggtatcctgcctgcaagcttcgggagggcaggggcaggccaggcccagggcttcctaagggacctggctgtcctgagccacagccggctgatagacaccatagtgaagaatccgatgggtgtctgtgacagtgtctcagggccagggtgacgagcatctgctgcccactgtgccagggaagaaagggagtactggcttgcagagacttacggctgaaactactagaaaacaggttttatgaactgcctctgaat

SEQ ID NO: 198792 - DNA, 601 bp, Human
gctgagttcacgtttttgctgtgtgctgctggtatcctgcctgcaagcttcgggagggcaggggcaggccaggcccagggcttcctaagggacctggctgtcctgagccacagccggctgatagacaccatagtgaagaatccgatgggtgtctgtgacagtgtctcagggccagggtgacgagcatctgctgcccactgtgccagggaagaaagggagtactggcttgcagagacttacggctgaaactactagaaaacaggttttatgaactgcctctgaatttatttgtattatgctkttttcataattaaaagaaaagcttgtaacagtttcctcatttataaattccatatttcaatacaaagcaaaacactcttggaggttctgggaatccttcagtgtgcaacgcatctgccattccaagacagagaccaaaaaaatggaggaaagtttgggggaagttacagtgaaaagctcctgatgggccgtggtggccatgcccatagttccagctactcgggaggctaaggcaggaggattacttgagctcaggagttcaacaccagcctcagaaacatagcaagaccccatctcatga

SEQ ID NO: 198793 - DNA, 601 bp, Human
aacaataatatctccccagcaccaagctcctgcaggagagaatggcatttgggtggcagacatggccgtgaatgggaaggagaagggcctgacctcactgcaaggccgtctgcattaaagaggccaatttctgagcacaaggcaggttgccaggaaatgcagcttgacatttataaacctactcaccagcctttgttctcaatgccagggcacccaagtaagcaagccttccttcccggcactgcagacacttctggaaagacccacccatttcttcagaaatgacacttcacagtgtggygagaggggagaagcgcacagaccatcctgcacagttggctcagcatttagcaattacataaaatgtgtgagactgattgtcatttgctcaaaaaatgtgttgagcacctaacgtacgctgaccacgtcactggacgtggcagagggagcaaagcataaagagaaaggccacacgccgaggctgtgatgggcagtgaggatatgtaaatcttatgcttatggactacatcctgccacacatgattttcataaaagtcattaactcccaaagcaaccctgcagggtgtttcagataaaaaaa

SEQ ID NO: 198794 - DNA, 601 bp, Human
gagcacaaggcaggttgccaggaaatgcagcttgacatttataaacctactcaccagcctttgttctcaatgccagggcacccaagtaagcaagccttccttcccggcactgcagacacttctggaaagacccacccatttcttcagaaatgacacttcacagtgtggtgagaggggagaagcgcacagaccatcctgcacagttggctcagcatttagcaattacataaaatgtgtgagactgattgtcatttgctcaaaaaatgtgttgagcacctaacgtacgctgaccacgtcactsgacgtggcagagggagcaaagcataaagagaaaggccacacgccgaggctgtgatgggcagtgaggatatgtaaatcttatgcttatggactacatcctgccacacatgattttcataaaagtcattaactcccaaagcaaccctgcagggtgtttcagataaaaaaatttagaatagctttatctgagttacacaattttaaaagtcagcaactgaagaaatgtccagaaagtcttggttaaataaaaaacacttaagtggcacagaggcaggagggggaatcctgaagctggtgcgtc

SEQ ID NO: 198795 - DNA, 588 bp, Human
aggccacaggggacaaggagaacccgtgctgaagagaccacagctggtcccaggggaccaagatgggagctctgcctcagaaacagtgtccagggctcaagtggcccaggttaacatcttctctgctacttggaaaagagatcttttcctgcaccataggccgacaggtgccagttcggcgatgactaagtacaaaagagtctgctgcaggagcaacatttaattctcaacgagagcacctggaggacaccaggaggagcatcacagacaggaaaaattataaacagtgaagggcagcccmaaacaataacaacaacttctcttccttagacacccttgagagttatgtcaataaccactgctcggttatattttacagaaagcctttctaaattaaaatatggtgctatccacttaaaccctactgggctgaacttacacatatgcatgatattgacccctgaattgatcagagattgatgctgaaaccacccaaaagcctccatgactggaagcttgatatctgacccggctttaaagaaagttggtggctttgggacagcagtcatgtggcgcacagcagcccat

SEQ ID NO: 198796 - DNA, 543 bp, Human
ctggagaaataaattttttattaaaaaagtaattggaaagagtttacattaatcagatttctaatttttcacttctccatggtaaagatcccagctatccagataaatgccactcagagcacccacatctcctggtggtcttggccttgtgtcagcattctaaatactcacatccatagcaagacatgagaaacaggaaggagaggaaagaagaatcagagaggtgtgccccaggacgtgggmgcagctggcacattcagagacggtctctgaattgcagatttcagagattgtttagcacagacatcctgttttatcatttgaaacctaaggaacagagagtgcaaagggcttgccaatagttggctagctagtcagtgagagacccaggagcagaacctgtgatcctggcgtcctgacactgccttgttctgtccaggagcagaacctgcgatcctggcatcctgacactgcctcgttctgtccaggagcagaacctgcgatcctggcgtcctgacactgcctcgttctgtccaggagcag

SEQ ID NO: 198797 - DNA, 601 bp, Human
gaaacctaaggaacagagagtgcaaagggcttgccaatagttggctagctagtcagtgagagacccaggagcagaacctgtgatcctggcgtcctgacactgccttgttctgtccaggagcagaacctgcgatcctggcatcctgacactgcctcgttctgtccaggagcagaacctgcgatcctggcgtcctgacactgcctcgttctgtccaggagcagaacctgcgatcctgacgtcctgatactgccttgttctgtccaggagcagaacctgcgatcctgacgtcctgacactgccktgttctgtccaggagcagaacctgcgatcctggcatcctgacactgccttgttctgtccaggagcagaacctgcgatcctggagtcctgacactgccttgttctgtccaggagcagaacctgtgatcctggcgtcctgacactgcaatcctggtgtcctgacactgccttgttctgtccaggagcagaacctatgatcctggcgtcctgacactgcaatccttgcatcctggcactgccttgttctgtccaggagcagaacctatgatcctggcatcctgacactgccttgttctgtcca

SEQ ID NO: 198798 - DNA, 601 bp, Human
cacactgctactttctgaggaacacacagatgaatacaacagtccccatgggcaggtttagcagggaagaagcacagtcaccgaagtccaaaaaagccaggctggagcccatgggccatgcagaacaggccaggagccgagggcaggtcactcagttccctttctctcaaggagctttcagctcaggagaataaacaaggagtatacacacatcatgtccaagggcaatcttagtaaccacaaccaaagaggctggagccactgcacacctcagggaaggagaggccacttgtgctgtgcraggcctgcctgcagtcactgagcgtgtgaggcctgcctgcagtcactgagcatgtgagggctgcctgcagtcactgagggtgcgagggctacctgcagtcactgagtgtgtgaggcctgcctgcagtcactgagagtgcaagggctacctgcagtcactgagcatgtgagggctgcctgcagtcactgcgcttgggagaggaggcacggcacatctggcgtttcagagccgatggcatgttagaggccaccggggagggacagctgctgggcacagctggtgcactagaaagcagcttga

SEQ ID NO: 198799 - DNA, 601 bp, Human
acagggcagtgcaaggtgacctgggggtaggagtaccgagcacatggaacacacgtaaggcagctccttgttcaggcatgaggcaggaagagctagaatggggccgaattcagagcaacagggacaggggacccgatggatatcgaaggtggccaagaatggtgcatacacactttcttctaaggacactttctgtctagatagaaactcatacatgaatacacatatgtatacacacacacacacacacacacaggtcagtaccattctttcaacttttctgtttgtatattttcatcayaaaatattggggaaatggtgccttttcatctctgcaatgtgagagctctatagcatcagaaactctcccttatcttacagaccatgtagaaacatgtggggaaaagtcctacatgcatctataaatcaccaggtcctgctagccacgggcatctcctcttggtcctcatgttacattttcttagacttaagttttcttcatagcaagggaacatgacttgactctgaaaacttgaatgatgtattttaaggtgagtaagttacataggaataatgtatatccctatcatcattgttacta

SEQ ID NO: 198800 - DNA, 601 bp, Human
cctcctctccagaatctggcaaccaggagaggccctttggcgggcccagtaatgggggtgcatgcacctctctgcccatcccacacctctacacggctgctcccaggcaccagagcctccacctaccccaaaccaagtcctgcccatagtgtgccccgtagcaccgtcagccctgccttccatgattgcagctgatgtgcctgggggcgcgggcaccattaattcctgtatcttcccctctgtccaatccatcaccaaatcccactgctggcacctccaagacacctgcagactgcagccygcacgccagtgcccaaggtcaggccaggtggcccctgcctgctccccatccttcgtgctctgcccagccgtccccttcactgtggtcagagctgtgggcggtaagccacccaggtgccgaggcaagagactgagggcacgaactgttccagtgtaataaaatatgtaaaataagaatagttatactagatctagatcatagatatgattatatatgaatatcattcatcattagtttgtagcaattactctttattccaatattatcatagtctttgctctataatcataacctaggaaa

SEQ ID NO: 198801 - DNA, 601 bp, Human
aggagaggccctttggcgggcccagtaatgggggtgcatgcacctctctgcccatcccacacctctacacggctgctcccaggcaccagagcctccacctaccccaaaccaagtcctgcccatagtgtgccccgtagcaccgtcagccctgccttccatgattgcagctgatgtgcctgggggcgcgggcaccattaattcctgtatcttcccctctgtccaatccatcaccaaatcccactgctggcacctccaagacacctgcagactgcagcctgcacgccagtgcccaaggtcaggycaggtggcccctgcctgctccccatccttcgtgctctgcccagccgtccccttcactgtggtcagagctgtgggcggtaagccacccaggtgccgaggcaagagactgagggcacgaactgttccagtgtaataaaatatgtaaaataagaatagttatactagatctagatcatagatatgattatatatgaatatcattcatcattagtttgtagcaattactctttattccaatattatcatagtctttgctctataatcataacctaggaaaaaccaggccatacagagatagtag

SEQ ID NO: 198802 - DNA, 601 bp, Human
gcctcggctgccaaacagggaagggccccctgtccagtggacacgtaacccatgtgaccttacctatcactggagatggctcacactccttaccctgcccctttgttttgtatccaataaatatcagcgcagcctggcattccgggctactactggtctccgtgacttggtggtagttgtccccagggcccagctgtcttttatctttttgtcttgtgtctttatttctatgatctctcgtctccacacacggggagaaaaacccactgaccctgtggggctggaccctacacagagcgayacttctaacggggccctgttccagaccccactgcctgtggatggagtccgggccgaggccccttcctctctgtctggttcttgctgcttttttcagtctggaatctttggaggctcttgctctgctctaatgcagaccttctcccacacactccctccacctggaagctcctcctgccttcgtattggccttggtaactcccgcaggtcctgctaatctcgcctgaaaggtcacctctgccaaggagtgtcaccctgccccagacaaggtcagatctccttaatggatgccctgagccat

SEQ ID NO: 198803 - DNA, 601 bp, Human
cacgtaacccatgtgaccttacctatcactggagatggctcacactccttaccctgcccctttgttttgtatccaataaatatcagcgcagcctggcattccgggctactactggtctccgtgacttggtggtagttgtccccagggcccagctgtcttttatctttttgtcttgtgtctttatttctatgatctctcgtctccacacacggggagaaaaacccactgaccctgtggggctggaccctacacagagcgatacttctaacggggccctgttccagaccccactgcctgtggrtggagtccgggccgaggccccttcctctctgtctggttcttgctgcttttttcagtctggaatctttggaggctcttgctctgctctaatgcagaccttctcccacacactccctccacctggaagctcctcctgccttcgtattggccttggtaactcccgcaggtcctgctaatctcgcctgaaaggtcacctctgccaaggagtgtcaccctgccccagacaaggtcagatctccttaatggatgccctgagccatcacagcatggccaccaggcactccccggggcctcatccaca

SEQ ID NO: 198804 - DNA, 601 bp, Human
tgtatccaataaatatcagcgcagcctggcattccgggctactactggtctccgtgacttggtggtagttgtccccagggcccagctgtcttttatctttttgtcttgtgtctttatttctatgatctctcgtctccacacacggggagaaaaacccactgaccctgtggggctggaccctacacagagcgatacttctaacggggccctgttccagaccccactgcctgtggatggagtccgggccgaggccccttcctctctgtctggttcttgctgcttttttcagtctggaatcttyggaggctcttgctctgctctaatgcagaccttctcccacacactccctccacctggaagctcctcctgccttcgtattggccttggtaactcccgcaggtcctgctaatctcgcctgaaaggtcacctctgccaaggagtgtcaccctgccccagacaaggtcagatctccttaatggatgccctgagccatcacagcatggccaccaggcactccccggggcctcatccacacagaggccgggagcaggggggcacacctggcttgttctctgtcccccatgggggcggcaggcactgg

SEQ ID NO: 198805 - DNA, 601 bp, Human
ctcattgacccccttggagtccttacagaagctgcacattaagtcccacgcatcatcccaggtcaggggacggtgagtggccatccagcatggtggaagcaggtgcagctgtgccacccacatcgggacgcgtgctccactcgtggcattccaggctcacaatgtcgcccttatccgatgatcagccacctcggatgtgtccatcaagcttttaaaattcacaaacaaaaacaaaagatgcactagacccacccagcgaccccaaggtcacgccctctgtggttattggcaactcggggaygctgcccagctcccgattccgctcagcacctgtggacgcgggagcatctatcatcaatcctctgcaattctattttatgataaatacagaaatgacccttaacccacctttccctcctttttgctttttcctattgacacctgcccagcacatctgcctctcggcaaccacagaatgaaccagaaactttgctcttctgctgtgcccacaggaaactgaatctcctgacagcctcccatgactgttctgctagaatcgtcaaacttggggaaaaacaggatttgagatgaacttccacgt

SEQ ID NO: 198806 - DNA, 601 bp, Human
gggacctgcaacccgccatgtctaagcacccccgcggtgggctcccgcgcggcccaagcctccccggcaagtgccaccccctgcttctcggcgaccggtcccatcgaccgcccaacggctgaataatgcaggcggtgactggcagctccgcccgtggcgctggcgggggatccaattaggaaacccagctgggctcctgaattgggtggggacttaaacaactttcatgtccctctggagaattatatatgcgctaatcagcactctgtgtcttcccaatctggtagggacttggagaacwtttatgtctagctaaaggactgtaaatacaccaatcagcactcttgtgtctagctaatggtttgtaaacacaccaatcagcactctgtgtctagctcaaggtttataaatacaccaatcagcactcagtgtctagctcaggggattgtaaatgcaccaatcagcaccctgtcaaaaaagaccaatcagctctctgtaaaacagaccaatcagctctctgtaaaatagaccaatcagcaggatgtgggtggggccagataaggggaaaaaagcaggctgcccgagccagcagtggcaaccc

SEQ ID NO: 198807 - DNA, 601 bp, Human
catgtctaagcacccccgcggtgggctcccgcgcggcccaagcctccccggcaagtgccaccccctgcttctcggcgaccggtcccatcgaccgcccaacggctgaataatgcaggcggtgactggcagctccgcccgtggcgctggcgggggatccaattaggaaacccagctgggctcctgaattgggtggggacttaaacaactttcatgtccctctggagaattatatatgcgctaatcagcactctgtgtcttcccaatctggtagggacttggagaacatttatgtctagctaarggactgtaaatacaccaatcagcactcttgtgtctagctaatggtttgtaaacacaccaatcagcactctgtgtctagctcaaggtttataaatacaccaatcagcactcagtgtctagctcaggggattgtaaatgcaccaatcagcaccctgtcaaaaaagaccaatcagctctctgtaaaacagaccaatcagctctctgtaaaatagaccaatcagcaggatgtgggtggggccagataaggggaaaaaagcaggctgcccgagccagcagtggcaacccacttgggtcccctttc

SEQ ID NO: 198808 - DNA, 601 bp, Human
tctaagcacccccgcggtgggctcccgcgcggcccaagcctccccggcaagtgccaccccctgcttctcggcgaccggtcccatcgaccgcccaacggctgaataatgcaggcggtgactggcagctccgcccgtggcgctggcgggggatccaattaggaaacccagctgggctcctgaattgggtggggacttaaacaactttcatgtccctctggagaattatatatgcgctaatcagcactctgtgtcttcccaatctggtagggacttggagaacatttatgtctagctaaaggaytgtaaatacaccaatcagcactcttgtgtctagctaatggtttgtaaacacaccaatcagcactctgtgtctagctcaaggtttataaatacaccaatcagcactcagtgtctagctcaggggattgtaaatgcaccaatcagcaccctgtcaaaaaagaccaatcagctctctgtaaaacagaccaatcagctctctgtaaaatagaccaatcagcaggatgtgggtggggccagataaggggaaaaaagcaggctgcccgagccagcagtggcaacccacttgggtcccctttcacat

SEQ ID NO: 198809 - DNA, 601 bp, Human
tggaccttgcagctgggagatggcaggaccgggtatggggaaaggagggaggaaggcaggcatgctgggctggaggagagctgagccagggtgggcaacaggacttggtgggggtccaggctgtgcagtcccaggggaagaacggcccatgccagcggccctgactgagcagagcaggccagagcgtggggacttcatccctcagtgtccctgtcactccttcaacatgaaggagaaagccatgaaacgacgcaggcggctgtctgatcaggcccactgggtgctgagcttgctgtccccrtggggtgcccgtgctcatggcagccgagggtacggtgcagtgcacaggaggcccaggccacagctcccacgccaggaccattagggacccagtgcagtggctggactgcagctggggcaggagctgctgaggaggtgggtgcccagcaccacctttgcactcggcaccacctttgcactcagcagaacggaggccgcgtcctcagggaagcatgggcctgcattggtacggcttcactttaaaaatgcatcatcaaaccccgcaaaccactggaaccgggtgcctattgaatgtgagcac

SEQ ID NO: 198810 - DNA, 601 bp, Human
gaggtgagggaaagagtggaaacagcattcgcttatggacaaagaggaaaagaaaaggctgtgaaaacaggcatggcagcctcgcatcatggaaggaccagggcttcaacacagcaaaacagagagccaagtggacagcaggctcctccagcaaaacctgaggcctcgtcccccaggcccacagcccagcggcatcttcaccagcagacgcggctcccctgggactcccctccagcacagctcatctccagtgggctaggacggctaccacaggaggacatacgtgtcctggccacagccrccagccatcctgccgtcctcccgtcagtctctaaccccacggggcctggggcagtgaagacagaaacccatgtgcagggaagagtaatacttgggaaactcagcgacgcccacagtgtgctccatgaccgtcacaccgtcagcaaaaccccctcctgcacatccagggtacagggccttctgctggatttcacctgccccggcagccgactgcaccagcatcacagcctcctgccgacgatccctctgctgggaggctgggcgttccgtggagagaacagctgagaccccctcggcagct

SEQ ID NO: 198811 - DNA, 601 bp, Human
acagcaggctcctccagcaaaacctgaggcctcgtcccccaggcccacagcccagcggcatcttcaccagcagacgcggctcccctgggactcccctccagcacagctcatctccagtgggctaggacggctaccacaggaggacatacgtgtcctggccacagccgccagccatcctgccgtcctcccgtcagtctctaaccccacggggcctggggcagtgaagacagaaacccatgtgcagggaagagtaatacttgggaaactcagcgacgcccacagtgtgctccatgaccgtcamaccgtcagcaaaaccccctcctgcacatccagggtacagggccttctgctggatttcacctgccccggcagccgactgcaccagcatcacagcctcctgccgacgatccctctgctgggaggctgggcgttccgtggagagaacagctgagaccccctcggcagcttcccaggcaacagaaggcgcagggaggtggtggtgattcactgtgtttctaacaggtcctctggccacggaagcctcctgcacatgtgaaagcctgcagagaatcccacgcacttcaaaactctcactcatgtt

SEQ ID NO: 198812 - DNA, 601 bp, Human
gagaccccctcggcagcttcccaggcaacagaaggcgcagggaggtggtggtgattcactgtgtttctaacaggtcctctggccacggaagcctcctgcacatgtgaaagcctgcagagaatcccacgcacttcaaaactctcactcatgtttttcagaagcgggttttacaacttttggcatgaaaaggtcttagtggcatttctatgggtgtttatctaggctgctcccaaaccccagccaactaggggtgagctcccgtggccacctgtgacagtcagcccctcgcagtagacgtgcygacgtggctcccgaggtggaggggaagctggaggccctgggggctcttctccctgatcagggtatgaattctaaatgaacgtgaaagtgaggatgaaatggaacctgctctccccagcagtgagttggaggggggccaggtgctccccagcagtgagtcggaggggacaaggcagcaccctctgccagcaggatcagcattgctcgttcatttgcaggtgagaacgagctgctcccatgagtggtatgtccagtgcataaaccccctctgtgtaaaaataaacacagaaaagtggctgct

SEQ ID NO: 198813 - DNA, 601 bp, Human
tctttgaaaggagcaatacaaaaattgatcagaaatatactatttaagaagaaactaccaaggaaatgaagaataaaaaggatttttctcttctgccagttcaactatgtgactgagccacggagattaaacgtagctaccagtcatttctatgtactttgtggtagagtaagtgcctccttgagcaaaacccacttatttttaatattcactaataccctgtgctcatacccaaggtcataaattagcagaattcccgggaaagcattgcctacgataaagaggagacgctgagtaatgracagcagctgcccttctcattcggcatcaataccacgtgacgtttgatggggactaatgtgggattaactacacgcctattcattaggttttgtatcattttgtataaaattagcaaaatgaatgccctttgaattctaccgccagggtgatctccccgcattaataacagcagcctcaggtcctcaggcccttgagggaaccagacgccagcagccattgggcttccaggcagctggcaggtggcaggtgcaggcagcacccagcactcccagtaatttcaacagcaggctcttgagtt

SEQ ID NO: 198814 - DNA, 601 bp, Human
tttgaaaggagcaatacaaaaattgatcagaaatatactatttaagaagaaactaccaaggaaatgaagaataaaaaggatttttctcttctgccagttcaactatgtgactgagccacggagattaaacgtagctaccagtcatttctatgtactttgtggtagagtaagtgcctccttgagcaaaacccacttatttttaatattcactaataccctgtgctcatacccaaggtcataaattagcagaattcccgggaaagcattgcctacgataaagaggagacgctgagtaatgaamagcagctgcccttctcattcggcatcaataccacgtgacgtttgatggggactaatgtgggattaactacacgcctattcattaggttttgtatcattttgtataaaattagcaaaatgaatgccctttgaattctaccgccagggtgatctccccgcattaataacagcagcctcaggtcctcaggcccttgagggaaccagacgccagcagccattgggcttccaggcagctggcaggtggcaggtgcaggcagcacccagcactcccagtaatttcaacagcaggctcttgagttct

SEQ ID NO: 198815 - DNA, 601 bp, Human
gatttgttctcggtcacttgcagccctgtgtctcctgccttctatctgagccagttccacacatcagggcagcccagtccctctccacacagtgaaatcccagatggtgcccacggatagccacattgccctgtgactgcccctcgtcccctcactgcacaccagatttccacggaaaccgagaccttcctctgggttgccccatgtgggtagtgtgagtctctctctgccctggctgtgcatgtgcgtgtttgcgtgcgtgtgtgtgtgcacacacgtgtgtgtgcgtgtacgtgtgtgyggaaacagcctcacctgtggccttctccacatcctcagtggtcacgttttggacattggcgctcactttgaaggtcactgctggtccgagaaccctggaagggataatttaaaataagttcataacgaagtctacgcgccacaccgcttttctgaaaacgacatggaaaacactggtgtgtttttaaaaacgcaaacatccaaggccgctgtggctccaggcgtcgactccactggacgtcggttttccttcacaccatgacctttgtttccatttgccaggaattccgtttttgggctt

SEQ ID NO: 198816 - DNA, 601 bp, Human
ctggaacagaccccttaaatgtcttctaagaagtaaatccctggaacagacaggaaatgcgaagaggacccaatttaggtgggagagggcagctaagactgttgcttcctggtccctgggaggtgcctgcactgacatctaagctgtgaaactgggtaccatgtagcccagggtcccttgctgtccccactgcagccacacaccctccaccacaggctcatcccaaggcagcatatgacacccaggctgtggattttgcacccaaaatcctttcaacctcacatgtatttttgattcagayatctctgctcatgatacctcagtcccaacctctggtcttcctccttgggatttttgctcattctcccagccagggccagctcctccatgtgcaagcccttggtgaaggggactgtcgtgccattacgaggcagcacaattaccatcctaacaccatggctgaatattccatgtggacgtcttagcatcactttgaactcaacaaggtctcccttgaatcagcgcctgctctgaggagcaaacagcattctaaccttacggatattccctttggcttccttatgccaggaatatccagcta

SEQ ID NO: 198817 - DNA, 601 bp, Human
tcacagcagagctgagtgacttcctgcgtccagctctactgcatgcaaaatgtccttggaagccgcctccagggatgaccatggagcaggagctggtgtcttctcgagcccaggccccaggcctgtctacggtgcctcggctgggccctctgctggtccccactatgggccctcagaaaggaggaggccactccctccctggactgcagctctcctgccaacgatgttccactcgctcatgagtgctgagttctaccccctctcaaagccctactcccgagtgagcactgtgagagtggcygattctccctgtctccacagtcttccagaagggccctgagtgcctgatatttagtgctcaaatggcacaccagacgttttatagatgttttccttcttcccgagcacaggatgggctctttgaggcatgcatgatgatttctgccacggcctcacccacgcaggaggtgatcaattcatatttgtgaccggttcaacattttggttgaatggttttctaaaattaagagaaagtcctcattaacacaagcagcactcatgtacccccgaaacaacgctgaggacagagagctcagccaca

SEQ ID NO: 198818 - DNA, 601 bp, Human
gtctacggtgcctcggctgggccctctgctggtccccactatgggccctcagaaaggaggaggccactccctccctggactgcagctctcctgccaacgatgttccactcgctcatgagtgctgagttctaccccctctcaaagccctactcccgagtgagcactgtgagagtggccgattctccctgtctccacagtcttccagaagggccctgagtgcctgatatttagtgctcaaatggcacaccagacgttttatagatgttttccttcttcccgagcacaggatgggctctttgargcatgcatgatgatttctgccacggcctcacccacgcaggaggtgatcaattcatatttgtgaccggttcaacattttggttgaatggttttctaaaattaagagaaagtcctcattaacacaagcagcactcatgtacccccgaaacaacgctgaggacagagagctcagccacagggcttcaagcttacacacggcatctgtgaaactgtaatctcgaccacatctgaagattccctgacagatgggactggaatatcctaaacctaatttttccctcacgtgctgaaagttttctct

SEQ ID NO: 198819 - DNA, 601 bp, Human
cccgagtgagcactgtgagagtggccgattctccctgtctccacagtcttccagaagggccctgagtgcctgatatttagtgctcaaatggcacaccagacgttttatagatgttttccttcttcccgagcacaggatgggctctttgaggcatgcatgatgatttctgccacggcctcacccacgcaggaggtgatcaattcatatttgtgaccggttcaacattttggttgaatggttttctaaaattaagagaaagtcctcattaacacaagcagcactcatgtacccccgaaacaaygctgaggacagagagctcagccacagggcttcaagcttacacacggcatctgtgaaactgtaatctcgaccacatctgaagattccctgacagatgggactggaatatcctaaacctaatttttccctcacgtgctgaaagttttctctaaaggctgtgaggaggttcttggttcctcagagtccaaagacccagacccctatgctatgaagaagcatgtgacccatccatggccccgtatttcacgtgggggccgcaggagaggcccacacagcccgtgtcctttcttgcacgcatgcc

SEQ ID NO: 198820 - DNA, 601 bp, Human
gctgtcagtctgtgccctgctcagtcaggaggggtctgctcctcctccaaattcttccataaaatccactctctaaattgactatggcttgtgtgggttcacacagtccccgcacgctgtactgctttctcagggagcctggttgctttccttcgggaatgacgtggttgatacaagggaggggactgtctctttcccgaccctggaccgtgcagtgaagatctcatgaggaatctgtaaatggccacgtcagggtagatcttgaaagtgtcgtcccgatggtcgtgccaggcacatctayggtaagaagcgtctgatgcaagagcaggaggagtttctgagtcactgttcctgggagaaccatccaccttttgacagtcaaattcacttaccgtgaaaggtgacttctatttagggtggaagaaatgccaaaaaggaatgctgcccactcagatgcaaacgcttcctcccctgacgaaggagggagtcttcacacaaaccttcctcccctgatgaaggagggagtcttcacacaaaccttcttcccctgatgaaagagggagtcttcacacaaaccttcttcccctgatgaaagagggag

SEQ ID NO: 198821 - DNA, 601 bp, Human
tccccgcacgctgtactgctttctcagggagcctggttgctttccttcgggaatgacgtggttgatacaagggaggggactgtctctttcccgaccctggaccgtgcagtgaagatctcatgaggaatctgtaaatggccacgtcagggtagatcttgaaagtgtcgtcccgatggtcgtgccaggcacatctacggtaagaagcgtctgatgcaagagcaggaggagtttctgagtcactgttcctgggagaaccatccaccttttgacagtcaaattcacttaccgtgaaaggtgactyctatttagggtggaagaaatgccaaaaaggaatgctgcccactcagatgcaaacgcttcctcccctgacgaaggagggagtcttcacacaaaccttcctcccctgatgaaggagggagtcttcacacaaaccttcttcccctgatgaaagagggagtcttcacacaaaccttcttcccctgatgaaagagggagtcttcacacacatccttcctcccctgatgaaagagggagtcttcacacaaaccttcctcccctgatgaaagagggagtcttcacacacacctgctgcctagagccc

SEQ ID NO: 198822 - DNA, 601 bp, Human
gaatctgtaaatggccacgtcagggtagatcttgaaagtgtcgtcccgatggtcgtgccaggcacatctacggtaagaagcgtctgatgcaagagcaggaggagtttctgagtcactgttcctgggagaaccatccaccttttgacagtcaaattcacttaccgtgaaaggtgacttctatttagggtggaagaaatgccaaaaaggaatgctgcccactcagatgcaaacgcttcctcccctgacgaaggagggagtcttcacacaaaccttcctcccctgatgaaggagggagtcttcwcacaaaccttcttcccctgatgaaagagggagtcttcacacaaaccttcttcccctgatgaaagagggagtcttcacacacatccttcctcccctgatgaaagagggagtcttcacacaaaccttcctcccctgatgaaagagggagtcttcacacacacctgctgcctagagccctcagaggtgtgatactcgaacaatgtgttcacatgggtcctatgaagaatatattaggagaaacaaaagctatttattgccgctaggagtcatctcccaattgggctggaaataacatgaaaaa

SEQ ID NO: 198823 - DNA, 601 bp, Human
tgcagattgtatcttctttgcaattactttgccattacatgggatttgggaaatcctttctgtgccagggaatgtcttgccgcttacttttctcatggagtatttggaagaaaacagattgttcagtatgtatgctttgcctttgaactttagaagcatttgcctcctttgaagttctactgcaggctgctttcctgttacacctgctgggtggcatgaccagtcccaagagaagacccttgttcccccagcacaggggtgggccggatctcaccaggagcagcagaacgctcgccattcycgaaggaccagggccaccccatctgtgttttttttgttttgtttttgtttttgttttcagacggagtctcgcactgtcacccaggctgcagtgcaatggcgtgatctcggctcactgcaacctctgactcccgggttcaagtgattctcctgcctcagcctcccgagtagctgggattacaggcacctgccaccatgctcagctaattttttttttaaaatagagatggcgtttcactatgttggccaggctggtctcgaactccagaccttgtgatccgcccacctcggcctcccaaac

SEQ ID NO: 198824 - DNA, 601 bp, Human
tggaaagctaccctttatttggtgttaagtatctgcatacgcagggcatttaattctacaactctgatgtagacattatcgtctctactccatggaggagcacactgaggccaggtggcttcagtaatctgcccagggcctcacagcaagttgagaaaaacagagtcaaacccatgtgcctttgaattcagtctgcccattctttcgtggaatcattcattcactcattcaacaaataagcccctgttatgggccagaaacactctagtcactgatgacgcatgattgagcaatacagacygaggccctgccttcaaggagcgtaggagtgtatactttctggttctggttttgcagagacgaggtcttgctatgttgccctggctggtctcaaaactcctggtctccagtgatcctcccagttcagcccccaaagtactgggattacaggcgtgagccgccgcaccaggccaggagataaaagattcaagtcctatggatgaaagtgcctttacaagaaaactcagaactgcctgggaaactcttcactacctggtgtccagtacccaaatccagcatttacccaatgcttcacacttga

SEQ ID NO: 198825 - DNA, 601 bp, Human
ataaggctatagtcaccaaaacagcatggtactggtataaaaataggcacacagaccaatggaacagaatagagaacccagaaataaactcaactacttaacagccaactgatcttcgacaaagcaaacaaaaacaaagtggggaaaggacactctattcaaaaatggtgctgggataattggcaagccacatgtagaagaataaaactggatcctcatctctccccttatccaaaaatcaactcaagatggatcaaggacttaaatctaagacctgaaaccataaaatttctaggaaatrgcattggaaaaactcttccagacattggcttaggcaaagacttcatgacaaagaacccaatagcaaatgcaacaaaaacaatgataaatagctgggacttaaactaaaaagtttctgcacagcaaaagaaacaatcagcagaataaactcattccttcttccagtcatctagcccaaacaatcccactgtatacaaagaaagacctcacaccttccattgcaccaaaagagtttaaaacccagctcaccatgaaagccatggagactttaaaagaaatcccacctggtatttaagaaaat

SEQ ID NO: 198826 - DNA, 601 bp, Human
ccttcaccctggagccatgatgctaacagtgcatggcagccatcagcagcagggcggccaggagggaaccttcagaaaacactgagcccctgtgcgcctgagccacggccttccacgtgctggacagccaccacagaagggctttgccagaggaaaatatggtaaactcaatgcacgcatcccgagctggcccgaggatgctttattccaaagccacctcttgtgactgcctgccctctgcccaattatctcagttatgtgtctgggtgcaacagcttcctccctcccatggctccaggcygccctgctgctcatggaggcacctctcatggtacccaggctgcttcttttccatggccctcaaatgtccctgaggacaatctcacttttaactaaggaggcatccacacctccacacgttcatcagtaattgtgggccttggcagcaacaggtgagtttcccagggctgcagaatcacagagcatgccccatgtatttgatatatggagagaggcagaagggggtgtgggatgggcctgcagctttgcgggtgttggagggatgaggcctttgttgttcaaggactcattgcatcacgct

SEQ ID NO: 198827 - DNA, 601 bp, Human
ggggccagtgagtgaatgacgtcaaccctgtgtgaaggagccagtgagtgaatgacatcacccctatgtgaagactcagtgaatgaatgacatcaccctgcgtgtaggagccagtgagtgaatgacgtcacccatgtgaagagtgtctgaatgatgtcacccctgtgtgaaaggttcagtgagtgatgtcacccctgtgtgagggagacagtgagtgaatgacgtcacccctgtgtgatgagtcactgagtgaatgatatcacccctgtgtgaagcgtcagtgagtgaatgacgttacccmggtgtgagggagccagtgagtgaatgatgtcacccgtgtaaagagtcagtgagtgaatgacgtcacccctatgtgaaggggacagtgagtgaatgatgtcacccctgtgtgaagagtcagtgagtgaatgacgtcactctgtgggagccagtgagtgaatgacgtcacctgtgtgaagagtcactgagtgaatgaagtcaccctgtgtgaaggggccagtgagtgaacaacacgtgtaggcaggcacccctcggtccacaggcaggtgggcacacagcccgggccggcctcttgtctcac

SEQ ID NO: 198828 - DNA, 601 bp, Human
ggccctccagaggctcccacacattggcataggacatgtgcagaatgttctagagccttcggtggttacagcaccaaaggtttgacacttggctgcagcgacactgtccttcaggagattttcatccttccccttaaacactggtttccactgcctctaaataacttaccaaagctgctgaaatcacctttcacttctctaaacaggttccctcatgtaattaacaagagccatgggctcgcagctccttccctcccacccagtctctgcgaccgagcaacaggagccaaacagaaacccyagggccccgtacttactccacgtcagcgaacgcgctgctgggcacctgcaggaggcgggcgacgtcctccaccagccgccttccttcctcggggcgcagggggctgcggatgacagcagggatggggagcagtcaccacagagccagcagtcctggagaactaaagccctgtggccccacagccccgctccctggtccccacacacaccctgctctcctggcctggggtcagctgccccctcaggcacaaggagtcacctgagtttccagcaacaagacaaacagtgcagtgcggacggg

SEQ ID NO: 198829 - DNA, 601 bp, Human
catgtgcagaatgttctagagccttcggtggttacagcaccaaaggtttgacacttggctgcagcgacactgtccttcaggagattttcatccttccccttaaacactggtttccactgcctctaaataacttaccaaagctgctgaaatcacctttcacttctctaaacaggttccctcatgtaattaacaagagccatgggctcgcagctccttccctcccacccagtctctgcgaccgagcaacaggagccaaacagaaaccccagggccccgtacttactccacgtcagcgaacgcrctgctgggcacctgcaggaggcgggcgacgtcctccaccagccgccttccttcctcggggcgcagggggctgcggatgacagcagggatggggagcagtcaccacagagccagcagtcctggagaactaaagccctgtggccccacagccccgctccctggtccccacacacaccctgctctcctggcctggggtcagctgccccctcaggcacaaggagtcacctgagtttccagcaacaagacaaacagtgcagtgcggacggggctgtgggaatcgcaagtggcccaccgtgtggag

SEQ ID NO: 198830 - DNA, 601 bp, Human
agtcacagagcagctgggtggacatggcctggagacgagtgcaggaggccgtcagctggggcaggggcctgagctggccaccacggctgtccggtggggagcctggggatctggagggacatctgaggccatgccggtggagtccgctggcgctgggaaaacacaagatgggcagaagccccaggaaggcccagctgggagtggtgctgacagagtcaggagtttacatcctgcacacgtggacatggggaccccagcagggcgtccaggctaggtgctgaggggcgacgtgtctgtcagygcagaggtcaaaggccccagcggggcatccaggctgggtgctgagggcagtgcatccatgtgtgcagaggtcagaggccccagcagggtgcccaggctgggtactgaggggcgatgtgcctgtgagtgcagaggtcagaggccacagcagggcgtccaggctgggtgctgggggcagtgcatcatgaatgccgagaccggggagctgtacgaccagaggtgttcactggcctcaggagggtgactgaagctggagcacctaagacggagccttgccccccagcatttaggatcccccagc

SEQ ID NO: 198831 - DNA, 601 bp, Human
gtgcatccatgtgtgcagaggtcagaggccccagcagggtgcccaggctgggtactgaggggcgatgtgcctgtgagtgcagaggtcagaggccacagcagggcgtccaggctgggtgctgggggcagtgcatcatgaatgccgagaccggggagctgtacgaccagaggtgttcactggcctcaggagggtgactgaagctggagcacctaagacggagccttgccccccagcatttaggatcccccagcattgagggccccccggcatttagggccccccagcattgagggccccccarcatttagggcaatgaggggaactggcaaaagagaatgaaaaggactgtgacagaggcaagcagcgagctggcaagaattccaagaaggagaagggccgggcctcagattggtccagagagatgaggatggggagctgaggccgagcttagcgggtcatgatggctgtgggctgacctcacaggagctcttctgcaaggctgtagggacctgcagcctgttcagcattggagggatggagagtaggaaaggagagatggggccaacactgtaagagctgcccagggttctgggggcaagag

SEQ ID NO: 198832 - DNA, 601 bp, Human
cagcagggtgcccaggctgggtactgaggggcgatgtgcctgtgagtgcagaggtcagaggccacagcagggcgtccaggctgggtgctgggggcagtgcatcatgaatgccgagaccggggagctgtacgaccagaggtgttcactggcctcaggagggtgactgaagctggagcacctaagacggagccttgccccccagcatttaggatcccccagcattgagggccccccggcatttagggccccccagcattgagggccccccagcatttagggcaatgaggggaactggcaaaasagaatgaaaaggactgtgacagaggcaagcagcgagctggcaagaattccaagaaggagaagggccgggcctcagattggtccagagagatgaggatggggagctgaggccgagcttagcgggtcatgatggctgtgggctgacctcacaggagctcttctgcaaggctgtagggacctgcagcctgttcagcattggagggatggagagtaggaaaggagagatggggccaacactgtaagagctgcccagggttctgggggcaagaggggcagtttctgttaagctggaagacgtcta

SEQ ID NO: 198833 - DNA, 601 bp, Human
ggagctgaggccgagcttagcgggtcatgatggctgtgggctgacctcacaggagctcttctgcaaggctgtagggacctgcagcctgttcagcattggagggatggagagtaggaaaggagagatggggccaacactgtaagagctgcccagggttctgggggcaagaggggcagtttctgttaagctggaagacgtctaggatgctagcatagggataggagtgatgagacaaggtgctggatgtagggcatggctgtgtgtgcccagagcaggcagaggccttcggcaggagtaggasaatggtaacagaactggcaccagggctggagaccccaggcattctctatccatgacttacactcagggaccccttggggagaggacctcagcagggcctgcagattcagactcatgagcaggcgcatgccgtgactagtctagcctcagagcgcagctgcactagctggagagagagggtagttcttgggggttatgaatccttcctggggacagagagacgcattgaggtggattctcatgggcctcgcacctgcaacaagaaagccatctgatggcgtcgacgctaaagctgttgttg

SEQ ID NO: 198834 - DNA, 601 bp, Human
cctcgcacctgcaacaagaaagccatctgatggcgtcgacgctaaagctgttgttgtggccaccagggacacagcctaccatccttggccaggacttcgaggcacgtagcaatccgggaccagctggggcacaggccgccttccactcagggaggagccacatctgagctcaggggctgagcctgtcccaaaagcccggtacctccagggagaccggtggcccctacatctgggtacccctcagagccacctggggagggtgtccaggcccatgcctgtcctgcccagccagtgtggctgsaactggagcccaggacagtgtatttaaaataaaaaaaccaaaccaaacaaaaaaaccctttgtaggtgaaggtgacagctggtccagtttgggagtggttacagcaatggaaagatgaggctgcatccacgtaccacaggccttccctgcccagtccagggctctgggacctgagtgggccaaggactcaccaggatgggccaaggactcaccaggaatgcagatgccccagccaccctccagcgtttcggagtcaggaggccacaggtcaggcctgggaatctgtgtttctcgtgggtt

SEQ ID NO: 198835 - DNA, 601 bp, Human
taaaatcagcaacaaagccacatgacttccaaccctagactaacgtaggtcgctcagcttcaggcaatctacacatcagttgggagggatgtggaagacgtgccgcgggaatgctctactcttcatctaagaaatacttcctgagcacttgtggtaccaggctgagccaggagctatggaagcagagatgagagaggaggaggagccagcggcccccggcagcctctaatctggcaggaacaacggtaaagaatatgcattaaaaaacccatggcaaaccccagggaaaagagaagccacyggccacggccctggggcctacatgggagcctggtccaggctggggtaagggagccccagaagggtccccaagaactaccacagggctgagagaatggatcgtgttactagtctaaggcacagagcgcgagaggcagacgcagggatggaaacagcaagcaaatgccctcgggtagcacagtcactcagagaacttgagagaaggggcaggggaggcacggatggctagaaggaagggagccaactacatgggtgctcctcacccattaagggattggagtttatcccaaatacaatggcg

SEQ ID NO: 198836 - DNA, 601 bp, Human
ccccagaagggtccccaagaactaccacagggctgagagaatggatcgtgttactagtctaaggcacagagcgcgagaggcagacgcagggatggaaacagcaagcaaatgccctcgggtagcacagtcactcagagaacttgagagaaggggcaggggaggcacggatggctagaaggaagggagccaactacatgggtgctcctcacccattaagggattggagtttatcccaaatacaatggcgagctatcaacagggcctaggcaagggcactgtcccactctcctggtcccagctwctcagaaggctgaggagccaagatcactggagtccaggagctcaaggctgcaatgagctatgattgcacctgtgaatatccactgcatcccagcctgggtgaaagagcaagaccccatatccaaaataacaacaacaacaacaacaaaagttccctcccctggataaagaacaggttggagaccagaggagacagaagggaaacagctggtggcctccagattgtctcaatgagacatgagctcaagcagcatggaccgtggtaatggtgactgaagtggacatggtcatagactgcgat

SEQ ID NO: 198837 - DNA, 601 bp, Human
tgatccttgaactctgaagcctaatgaaggcctccgacttctagtggaaggtctggatacaccttgcagtcaatgtcagctttcatcacagtaggagctaccgctactcaccttcagccctgtggcaagcagctgtgcacatgttcctggagcagcctgcacacactggcaggagccagaacaggcaatacagatgttgtcctccaaatattgggaatctgcaatctcactgctgattgctgcttctcatcacagaggtgcaggaaaggaggagggcaccattgtttggccacctcctcaytgttgttgctcctccccctctggccaaaatgacttacaggggatttaaaatgctaacacccatttttcccaccttcatttttctctttttccgcttttgggagccagaaattaaagaccagaatattcaaaagtaactgaatatacagggaaaattagaaagtcaccacacatgctcagggaaaggctcagataataccacaagtttacacctcaggctgatccttggcacaaagacagcctacaaaaaatttaaaagaaagataaacaaaaaatagcaaacctatggagagacaatctg

SEQ ID NO: 198838 - DNA, 601 bp, Human
gagccagaacaggcaatacagatgttgtcctccaaatattgggaatctgcaatctcactgctgattgctgcttctcatcacagaggtgcaggaaaggaggagggcaccattgtttggccacctcctcactgttgttgctcctccccctctggccaaaatgacttacaggggatttaaaatgctaacacccatttttcccaccttcatttttctctttttccgcttttgggagccagaaattaaagaccagaatattcaaaagtaactgaatatacagggaaaattagaaagtcaccacacwtgctcagggaaaggctcagataataccacaagtttacacctcaggctgatccttggcacaaagacagcctacaaaaaatttaaaagaaagataaacaaaaaatagcaaacctatggagagacaatctgatttccagagttagattaaaatttctagttttcaacaaaaaattgcaagaaacaagaaacaaagaaacaagaaactacagcccattcaaaggaaaaaggtaagtcaacaataattgtctctaaaaaaagacctgatggcagatgtactaggcaaagactttaaaacaattgt

SEQ ID NO: 198839 - DNA, 601 bp, Human
ggagccagaaattaaagaccagaatattcaaaagtaactgaatatacagggaaaattagaaagtcaccacacatgctcagggaaaggctcagataataccacaagtttacacctcaggctgatccttggcacaaagacagcctacaaaaaatttaaaagaaagataaacaaaaaatagcaaacctatggagagacaatctgatttccagagttagattaaaatttctagttttcaacaaaaaattgcaagaaacaagaaacaaagaaacaagaaactacagcccattcaaaggaaaaaggtaagtcaacaataattgtctctaaaaaaagacctgatggcagatgtactaggcaaagactttaaaacaattgtcataaaaatgcttgaagaacaaaagaaagatgtaaagaaagtcagaaaaattatgtatgaaaaatgaaaatgtcaaagagaaaacctaaaatataaaagaaattctgaagctcaaaatacaatagctgaaattaaaaagttcactagagagattcaaaggcagatttgagcaagaaaaataaagaatcagtgaacttgaagataggacaatggaaattattcagtcta

SEQ ID NO: 198840 - DNA, 601 bp, Human
agaccagaatattcaaaagtaactgaatatacagggaaaattagaaagtcaccacacatgctcagggaaaggctcagataataccacaagtttacacctcaggctgatccttggcacaaagacagcctacaaaaaatttaaaagaaagataaacaaaaaatagcaaacctatggagagacaatctgatttccagagttagattaaaatttctagttttcaacaaaaaattgcaagaaacaagaaacaaagaaacaagaaactacagcccattcaaaggaaaaaggtaagtcaacaataatkgtctctaaaaaaagacctgatggcagatgtactaggcaaagactttaaaacaattgtcataaaaatgcttgaagaacaaaagaaagatgtaaagaaagtcagaaaaattatgtatgaaaaatgaaaatgtcaaagagaaaacctaaaatataaaagaaattctgaagctcaaaatacaatagctgaaattaaaaagttcactagagagattcaaaggcagatttgagcaagaaaaataaagaatcagtgaacttgaagataggacaatggaaattattcagtctaagaaatagaaaaaaa

SEQ ID NO: 198841 - DNA, 601 bp, Human
gcaggttccttcctcccggctcctgtgctccccagcagcctgggcttttctctctgcctgggcctggtggtgactgctccaaagggccagcctacctgctcccatcgctgacctgccttgcctcagccccctgcaccccagcctccctgggcctccccatccttggagccattaggaagagggcaggtgcagaagggcaggtggagaaggctaggaccgaccacaccactccaatcagcaaagacagaaactgctgctcttcaggctttccctaaaactccctgtgtgctttgatcagcaycactcagctcatgacttattttaaaaggtctccagtactttcatattttaatcctgcctccccctacaaactgcaaactcattgagggcaggagccacgtgtcatctgagtttgtttcttccaagcctactgccccctgcggagcataagccaacttcccaatcaatgtttgctaccaaattccatgagtctccttttctagcatgtttcaaaccaaggggatggtatgaggacatgggaggggctccaccacgaatcctgggcccagccctctgccctccatgctccaatatggaaacc

SEQ ID NO: 198842 - DNA, 601 bp, Human
ggctgactgtgctcacaatgatcacgcagccattcctatttcatctctaaagccacagccatcatctgtcattccgaggcctgaacttccttagaaagcagttggacgtcatcctgaaaatgagtgggaggatccagcaggtgcgacgtgctgtgtctgcatgtggcggcttccaccctcaatacctggacactaatattgccgtagaagagaaacaggcatgagaacttttatggggtcagggtcagagctaggagtgcctgtgagggcagtggaaaggactttcaaagctgaagatggygtctcctctctctagagtctttcagttctgaaggacagtggcaagtttgtgacgtctctaagctcaaccacgttggacaagcctgttcctatggatctactgaatcagccacatgggaggccctaaggcctcggcaagcactcactggagggaggctcagagtaagaagtgacagtgtccctcttccacggtgtcctctcagccccggcacagtgctgggtcttccgtgtggcatccacgtcaccccgaaatgagtgcacgggtggacgcatgagcagaaaatgactacgggagtgtcac

SEQ ID NO: 198843 - DNA, 601 bp, Human
ctgtatctcaggaccagtggagtcacagccagattccaacaggagagggtgacggggccagatttggttttgtcgagtcctctttgggttcaacgtgcacggcgggtgagaaagaaagagccgtgatgctggtgcgcaagagagaaggccccgcagtgcggaggcaagaggctcagatggcctggaccagggtgggagaagggaagaggggagaaggggagacagcatggatggagccataggaggggagacagctggccatggagggagccgggtggggcacagagcccactgagctgcygggctggcgagacatggctcaggcccaaccatggccacccccctgcctcaagtgcctcccacggccgcctccctgtctcgagtccctcccagggccacctccctgcctgaagtccctcccagggctgcccccctgtctcgagtccctcccagggccacctccctgcctcaagtccctcccacggccgaccccctgcctcaagtccctcccagggccacctccctgcctcaagtccctcccacagccgccccctgcctcgcgtccctcccacggccacccccctgcctcgcgtacttccca

SEQ ID NO: 198844 - DNA, 601 bp, Human
tttgcacattcttccctcagccggcctccccgcaagactcagggctccaacctctccagcttcccctcgtggaaatccattggctcctcctctttcaagcaacactgtgttcttcccactgctgacagaggctgctcatccgtgcacctgtgccctgcgtcctcctctgcgtgcaccctgcgtcctcctctgcttgcgccctgcatcctctgcacgtggcccgggctctgctccacctgagccccgttcatctctccacagtccaggagccacacactgcggctgccactccagagaccargaaacccaagcacaggggcgtttgccacattctaggtctcggggctgccgtgggaccctgaccctggatgccggacttccgtgggtcaagggcccaggccaccttctccaacagcactgtggccgccaccccagactcaagcctctgcctcagctcccatgttttcctgactacaggtttcacttccccaaaatccacctcactggctcagcgtggtcgttccgcagaatacatcccaatccagtggggtctggggtaggcagagagaggcatgtgtgtgtgagccgtggtctctgaagc

SEQ ID NO: 198845 - DNA, 601 bp, Human
tgtgtgtgtgagccgtggtctctgaagctcttgcctctggatttagaaggcaggttcctctttgctgagaggtaaggggctccctcctccctatacctggtgtccgtcctgtgattccttctggaaacctaacatgaaatcattttaaagttgtccttggaggactggggcggctgtcctgcccttcgtccagtcttcaagaatccctctagtttgtaaaaaggataaaaatgtaaatggcaaaggattactgtgtccatcagaaaatgtgagagagaaaatcatgcctggaaaagccgasccctaccatcctcccatctgaacctcagcaccaagagcatgtggatgctgaggtgacaccgagttctaaaccacattcctctcctttctgtgggacaaccaaatgtacaaaagtcccccttttttaaagaatgccatctgtgtcttggaaattaatagctgatctgttaaggtttaagctgaaatctggtgaaaacttgcccaagagaatcacaaattattagtctgataatagggcaaaaacctcaatctccttgcaagaagagaggagacctcacctagtgcatcacaccttgctcaa

SEQ ID NO: 198846 - DNA, 601 bp, Human; identical to SEQ ID NO: 26075

SEQ ID NO: 198847 - DNA, 601 bp, Human; identical to SEQ ID NO: 26076

SEQ ID NO: 198848 - DNA, 601 bp, Human; identical to SEQ ID NO: 26077

SEQ ID NO: 198849 - DNA, 601 bp, Human; identical to SEQ ID NO: 26078

SEQ ID NO: 198850 - DNA, 601 bp, Human; identical to SEQ ID NO: 26079

SEQ ID NO: 198851 - DNA, 601 bp, Human; identical to SEQ ID NO: 26080

SEQ ID NO: 198852 - DNA, 601 bp, Human; identical to SEQ ID NO: 26081

SEQ ID NO: 198853 - DNA, 601 bp, Human; identical to SEQ ID NO: 26082

SEQ ID NO: 198854 - DNA, 601 bp, Human; identical to SEQ ID NO: 26083

SEQ ID NO: 198855 - DNA, 601 bp, Human; identical to SEQ ID NO: 26084

SEQ ID NO: 198856 - DNA, 601 bp, Human; identical to SEQ ID NO: 26085

SEQ ID NO: 198857 - DNA, 601 bp, Human; identical to SEQ ID NO: 26086

SEQ ID NO: 198858 - DNA, 601 bp, Human; identical to SEQ ID NO: 26087

SEQ ID NO: 198859 - DNA, 601 bp, Human; identical to SEQ ID NO: 26088

SEQ ID NO: 198860 - DNA, 601 bp, Human; identical to SEQ ID NO: 26089

SEQ ID NO: 198861 - DNA, 601 bp, Human; identical to SEQ ID NO: 26090

SEQ ID NO: 198862 - DNA, 601 bp, Human; identical to SEQ ID NO: 26091

SEQ ID NO: 198863 - DNA, 601 bp, Human; identical to SEQ ID NO: 26092

SEQ ID NO: 198864 - DNA, 601 bp, Human; identical to SEQ ID NO: 26093

SEQ ID NO: 198865 - DNA, 601 bp, Human; identical to SEQ ID NO: 26094

SEQ ID NO: 198866 - DNA, 601 bp, Human; identical to SEQ ID NO: 26095

SEQ ID NO: 198867 - DNA, 601 bp, Human; identical to SEQ ID NO: 26096

SEQ ID NO: 198868 - DNA, 601 bp, Human; identical to SEQ ID NO: 26097

SEQ ID NO: 198869 - DNA, 601 bp, Human; identical to SEQ ID NO: 26098

SEQ ID NO: 198870 - DNA, 601 bp, Human; identical to SEQ ID NO: 26099

SEQ ID NO: 198871 - DNA, 601 bp, Human
ggcacccatggcgctgcagtcacctggaaagctgtctccacggagggtggccttggggccatccgcctgttctccagactctcccagggccgctctcccagggctgcctcgagctactccatggtccacgccttgcatcaggccagccatcagctcagccatgccgtccagctccaggccactcaggcccctcacctcagccggctgcctctgcaggtccttcaggagggtatgaatccgtgctcctaggggcacacacacaaacacaaggacgttgtgggtggacgaatgcaaaggtgasggcctccagaccataggggtgtggtgggcgtctgcggcgtcccaaggcagtggccacctagggccaggcgcaggccagtgctcagagaagattgggatattggacttgaatctcaaatccacctgaccctgtaaccatcactagttcagttccccagaggtggaaaacccacagaatggaaggacagactcatccacgcgctcaggaggatggaaagcacagcttccagaaaacactggaatgaccaagccaggaagagagatgggctaggcaacttcaccatgtcctccagaggataaa

SEQ ID NO: 198872 - DNA, 601 bp, Human
agaggtggaaaacccacagaatggaaggacagactcatccacgcgctcaggaggatggaaagcacagcttccagaaaacactggaatgaccaagccaggaagagagatgggctaggcaacttcaccatgtcctccagaggataaaagaatgggatgagctgtgtccccctcacttggcagaaggagaaacaatgcctggcaaggacagcgccctgcccaggacaccctgcccagcacaccctgcccagcacaccctgcccagcacaccctgcccagcatggaccaactctaattacatctaaacacagccacacagggtcaaagcctcgtccaagaaagtaactgctgccggaaaagccccttaaaggaaggtggcagggtctaggcccccacttcacacaagcagcaacagatgcaggaggaggcagaaaaacagaacccgaaattgagaatagggcagtcgatgattagagccaggagacaaggccatttgtggagctgccataaccacggagagatgtgtgcacccgctgctcagcagagtggggaaattaaaacagaatccaacacacattctgtaagtgaagagcacggcgtctga

SEQ ID NO: 198873 - DNA, 601 bp, Human
tggcagaaggagaaacaatgcctggcaaggacagcgccctgcccaggacaccctgcccagcacaccctgcccagcacaccctgcccagcacaccctgcccagcatggaccaactctaattacatctaaacacagccacacagggtcaaagcctcgtccaagaaagtaactgctgccggaaaagccccttaaaggaaggtggcagggtctaggcccccacttcacacaagcagcaacagatgcaggaggaggcagaaaaacagaacccgaaattgagaatagggcagtcgatgattagagcsaggagacaaggccatttgtggagctgccataaccacggagagatgtgtgcacccgctgctcagcagagtggggaaattaaaacagaatccaacacacattctgtaagtgaagagcacggcgtctgaaatttaaaatttatgtccattacgggtggacataacggaagaaacggtttgtgaatctgaagacagatcatagaagcgatcatcgttggaagaacagaatgggagacgttctgcagaacctcagtcacccctggggcatccaagccgtcggagtcaggagggcacgggggggcg

SEQ ID NO: 198874 - DNA, 601 bp, Human
gccctgcccaggacaccctgcccagcacaccctgcccagcacaccctgcccagcacaccctgcccagcatggaccaactctaattacatctaaacacagccacacagggtcaaagcctcgtccaagaaagtaactgctgccggaaaagccccttaaaggaaggtggcagggtctaggcccccacttcacacaagcagcaacagatgcaggaggaggcagaaaaacagaacccgaaattgagaatagggcagtcgatgattagagccaggagacaaggccatttgtggagctgccataaccrcggagagatgtgtgcacccgctgctcagcagagtggggaaattaaaacagaatccaacacacattctgtaagtgaagagcacggcgtctgaaatttaaaatttatgtccattacgggtggacataacggaagaaacggtttgtgaatctgaagacagatcatagaagcgatcatcgttggaagaacagaatgggagacgttctgcagaacctcagtcacccctggggcatccaagccgtcggagtcaggagggcacgggggggcgggaaaggaaccagaaacacctgaaagaaagcccac

SEQ ID NO: 198875 - DNA, 601 bp, Human
acagccacacagggtcaaagcctcgtccaagaaagtaactgctgccggaaaagccccttaaaggaaggtggcagggtctaggcccccacttcacacaagcagcaacagatgcaggaggaggcagaaaaacagaacccgaaattgagaatagggcagtcgatgattagagccaggagacaaggccatttgtggagctgccataaccacggagagatgtgtgcacccgctgctcagcagagtggggaaattaaaacagaatccaacacacattctgtaagtgaagagcacggcgtctgaaatytaaaatttatgtccattacgggtggacataacggaagaaacggtttgtgaatctgaagacagatcatagaagcgatcatcgttggaagaacagaatgggagacgttctgcagaacctcagtcacccctggggcatccaagccgtcggagtcaggagggcacgggggggcgggaaaggaaccagaaacacctgaaagaaagcccacaagtctctcaaatctgggaaggattgtcactcagggactcaagacagtcactaagttccacgataataaaatgcaaggagaaccacgccatgact

SEQ ID NO: 198876 - DNA, 601 bp, Human
aagtaactgctgccggaaaagccccttaaaggaaggtggcagggtctaggcccccacttcacacaagcagcaacagatgcaggaggaggcagaaaaacagaacccgaaattgagaatagggcagtcgatgattagagccaggagacaaggccatttgtggagctgccataaccacggagagatgtgtgcacccgctgctcagcagagtggggaaattaaaacagaatccaacacacattctgtaagtgaagagcacggcgtctgaaatttaaaatttatgtccattacgggtggacataayggaagaaacggtttgtgaatctgaagacagatcatagaagcgatcatcgttggaagaacagaatgggagacgttctgcagaacctcagtcacccctggggcatccaagccgtcggagtcaggagggcacgggggggcgggaaaggaaccagaaacacctgaaagaaagcccacaagtctctcaaatctgggaaggattgtcactcagggactcaagacagtcactaagttccacgataataaaatgcaaggagaaccacgccatgacttcagctgagctactgcaagtcagagatggaga

SEQ ID NO: 198877 - DNA, 601 bp, Human
gagccaaaaagctcctgaaagggtaaatatgtggttacataaacaagaaagaccgtcttcttttctcctcttactttatctaaaaaacaactgattgttagcaaggaaaaattattaccactttaaggtagggttcataaaacagctgcaggcatgaactggatggcacaagaggctagagggagctgaagcctcctcaccgcgtccaggaagtggcacagtgacaactccgaggagactgtttcaaaggcgccagggcgtttcaacagagaaaggaaagtcttttccaaaaggacatctyccgtattacccagaaattggactcgtaagtatttacccgagagaagtgaaacccgtaaccatgagagttaaatgagactgtgggtagcagcctgactcctcatagttccacagacagagtctaaagtccatgtgcccggcagcaggagagcggataaggaggccacatccacaccagcactgagccagaaggaaccacagagacgagaagggggacagacctagaaccagtcaggctgagtgagagaagccggtcaccagagaatccacagaatcctgttaacagaagatgaagttcaag

SEQ ID NO: 198878 - DNA, 601 bp, Human
ctttatctaaaaaacaactgattgttagcaaggaaaaattattaccactttaaggtagggttcataaaacagctgcaggcatgaactggatggcacaagaggctagagggagctgaagcctcctcaccgcgtccaggaagtggcacagtgacaactccgaggagactgtttcaaaggcgccagggcgtttcaacagagaaaggaaagtcttttccaaaaggacatcttccgtattacccagaaattggactcgtaagtatttacccgagagaagtgaaacccgtaaccatgagagttaaaygagactgtgggtagcagcctgactcctcatagttccacagacagagtctaaagtccatgtgcccggcagcaggagagcggataaggaggccacatccacaccagcactgagccagaaggaaccacagagacgagaagggggacagacctagaaccagtcaggctgagtgagagaagccggtcaccagagaatccacagaatcctgttaacagaagatgaagttcaaggatgggcgaggtctgcccagggcaaccagagccgcatcacctgcaggtggggctggggcaggaggaagcgtcg

SEQ ID NO: 198879 - DNA, 601 bp, Human
taaaaaacaactgattgttagcaaggaaaaattattaccactttaaggtagggttcataaaacagctgcaggcatgaactggatggcacaagaggctagagggagctgaagcctcctcaccgcgtccaggaagtggcacagtgacaactccgaggagactgtttcaaaggcgccagggcgtttcaacagagaaaggaaagtcttttccaaaaggacatcttccgtattacccagaaattggactcgtaagtatttacccgagagaagtgaaacccgtaaccatgagagttaaatgagactrtgggtagcagcctgactcctcatagttccacagacagagtctaaagtccatgtgcccggcagcaggagagcggataaggaggccacatccacaccagcactgagccagaaggaaccacagagacgagaagggggacagacctagaaccagtcaggctgagtgagagaagccggtcaccagagaatccacagaatcctgttaacagaagatgaagttcaaggatgggcgaggtctgcccagggcaaccagagccgcatcacctgcaggtggggctggggcaggaggaagcgtcgggtgtga

SEQ ID NO: 198880 - DNA, 601 bp, Human
tcatgggcccatttccgagctttgaaggaaaacctgactttcttttgtattcagtgttgaaatctctgtcctcataaaggtttatgtaaaatagctcatggccacgtctctaccttcccgaacgacaccggcagagtgacgcagaggggacacagaatgtcctgacctcagtggggtctcaccacgaccctccactgtaggggggtcccgctgccaccctccacgctagaggggtctcaccacgaccctccaccctagacaggtcccgccgcaaccttctgccctagagggatcccactgygaccctctgccctagagggatctcggcacaatcctctacaatagaagcggaggaattatttctgctttttacaaattaagaaatgtaggcattttaggttttttgtctgcgtcaaatgcatcaccaggcctgggctgcagcctgcagtgtctgcacagggctcgacagtggcactgcctgtggcacccccgttcactcagccgcacgtcccgtcctctctccacagcgcaggctgtgtctagtccatgccgaggcagcggggccggcacccggtccccacgtgccccgttcactgcatac

SEQ ID NO: 198881 - DNA, 601 bp, Human
attcagtgttgaaatctctgtcctcataaaggtttatgtaaaatagctcatggccacgtctctaccttcccgaacgacaccggcagagtgacgcagaggggacacagaatgtcctgacctcagtggggtctcaccacgaccctccactgtaggggggtcccgctgccaccctccacgctagaggggtctcaccacgaccctccaccctagacaggtcccgccgcaaccttctgccctagagggatcccactgcgaccctctgccctagagggatctcggcacaatcctctacaatagaagmggaggaattatttctgctttttacaaattaagaaatgtaggcattttaggttttttgtctgcgtcaaatgcatcaccaggcctgggctgcagcctgcagtgtctgcacagggctcgacagtggcactgcctgtggcacccccgttcactcagccgcacgtcccgtcctctctccacagcgcaggctgtgtctagtccatgccgaggcagcggggccggcacccggtccccacgtgccccgttcactgcatacgcaggacaggagtcagtgtctggggccgcctagactcgcatgactttc

SEQ ID NO: 198882 - DNA, 601 bp, Human
tgcctgtggcacccccgttcactcagccgcacgtcccgtcctctctccacagcgcaggctgtgtctagtccatgccgaggcagcggggccggcacccggtccccacgtgccccgttcactgcatacgcaggacaggagtcagtgtctggggccgcctagactcgcatgactttccaaacacaagtgccgatggcctgtggtgggttctttgagtgaaaattttttaagtgcagtctctcttgcccattaattgaagctggttcttcagggggcgtcttgctacacggctgtaaggacacattttttgaagtgttttgcttcatttctgaacactctctgctgcaccccatcccccaccagggtctcgcatggaaagggtcacagccatgaccctctgattttcccctttgaaaacctgagtcctgtcagcgccactccagacttgctgttgatgactaagaccctctgatgtaaaggcctgaacgtccatgacaggcatttctgagacagcattatgtgtagtttagcatgggatgaagcggacagagtcctttaaagtcaatctgtacacgaaatgtgtgacggacacgggcgttctgat

SEQ ID NO: 198883 - DNA, 601 bp, Human
agggattggcatggaggccgcgtactcttctgttttttcattagccttgagccttggaggggagggccagcctcccttcgccacacccccagggcccaccaacccccacacatcagccctcaccatgcattcactgatggaatgctaccttcaaagaaagcttccagcaacaaactcaggaaaatacatctcactttctcacaaacaaaaacatgcctaaaaccgcagcaaagcctgccttcaccgctactcctgtctgcaggtgacaaagggctgaagggctggacagtcccaggtcaayggcacccatgccccagctccttccacgctgacaggctcacgttgtttcacagagaagataaaagatgtgctccggaattaaaggtgcgtgtataccacagccctcggtgctgttttgaaaatgtgctgctcattgcagctttcagaatcagaagagccatctcagcctcgcaaccgagccaccgagccacgagcccagagcaaccttttcattctcattcactgcagtctcctcccaccacagatctttttctttcccagcgattatcatcgcgacagtcttatctcgctcgtccacgtc

SEQ ID NO: 198884 - DNA, 601 bp, Human
caagtgctttctgagtgaatgagtgaactcaggagaatcaggagcccgtgtgattggccgggacttcgcaagtgctttctgaatgaatgagtgaactcgggagaatcaggagcccgtgtgattggccgggacttcgcaagtgctttctgaatgaatgagtgaactcgggagaatcaggagcccgtgtgattggccgggacttcgcaagtgcttcctgaatgaatgagtgaactcgggagaatcaggagcccgtgtgattggccgggacttcgcaagtgcttcctgaatgaatgagtgaackcgggagaatcaggagcccgtgtgattggccgggacttcgcaagtgctttctgaatgaatgagtgaactcgggagaatcaggagcccgtgtgattggccgggacttcgcaagtgctttctgagtgaatgagtgaactcgggagaatcaggagcccgtgtgattggccgggacttcgcaagtgctttctgagtgaatgagtgaactcgggagaatcaggagcccgtgtgattggccgggacttcgcaagtgcttcctgaatgaatgagtgaacgcgggagaatcaggagcccgtgtgattgg

SEQ ID NO: 198885 - DNA, 601 bp, Human
agcccgtgtgattggccgggacttcgcaagtgctttctgaatgaatgagtgaactcgggagaatcaggagcccgtgtgattggccgggacttcgcaagtgctttctgaatgaatgagtgaactcgggagaatcaggagcccgtgtgattggccgggacttcgcaagtgcttcctgaatgaatgagtgaactcgggagaatcaggagcccgtgtgattggccgggacttcgcaagtgcttcctgaatgaatgagtgaacgcgggagaatcaggagcccgtgtgattggccgggacttcgcawgtgctttctgaatgaatgagtgaactcgggagaatcaggagcccgtgtgattggccgggacttcgcaagtgctttctgagtgaatgagtgaactcgggagaatcaggagcccgtgtgattggccgggacttcgcaagtgctttctgagtgaatgagtgaactcgggagaatcaggagcccgtgtgattggccgggacttcgcaagtgcttcctgaatgaatgagtgaacgcgggagaatcaggagcccgtgtgattggccgggacttcgcaagtgctttctgagtgaatgagtgaactcg

SEQ ID NO: 198886 - DNA, 601 bp, Human
gtgattggccgggacttcgcaagtgctttctgaatgaatgagtgaactcgggagaatcaggagcccgtgtgattggccgggacttcgcaagtgctttctgaatgaatgagtgaactcgggagaatcaggagcccgtgtgattggccgggacttcgcaagtgcttcctgaatgaatgagtgaactcgggagaatcaggagcccgtgtgattggccgggacttcgcaagtgcttcctgaatgaatgagtgaacgcgggagaatcaggagcccgtgtgattggccgggacttcgcaagtgcttyctgaatgaatgagtgaactcgggagaatcaggagcccgtgtgattggccgggacttcgcaagtgctttctgagtgaatgagtgaactcgggagaatcaggagcccgtgtgattggccgggacttcgcaagtgctttctgagtgaatgagtgaactcgggagaatcaggagcccgtgtgattggccgggacttcgcaagtgcttcctgaatgaatgagtgaacgcgggagaatcaggagcccgtgtgattggccgggacttcgcaagtgctttctgagtgaatgagtgaactcgggagaat

SEQ ID NO: 198887 - DNA, 601 bp, Human
tggccgggacttcgcaagtgctttctgaatgaatgagtgaactcgggagaatcaggagcccgtgtgattggccgggacttcgcaagtgctttctgaatgaatgagtgaactcgggagaatcaggagcccgtgtgattggccgggacttcgcaagtgcttcctgaatgaatgagtgaactcgggagaatcaggagcccgtgtgattggccgggacttcgcaagtgcttcctgaatgaatgagtgaacgcgggagaatcaggagcccgtgtgattggccgggacttcgcaagtgctttctgartgaatgagtgaactcgggagaatcaggagcccgtgtgattggccgggacttcgcaagtgctttctgagtgaatgagtgaactcgggagaatcaggagcccgtgtgattggccgggacttcgcaagtgctttctgagtgaatgagtgaactcgggagaatcaggagcccgtgtgattggccgggacttcgcaagtgcttcctgaatgaatgagtgaacgcgggagaatcaggagcccgtgtgattggccgggacttcgcaagtgctttctgagtgaatgagtgaactcgggagaatcagga

SEQ ID NO: 198888 - DNA, 601 bp, Human
tgagtgaactcgggagaatcaggagcccgtgtgattggccgggacttcgcaagtgctttctgaatgaatgagtgaactcgggagaatcaggagcccgtgtgattggccgggacttcgcaagtgcttcctgaatgaatgagtgaactcgggagaatcaggagcccgtgtgattggccgggacttcgcaagtgcttcctgaatgaatgagtgaacgcgggagaatcaggagcccgtgtgattggccgggacttcgcaagtgctttctgaatgaatgagtgaactcgggagaatcaggagcccktgtgattggccgggacttcgcaagtgctttctgagtgaatgagtgaactcgggagaatcaggagcccgtgtgattggccgggacttcgcaagtgctttctgagtgaatgagtgaactcgggagaatcaggagcccgtgtgattggccgggacttcgcaagtgcttcctgaatgaatgagtgaacgcgggagaatcaggagcccgtgtgattggccgggacttcgcaagtgctttctgagtgaatgagtgaactcgggagaatcaggagcccgtgtgattggccgggacttcgcaagtgct

SEQ ID NO: 198889 - DNA, 601 bp, Human
tggccgggacttcgcaagtgcttcctgaatgaatgagtgaactcgggagaatcaggagcccgtgtgattggccgggacttcgcaagtgcttcctgaatgaatgagtgaacgcgggagaatcaggagcccgtgtgattggccgggacttcgcaagtgctttctgaatgaatgagtgaactcgggagaatcaggagcccgtgtgattggccgggacttcgcaagtgctttctgagtgaatgagtgaactcgggagaatcaggagcccgtgtgattggccgggacttcgcaagtgctttctgartgaatgagtgaactcgggagaatcaggagcccgtgtgattggccgggacttcgcaagtgcttcctgaatgaatgagtgaacgcgggagaatcaggagcccgtgtgattggccgggacttcgcaagtgctttctgagtgaatgagtgaactcgggagaatcaggagcccgtgtgattggccgggacttcgcaagtgctttctgaatgaatgagtgaacttgggaataaccacgcgaagcgttgcatggctggagagttgcacggccggcagcagaaacaagttcttccagcttccacatga

SEQ ID NO: 198890 - DNA, 601 bp, Human
aagcagcgtataaatattacatgctcatggctagcaggacatgggtttggatcataatctcaaaagatacagtcccaattgccataatcccaaatagtgaatccccaaatatctgaatatcaaaatctctaaatagagtctaaatcccaaaagtctagtgttgctaatgtttaaaatcccctaaatcataaccacaggagagttgcatcctgctgggtggagctattagcttgttattgtctttatttggaaattaagcataacttaaggagttgtgtgtgagtgccaagttgacaagggrtgaaaccatagacttcgttttaggtgtcaacttgactgggttaaggaatacctagaaatccagtaaagcttcattttgggtgtttctgggaggtgtctccagggagactggggtggagtctgagagggctgggggaaggtctgcctcagtgttggtgggcgggcactgtccaaacagctggggcccagagaaaacaaacacagagggtgaattaggctccctctgagtgctggggcagactttccttctgctgccctggacatcagagctccaggtttggcggcctttggactccaggac

SEQ ID NO: 198891 - DNA, 601 bp, Human; identical to SEQ ID NO: 26100

SEQ ID NO: 198892 - DNA, 601 bp, Human
gggaaaagaattcagcaatatttctcctacttgctttctgcaagaagaaaaataaggctctattctgcccgaccccgcaggcagtcagaccttaatgttatcttcccttgttccctgaagatcgctgttgttctgttccttttcagggtgccctgatttcatattgttcaaacacatgttttacagtttgtaccattaatgcaatcatcacaggatcccgaggtgacatacatcctcagcttatgaagatgatgggattaagagattaaagacaggcataggaaattataagagtattgaktggggaaatgataaatgtccatgaaatcttcacaatttatgttcagagactgcagtaaaaacaggcataagaaattatgaaagtactaattttgggaactgataaatgtccatgaagtcttcacaatttatgttttgccgcagcttcagccggtccctccatttggggtccctgacttcccgcaacaacttccaccatcaacaatatcatctccactatctccaccatcaacagcagcatccccaccaccatcatcttcaccatcatcatcccaccatccacagcagcatccccaccatc

SEQ ID NO: 198893 - DNA, 601 bp, Human
aaatcttcacaatttatgttcagagactgcagtaaaaacaggcataagaaattatgaaagtactaattttgggaactgataaatgtccatgaagtcttcacaatttatgttttgccgcagcttcagccggtccctccatttggggtccctgacttcccgcaacaacttccaccatcaacaatatcatctccactatctccaccatcaacagcagcatccccaccaccatcatcttcaccatcatcatcccaccatccacagcagcatccccaccatcatcatcttcaccatccacagcagsatccccaccattatcacttccaccatcaacatgatccctgccatcatcacctcaaccatcagcttcccaccatcatcatcagcagcagcagcagcaccatcatcatccacaccatccacagcagcatccacaccatcagtgtcacccccgccatcagcatcatcaaacccctactgctgctgtgtgccaagccctggacttctatgaaggaagaataactcagatgtggccctgtcctcaaacatcttgcagactgaactaggagttgagtcatagacattaacaaccgtaattgaaaga

SEQ ID NO: 198894 - DNA, 601 bp, Human
atgtccatgaagtcttcacaatttatgttttgccgcagcttcagccggtccctccatttggggtccctgacttcccgcaacaacttccaccatcaacaatatcatctccactatctccaccatcaacagcagcatccccaccaccatcatcttcaccatcatcatcccaccatccacagcagcatccccaccatcatcatcttcaccatccacagcagcatccccaccattatcacttccaccatcaacatgatccctgccatcatcacctcaaccatcagcttcccaccatcatcatcakcagcagcagcagcaccatcatcatccacaccatccacagcagcatccacaccatcagtgtcacccccgccatcagcatcatcaaacccctactgctgctgtgtgccaagccctggacttctatgaaggaagaataactcagatgtggccctgtcctcaaacatcttgcagactgaactaggagttgagtcatagacattaacaaccgtaattgaaagaatgctattagaaagggtcagaaaagcaatcctggttttggaagaatgtgattctcttcagctggaggaaatcagagctgctt

SEQ ID NO: 198895 - DNA, 601 bp, Human
cctgtgaatgcaggcgtccctcctcttggatagacatccagaggggaactgctgagtccaaggacagacgtatctttagcctttaagcagcttccaaatacaggttataacagcttgcattgcattcccgctaatttgagaatttctatgtcctcatcaagagttggttttatggatttttttttaattttagccaatctagtgacatgaagtggttgttctttatggttttgtgaataaggatgctaagcacctttgatgccttcattggccatttgtatatctttttatgaagtatccrttcaaagtttttatacatttttgcatgggattgcttgcctcttttccctttggagcactactgagatataattgacatacaataaacagtacaggaggcatgacaatgaacacgtccgtcaccctgaatacattccggtgcccctggagacactgccctctcccatccctgtccacagctccaggcaatcccgaccagctttctgtcccttataacccagtttgcattttctacagctttccaaactggaattataacaatagctcctcttttgtcttttggtcaacagaaatgagactc

SEQ ID NO: 198896 - DNA, 601 bp, Human
tattgaatgcttttcctgcatctatcgagataatcgtatggtgtttgtttttaactgtttatgtgacgtatcacatttattgacttgcatgtgttaaaccatccctgcatccctgggatgaaacccacttgatcatggtttattatctttttgatgtgctgttgggttcagtcagctagtatttcgtagagggtttttgcctctatgttcatcagggatattggtctatagtttgcttttgttcattattttatccctgattttagtgtcagagtgatactggcttcatagaattagttakggaggattctctctgccctgatcctttggaatagtttcagtagaattggtaccaattctttgagtgtctggtataattcagctgtgaatccatctggtcctgggctttttttgttatgggcaatttttaagttactgattcaatctcactgcttgttattagtctgttcagggtttttattccttcctaatttaatctaggagggttgtatgcttgcaggaatatattcgtgtattcatttcttctagattttctagtttgtatgcatagaagtgttcataatagtcgtgaatgatcttt

SEQ ID NO: 198897 - DNA, 601 bp, Human
ccgcgatggggaaggccgccacgctcgccccctgtatggggaaggccgccacgctcgccccctgatggggaaggccgccacgctcgccccctgtagggggaaggccgccacgctcgccccgcgatggggaaggccgccacgctcgccgcctgatggggaaggccgccacgctcgccccctgtatggggaaggccgccacgctcgccccctgagggggaaggccgccacgctcgccccctgatggggaaggccgccacgctcgccccctgatggggaaggccgccacgctcgccccctgtaytggaaaggccgccacgcccgccccctgtagggggaaggccgccacgctcgccgccttgtatggggaaggccgccacgctcgcccgctgtatggggaaggctgcttccagagcactccggggcgtgtgttgagaatgctggtgctggaatcctagtgcagtaagccaggaatggaaagacttcagtaaatacaactggttagtgtgacgaggccacgggccctttggcctaatgagcactgagctgctgagtccagcagaaccactgagcacctggaaagcatcccaggacatgcagtaca

SEQ ID NO: 198898 - DNA, 601 bp, Human
cgcgatggggaaggccgccacgctcgccccctgtatggggaaggccgccacgctcgccccctgatggggaaggccgccacgctcgccccctgtagggggaaggccgccacgctcgccccgcgatggggaaggccgccacgctcgccgcctgatggggaaggccgccacgctcgccccctgtatggggaaggccgccacgctcgccccctgagggggaaggccgccacgctcgccccctgatggggaaggccgccacgctcgccccctgatggggaaggccgccacgctcgccccctgtackggaaaggccgccacgcccgccccctgtagggggaaggccgccacgctcgccgccttgtatggggaaggccgccacgctcgcccgctgtatggggaaggctgcttccagagcactccggggcgtgtgttgagaatgctggtgctggaatcctagtgcagtaagccaggaatggaaagacttcagtaaatacaactggttagtgtgacgaggccacgggccctttggcctaatgagcactgagctgctgagtccagcagaaccactgagcacctggaaagcatcccaggacatgcagtacac

SEQ ID NO: 198899 - DNA, 601 bp, Human
gatggggaaggccgccacgctcgccccctgtatggggaaggccgccacgctcgccccctgatggggaaggccgccacgctcgccccctgtagggggaaggccgccacgctcgccccgcgatggggaaggccgccacgctcgccgcctgatggggaaggccgccacgctcgccccctgtatggggaaggccgccacgctcgccccctgagggggaaggccgccacgctcgccccctgatggggaaggccgccacgctcgccccctgatggggaaggccgccacgctcgccccctgtactggraaggccgccacgcccgccccctgtagggggaaggccgccacgctcgccgccttgtatggggaaggccgccacgctcgcccgctgtatggggaaggctgcttccagagcactccggggcgtgtgttgagaatgctggtgctggaatcctagtgcagtaagccaggaatggaaagacttcagtaaatacaactggttagtgtgacgaggccacgggccctttggcctaatgagcactgagctgctgagtccagcagaaccactgagcacctggaaagcatcccaggacatgcagtacactgt

SEQ ID NO: 198900 - DNA, 601 bp, Human
ccacgctcgccccctgtatggggaaggccgccacgctcgccccctgatggggaaggccgccacgctcgccccctgtagggggaaggccgccacgctcgccccgcgatggggaaggccgccacgctcgccgcctgatggggaaggccgccacgctcgccccctgtatggggaaggccgccacgctcgccccctgagggggaaggccgccacgctcgccccctgatggggaaggccgccacgctcgccccctgatggggaaggccgccacgctcgccccctgtactggaaaggccgccacgcycgccccctgtagggggaaggccgccacgctcgccgccttgtatggggaaggccgccacgctcgcccgctgtatggggaaggctgcttccagagcactccggggcgtgtgttgagaatgctggtgctggaatcctagtgcagtaagccaggaatggaaagacttcagtaaatacaactggttagtgtgacgaggccacgggccctttggcctaatgagcactgagctgctgagtccagcagaaccactgagcacctggaaagcatcccaggacatgcagtacactgtgctcggcctaggaa

SEQ ID NO: 198901 - DNA, 601 bp, Human
tacagaagcctgaaatctcccagcagcagtggaggcagagcacagggccccacagcccttctgataaagacacagcggggcagaggaggaggacaaagcaatgatttcagagctggaggtgctaaattaccaacgttcaagagggtgggagaaatgccagtttccaccgtgctgtgctgagacctgctctgtggtgccgaggcacaggtgtgcggagggaatatgtttgccagtgtcctggcgccctctgattcctctcatcagagtcggagacctccactgagcctggttcagactctcracctaatttctatttcattttttaaagattattttatcaacgatagttacggttacagctattgctgactgggcactccatgaggagcttcacacgtggctctcatgacacctccagggccactacccctggtttacagctgaggactcgaggcacagaagctgagcggctccccctggccccagagcagtgggtggaggagcctctgacccaaggacagagctgcatgaaatccaccttctgcatccacaaaatccagcaggatgtctggcgcaccagacgtgcttagttgctctcagt

SEQ ID NO: 198902 - DNA, 601 bp, Human
cctccactgagcctggttcagactctcaacctaatttctatttcattttttaaagattattttatcaacgatagttacggttacagctattgctgactgggcactccatgaggagcttcacacgtggctctcatgacacctccagggccactacccctggtttacagctgaggactcgaggcacagaagctgagcggctccccctggccccagagcagtgggtggaggagcctctgacccaaggacagagctgcatgaaatccaccttctgcatccacaaaatccagcaggatgtctggcrcaccagacgtgcttagttgctctcagttaatgaataaaaactttaaatttagcctgtttaaaatagtgttaagtggaccagaccctctagggttaggcccacacagagagactcccacaggctcctggaaggctttggggcatgtttttcaggccagccagtggtcctgatgggaggtgggcctggcacagagcagggctgggactggcctttcattgtgagcctaaccttagagggagacctggggcccacagagccctgtgaccctgtacttccacgagggctgaagacccccaccct

SEQ ID NO: 198903 - DNA, 601 bp, Human
cagttaatgaataaaaactttaaatttagcctgtttaaaatagtgttaagtggaccagaccctctagggttaggcccacacagagagactcccacaggctcctggaaggctttggggcatgtttttcaggccagccagtggtcctgatgggaggtgggcctggcacagagcagggctgggactggcctttcattgtgagcctaaccttagagggagacctggggcccacagagccctgtgaccctgtacttccacgagggctgaagacccccaccctccaccatgaggggtgatttcaacmaaccaggaaacacagtccatgatcaggaaaaacacaaatatggcccaggtgccactgggccctcctgagcagcctctcaactgtggcctgtgggtctggcaccccgtggcccctgcatggctctgggccagcatcagggctctgtttggcggccgtggacagactggcttctgcattcaaacgtcattgtgacatcctcctgaagaggcaaggccacagcaaagatggctgcccaggagctgccctcggaaaggctccagagaaccatggggccaaggccgggccttccccaggcaccac

SEQ ID NO: 198904 - DNA, 601 bp, Human
agtcgtcataaaaatcatgcctgcttttccatttacaaaatttactgagattcctaattccgtgtccttaagatgttgagtgggcttcgcatagtgaagggtcttgggtggctctgtgatgcgggtccttgcagctcccactcgccctgcataaacactcctggggttcgcctccgagcctgtctggggtctgtgtgcccagggcatcaccttgtgttttggtgcccagaccctcatgcccacaggcagatggagcccttacgctgccctgggctgcccccggggcaggcttgccggggarcaggagctttccttggatgcagtagttgcacctggtgccccctaattccagccatgttcatggcccctcagtctacctcagtcaggtttcagtgtccactgctgtcccggatcctttctcaaagggtgaagagcagccacctatctcctctacctccctggtgtgcatctgtggtttaaatggtgggctttctggagtcacgacaccttgtcccaagaaagatcctacagagcctcacccagaggactaagcatttgtgggggtggctggactgggagcaggtgtcgctctaaggggccc

SEQ ID NO: 198905 - DNA, 601 bp, Human
ggtgaagagcagccacctatctcctctacctccctggtgtgcatctgtggtttaaatggtgggctttctggagtcacgacaccttgtcccaagaaagatcctacagagcctcacccagaggactaagcatttgtgggggtggctggactgggagcaggtgtcgctctaaggggccccaggaacaccgaagccctgttcacaggatgcccgctggcccgggaaacaggcgcaaagccaagaggagccagcgactaaggaaacatgcccaggtacctgcaccctgaaggaaaagccaaccccrgcccggggaggaagtggaagggtcacctcagcggggggtctgtcctgcgccgtatgggtcctggcgagcacgtctgaggctggggcctgggacagggcctccaggaagggcaggtggcgtcggagggcgttggccagggcagcaccgccctcccgactgtacctcctctcgctgccaacgctgtgttttgagggcctgaaaaagcaaaagaaaccagacatcaaccgcatgtttgctggtgcctggagctgctctgtcccctgtggtgcctgggtgcatgcaaggggctgggagccgggc

SEQ ID NO: 198906 - DNA, 601 bp, Human
gtgtcgctctaaggggccccaggaacaccgaagccctgttcacaggatgcccgctggcccgggaaacaggcgcaaagccaagaggagccagcgactaaggaaacatgcccaggtacctgcaccctgaaggaaaagccaaccccggcccggggaggaagtggaagggtcacctcagcggggggtctgtcctgcgccgtatgggtcctggcgagcacgtctgaggctggggcctgggacagggcctccaggaagggcaggtggcgtcggagggcgttggccagggcagcaccgccctcccgastgtacctcctctcgctgccaacgctgtgttttgagggcctgaaaaagcaaaagaaaccagacatcaaccgcatgtttgctggtgcctggagctgctctgtcccctgtggtgcctgggtgcatgcaaggggctgggagccgggctctcggtggccggcctggccttgctgctccatgaccatgggtttgaacttctcccgggcccccgagcctgtgtcctgcacgaggatggctaacagcacctgcctcgtggttgtggggatggacgattgacccctgctgagagcagaagacaggaagc

SEQ ID NO: 198907 - DNA, 601 bp, Human
atgtacttcgccacagcctcgggacgtccatgcagtgctctcagcccctccgctgcagtccctgctgttaaacagtgattcacgcaccgccatcgcgtgcaccatgcagggcagggacgccggaggctagaaggacaaacacatgggacgcttcccgtgggcagacacatgtggtgcccaccctgctgagggcggcaggggtagggccagcgaggacaaggccaagaaccaggcacggctggccaggggccccatgggacagctgcgtgctgaaggcataaatccaggaggcagctggacstgtcagccacatgtggcccccactaatgatgctcagagtccctgagaaagcagccacttgccagtggggcccccatcaccagcttgtgcagccacacggaaaggaagagcagaaccagggagattcactggaaaagtcgcggtaacgcccaacaggccccggagagacagagtcaggactccccatgtttatggggagccctggtggaggcctgggcatgcacagaggatgtccgtggccccctgagcctgcgccctgtccccctttaccctcagctgtggcggagagcttgcctgagcc

SEQ ID NO: 198908 - DNA, 601 bp, Human
tagaaggacaaacacatgggacgcttcccgtgggcagacacatgtggtgcccaccctgctgagggcggcaggggtagggccagcgaggacaaggccaagaaccaggcacggctggccaggggccccatgggacagctgcgtgctgaaggcataaatccaggaggcagctggacgtgtcagccacatgtggcccccactaatgatgctcagagtccctgagaaagcagccacttgccagtggggcccccatcaccagcttgtgcagccacacggaaaggaagagcagaaccagggagattcmctggaaaagtcgcggtaacgcccaacaggccccggagagacagagtcaggactccccatgtttatggggagccctggtggaggcctgggcatgcacagaggatgtccgtggccccctgagcctgcgccctgtccccctttaccctcagctgtggcggagagcttgcctgagccacggggcagcgtctcagcctgggacacgatgggcatggcctccctagggatgggcatggccctccctgcccagctcacccgcagactctgccgctggtctctgcacccaggactcagccgcccagag

SEQ ID NO: 198909 - DNA, 601 bp, Human
cggagagacagagtcaggactccccatgtttatggggagccctggtggaggcctgggcatgcacagaggatgtccgtggccccctgagcctgcgccctgtccccctttaccctcagctgtggcggagagcttgcctgagccacggggcagcgtctcagcctgggacacgatgggcatggcctccctagggatgggcatggccctccctgcccagctcacccgcagactctgccgctggtctctgcacccaggactcagccgcccagagcttcacagcccccacggaggcctttgctttttygcacatgaccaaaagggcccagagcatgctcctaaataaggaagataattcccataggagacgcctctaccagccaggtttaagaacacctgcgtgagtgactgcaccccacctccacattccagcaaggctctgtctcaaaaaaaaaaaaaaaaaaaaggaatataatgtgaggccggcatgggggctcgcagctataatcctggcactttggaagtggaggcaggagggtcactagagcccaggaacttgaggctgcagtaagctacgatagcgccgctgtgctccagcctcaggcaa

SEQ ID NO: 198910 - DNA, 601 bp, Human
acttcaggtccgacttgtgctgcagtggacggtccagacgccacaggccccggcgtcatgccccactgccagcacaagactcaggcctccctcataacaggctttacaggtgcggtcagctgccatctgcttctctcaggccagggagaggctaggtccgaggtggaggcaggtactttcctgagcgcccaggcactggctgcctcagagccctggggcatggctccaccttcaccttctcaacatctaagtctagatcctcgttagggcaagaagcccaaattacagatagtgtataacwgtcacgtttaactgaccacaggttgcctccaagggacatcacaccacttaacatatgaaatacgagccttaaatagatccttgcaattctccctccagctctgatgcaggtgttgacatgaattctgttgacagctatgttatcaacctcacaatacactttcatcatttttgtttaatcaacttctttaaatgtgatttaagtgacaggaaaacaccatctatcggtggatgcagttgccttcgcgtgttctctcattggtttccatctggcacctttcccttctgccagaacggcggc

SEQ ID NO: 198911 - DNA, 601 bp, Human
ggtgcggtcagctgccatctgcttctctcaggccagggagaggctaggtccgaggtggaggcaggtactttcctgagcgcccaggcactggctgcctcagagccctggggcatggctccaccttcaccttctcaacatctaagtctagatcctcgttagggcaagaagcccaaattacagatagtgtataacagtcacgtttaactgaccacaggttgcctccaagggacatcacaccacttaacatatgaaatacgagccttaaatagatccttgcaattctccctccagctctgatgcaggtgttgacatgaattctgttgacagctatgttatcaacctcacaatacactttcatcatttttgtttaatcaacttctttaaatgtgatttaagtgacaggaaaacaccatctatcggtggatgcagttgccttcgcgtgttctctcattggtttccatctggcacctttcccttctgccagaacggcggctttaccagccctggtcatggagctctgtgggtgatgatgtccttcagcgtctgtatttctgagaaagccaataattttacctttgtatctgaaggatacttccatggg

SEQ ID NO: 198912 - DNA, 601 bp, Human
gccttcatcatctcatctctctatgaaatgcacctttttttcctctggctgcttttaaggttggctttttatcactggttttgagaaattttattatgatatttcttagtcttcatgtttcttttttagggggcttattgagctttctggctctgtgagtttatcatttttatcatattgaaacaattttcctcattatttcttcaaatgatttttctgttcctgtctctcccgccttgggactccagttatacagatatttggcctttagatgtgtcccatagctcactggtgttttttatttttttttaattatccttccttgtttccttatggatagttcctattgctgtgtcttcaagttcactaatattttctaccacagtgtctaatctgctattcattccacccatgaaattttcctgtctcctacttattgtgtctgtgtcagttctgtgtctacactgatgaattttatgagttgcattttcctgctccttttcatgccagataatccatgtctatatattcacattgtgaattttaccttattgggtgatggacatttgcaatcccataaatattatttacctttgctctg

SEQ ID NO: 198913 - DNA, 601 bp, Human
gtgaactcaagctgccttggtttccccagaccttcagctctgtctcatcaactctggcaggccactgagcaccactgtccctgaggcagctgggggcaagtgtcatcgccacacagctgcgtcccctcccaaaatggccctccaccatgggggtctgcctcacccacgtttataccccatctagggaggtctgcatcccacactggtccccagcccctgaggaggggtgagggctcctgaggcctctgtcatgaccacactgagtccaacctctcctcggccaaacccgtctcttcacttccccatgaggggtcttcccaagaccctgcatttggacttcaggactacagagtctgctgtccagacacccaaccgagatgtagctccccgggcacccctggggccctgcccacggctagtgaggatcttgggggacttcaatccagtgcccccgatgccagtggaaaggcgactatagatttctccttgagaagtgctccaggccagaagacgatggaaaacatttttaaagtagtgaaagaaaaaaaagtaacccagaattctatatcccatgaaaatatccttcaaatacaaaggtaga

SEQ ID NO: 198914 - DNA, 601 bp, Human
ataaaggagaggtttaattgactcagttcagcatggctggggaggtctcaggaaacgtaacaatcatggcagaaggggaagcaaacacacccttcttcacaaggtggcaggagagagaagtgcaaggagcaaaggggaaagagtcccttataaaaccatcagatctcgtgaaaactcactcactatcatgagaacagcatggagacagccacctccatgattcaattacctcccactgggtccctcccatgacacgtgcagattatgagaactacaattcaagatgagatttgggtggggrcacagccaaacaatatcacttttcaagttacactgatacagatgtaacaggcatataaattaccaaggcttttgcagttctttgcatctcaaatcatggctataatttccttggccattttttaattaatgaaatttcatgttctatgttgtcagagtgtaatttaactgcagttaatttacttttctggtattttgtctacttttctcactaattgctaatcaatgcaaatggaaccacctcataaatgtatctttaaattgtcgtattcatctttgcttcgcctctgtccatgcctgg

SEQ ID NO: 198915 - DNA, 601 bp, Human
ctgatacagatgtaacaggcatataaattaccaaggcttttgcagttctttgcatctcaaatcatggctataatttccttggccattttttaattaatgaaatttcatgttctatgttgtcagagtgtaatttaactgcagttaatttacttttctggtattttgtctacttttctcactaattgctaatcaatgcaaatggaaccacctcataaatgtatctttaaattgtcgtattcatctttgcttcgcctctgtccatgcctggggacttgtttgtgatgctgcagtatgttacggyaatgagagggtttatcattatgccgcgtggtgttgtagcaattaacttgcacattgacttttgctctgtcatccagcttgaagtaggtcaaaacttcatacgtatgaattttgtactttaaaaagatgaaaaatgttttacacttagtagctattcccttctccattggcacacactggccttaggctcacgataatatgagatagtctagattgtcacccagtttgttaaaggaaaaaattccacattacaggcccatcttatgttttatatccaaccttcatggccacctgaagttct

SEQ ID NO: 198916 - DNA, 601 bp, Human
aatttcatgttctatgttgtcagagtgtaatttaactgcagttaatttacttttctggtattttgtctacttttctcactaattgctaatcaatgcaaatggaaccacctcataaatgtatctttaaattgtcgtattcatctttgcttcgcctctgtccatgcctggggacttgtttgtgatgctgcagtatgttacggcaatgagagggtttatcattatgccgcgtggtgttgtagcaattaacttgcacattgacttttgctctgtcatccagcttgaagtaggtcaaaacttcatrcgtatgaattttgtactttaaaaagatgaaaaatgttttacacttagtagctattcccttctccattggcacacactggccttaggctcacgataatatgagatagtctagattgtcacccagtttgttaaaggaaaaaattccacattacaggcccatcttatgttttatatccaaccttcatggccacctgaagttctctgtgaagtcatcggtgctcatatacacagctggtatttgttgtccctgttcctgcctcaggagcatttagcatgatccctggttctctttagccattag

SEQ ID NO: 198917 - DNA, 601 bp, Human
actctcttagcccttagcatgttctcagctcctccttagactttagcatgttctcaggttcctggttctcaggtcctccttagtccttagcatgttcttaggctctcagttctcaaggtctcttagcccttagcgtgttctcaggttcctggttctcaggttctcttagcctttagcatgttctcaggttcctggtgaccccttaggtgcgagctctgttcctcacactgggcactcatacctactgctttgctgattttccacactgcgtctctttctggctttctctcatggggcttaytctgcttaagggacctcatgtgtgggaagagaagaaccagcaggagaaatgagcttgtggttgccactctggtaagcccaaaaacagggctggggattctgaagacttcattctaatgtcgcctttatttcatgaatggatgattggttttcagcaagttactcaatctctggagattaactgccttatgtaaagaacaccagctactatgtcactggcccatggtggattcttgttcagctgtgaagctcagaatgctctgaatacacatggagtggagaaagccaggtgacattcttc

SEQ ID NO: 198918 - DNA, 601 bp, Human
ttatttcatgaatggatgattggttttcagcaagttactcaatctctggagattaactgccttatgtaaagaacaccagctactatgtcactggcccatggtggattcttgttcagctgtgaagctcagaatgctctgaatacacatggagtggagaaagccaggtgacattcttcgttagtgtagctacccatgcaagaattcaaaggcttgggcagatcacgcattctgtccttcaccaccatttatccaacaaatgctggcccagggtccatctggtgaagggcacaggcaggcactaggggagcctggttagaagcagctcctgggagtggggagtgaggatgctgaaagccaacacggttccttatcatgcagcaggaatcagaacatgatccctttaatgaggaatgaaacaaatccattactataaaatcgcttgaaaatctagaggtgatggccacaaattaaatccaaaataagacaaaattacgaatactaaagaagaggcaaacgagccacaatccacgtatgagaaggcaaacaagccacaatccacatatgagaagaaaaagccccacagaggaatcagtccccttgc

SEQ ID NO: 198919 - DNA, 601 bp, Human
accaaacatttattgtttcaaaaggatataaaatgacaattacagataatttagaacaaaagcaagtgagaattcatcagttatagaatgatgttaaaattatgctcaaaagcaaattatttatgtgatttcattatttttttaaaaatgaataaatagcgtaaataagttttactgaagaagttttatttaaaagagaacagcaaaaagaagaaaatctaagagataattctttttaaaaatcatgttacaagggtgaaaaaaaagtggttttttttttttgagacagggtctcactctmtctcccaggctagagtgctgtgtgtgatcatgactcactgcagcctcaatcccccgggctcaggtgatcctctctctcagcctcctgagtagccaggcgccaccacacctggctaaagaaaacgtacgtttacaatgcaaaggaatataactacacaagtgctgagtaattttaaaaaccataatagtgagaactaagctctgattttttctcttgtccaaattcctatctaagaggtctgggaagtcataccccacaaaccataaattctcatcagatgggttttatttgaccctatat

SEQ ID NO: 198920 - DNA, 601 bp, Human
tctctcagcctcctgagtagccaggcgccaccacacctggctaaagaaaacgtacgtttacaatgcaaaggaatataactacacaagtgctgagtaattttaaaaaccataatagtgagaactaagctctgattttttctcttgtccaaattcctatctaagaggtctgggaagtcataccccacaaaccataaattctcatcagatgggttttatttgaccctatatatcgtgactgacttttcagtctgactctggcagaacattatgagacaaagggaaaaaatcaaaatatttaacyctaaaatatatttccttgcaatacctggaaattgccctgcaaagtctcttgtgggaaaaatccacattctatagggatctactttcccctttgttttccttccttcctttccagatccaggagataatcaaccaagagccaggcacccttttaggtccaataagaagcatcttacaacctgctttctctgaagtctgctaactgagagcttcctctgcacaataaaacttggtctccacaatcctttatcttaactggaacattttctattgatcccaggtcttcagataaactcaacga

SEQ ID NO: 198921 - DNA, 601 bp, Human
gaaaattcacaaagaagattccaatctcggccagatgtggtggctcatgcctgtaatcctagcactctgggaggccaaggtgggcggatcatgaggtcaggagttcaagaccagcctggccaacacggcaaaaccccatctctactaaaaatacaaaaattagctgggtatggtggcgcgcacctgtagtcccagctactcaggaggctgaggcaagagaattgcttgaacccaagaggtggaggctgtagtgagccaagatcgtgccactgcactccggcctaggtgatgaagcaagagcccaaaaaaaaaaaaaaaaaaaaaaaaagaagaggaaagaaagaggaaagaaaaaggaaggaaggaagggaggaaggaaggagaaaattccaatctcaaagcatatgtattttaaacttttaatctcacttataactcataaaacaaagataacataccatttttcataataaaactggcactgttttaaataataaaaactggcaatttttccaaatgaccacatttaacgttgtttagaaggcacaatccaggcgcctctccatggttgttgctgagtttgatttctcagaggcaggtc

SEQ ID NO: 198922 - DNA, 601 bp, Human
aaattcacaaagaagattccaatctcggccagatgtggtggctcatgcctgtaatcctagcactctgggaggccaaggtgggcggatcatgaggtcaggagttcaagaccagcctggccaacacggcaaaaccccatctctactaaaaatacaaaaattagctgggtatggtggcgcgcacctgtagtcccagctactcaggaggctgaggcaagagaattgcttgaacccaagaggtggaggctgtagtgagccaagatcgtgccactgcactccggcctaggtgatgaagcaagagccmaaaaaaaaaaaaaaaaaaaaaaaaagaagaggaaagaaagaggaaagaaaaaggaaggaaggaagggaggaaggaaggagaaaattccaatctcaaagcatatgtattttaaacttttaatctcacttataactcataaaacaaagataacataccatttttcataataaaactggcactgttttaaataataaaaactggcaatttttccaaatgaccacatttaacgttgtttagaaggcacaatccaggcgcctctccatggttgttgctgagtttgatttctcagaggcaggtcct

SEQ ID NO: 198923 - DNA, 601 bp, Human
tggtgggtttttgtttggtttcctacagaaaagtcttacagactataacagcacattctctttgataaaggaggtattaaaggtagatacaccaggcacagaagcacaaagaggcagcccctgccctcagtgtgcgccgcgtgctgaagtcgcagcccctaacctcagtgtgcgccatgttctggggaaagacgcagcccctgccctcagcgtgagccgcgttctggggaaagacacggcccctgccctcagcgagcgccgtgtggtgaagacgaagcccccgccctcggtgtgcgccgcwtgctggggaaagacgcagcccccgccctcagtgtgtgcggcgttctggggaaagaagcagccgccgccctcagcgtgcgccgtgtggtgaagacgaagcccccgccctcggtgtgcgccgcttgctggggaaagacgcagcccccgccctcagtgtgcgccgcgttctgaggaaagaggcaacccgcgccctcagtgtgtgcggcgtgctgggggacggttaccagttctccacacgttctcactcttgatcctgccaggacacttaactgctttccctatcagatggccatgagcatga

SEQ ID NO: 198924 - DNA, 601 bp, Human
cccagctccaggaagctcggggagggggggagagagagagaccgtccgttcgtttgtctcggagaatgtaagagaaaaaaagtctgcctggtaatccacaaaattcttctagattgtatccaagactgccaaggtgatacatctgtgagtctgaaacagccatgaaattactgggctttgagtggcccctaatgcagatatggctgcagggattaaaaacgtagatcacagaaccaaagtcttttcttttttttttttaatttatttattttttattattatactttaagttttagggtayatgtgcacattgtacaggttagttacatacgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccgcctatgagtgagaatatgcggtgtttggttttttgttcttgcgatagtttactgagaatgatggtttccaatttcatccatgtccctacaaaggacatgcactcatcat

SEQ ID NO: 198925 - DNA, 601 bp, Human
gctcggggagggggggagagagagagaccgtccgttcgtttgtctcggagaatgtaagagaaaaaaagtctgcctggtaatccacaaaattcttctagattgtatccaagactgccaaggtgatacatctgtgagtctgaaacagccatgaaattactgggctttgagtggcccctaatgcagatatggctgcagggattaaaaacgtagatcacagaaccaaagtcttttcttttttttttttaatttatttattttttattattatactttaagttttagggtacatgtgcacattgtrcaggttagttacatacgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccgcctatgagtgagaatatgcggtgtttggttttttgttcttgcgatagtttactgagaatgatggtttccaatttcatccatgtccctacaaaggacatgcactcatcattttttatggctgca

SEQ ID NO: 198926 - DNA, 601 bp, Human
agagagagagaccgtccgttcgtttgtctcggagaatgtaagagaaaaaaagtctgcctggtaatccacaaaattcttctagattgtatccaagactgccaaggtgatacatctgtgagtctgaaacagccatgaaattactgggctttgagtggcccctaatgcagatatggctgcagggattaaaaacgtagatcacagaaccaaagtcttttcttttttttttttaatttatttattttttattattatactttaagttttagggtacatgtgcacattgtacaggttagttacataygtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccgcctatgagtgagaatatgcggtgtttggttttttgttcttgcgatagtttactgagaatgatggtttccaatttcatccatgtccctacaaaggacatgcactcatcattttttatggctgcatagtattccatggtgt

SEQ ID NO: 198927 - DNA, 601 bp, Human
atgcagatatggctgcagggattaaaaacgtagatcacagaaccaaagtcttttcttttttttttttaatttatttattttttattattatactttaagttttagggtacatgtgcacattgtacaggttagttacatacgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccrcctatgagtgagaatatgcggtgtttggttttttgttcttgcgatagtttactgagaatgatggtttccaatttcatccatgtccctacaaaggacatgcactcatcattttttatggctgcatagtattccatggtgtatatgtgccacattttcttaatccggtctatcattgttggacatttgggttggttccaagtctttgctattgtgaataatgccgcaataaacatacgtgtgcatgtgtctttatagcagcatgatttatagtcctttgggtatatacccagtaatgggatg

SEQ ID NO: 198928 - DNA, 601 bp, Human
tttaatttatttattttttattattatactttaagttttagggtacatgtgcacattgtacaggttagttacatacgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccgcctatgagtgagaatatgcggtgtttggttttttgttcttgcgatagtttactgagaatgatgrtttccaatttcatccatgtccctacaaaggacatgcactcatcattttttatggctgcatagtattccatggtgtatatgtgccacattttcttaatccggtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatg

SEQ ID NO: 198929 - DNA, 601 bp, Human
tttagggtacatgtgcacattgtacaggttagttacatacgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccgcctatgagtgagaatatgcggtgtttggttttttgttcttgcgatagtttactgagaatgatggtttccaatttcatccatgtccctacaaaggacatgmactcatcattttttatggctgcatagtattccatggtgtatatgtgccacattttcttaatccggtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacaaagcaatggcaacaaaagac

SEQ ID NO: 198930 - DNA, 601 bp, Human
agcctcaaaaagacaaatctaagatttatcacccttaaagaggagggagagagagaaagaggtagaaagtttagttgaaaggataataatgagaacttctcgaacctagagaaagatgtcagtgttcaagtataggaaggctataagaacactaaacagattcaacccaaataagactacctcaagacatttaattatcaaactcccaaaggtcaggaatgaagaaagaatcctaaaatctgcaaaagaaaataaacaaacaaacaaaaatacaatggagctgcagtacatctggcagcaracttttcagtggaaactttacaggccaggaaacgggattgttatttaaagtgttaaaggaaagaaacccttttattctgaaattgtatatccaacaaaaatgcatttcaaatatgaaggaaaaatactttcccagacaaacaaaagctgaaggattccatcaacagcagacctgtcctataagaaatgctaaagggatttcttccgtctgaaataaaagaatgttagtgagcagtaagaaatcatctaaaggtacaaaactcactggtaatagtaagtacacagaaaaacacagaatatc

SEQ ID NO: 198931 - DNA, 601 bp, Human
aacctagagaaagatgtcagtgttcaagtataggaaggctataagaacactaaacagattcaacccaaataagactacctcaagacatttaattatcaaactcccaaaggtcaggaatgaagaaagaatcctaaaatctgcaaaagaaaataaacaaacaaacaaaaatacaatggagctgcagtacatctggcagcagacttttcagtggaaactttacaggccaggaaacgggattgttatttaaagtgttaaaggaaagaaacccttttattctgaaattgtatatccaacaaaaatrcatttcaaatatgaaggaaaaatactttcccagacaaacaaaagctgaaggattccatcaacagcagacctgtcctataagaaatgctaaagggatttcttccgtctgaaataaaagaatgttagtgagcagtaagaaatcatctaaaggtacaaaactcactggtaatagtaagtacacagaaaaacacagaatatcataacactgtaattgtggtgtgtaaactgctcatatctggagttaaaagactaaaagatgaacttatcaaataactccaacaacttttcagatataaagata

SEQ ID NO: 198932 - DNA, 601 bp, Human
agatgaacttatcaaataactccaacaacttttcagatataaagatataaatagaaacaacaaaaagttaaaaagtagggggatgaagctaaagtgtagagtttttattagttttctctgtgctggtttgttagtttgcttatgtaatcaatgttaagttgtcatccgtttaaaataatgggttataagatgttatttgcaagccttattgtaacctcaaatcaaaaaacataaacagatacaacaaaaagtaaaaagctagaaattaaaacataccaccaaagaaaatcactttcacttaaaaaaaaaagtaaggaaagaaataagaaagagaagaccacaaaacaatcagaaaacaaataacaaaatggcaagagtaagttcttacctatcaataataacaaatacacatggactaaactctccaatcaaaacacacagagtggttgaatggattaaaaaaaagacccaatcatctgttgcctataaaagacacacttcacctataaagacaaatatagactaaaaagaaagggatggaaaaagataatccgtgcaaatggaaaccaaaaaagagcaagagtagcagtacttgtatcag

SEQ ID NO: 198933 - DNA, 601 bp, Human
ccagaagaaatggataaattcctagacacatagaatctaccaggactgaaccatgaagaaatcaaaaacctgaacagatcaataacaaataatgagattgaagctgtaataaagtctccaagcaaagaaaagcctgggacttgatcacttcactgctgaattttaccaaatatttaaagaagaatcttgctcaaactattccaaaagatagaggaggaggaaacacttccaaattcattccattaagccagtattaccctgataccaaaaccaaagacacatcaaaaaataaaacttcacrccaatatccctgatgaatattgatgcaaaaatcgtcaacaatcgtcaactgtcctggggataggacagtctcttctataaatggtgctgggaagactggataaccacatgcagaagaatgaaactagactcctatctcttcctatacaaaaatcacataaaaatggattaaagacataaatctaagacctcaaactatgaaacgactaaaagaaaacactgggaaaactccctagtacactggatagtgtaaagatttatttagtaataccccatgagcacaggcagccaaagcaacttg

SEQ ID NO: 198934 - DNA, 601 bp, Human
acacatcaaaaaataaaacttcacgccaatatccctgatgaatattgatgcaaaaatcgtcaacaatcgtcaactgtcctggggataggacagtctcttctataaatggtgctgggaagactggataaccacatgcagaagaatgaaactagactcctatctcttcctatacaaaaatcacataaaaatggattaaagacataaatctaagacctcaaactatgaaacgactaaaagaaaacactgggaaaactccctagtacactggatagtgtaaagatttatttagtaataccccatragcacaggcagccaaagcaacttgagtaatgctccacaagcacaggcaaccaaagcaaaactggacagatgggatcacatcaagtgaaaaaacctctgcacagcaaaggaaacaatcaacaaagtgaagagatacccacagaataggagaaaatatttgcaaagtattcatctgacaagggattaataaccagaatgtataaaaagctcaaacaactctgtagaaaaaaatttcaataatctaactttaaatgggcaaatagatataactctgaatagacatttctcaaaaaagacattc

SEQ ID NO: 198935 - DNA, 601 bp, Human
ttagatataaaaaacaaacaaaacaatgcagaggtatgggagtttaagcatctcctatgaacttctgtccgtggcatatcttggagaaaatataaccctgggaagaaggaatccactcccagagatgacatacgtcttcccactaagtacaactaaaatctctgagcatacgtaaaacaagcataagactctgaaggatggcaatacgaaggcagagcagagaaggacatggtggtggattccctgggttttctttttgcctcaggtacctcagacttggagtcaaagaggccgcaatccrgaaacaccagcgtgtacacacacacacacacacacacacacacacacacaactaaagcagcctctctctaatcaaggagtcaggaaagaatcaactcagcaagacagaaaaatattagatattaacagctctaccccagcaaaacaccacagaaaaaagtacagcctctccctacccatgccaacaaaggccaaatggggatctagacttcctctttcatgaggctgtaataaggcctcccctcaggcctaccaggtagtgtcagagaaggccaagtagggatccagaactttcatctcc

SEQ ID NO: 198936 - DNA, 601 bp, Human
ccattgggttgtaattaccacaacccctgcagtgccagcagagaccatctgggaagttgaaactcccacccctctccctaaccaatcagtaaaaagaccccaccttcaggtatcaacagaggcctcctggggaatctagacttccatctccctgtcagttacaaggaatcaccaccaccaccccttacccccagaagaggagtgtccaaaaagagacagttaaaatgcaaggtttaaatgagatccagaatcatgacataatacaaaaatgtccagatttcaaaagaaaataactggttayacaaagaacaaagaagatcacaaaataaatagaaaagagacaatccacagaaaccaacactgagatgaccgagatgttaaaattgcctgagaaagattttaaaccagttacgataaaaatgcttcaatgagcaattatgaacacacttgaaacaaatgaaaaagtaggatgtctcagaaaatagatgatgtaaataaaagccaaattgaaatattattactgaaagatacaataaccaaaataaacaacgcagtggatgcacataacagaaggatggagagacagaggaaagaatcagtg

SEQ ID NO: 198937 - DNA, 601 bp, Human
tcatgacataatacaaaaatgtccagatttcaaaagaaaataactggttatacaaagaacaaagaagatcacaaaataaatagaaaagagacaatccacagaaaccaacactgagatgaccgagatgttaaaattgcctgagaaagattttaaaccagttacgataaaaatgcttcaatgagcaattatgaacacacttgaaacaaatgaaaaagtaggatgtctcagaaaatagatgatgtaaataaaagccaaattgaaatattattactgaaagatacaataaccaaaataaacaackcagtggatgcacataacagaaggatggagagacagaggaaagaatcagtgaagtgaggataaaacagtaggaattactcaatgtcaacaacacagagaaaatagtagaaaaacatgataaagcttcagcaactgcggggctataaccaaagatataatattcatgctatcagagtttcaaaaagaggagtgaaagaagacaagatgacaggtctgaaaaggtactcagaaaaataatggctgaaaacttctcaattttggaagaaacatgaacctaaaactttaagaagctaagcatacc

SEQ ID NO: 198938 - DNA, 601 bp, Human
atataggaacagaaaaccaaatactgcgtgttctcacttataagtggaaactaaacacggagtacacacagacacaaaaatgaggatgacagacgccgaggactacaaaaggcagagggtgggaggaagacgtgggttgaaaagctataagggactaggttcactacctgggtggcaggattgttatcacaccaaactgtaacaacacacaattcacccatgcatatgtaccctcaaaccgaaaacaaaagtcaaaagaaaaataaaagagaaagtctcaaatcaataatctgaattcttyaagaatctgtaataaaggagaacacaataaacccaaataaagtagaagaaaataaataataaggataagaaaagaaatcaatgtaatttaagtgagaaaaaaatagagaagataaatgacaatgaaagctggttccttgaaaaaaatcagtaaaattgacaaatctctatcaagactaacaaaaaacaagagagaagacacaaattatcaatataagcaaagaaacaggggaagtcactacagactctgcaaacatcaaaaggataatcagggaataaacaactctacacacataaacct

SEQ ID NO: 198939 - DNA, 601 bp, Human
ttataagtggaaactaaacacggagtacacacagacacaaaaatgaggatgacagacgccgaggactacaaaaggcagagggtgggaggaagacgtgggttgaaaagctataagggactaggttcactacctgggtggcaggattgttatcacaccaaactgtaacaacacacaattcacccatgcatatgtaccctcaaaccgaaaacaaaagtcaaaagaaaaataaaagagaaagtctcaaatcaataatctgaattctttaagaatctgtaataaaggagaacacaataaacccaartaaagtagaagaaaataaataataaggataagaaaagaaatcaatgtaatttaagtgagaaaaaaatagagaagataaatgacaatgaaagctggttccttgaaaaaaatcagtaaaattgacaaatctctatcaagactaacaaaaaacaagagagaagacacaaattatcaatataagcaaagaaacaggggaagtcactacagactctgcaaacatcaaaaggataatcagggaataaacaactctacacacataaacctgacaacatagatgaaatggatcgactccttgaaatcc

SEQ ID NO: 198940 - DNA, 601 bp, Human
tacaaaaggcagagggtgggaggaagacgtgggttgaaaagctataagggactaggttcactacctgggtggcaggattgttatcacaccaaactgtaacaacacacaattcacccatgcatatgtaccctcaaaccgaaaacaaaagtcaaaagaaaaataaaagagaaagtctcaaatcaataatctgaattctttaagaatctgtaataaaggagaacacaataaacccaaataaagtagaagaaaataaataataaggataagaaaagaaatcaatgtaatttaagtgagaaaaaartagagaagataaatgacaatgaaagctggttccttgaaaaaaatcagtaaaattgacaaatctctatcaagactaacaaaaaacaagagagaagacacaaattatcaatataagcaaagaaacaggggaagtcactacagactctgcaaacatcaaaaggataatcagggaataaacaactctacacacataaacctgacaacatagatgaaatggatcgactccttgaaatccacaagttacctcaattcatccaatgtgaaatcaataatttgaatacttctacactattaaggaact

SEQ ID NO: 198941 - DNA, 601 bp, Human
atgattacagcaatcgatgcagaaaagacatttaaaaaattcaacactcattcatgaagaaaactttcagaaaaatagaaatcaaggggcactttatcaagctaacaataaacatctacaaaaccccacatttcactgtacttaatggtgagtaaccatcaaaagctttcactgaagactaggaacaaagcaaggatgtttgctctcaccaatcttattcaacataaagctggaagttccagccagtgcaatagggcaagataaaaaaaaaataaaagatatgcagacacaaaggaagaarttaaactgtacctatgtcctatttcctgattatctacacagaaagccccaaggactctacaaaaaatataaaaacctctcaaacctaataagttcttgtactatatactaacaatgaaggcatgaaaactgaaattaaaatactatttaaaaccactcaaagaatacctaggtgtaaatttaacaaaccacgtacaggacctatgtgctgaaacacaaacaatggtgatgaaagaaaccaaagatcaaaataaatgacagacataccatgttggtagatcagaagattcaacataataat

SEQ ID NO: 198942 - DNA, 601 bp, Human
tcaacataaagctggaagttccagccagtgcaatagggcaagataaaaaaaaaataaaagatatgcagacacaaaggaagaaattaaactgtacctatgtcctatttcctgattatctacacagaaagccccaaggactctacaaaaaatataaaaacctctcaaacctaataagttcttgtactatatactaacaatgaaggcatgaaaactgaaattaaaatactatttaaaaccactcaaagaatacctaggtgtaaatttaacaaaccacgtacaggacctatgtgctgaaacacamacaatggtgatgaaagaaaccaaagatcaaaataaatgacagacataccatgttggtagatcagaagattcaacataataatgatgtcaactctccccagattgatacagaggtttcacataattcctataaaaaatcccagggaaatactttgtagatacagaaaagcaagttatatggaagagcaaaggaactagagtagctaaaacaatttgggaaaataaaaataaagtggaaggagtgatcatatataatttcaagtcttatataggtacaataatcaagactgtgtagtactga

SEQ ID NO: 198943 - DNA, 601 bp, Human
gtaggaaaatttgccttttcaacaaatggtcctggagtgattggacatccacaggcaaaaacaggaacctctatgtaagcttcacagtctacacaaaagcaactcatggacataaatgtaaaaatgcaaaactataaaacttttagaaaaaaacaacagaaaatctttggaagctagagctaggcaaaaagttcttagacttgacatcaaacatcttccataaaaagaaaaattgacaaattggccttcatcaaaattaaaaacttttgctctgtggaaaggccctcttaagagctgaaasaatgagcgcagagttggagaaatattggcaaaccacgtatctgacaaaggactagtatcaggaatatacacagaactctcaaaactaaacattaaaaacattcaattagaaaaagggtgagagatgaaaagacatttcgacaaagaggatctactgatggcaaataaccacacgaagagatgctgaccatcatctcatcagggaaatgtcaattacacccacaatgagatgccaccacacacctatcagaaaggctaaaataaaaaatagggacaacatcaaatgctggaaaggatttgg

SEQ ID NO: 198944 - DNA, 601 bp, Human
aaagaaggaaggctgggaacacaccaggtttgtgggtggggacgacgtttgtttcttctgcaggctgaactgtgtggcagaggagatccccgtgggaggggcaggtggagaatgccagggacagactgctgagagggaaacggaggcggcagagcaagtggtggcagcgtgcatggtggtcccggcttgcatgcaacacgtcaacacttaagcaggcaagggcatagcaaggacagaaaccaaggtgcacgctgcatatgaggaacgaagacagcgcttcccttttttttttttttttttccggtggtatccaagagtaagatatgcatcttgaagtgagacctggggaagtcccacaacacagcacttaccctaatcgcgtgggagcctctcacgtatcactgtgtcctattatatcatatttattctcttctgtctcactttttaaaatttctggctgcaacaccctaaaactctctcagggtcattaatgggctgtggcttgcagtttcaaacacactggatccaggcgacaggctgtttggagggaggagggagccaggctgaggaacagagatgcaaaggtttgggggtgaagctg

SEQ ID NO: 198945 - DNA, 601 bp, Human
tcttctgcaggctgaactgtgtggcagaggagatccccgtgggaggggcaggtggagaatgccagggacagactgctgagagggaaacggaggcggcagagcaagtggtggcagcgtgcatggtggtcccggcttgcatgcaacacgtcaacacttaagcaggcaagggcatagcaaggacagaaaccaaggtgcacgctgcatatgaggaacgaagacagcgcttcccttttttttttttttttttccggtggtatccaagagtaagatatgcatcttgaagtgagacctggggaagtcycacaacacagcacttaccctaatcgcgtgggagcctctcacgtatcactgtgtcctattatatcatatttattctcttctgtctcactttttaaaatttctggctgcaacaccctaaaactctctcagggtcattaatgggctgtggcttgcagtttcaaacacactggatccaggcgacaggctgtttggagggaggagggagccaggctgaggaacagagatgcaaaggtttgggggtgaagctgaagatgactgactgccaagctaggctccagtggcaccagctccaggagaggac

SEQ ID NO: 198946 - DNA, 601 bp, Human
ctgaggaacagagatgcaaaggtttgggggtgaagctgaagatgactgactgccaagctaggctccagtggcaccagctccaggagaggaccctgggtcacaggacgaatggaggcctcagagctactcatcagagagtgcactgtgcgtggataaatgggaggagggaggtcagttgggagaaggtgtgagaaaatggaacagtagaaaatctgtcaaagtaaagaggatgggatagatcctccatctgttttaggagaaaaacaataaaaaagaggtgctgagcagaggagcaaaatcracaataaagacagacagcccaaggtcatgtgctcaggagccaggagaagagagagcttcaagggtgagagagaggcggtattcatttcaaacgcggtaatactgagagataaatcagagtgataagaatcagaaatgaaatctattagcattttattttgcctacaggaaagctgtaaatgagaggctgatttcaaaatatgaacgtggtcagggttgaaatggggctgaggaggagcccctgacgtgtgacgggaagaccccaggtggcgaggaagaagtgtcggggaaaggcggtggt

SEQ ID NO: 198947 - DNA, 601 bp, Human
acagtagaaaatctgtcaaagtaaagaggatgggatagatcctccatctgttttaggagaaaaacaataaaaaagaggtgctgagcagaggagcaaaatcgacaataaagacagacagcccaaggtcatgtgctcaggagccaggagaagagagagcttcaagggtgagagagaggcggtattcatttcaaacgcggtaatactgagagataaatcagagtgataagaatcagaaatgaaatctattagcattttattttgcctacaggaaagctgtaaatgagaggctgatttcaaaatrtgaacgtggtcagggttgaaatggggctgaggaggagcccctgacgtgtgacgggaagaccccaggtggcgaggaagaagtgtcggggaaaggcggtggtcagcacattgcaggatctagattttatgagtagaattcacgactatataaaaaaatacagtggcactctaatcagcagtaaactcatgctcaaaatgctctttacggaagatgaatgtgcagcttgccctcgcatcagcaaggaaagggctggtgagcagagtgtgaaggatgatcccatgcaggaagcctgtaggcttt

SEQ ID NO: 198948 - DNA, 601 bp, Human
ggatgggatagatcctccatctgttttaggagaaaaacaataaaaaagaggtgctgagcagaggagcaaaatcgacaataaagacagacagcccaaggtcatgtgctcaggagccaggagaagagagagcttcaagggtgagagagaggcggtattcatttcaaacgcggtaatactgagagataaatcagagtgataagaatcagaaatgaaatctattagcattttattttgcctacaggaaagctgtaaatgagaggctgatttcaaaatatgaacgtggtcagggttgaaatggggmtgaggaggagcccctgacgtgtgacgggaagaccccaggtggcgaggaagaagtgtcggggaaaggcggtggtcagcacattgcaggatctagattttatgagtagaattcacgactatataaaaaaatacagtggcactctaatcagcagtaaactcatgctcaaaatgctctttacggaagatgaatgtgcagcttgccctcgcatcagcaaggaaagggctggtgagcagagtgtgaaggatgatcccatgcaggaagcctgtaggctttgtgaactgagaggaaacactccttaag

SEQ ID NO: 198949 - DNA, 601 bp, Human
atgtgctcaggagccaggagaagagagagcttcaagggtgagagagaggcggtattcatttcaaacgcggtaatactgagagataaatcagagtgataagaatcagaaatgaaatctattagcattttattttgcctacaggaaagctgtaaatgagaggctgatttcaaaatatgaacgtggtcagggttgaaatggggctgaggaggagcccctgacgtgtgacgggaagaccccaggtggcgaggaagaagtgtcggggaaaggcggtggtcagcacattgcaggatctagattttaygagtagaattcacgactatataaaaaaatacagtggcactctaatcagcagtaaactcatgctcaaaatgctctttacggaagatgaatgtgcagcttgccctcgcatcagcaaggaaagggctggtgagcagagtgtgaaggatgatcccatgcaggaagcctgtaggctttgtgaactgagaggaaacactccttaagaagatgacgtgaagtcaattaaagggatcaggtgggctctccttcccaatcagagaagacagggtcatagttccattcctgggctgctcaactgtgcaca

SEQ ID NO: 198950 - DNA, 601 bp, Human
ggtgacttcactctgctccacagagaagcaaaaacacacacagcactgacacaatcccagcaatggccacacactcaaatacaaaaggagacagttcccaggaacacagaaaattgaaaacaccccaagcagacagcaaaagcatcagaccaccatgtctgcaccatccctcctcataatctgtttggcatcaagagtatgggaaatttcccctcaactcatagcttctatgctggaaaaagtgagggtgaggtggacaatcagcttctccaacctcttgggggccctggctggagacctsttcctgcttcaacccatgggaagcgctgcaaatgtgtgaagggaaacatccctgaggacagccagagataaaagggggaggtgggactatagtccccagccccacaaactctactctgcaactcggtcaaagaggcactccatcagagtggctgctcacagcaccaccctgtagcaggaatgctccacaggtcccctcagcacgaggccccagccagccttctcacactgctggcatatcccctttgagacctctcccattcagtacaggcagcactcagatctttaaccttcagtacag

SEQ ID NO: 198951 - DNA, 601 bp, Human
tttaaccttcagtacaggcagcactcagatctttaaccagagccaaggtaaacctgggcttaaggtgccatctagtgccgaaaaggagacagggacctagaagggggagaaaaagaaattccacaggtaaattatgtgactctctaagcaaatgtatccaataaaaactaaaacaagccaggagacaagactggagtaaataaataatccttcagtgcaaggacacagacacacatcaacaagaaacagcagcaaatgggaaaccatggccttctcaaatggacaaagtaaggaactagcrattggccctaataagatggcaatatgtgagttctcggaccaagaattcaaaatagcagttttaaggaaactcagtgatttccaagataacacagaaaagcaattcagaaatttaacaaagagattgaaacaatttttaaaaattcaaacagaaatcttggaactgagaaatacatttgctgaactgaaaaattcattatagcctctcaaaagcagaatggatcaagcagaggaaggaatcagtgagctcaaagacaggctatttgaaaatacacaatcagggatggaaaaagaacaaaga

SEQ ID NO: 198952 - DNA, 601 bp, Human
acaaaaatcttcaacaaaatattagcaaactgaattcaagaacacattaaaaagatcattcaacatgatcgagtgggattcatcccagggatacaatgacgattcaaaatatgcatatcaataaacataatacatcacattaacagaattaagaacaaaactacatgatcatttcaatagatgctaaaaaagcatttgataaaattcaacatccctttatgataaaacactcatcaaaatgggtatagaaagaacatacctcaaaataataaacgctatatatgacaaatccacagctaayaccataatgaatggggaaacactgaaagccttttctctaacatttggagcaagacaaggatgttcactttcaccatttttatacaacatagcactgaagtcctgaccacagcaattaggcaagagaaagaaatacaggcacccaaattggaaaggaaaaagtcaaattagccttatttgcagacatcatgatcttatcatatttataaaacaccaaagacttcaaaacactgtcagaactgacaaattcagtaaagttgcaggatacaaaatcaacatacaaaaatcagcagcatttata

SEQ ID NO: 198953 - DNA, 601 bp, Human
aaaggcttaaatataagacccgaaactatgaaaccgctaaaagaaaacactaaggaaacactccaggacattgatcagggcaaagatttttttggtaaggcctcaaaagcacagataaccaaagcaaataaagataaaatgagatcacatcaagctaaaaggcttctgcacagcaaaggaaacaaaaaagtgaagaaacaacccacagaatggagaaaatatatgtaaacgatccatctgacaagggattaataaccagaatatataaagagctcaaaacactcaacagcaaaaaaaaaamaaacctctaatttaaaaatgggcaaaagatctgaatagacatttttcaaataaaaacatataaatggccaacaggtacagtcatcaaataaaaacatacaaatggcaaacagatatagtcatcaaataaaaacacacaaatggccaacagatatagtcatcaaataaaaacacacaaatggtaaacagatatagtcatcaaataaaaacatacaaatggccaacagatatagtcatcaaataaaaacatacaaatggtaaaacagatatagtcatcaaataaaaacatacaaatggccaa

SEQ ID NO: 198954 - DNA, 601 bp, Human
atagtcatcaaataaaaacacacaaatggtaaacagatatagtcatcaaataaaaacatacaaatggccaacagatatagtcatcaaataaaaacatacaaatggtaaaacagatatagtcatcaaataaaaacatacaaatggccaacaggtatagtcatcaaataaaaacatacaaatggccaacaggtatagtcatcaaataaaaacatataggtggtaaacagatatagtcatcaaataaaaacttacaaatggccaacagatatagtcatcagagaaatacaaatcaaaatcacartgagatatcatcccactcccgttaaaatggctttttttttcttttgagacggagtcttgctctgtctcccaggctggagtgcaatggcacaatctccgctcactgcaacctccacctcctggattcaagcgattctcctgcctcagcctcccgagtagctgggattacaggcacctgccaccacacccggctaattttttgtatttttagtagagacggggtttcaccatgttggccaggctggtctcgatctcctgacctcatgatctgcctgcctcagcctcccaaagtgatgggatt

SEQ ID NO: 198955 - DNA, 601 bp, Human
gtaaacagatatagtcatcaaataaaaacatacaaatggccaacagatatagtcatcaaataaaaacatacaaatggtaaaacagatatagtcatcaaataaaaacatacaaatggccaacaggtatagtcatcaaataaaaacatacaaatggccaacaggtatagtcatcaaataaaaacatataggtggtaaacagatatagtcatcaaataaaaacttacaaatggccaacagatatagtcatcagagaaatacaaatcaaaatcacaatgagatatcatcccactcccgttaaaayggctttttttttcttttgagacggagtcttgctctgtctcccaggctggagtgcaatggcacaatctccgctcactgcaacctccacctcctggattcaagcgattctcctgcctcagcctcccgagtagctgggattacaggcacctgccaccacacccggctaattttttgtatttttagtagagacggggtttcaccatgttggccaggctggtctcgatctcctgacctcatgatctgcctgcctcagcctcccaaagtgatgggattacaggcatgagccaccgggcctggccca

SEQ ID NO: 198956 - DNA, 601 bp, Human
acaatagcaaaaatatggagtcgacctaagtgtccatcaatggatgaatggatatagaaaatgcagaatatatacacaatggaatagtattctgccataaaaaagggtgcaagcctgtcataggcaccaacatgggaaactggaagtcattatgtgaagtgaaataagccaaacatagaaagacaaatactgcatgttctcactcatatgtgggagctaacaaatggatctcatgagggtgcctccgttgagattggtggttaccagaggatgggaaggggagctgggaggaaggaaggagagacattgactaatggctacaaatagacagaagaaataaaacctagtgtttgatagatcaacagggtgactagagttaacaataatgtatgtatgtttcaaattagccaaaagagaacagcttgactgttcctggcacaaagaaaagatgaatattttaggtgaagatcccaatcaccctgatttgatctttacaaattatacaatggtattaaattatcacatgtaccctgaaaatatgtacatcgattctgtatcaatatagaaaagctttctagagagcccatttttctacactcgg

SEQ ID NO: 198957 - DNA, 601 bp, Human
gggagctaacaaatggatctcatgagggtgcctccgttgagattggtggttaccagaggatgggaaggggagctgggaggaaggaaggagagacattgactaatggctacaaatagacagaagaaataaaacctagtgtttgatagatcaacagggtgactagagttaacaataatgtatgtatgtttcaaattagccaaaagagaacagcttgactgttcctggcacaaagaaaagatgaatattttaggtgaagatcccaatcaccctgatttgatctttacaaattatacaatggtattaaattatcacatgtaccctgaaaatatgtacatcgattctgtatcaatatagaaaagctttctagagagcccatttttctacactcggcacctccacaacaagcaggaagcagccggtgtgaccacacctcccaaaaccaccattacgggctgcttagcattctaggacacggagacgtcgtgggggaaactgcagggtgactgaagaaggagaatcccagaactcccccaaggacgacagtgcagagcccacagcgttgttgaaggggctgggtgagctgtgagtagatcccaggcac

SEQ ID NO: 198958 - DNA, 601 bp, Human
cccaatcaccctgatttgatctttacaaattatacaatggtattaaattatcacatgtaccctgaaaatatgtacatcgattctgtatcaatatagaaaagctttctagagagcccatttttctacactcggcacctccacaacaagcaggaagcagccggtgtgaccacacctcccaaaaccaccattacgggctgcttagcattctaggacacggagacgtcgtgggggaaactgcagggtgactgaagaaggagaatcccagaactcccccaaggacgacagtgcagagcccacagcrttgttgaaggggctgggtgagctgtgagtagatcccaggcaccatcaccatcgtccttgccattgctggccgtcatctctggtcatcgcaaacagagccccttacggtacgttaggggatggggtggaaacgcttggctaaatgaagatgctgctgacattgctacgtggtgcctgccacacaggcaggcaatgtcttcagaggagccccagcttctcctctcccttctcctcctcagatctaggtagggccgcttgtgctcccttggggcatgaaggaaaaacttcacgcaggccaccc

SEQ ID NO: 198959 - DNA, 601 bp, Human
tacactcggcacctccacaacaagcaggaagcagccggtgtgaccacacctcccaaaaccaccattacgggctgcttagcattctaggacacggagacgtcgtgggggaaactgcagggtgactgaagaaggagaatcccagaactcccccaaggacgacagtgcagagcccacagcgttgttgaaggggctgggtgagctgtgagtagatcccaggcaccatcaccatcgtccttgccattgctggccgtcatctctggtcatcgcaaacagagccccttacggtacgttaggggatggkgtggaaacgcttggctaaatgaagatgctgctgacattgctacgtggtgcctgccacacaggcaggcaatgtcttcagaggagccccagcttctcctctcccttctcctcctcagatctaggtagggccgcttgtgctcccttggggcatgaaggaaaaacttcacgcaggccacccctctagccaccgtgctcattcagaagccacaccagacaaacgttgaggggtgggtaaggctgcctgggccctgggccctcagaacctcaagcaaagctgcccgaaggtggggtctgccctggc

SEQ ID NO: 198960 - DNA, 601 bp, Human
aaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtcycggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacagatgatcaataaatactaagggaactcagaggctggcgggat

SEQ ID NO: 198961 - DNA, 601 bp, Human
actccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatcyactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacagatgatcaataaatactaagggaactcagaggctggcgggatcctccatatgctgaacgctggttccccggg

SEQ ID NO: 198962 - DNA, 601 bp, Human
gaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacrgatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacactctgccacttcgccgccacccatgctgccattgcactgatgctggcttctcgtttcctgctccccctctttctgaacaccccccggcagacacagcgcttacatgggagtgcacga

SEQ ID NO: 198963 - DNA, 601 bp, Human
aaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacaratgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacactctgccacttcgccgccacccatgctgccattgcactgatgctggcttctcgtttcctgctccccctctttctgaacaccccccggcagacacagcgcttacatgggagtgcacgaa

SEQ ID NO: 198964 - DNA, 601 bp, Human
tctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacagatgatsaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacactctgccacttcgccgccacccatgctgccattgcactgatgctggcttctcgtttcctgctccccctctttctgaacaccccccggcagacacagcgcttacatgggagtgcacgaaggacac

SEQ ID NO: 198965 - DNA, 601 bp, Human
agggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacagatgatcaataaatactaagggaactcagaggctggcgggatcctccatatgctgaacgctggttccccgggtccccttayttctttctctatactttgtctctgtgtctttttcttttccaaatctctcgtcccaccttacgagaaacacccacaggtgtgtaggggcaacccacccctacactctgccacttcgccgccacccatgctgccattgcactgatgctggcttctcgtttcctgctccccctctttctgaacaccccccggcagacacagcgcttacatgggagtgcacgaaggacacccttccctcacgctgagctcagcacagagcctgcaggagttgcccgcagcccggcggctgccatggagatacac

SEQ ID NO: 198966 - DNA, 601 bp, Human
ggcggctaagtcgctaagtcacgcccgtgtccggctctgattggaaaaggacgccctgggcttggctgggaggaaaggccagagggtccacaggggaaaagctcagctctggggggcatccctccctacagctgggcctggagaggagcccagcacacctgatggccatcgcagatcaggaaaccgtcctcccctccctcctgccctgggccaagcaggtcctgccagttactataaaataaagcggggggtgtgggtggcaccaaaagcacagcaggcgagacgcggggcacaggaaggraggaagccacagcaaggcttctggtctctgccgctcatcagaaacctttcttccgccctcagccactgtccctcttaatccagccacattcacggtttctgtatcacccaaaacatcatgtttgttggaacttattttattttagattcaggtcttgttaaccattgctccaggatgctttactttccttgtcttaaacgggaacttcccaggtcatgttattaagaagtgggtgcccaggaagcacgggtcgcagctccacacggacagaggctcctgggacctgggactggctctagg

SEQ ID NO: 198967 - DNA, 601 bp, Human
ttcaggtcttgttaaccattgctccaggatgctttactttccttgtcttaaacgggaacttcccaggtcatgttattaagaagtgggtgcccaggaagcacgggtcgcagctccacacggacagaggctcctgggacctgggactggctctaggtcatgacagctcagcaggattccagggaccgacggattcagtcctgaggggcagaccaggtcctggtaggtacagcaaggaggactcccctgcaagtctggagcaacaaggccccatgaagggagacaaaaccagggaccctgacayggtggctacaagggcagaggtgagagcagaggtgtgaaggccacgcagcccccaggacgcccccaggacaggctggcctatgctaagccacgcggctccccagactcctgaatggagaagagggtgctggcctcagaggctctcgtgagggccgtggaggggagcggaaagccaggcaggcagctgccacccgagcctggtgtttgctcggtcaaggtgccacagcccccatcaccccggggtgggggccaccaccatgccctgaggaccgagggccttctctgaggccagccagagggt

SEQ ID NO: 198968 - DNA, 601 bp, Human
tcctgggacctgggactggctctaggtcatgacagctcagcaggattccagggaccgacggattcagtcctgaggggcagaccaggtcctggtaggtacagcaaggaggactcccctgcaagtctggagcaacaaggccccatgaagggagacaaaaccagggaccctgacacggtggctacaagggcagaggtgagagcagaggtgtgaaggccacgcagcccccaggacgcccccaggacaggctggcctatgctaagccacgcggctccccagactcctgaatggagaagagggtgcyggcctcagaggctctcgtgagggccgtggaggggagcggaaagccaggcaggcagctgccacccgagcctggtgtttgctcggtcaaggtgccacagcccccatcaccccggggtgggggccaccaccatgccctgaggaccgagggccttctctgaggccagccagagggtcgatgttcctctgcgccttttccaaacagcaggatggtgcagaaacctcaggagggtaaaacccgtcagctattccccttggggcactgtctctctgtgcagggaagagtcagcagttctctctgttg

SEQ ID NO: 198969 - DNA, 601 bp, Human
ctggagcaacaaggccccatgaagggagacaaaaccagggaccctgacacggtggctacaagggcagaggtgagagcagaggtgtgaaggccacgcagcccccaggacgcccccaggacaggctggcctatgctaagccacgcggctccccagactcctgaatggagaagagggtgctggcctcagaggctctcgtgagggccgtggaggggagcggaaagccaggcaggcagctgccacccgagcctggtgtttgctcggtcaaggtgccacagcccccatcaccccggggtgggggccrccaccatgccctgaggaccgagggccttctctgaggccagccagagggtcgatgttcctctgcgccttttccaaacagcaggatggtgcagaaacctcaggagggtaaaacccgtcagctattccccttggggcactgtctctctgtgcagggaagagtcagcagttctctctgttggagcagacgcgacctccagctctaaccaagactctcagaccacgttcaagttgcagccagcaaggagcccggagctggtatcccggagcttgttctttcctggggcgctttgtttcagtccac

SEQ ID NO: 198970 - DNA, 601 bp, Human
aagccaggcaggcagctgccacccgagcctggtgtttgctcggtcaaggtgccacagcccccatcaccccggggtgggggccaccaccatgccctgaggaccgagggccttctctgaggccagccagagggtcgatgttcctctgcgccttttccaaacagcaggatggtgcagaaacctcaggagggtaaaacccgtcagctattccccttggggcactgtctctctgtgcagggaagagtcagcagttctctctgttggagcagacgcgacctccagctctaaccaagactctcagacyacgttcaagttgcagccagcaaggagcccggagctggtatcccggagcttgttctttcctggggcgctttgtttcagtccacaagccaacgctccgtagcgcggcccccaccctcctgccgtgtggggcaaactattcaaagtcccctggccgtcagaaggttccagagggtgtgcagtcactttcctccccattctcacagcagcaggaccaatggggacgtggctttgtctgcatccctgcggcccctgccactgcactcgccaccatcaaaagcttctcctctcggagctcaaggac

SEQ ID NO: 198971 - DNA, 601 bp, Human
ccaaacagcaggatggtgcagaaacctcaggagggtaaaacccgtcagctattccccttggggcactgtctctctgtgcagggaagagtcagcagttctctctgttggagcagacgcgacctccagctctaaccaagactctcagaccacgttcaagttgcagccagcaaggagcccggagctggtatcccggagcttgttctttcctggggcgctttgtttcagtccacaagccaacgctccgtagcgcggcccccaccctcctgccgtgtggggcaaactattcaaagtcccctggccrtcagaaggttccagagggtgtgcagtcactttcctccccattctcacagcagcaggaccaatggggacgtggctttgtctgcatccctgcggcccctgccactgcactcgccaccatcaaaagcttctcctctcggagctcaaggacacatcaaatgatgtcacaccacttcacgcccttctcccagcagccccgcttcagtgcctgggaagctgcacaaaataagattctgttatcaagcaacgctgcacttcccacatctggatgcacgccaagacaagacgtcagtcatttcctggt

SEQ ID NO: 198972 - DNA, 601 bp, Human
ttcctccccattctcacagcagcaggaccaatggggacgtggctttgtctgcatccctgcggcccctgccactgcactcgccaccatcaaaagcttctcctctcggagctcaaggacacatcaaatgatgtcacaccacttcacgcccttctcccagcagccccgcttcagtgcctgggaagctgcacaaaataagattctgttatcaagcaacgctgcacttcccacatctggatgcacgccaagacaagacgtcagtcatttcctggtgaaatgaaagaaagccacgcttcctccacgsccattgggtcacgaaatccttgctaatcctggccggggcactggaggatgctataaacaatcacggatctgagcaggtggatgaagggaacgtagatgacacgttgagggtgtggtgcgggcaatacacagactaagagtgggaactggcgaagtgagctataatcccaagcataaaggaaaggaggggaggtggcctccagcgcctctcctactagttaaaggagagagagggagaaaaataccactggaacctccaggcaggtcagacgggcacttggggcttatgtgcattatttga

SEQ ID NO: 198973 - DNA, 601 bp, Human
tgatgtcacaccacttcacgcccttctcccagcagccccgcttcagtgcctgggaagctgcacaaaataagattctgttatcaagcaacgctgcacttcccacatctggatgcacgccaagacaagacgtcagtcatttcctggtgaaatgaaagaaagccacgcttcctccacgcccattgggtcacgaaatccttgctaatcctggccggggcactggaggatgctataaacaatcacggatctgagcaggtggatgaagggaacgtagatgacacgttgagggtgtggtgcgggcaayacacagactaagagtgggaactggcgaagtgagctataatcccaagcataaaggaaaggaggggaggtggcctccagcgcctctcctactagttaaaggagagagagggagaaaaataccactggaacctccaggcaggtcagacgggcacttggggcttatgtgcattatttgatggaacaagcagtgtctttgtttcttaggatggccatttttatctttttgataagtgtggaggaagttggcttagtataatttaatttctctctcctattaacaggtctcagtaaaacaatgggg

SEQ ID NO: 198974 - DNA, 601 bp, Human
gataagtgtggaggaagttggcttagtataatttaatttctctctcctattaacaggtctcagtaaaacaatggggaatataccaaaaaaagagagagagagagaaagccaaaagaacataaaactagcacattagtcttttaaataaaaatgcagaggaagatagggaaggaaaagaatactacccaatattagtccagacctcgaatacgaccaggacagcctgccacagcagaaagaccaggtgtgtgggcttttgttttgtttttgttttctttcgagatggactctcactctgtcscccaggctggagtgcagtagcgtgatctcagctcagtgcaaccactgcctcctggggtcaagtgattctcctgcctcggcctcccaagtagatgggattataggtgtgtgccaccacacccggctaatttttgtatttttagtagagacagggtttcaccatgttggccaggttggtcttgaactcctgacctcaggtgattcacctgcctgggactcccaaagtgctgggattacaggtgtggccactgtgcctgggcaggtgtttggtctttctaatggcaaaaggcttccttcgaac

SEQ ID NO: 198975 - DNA, 601 bp, Human
aacccattttagaaattccttcagttaccaggtgactcttccctttctccagttcggctatagtttcctttcataacatatttgctgacggactttaattagaatccttcactttcggccgggcgtggtggcttacacctgtaatcctagcattttgggaggccaagggggaggatcacctgaggttaggagttcaagaccagcctggccaacatggcaaaaccctatctctacaaaaaatacaaaattagccgggcatgatggcaggtgcctgtaatcccagctacccaggaggttgagkcaggagaatggcttgaacccaggaggcaaaggttgcagtgagccaagatcacaccactgcattccagcctgggtgacagagtaagactctatctcaaaaaaagaattaataaataaataaaatttaaatttaaattttaaaaaaatccttcacttcccctgacacagactttaaagtacgaatcatcacacccaaattcagctctgaagacattgttttctgaagtgttcacgccctgttttgggcataccaggaaaggaggcagtgttctgttctgttttctcatatcctacctgaatc

SEQ ID NO: 198976 - DNA, 601 bp, Human
ttccctttctccagttcggctatagtttcctttcataacatatttgctgacggactttaattagaatccttcactttcggccgggcgtggtggcttacacctgtaatcctagcattttgggaggccaagggggaggatcacctgaggttaggagttcaagaccagcctggccaacatggcaaaaccctatctctacaaaaaatacaaaattagccgggcatgatggcaggtgcctgtaatcccagctacccaggaggttgaggcaggagaatggcttgaacccaggaggcaaaggttgcartgagccaagatcacaccactgcattccagcctgggtgacagagtaagactctatctcaaaaaaagaattaataaataaataaaatttaaatttaaattttaaaaaaatccttcacttcccctgacacagactttaaagtacgaatcatcacacccaaattcagctctgaagacattgttttctgaagtgttcacgccctgttttgggcataccaggaaaggaggcagtgttctgttctgttttctcatatcctacctgaatcttatgattgattttacagctaacgttctacagctcccc

SEQ ID NO: 198977 - DNA, 601 bp, Human
ccaagagtgagggagggaattcacaaagttcaactcctttcagaaaacatctgtgttcgtcgggaatactggcctgtagtcttctttccctggagtgtttgtctggctttggcatcagggtaatgatggcctcgtaaaatctgtttggaagtgtttcctcctcttcagtgttttggaagagtttgagaagatgggtattagttcttctggaagtgtctggtaggattcagcaatgaaaacatccgttcgtgggcattattttggctgagacattttattactgattcaatctccttactcrttacagtctgtttttctgtttcttcatgattcagtcttggtaggttgtatgtgtctaggaagggctccatttcttccagattgtccaatgtcttggcgtataaatgtccacagtggtctcatgacccttggtgtttctgtggtatccattgtaacgcctcttctttcatttctgattctatttatttgagtcttctctcatttctcagtctagctgaagatctgtccattttgtgtcttttcaacaaaacaactcccaattttgatgatctttcctattgtttttctaggctatttgact

SEQ ID NO: 198978 - DNA, 601 bp, Human
gagaggaaaaaaagatctgtctggtttcatgagaagaaatgctcagtggagagatggttactcgtgttttccagatggttctgtggaccccagaacgctgtcccagccaaactccaccacagataccaccttcagagttggccaggagctgcaggaagcccacaaaggttgatttggaagaagcaacatcctacaaaccagatccatccacacagagagcaggctctgctccttggcagtagtctctacttagtgctaagtactaagtacctcctaagttgtagtctctgcttagtactargtacctcctgagtcatagtctctgctaagtactaagcactagtcactactatatatctcctaagtatcagtgtctacttagtactaactactgctaagcactaagtacctcctaaatagcagtctgtttagtacaaagtactattaatgataattacaaactacctcctaagtagcagtctttgcttagttctaagtactgctaaatactaagtacttcctaagtcacagtccctacttcgtatctaatacctcctaagcaacagtctctacttagtgctgatccctcccaccccgagtc

SEQ ID NO: 198979 - DNA, 601 bp, Human
catgagaagaaatgctcagtggagagatggttactcgtgttttccagatggttctgtggaccccagaacgctgtcccagccaaactccaccacagataccaccttcagagttggccaggagctgcaggaagcccacaaaggttgatttggaagaagcaacatcctacaaaccagatccatccacacagagagcaggctctgctccttggcagtagtctctacttagtgctaagtactaagtacctcctaagttgtagtctctgcttagtactaggtacctcctgagtcatagtctctgctragtactaagcactagtcactactatatatctcctaagtatcagtgtctacttagtactaactactgctaagcactaagtacctcctaaatagcagtctgtttagtacaaagtactattaatgataattacaaactacctcctaagtagcagtctttgcttagttctaagtactgctaaatactaagtacttcctaagtcacagtccctacttcgtatctaatacctcctaagcaacagtctctacttagtgctgatccctcccaccccgagtcactgacatcacttcctgtcctccctcc

SEQ ID NO: 198980 - DNA, 601 bp, Human
ccgacctcttgacgtagagtcaggtctccttgccgagagtgggacctgcaccctgatccattactaggtggagggagttttccagactgggtttgtttgggttgatacaaaggcaactctgcacatccaaattcgcatggatgggagctgccttctaggcccctctggcagtttccccaggagtcaggcacagcgtctcatgacgtggctgtgtgaacaggtgagtggggatgtggaagcagccggctcagggccggcacacagtaggtcgcttgtgcgtggccaccatgctatccgccawccccggtgccatggttatccctatgctgactcacaggcatggggctgctgactcacaggcatggagctggacatcagtctggctcgcaggcacactggaaagctgctcttaccctactaactttcagtcactgagacacaaatcagggcctggttggcagcagcgagaccgtcagggtgccctccccacctgcgacaataaacaccgcatgatgttaccctccagggatgacccaggattgtgtgaaaccaaaattcattaaaaatgaatattctgggccaggctgcattcactaattga

SEQ ID NO: 198981 - DNA, 601 bp, Human
agcgagaccgtcagggtgccctccccacctgcgacaataaacaccgcatgatgttaccctccagggatgacccaggattgtgtgaaaccaaaattcattaaaaatgaatattctgggccaggctgcattcactaattgattgattgattgattgataatttgatttatttaaaatacacctttctcgtaagcttctcggcacatacggcaaaatataaataccccacatgaataaaattatcacttgaaaaaactcatcacttgaaggaagagggggaaaaatccatgttatggaaatggyagcgtaatgggtgggtctcctggtgaccaaagacatcctgggaggtgagagatggagagagaaacagaggcttaaagatttggagtcgagacgcgtctctctaccaagaaggaagaagacggctctcactgcccccagctctaactccgtgtggtccacaggacaggaagtcccacacgggagaaggaggatgctggggctgctgacgataagaaaatgtgagcgtttcacaagtcaccgtgggtggtcattgtccttgtccacgggatttttcaaagtaggacaatctgtattttaaag

SEQ ID NO: 198982 - DNA, 601 bp, Human
ttctcggcacatacggcaaaatataaataccccacatgaataaaattatcacttgaaaaaactcatcacttgaaggaagagggggaaaaatccatgttatggaaatggcagcgtaatgggtgggtctcctggtgaccaaagacatcctgggaggtgagagatggagagagaaacagaggcttaaagatttggagtcgagacgcgtctctctaccaagaaggaagaagacggctctcactgcccccagctctaactccgtgtggtccacaggacaggaagtcccacacgggagaaggaggaygctggggctgctgacgataagaaaatgtgagcgtttcacaagtcaccgtgggtggtcattgtccttgtccacgggatttttcaaagtaggacaatctgtattttaaagaagttgcgttttcttcctttttgacctttttaaagacttatgcagaaagtgactgcaaccaaaagcatatggttttattgctaattcaaccttacagagctgacaggcaaggccgaccaatgtgtgggagggctctgatgacagcaacgacgacagtgaatccaggggtgacgtcccccaggcgtgtgcttc

SEQ ID NO: 198983 - DNA, 601 bp, Human
caaggccgaccaatgtgtgggagggctctgatgacagcaacgacgacagtgaatccaggggtgacgtcccccaggcgtgtgcttcccatggccatgccggaatccgtggtcatgccggaatccactgatggtgcacgtgacccacgatgggaaaagtcacaagacagcttcagagctggtcaaacaggactgagaggggctacaccaggaatgcgcggcctgttgagtttctgtgatgaggccatcagaagccatctccacgcacttctcatagagcgcatggagcttcccagagcaagcrtgcagccatgccaggcctgggctgggagacatgtgtgaggacgcacgatggggttaggcagcctgagaaaccatccctggcacgggctgcctcaaggaatgaggaggtgtgggcttcccggctgcccatccccatatctgcacatagcccctgcatctcactacacagagcgtggcccgtgggtggcaccccccagcatggccaggagcaccgaggcgcacgctgggctctgagacgccccctggccaagaggggtggaggaagggggcaggcgccaggatctggaaggagatttccaac

SEQ ID NO: 198984 - DNA, 601 bp, Human
ctgcggtttttttgtttgtttgtttttaagatggagtttcattcttgtggcccaggctggagtgctatggtgcgatcttggctcactgcaatctccgcctcccgggttcaagcgattctcctgcctcagcctcctgagtaggtgggattacaggcatgcaccaccatgcctgggtaactttgtaattttagtagagatgggttttccccatgttggccaggctggtctcgaactcctcacctcaggtgatccacccaccttggcctcccaaagtgctgggattacaggcatgatccaccgygcccagcctaccatctgtgttcttaaccatacctcgcacaagaccccagcctggagagaggagcgggagggggaggcctttatccccccattattagggagatcccaaaggcttgtctcataaaatcacagcacatcgtttctgagggtaaagaattagagactccttgaaaatgggagagaatgagtgatgctttaacaagcttctaagatgaaatcctaaagctggggctttgctcagagcccactaaggccaggcgggtcatgctgtccttccaggagcggccccaccccttccgtc

SEQ ID NO: 198985 - DNA, 601 bp, Human
atctccgcctcccgggttcaagcgattctcctgcctcagcctcctgagtaggtgggattacaggcatgcaccaccatgcctgggtaactttgtaattttagtagagatgggttttccccatgttggccaggctggtctcgaactcctcacctcaggtgatccacccaccttggcctcccaaagtgctgggattacaggcatgatccaccgcgcccagcctaccatctgtgttcttaaccatacctcgcacaagaccccagcctggagagaggagcgggagggggaggcctttatccccccrttattagggagatcccaaaggcttgtctcataaaatcacagcacatcgtttctgagggtaaagaattagagactccttgaaaatgggagagaatgagtgatgctttaacaagcttctaagatgaaatcctaaagctggggctttgctcagagcccactaaggccaggcgggtcatgctgtccttccaggagcggccccaccccttccgtcttgacactcaaaccatcgggctggaggcaaatgtcagaggagaaaagcctttgcttttctcccagctctcctgtaagaagccgctgagct

SEQ ID NO: 198986 - DNA, 601 bp, Human
aggagaaaagcctttgcttttctcccagctctcctgtaagaagccgctgagctgccagctatgcagcaagcacctgcgtaccccaagatgcagccaggaaggagtggggtaccccgaccacgtggggacacagccctcccaaggggcagccagtgtttccctgaaggaactgaggccaggaagcttgtttctcatttacttgaattcaaatcttaaaatgtttgcaataaattcaaaattttcaaaatactgtgtaggactgaacaaaacaaaacactcccacacacaccccatgcacacrtatcacatatgtgcatatatacaccacacagtgcacacatgccacacacggacccacatcacatacatgcacatacacacgcacacacaccacacatatgcacacatcacacccacacagcacatatgtgcatatatacaccacacacgtgcacacacgccacacacatgcacccacatcacatgcatgcccctacacacgcacacacatcacacatatgtgcacatcgcacacatcacatatgtgcatatagatgacacacgtgcacacatgccacacgcatgcacccacgtcacatac

SEQ ID NO: 198987 - DNA, 601 bp, Human
aacacacacacgagtttcctacacttgacactcagatgcatttatggtctactcttaccaaagtaaaaagcaacagatgaattgttgaagtatggtacatcagctctaaatgcttcacatatttatggaaatattataataaagaaaatacttatactatcaaggaaagccgaacaacaggacccacaatcggatctatggggtggtccctgcctctaacctgagctcagataaagtaggacacttaagccctcatttttaggatgtatgaatgtggatattctctcattcctactgttgyataattttcagattctttctaatgcatataggttatttattgttatacatttatagcataatgcatgcctatttaagaaaattgaaatggtatcaaaacaaggcagaaattgcacagaacagcaaaagggaaccggcctccccatcctcatcccctctccatctgctcttaacccagactcaggttttgcttttctgcatacatgtacacacccatgtacacacacattccatacatatgcacacacacacgtacacacacatcccccccacatccacacagaaacagaagtgatagaaa

SEQ ID NO: 198988 - DNA, 601 bp, Human
ggtacatcagctctaaatgcttcacatatttatggaaatattataataaagaaaatacttatactatcaaggaaagccgaacaacaggacccacaatcggatctatggggtggtccctgcctctaacctgagctcagataaagtaggacacttaagccctcatttttaggatgtatgaatgtggatattctctcattcctactgttgcataattttcagattctttctaatgcatataggttatttattgttatacatttatagcataatgcatgcctatttaagaaaattgaaatggtaycaaaacaaggcagaaattgcacagaacagcaaaagggaaccggcctccccatcctcatcccctctccatctgctcttaacccagactcaggttttgcttttctgcatacatgtacacacccatgtacacacacattccatacatatgcacacacacacgtacacacacatcccccccacatccacacagaaacagaagtgatagaaaacaacgatttttataagacaggtatattttctttgcaaaatctcaaacccccgaattgttgtggtttctctctcgtctgttttttgacgtgat

SEQ ID NO: 198989 - DNA, 601 bp, Human
ctaatgcatataggttatttattgttatacatttatagcataatgcatgcctatttaagaaaattgaaatggtatcaaaacaaggcagaaattgcacagaacagcaaaagggaaccggcctccccatcctcatcccctctccatctgctcttaacccagactcaggttttgcttttctgcatacatgtacacacccatgtacacacacattccatacatatgcacacacacacgtacacacacatcccccccacatccacacagaaacagaagtgatagaaaacaacgatttttataagasaggtatattttctttgcaaaatctcaaacccccgaattgttgtggtttctctctcgtctgttttttgacgtgatgcaaaacatgtttgaatgttgcgccgtagtcctgattccttcaaatcaacatcagctgactcttagcagcactgtgctatcactatttcatatcattttcaaccagtcataaatgtgtcctcctaaccatgttgccacaaaagacaattccagatgctttgctatctggtagagaaaaaattaacaattcgcttattcttaaagtgtttgtggggaaattttccaa

SEQ ID NO: 198990 - DNA, 601 bp, Human
acagcaaaagggaaccggcctccccatcctcatcccctctccatctgctcttaacccagactcaggttttgcttttctgcatacatgtacacacccatgtacacacacattccatacatatgcacacacacacgtacacacacatcccccccacatccacacagaaacagaagtgatagaaaacaacgatttttataagacaggtatattttctttgcaaaatctcaaacccccgaattgttgtggtttctctctcgtctgttttttgacgtgatgcaaaacatgtttgaatgttgcgccrtagtcctgattccttcaaatcaacatcagctgactcttagcagcactgtgctatcactatttcatatcattttcaaccagtcataaatgtgtcctcctaaccatgttgccacaaaagacaattccagatgctttgctatctggtagagaaaaaattaacaattcgcttattcttaaagtgtttgtggggaaattttccaaaagaaaaaaggtgaaattacgcacagtgagatgagcacatttttacttgattgtaacaagtacggaagttaaagccccctggaaatctcggtggaaatca

SEQ ID NO: 198991 - DNA, 601 bp, Human
ctggtagagaaaaaattaacaattcgcttattcttaaagtgtttgtggggaaattttccaaaagaaaaaaggtgaaattacgcacagtgagatgagcacatttttacttgattgtaacaagtacggaagttaaagccccctggaaatctcggtggaaatcacataaagtagactctaggagacaattccctatctaggctggcatgaaatcctaatgcatagaaagggtaatgggacacgcacaaagcgtactgttacttagcaggctctcaagaaccacacagcatgacggtaataatgygctcatcttcaggagaatgggaacaagtgctcagggtcaaagaactgggctcccgtcctgcctgctgaggtccctggggtgctttggaaccctcattggtgagccgaggagaacctcgcctttctcccagcagagatcagatgtcctccttactgcacggatatgatacatgtgcatgcggtatgtgtgcatgtggggcgtgtgcaggtgtgcaatggatgtatacagtgcatgtggggcgtgtgcaggtgtgcaatggatgtatatggtgcatgtggggtgtgtgcaggtgtgcaatgg

SEQ ID NO: 198992 - DNA, 601 bp, Human
gtgcatgcggtatgtgtgcatgtggggcgtgtgcaggtgtgcaatggatgtatacagtgcatgtggggcgtgtgcaggtgtgcaatggatgtatatggtgcatgtggggtgtgtgcaggtgtgcaatggatgtatatggtgcacgtgtggtgtgtgcaggtgtgcaatggatgtatatggtgcatgtggggggtgtgcaatggatgtctatggtgcctgtggggtgtgtgcaggtgtgcaatggatgtctatggtgcatgtggggcgtgtgcaggtgtgcaatggatgtctatggtgcacrtgtggtgtgcacaggtgtgcaatggatgtctatggtgcacgtgtggtgtgtgcaggtgtgcaatggatgtctatggtgcacgtgtggtgtgcacaggtgtgcaatggatgtatatggtgcacgtatgcatgtgtgtgtccccctcattacctcacatgcgtatagagcacagacacacaccttaataaagcccagagtatgctcagcacagtaagtgtgcaaatcctgaaacgctgtaaaactggacctgtgacttgaagcctccattccattgttggggacacacaagcagggctccct

SEQ ID NO: 198993 - DNA, 601 bp, Human
tggatgtctatggtgcctgtggggtgtgtgcaggtgtgcaatggatgtctatggtgcatgtggggcgtgtgcaggtgtgcaatggatgtctatggtgcacgtgtggtgtgcacaggtgtgcaatggatgtctatggtgcacgtgtggtgtgtgcaggtgtgcaatggatgtctatggtgcacgtgtggtgtgcacaggtgtgcaatggatgtatatggtgcacgtatgcatgtgtgtgtccccctcattacctcacatgcgtatagagcacagacacacaccttaataaagcccagagtaygctcagcacagtaagtgtgcaaatcctgaaacgctgtaaaactggacctgtgacttgaagcctccattccattgttggggacacacaagcagggctccctaaggggaggtcagggaaacgagagccaccacatacctgccccaggctcagggcaggtcccagcaaagccccttcttggctctggcctcctcatcgtctgtgggacacgcccattttaccagaaacacaaagttggtccctccatccatccttcgcctaagcagcctgcctctccagttgccatggcaactctgctctggt

SEQ ID NO: 198994 - DNA, 601 bp, Human
agcacagtaagtgtgcaaatcctgaaacgctgtaaaactggacctgtgacttgaagcctccattccattgttggggacacacaagcagggctccctaaggggaggtcagggaaacgagagccaccacatacctgccccaggctcagggcaggtcccagcaaagccccttcttggctctggcctcctcatcgtctgtgggacacgcccattttaccagaaacacaaagttggtccctccatccatccttcgcctaagcagcctgcctctccagttgccatggcaactctgctctggttgccrcacagcctcaagcctcagctgctcggagtgggtgggaacgcgagagcacttgagcaccagtggcctgacaactctgcctcgtccccatcacctctgcggcgagaatcagagcagtcgcagaagctcctgccacaccactcccataatctctcagtgccaattacttggaggaaaaatggaatcatccccgtgcccagggtggtgagtggtgtcaccgttcggatggctcagatgaaggcggccaactgggcagcgggaatggagcctttctaggcaggcagacccaagcatactgctcct

SEQ ID NO: 198995 - DNA, 601 bp, Human
aaacgctgtaaaactggacctgtgacttgaagcctccattccattgttggggacacacaagcagggctccctaaggggaggtcagggaaacgagagccaccacatacctgccccaggctcagggcaggtcccagcaaagccccttcttggctctggcctcctcatcgtctgtgggacacgcccattttaccagaaacacaaagttggtccctccatccatccttcgcctaagcagcctgcctctccagttgccatggcaactctgctctggttgccgcacagcctcaagcctcagctgctyggagtgggtgggaacgcgagagcacttgagcaccagtggcctgacaactctgcctcgtccccatcacctctgcggcgagaatcagagcagtcgcagaagctcctgccacaccactcccataatctctcagtgccaattacttggaggaaaaatggaatcatccccgtgcccagggtggtgagtggtgtcaccgttcggatggctcagatgaaggcggccaactgggcagcgggaatggagcctttctaggcaggcagacccaagcatactgctcctgaattagtgtgtgggttggtgagc

SEQ ID NO: 198996 - DNA, 601 bp, Human
gacaactctgcctcgtccccatcacctctgcggcgagaatcagagcagtcgcagaagctcctgccacaccactcccataatctctcagtgccaattacttggaggaaaaatggaatcatccccgtgcccagggtggtgagtggtgtcaccgttcggatggctcagatgaaggcggccaactgggcagcgggaatggagcctttctaggcaggcagacccaagcatactgctcctgaattagtgtgtgggttggtgagcactccaggcggacctgatagcccggagccctatccctcactamcccccagccccagccctgcaccagttaccaaagacaaacaagagacacgtttctccaaaggatggcaggacaggacagggtaggaaggccccaccaccccatctccaggcacctggctttcagggaagccaccacgccagctgcacagacgcgtgacaggcaccccagtgctgaagcccaaggaggaggctgacagcccagttagatcgagtccaagcagcaaaatcacacagcacatcccgacaatcagccgcatcacatgcaaagccagagaacgaacctctcactccccaaatccaa

SEQ ID NO: 198997 - DNA, 601 bp, Human
gtttctccaaaggatggcaggacaggacagggtaggaaggccccaccaccccatctccaggcacctggctttcagggaagccaccacgccagctgcacagacgcgtgacaggcaccccagtgctgaagcccaaggaggaggctgacagcccagttagatcgagtccaagcagcaaaatcacacagcacatcccgacaatcagccgcatcacatgcaaagccagagaacgaacctctcactccccaaatccaatcctccccaacatgagccacccccaccacccccgattgatggggagatyaacatgccggaaaacgaccccatatcacaaagcagagcctggtttctcaaaggagaccttaatcttccctcacccttgggctggcggagtgagagtccctgtggcccgaggttcctcctgtcatgcccacggcactcagaactgaggctggcatgcggagggtgtggtttccccggaccagacctcgttgtccagaccaaacccaaccacagttccaatctgttttttagccaagtgctttaaatatgtgtcaagcactaatgctgggaggacttaaataaatacatgagccttttcttc

SEQ ID NO: 198998 - DNA, 601 bp, Human
cgccagctgcacagacgcgtgacaggcaccccagtgctgaagcccaaggaggaggctgacagcccagttagatcgagtccaagcagcaaaatcacacagcacatcccgacaatcagccgcatcacatgcaaagccagagaacgaacctctcactccccaaatccaatcctccccaacatgagccacccccaccacccccgattgatggggagattaacatgccggaaaacgaccccatatcacaaagcagagcctggtttctcaaaggagaccttaatcttccctcacccttgggctggcrgagtgagagtccctgtggcccgaggttcctcctgtcatgcccacggcactcagaactgaggctggcatgcggagggtgtggtttccccggaccagacctcgttgtccagaccaaacccaaccacagttccaatctgttttttagccaagtgctttaaatatgtgtcaagcactaatgctgggaggacttaaataaatacatgagccttttcttctaataaactggcagatccaccagatctacctgggccagtctcattttccaggcgactgagcctggatgtgcataactgaagctgcc

SEQ ID NO: 198999 - DNA, 601 bp, Human
tcccctcccctcggcggtggtcaggttggccttgagtcttccatgagaatctgcagaatgcggcacacaggcgaggcaagactggggacttccttgaataacaaggtgtccagtgctttaaaaatactctaatggtgaggaaggaaattgagaaaatgattcattagaagagcggaataactctttttaagagcaggctcgcagaagtcgagctgggcaacagattctcgagccgctggcatccatatttatcgagcagaggaagcatccctgtaactgcacagtggcacagagccactgmccacggcacgacccgccctccatctccacgttcaggagcatccctgtaactggacagtggcacagagccaccgctgcacacagcagtaaaaatgtacagccctccctctctgcgttcaggagcagagggcatgagtttcacctccctacaggacaggaaactacgacagtcatctttgcacctgaagaaacaaattatttaaactttctcatcctgcagtttacttcttagacatgtctactttctatagcaaaatagatctggacacgaataataaatgcgaagcatggtgttacaggg

SEQ ID NO: 199000 - DNA, 601 bp, Human
cagaagcccctgcaggcttcacgacgtgtgagcaagggaggttctttggctaaagacccagacaaggcaatgatctacccaacaagatcaccaagggcaagacttcacgcgagcacagctgaggaagatgtttggggcttatctgaccgtttctacaagcatctctcaaatcacaccacagaggaaaccaaaaggcctggttcagcctccaggggccgggctctggaagaaagtaggcccagggcaggagtccacggccacagggaacagggaatgctgccttcctgtggggaacaagagsatcggccactccaccaccaaagatccgcggccgaaccaccttgctgaaatttaacctgaacttgcctcagcacgacagcttcaggattaaaagtggttcacggatttggggaactgcagaggacagtatgtgtgtacagagaattacacaatcatgtagctttttgtggagtgagggtgccctctgtccattcaggatgctttggaaatgtttttaccaaactatgagtctcacagtttcgaggactccattcccgctggggctgtgctgtccgccgcacccttgcagtgggccctgacc

SEQ ID NO: 199001 - DNA, 601 bp, Human
agaggaaaccaaaaggcctggttcagcctccaggggccgggctctggaagaaagtaggcccagggcaggagtccacggccacagggaacagggaatgctgccttcctgtggggaacaagaggatcggccactccaccaccaaagatccgcggccgaaccaccttgctgaaatttaacctgaacttgcctcagcacgacagcttcaggattaaaagtggttcacggatttggggaactgcagaggacagtatgtgtgtacagagaattacacaatcatgtagctttttgtggagtgagggtaccctctgtccattcaggatgctttggaaatgtttttaccaaactatgagtctcacagtttcgaggactccattcccgctggggctgtgctgtccgccgcacccttgcagtgggccctgacccaccctcccaccccatgcaccaagctcctggccactcttttctggctgccctgggctcgccagctgatgaggccaatgggccctcctgtccctggggcttggcactaagcctcagggcacccgtcctcactgcctgactacctttctctgcctgttccagctggacccactgagcaaaa

SEQ ID NO: 199002 - DNA, 601 bp, Human
ggggaacaagaggatcggccactccaccaccaaagatccgcggccgaaccaccttgctgaaatttaacctgaacttgcctcagcacgacagcttcaggattaaaagtggttcacggatttggggaactgcagaggacagtatgtgtgtacagagaattacacaatcatgtagctttttgtggagtgagggtgccctctgtccattcaggatgctttggaaatgtttttaccaaactatgagtctcacagtttcgaggactccattcccgctggggctgtgctgtccgccgcacccttgcastgggccctgacccaccctcccaccccatgcaccaagctcctggccactcttttctggctgccctgggctcgccagctgatgaggccaatgggccctcctgtccctggggcttggcactaagcctcagggcacccgtcctcactgcctgactacctttctctgcctgttccagctggacccactgagcaaaaccttctaaaccagacgatgctcagaactacccagcctcagaactacctctgtcctcagacttagatgccacaggaaaccccttgctgggagagccagtgctgactccag

SEQ ID NO: 199003 - DNA, 601 bp, Human
acccaccctcccaccccatgcaccaagctcctggccactcttttctggctgccctgggctcgccagctgatgaggccaatgggccctcctgtccctggggcttggcactaagcctcagggcacccgtcctcactgcctgactacctttctctgcctgttccagctggacccactgagcaaaaccttctaaaccagacgatgctcagaactacccagcctcagaactacctctgtcctcagacttagatgccacaggaaaccccttgctgggagagccagtgctgactccagcttctcagcrggtttgattttggatgccgtgatcagaaccctgcaggtgctgtgtgttctgtctcatccagggatgtcccgtgtctactgcaggaccttcgggggaggcctgcctgcagaatctctgtgcaaaggtgatgtgggcagggagtgttgacgacgatgctttgatggtcctcttctgttgtctcccataggcacagctttggaccaagctctgtcccccacacaatggactgacctcttgggactcagagtctgatgccgactggctgaggaaagtggacgtggcagggaccccgcggctgcc

SEQ ID NO: 199004 - DNA, 601 bp, Human
agggcaccgaggcttctcctcactctgagaggagttgtcacgtgcacccttggagcaaggtcaccagccagtcacaagtgcagggccattattctggtccgcgccatgtggaattttaaaaagttttagatggtggaccattggcagttttagaaatacactaaggccccggaagacctacctattggttcaggtacctgaggaaaggtggtggaggagacagaagctggcgggggcgggggggaacctaggcagctcccgtgaggacaagtgatgacggcagagaagagggcaggactcragcagctgggcgcccagcagaagctccatgttggacaaccatgcactaccctggtggcttgagagcaatagaatttgcccgagtttaaaattaaactcagccctaataggaagtttatggaatgattcaccatctgtaataaaatttatctttcttggagtagaaaagagtatttttcccaaaaaatatagtctctaagaaattgtggaataatcaaatctatctataacctaaacttatgcaaaaagaaacatggatgtgagtttattctgccaaaacgaggaataaggtccttcaagc

SEQ ID NO: 199005 - DNA, 601 bp, Human
gaacaggcatgagacaacctgctaaggcagactgagagcccagtcagatccctgctttccctgggatctgggttgaaatggagttgaatgagggacccggacaaccagaatcatgctcaaagaggtttcgagtatcctctgtctaccacccaggtcagcaggcggggtttgccctggaccagcgtgtggagagacccgggcacacggctgctcaggacgcagtcagacgcggaacccgacccctcaggtttgatcacagaaacctgtggcgtgtttctggggtaggatccttcctttaaattaaaaacttacacaggaaccaaatgttcagagagtctacgtcccagatttggctgattcttttctcctcagcattacaatgagatggcgtgatttgaggacctgctgtacgtgcgctaaatgtctttttcttgttactctgacattcgaatccagtcaggcatcctgtattcaatctggaactctgctcttccttctggtgggccctcaagctctgggaatcataggatgagaggactgtggtgctggacgaccccgagcccccagttgggtgagcaagcgtgcagcagcgagaaatgtc

SEQ ID NO: 199006 - DNA, 601 bp, Human
cagtcagatccctgctttccctgggatctgggttgaaatggagttgaatgagggacccggacaaccagaatcatgctcaaagaggtttcgagtatcctctgtctaccacccaggtcagcaggcggggtttgccctggaccagcgtgtggagagacccgggcacacggctgctcaggacgcagtcagacgcggaacccgacccctcaggtttgatcacagaaacctgtggcgtgtttctggggtaggatccttcctttaaattaaaaacttacacaggaaccaaatgttcagagagtctacrtcccagatttggctgattcttttctcctcagcattacaatgagatggcgtgatttgaggacctgctgtacgtgcgctaaatgtctttttcttgttactctgacattcgaatccagtcaggcatcctgtattcaatctggaactctgctcttccttctggtgggccctcaagctctgggaatcataggatgagaggactgtggtgctggacgaccccgagcccccagttgggtgagcaagcgtgcagcagcgagaaatgtctgagcccccaggcttcaagcccacttcgctcagcctgggt

SEQ ID NO: 199007 - DNA, 601 bp, Human
gagcccccagttgggtgagcaagcgtgcagcagcgagaaatgtctgagcccccaggcttcaagcccacttcgctcagcctgggtctcacccactgtacaaaggatccaaccctgcagctccgctcctggaggactgaccaagacctgcggcggtgaccgcccccgcccagccccacggcgctgacctggaactgccctgatgatgagaatcacagggatggcgtgcgtgccaggggtgagcccgcctgcagaggagctggtgagggccacagcccatgccctcccctgctgggctccttgctgtcagctgacagtaccctggcttcgcggtgacagcagctcttcctctgagcgctgcctcagctcatcacatgagctgagagtgggatgggtctcatcatagctaccttctatccattcttttttacctaaggctttcttgagaggcagttttcactttgcagcctgaatcctactctgcttcaggtaagataactgggcgggagcctgacagtttaagagacccaaatagaactaatcttcaagcgggcacgtaagaacagctcacagcatggctgccccggctccttctcacctggga

SEQ ID NO: 199008 - DNA, 601 bp, Human
ccgcctgcagaggagctggtgagggccacagcccatgccctcccctgctgggctccttgctgtcagctgacagtaccctggcttcgcggtgacagcagctcttcctctgagcgctgcctcagctcatcacatgagctgagagtgggatgggtctcatcatagctaccttctatccattcttttttacctaaggctttcttgagaggcagttttcactttgcagcctgaatcctactctgcttcaggtaagataactgggcgggagcctgacagtttaagagacccaaatagaactaatctycaagcgggcacgtaagaacagctcacagcatggctgccccggctccttctcacctgggatttctcctggagcattcccgacgtccacacaccacatttcctccgctctgtctgctgcagagcctgctccagggtgaacacaggccgtcctgaatcagccgctgacgcctcccccggcatctccacgtgcagcccctgccctgcgcgactggcgtggaaagggctctggtgcgtctcacactctgctatcatcagcctccttcctgctccagttcttaagttcttgtcttttctgttgtct

SEQ ID NO: 199009 - DNA, 601 bp, Human
cctaaggctttcttgagaggcagttttcactttgcagcctgaatcctactctgcttcaggtaagataactgggcgggagcctgacagtttaagagacccaaatagaactaatcttcaagcgggcacgtaagaacagctcacagcatggctgccccggctccttctcacctgggatttctcctggagcattcccgacgtccacacaccacatttcctccgctctgtctgctgcagagcctgctccagggtgaacacaggccgtcctgaatcagccgctgacgcctcccccggcatctccacstgcagcccctgccctgcgcgactggcgtggaaagggctctggtgcgtctcacactctgctatcatcagcctccttcctgctccagttcttaagttcttgtcttttctgttgtctgcatttaatttaaatttctatgaatcgccgcgagacgaccctgtgagtacgcactccatgtgcatgtgcttctccacggagggagctgcctgggtggccgccctgctgatcctctgcatccagcctctggtaggatgggggcgaccacatcagataccacctctgtggaagggtctgtgtctcctc

SEQ ID NO: 199010 - DNA, 601 bp, Human
ctccacgtgcagcccctgccctgcgcgactggcgtggaaagggctctggtgcgtctcacactctgctatcatcagcctccttcctgctccagttcttaagttcttgtcttttctgttgtctgcatttaatttaaatttctatgaatcgccgcgagacgaccctgtgagtacgcactccatgtgcatgtgcttctccacggagggagctgcctgggtggccgccctgctgatcctctgcatccagcctctggtaggatgggggcgaccacatcagataccacctctgtggaagggtctgtgkctcctcccctgccccccagtcacagctttgggggagatttcagagatttcagggccttccctgaagcctttcctggaaggtggattctcttgctttttcagcaaccaccagccgttggctctgctggaatggcatccagggttttccttgttgcttctgtatctgtttgttttggcctatttgttgttcatattgttaagctttagggaggaacgtttggggatctggtttcacaaggtcccaggaagccagaagtctcctgcagccacgcgaggtctgtccacgaggcctgcactgcgt

SEQ ID NO: 199011 - DNA, 601 bp, Human
tgttgtctgcatttaatttaaatttctatgaatcgccgcgagacgaccctgtgagtacgcactccatgtgcatgtgcttctccacggagggagctgcctgggtggccgccctgctgatcctctgcatccagcctctggtaggatgggggcgaccacatcagataccacctctgtggaagggtctgtgtctcctcccctgccccccagtcacagctttgggggagatttcagagatttcagggccttccctgaagcctttcctggaaggtggattctcttgctttttcagcaaccaccagcygttggctctgctggaatggcatccagggttttccttgttgcttctgtatctgtttgttttggcctatttgttgttcatattgttaagctttagggaggaacgtttggggatctggtttcacaaggtcccaggaagccagaagtctcctgcagccacgcgaggtctgtccacgaggcctgcactgcgtggtcgtgctgggtagacacaccggctaggagacgaatgtggaagagttgatttcaactaaaggatccagagtggggtgagggaggtgcagcgtcggtacagggaggcaggaag

SEQ ID NO: 199012 - DNA, 601 bp, Human
gttgtctgcatttaatttaaatttctatgaatcgccgcgagacgaccctgtgagtacgcactccatgtgcatgtgcttctccacggagggagctgcctgggtggccgccctgctgatcctctgcatccagcctctggtaggatgggggcgaccacatcagataccacctctgtggaagggtctgtgtctcctcccctgccccccagtcacagctttgggggagatttcagagatttcagggccttccctgaagcctttcctggaaggtggattctcttgctttttcagcaaccaccagccrttggctctgctggaatggcatccagggttttccttgttgcttctgtatctgtttgttttggcctatttgttgttcatattgttaagctttagggaggaacgtttggggatctggtttcacaaggtcccaggaagccagaagtctcctgcagccacgcgaggtctgtccacgaggcctgcactgcgtggtcgtgctgggtagacacaccggctaggagacgaatgtggaagagttgatttcaactaaaggatccagagtggggtgagggaggtgcagcgtcggtacagggaggcaggaagc

SEQ ID NO: 199013 - DNA, 601 bp, Human
tggccgccctgctgatcctctgcatccagcctctggtaggatgggggcgaccacatcagataccacctctgtggaagggtctgtgtctcctcccctgccccccagtcacagctttgggggagatttcagagatttcagggccttccctgaagcctttcctggaaggtggattctcttgctttttcagcaaccaccagccgttggctctgctggaatggcatccagggttttccttgttgcttctgtatctgtttgttttggcctatttgttgttcatattgttaagctttagggaggaacrtttggggatctggtttcacaaggtcccaggaagccagaagtctcctgcagccacgcgaggtctgtccacgaggcctgcactgcgtggtcgtgctgggtagacacaccggctaggagacgaatgtggaagagttgatttcaactaaaggatccagagtggggtgagggaggtgcagcgtcggtacagggaggcaggaagcaggagcaggacgggttgaggcagcagcaccagcaacgcctgtgaaacccctcgtgcatgtccccgtgaggacccctgatgcctctgctgcctgatgctgca

SEQ ID NO: 199014 - DNA, 601 bp, Human
actgtgatgggacctggggtatccagcaaggggggcgtgaggctccgactggctgagtctgtgtcagcgtcagcaacagtgcccatcccgagctctttcccagcgcaccccaggacatggtggaaggtggaagaccctgcctacgggcagctcagagagcaggtggcagaggccagggtcggcctgcatgcagacaagcaggccgggcagcgggaagaggctcccggaaagatgggagcaccaggccacatggagcttggacagggcaaggagtcagggggagggaggtaacagcccctgrgaaataataaagcacacgaacttgtgagacacaatcccttccccagattcccaactgtgtgatcctggcagggacccagcccaagcctcaggggctcacaggcagcgatgggccaaggaagggcttcagggcccagcgactccctgcaaactgagccctgtcctgcacaggtgagaagggaagggatggctcccctgccagttagagacagaggcttggtgcctgggggactccagccacccatcctgagccagaatgtggacgtccactccatagagcacacgaagaggataaaacagc

SEQ ID NO: 199015 - DNA, 601 bp, Human
gcatgcacaccgccaggacacagcagctctgtggaagacgccatgcagaagcctcttcagggcaccgccatgagccaccctcagaacctgagctccaggcactacggacgattttaggaaacctgtgtctgttgcatttcgaatattctgacggggcttcccgttatttcaggagaagctaattccccacacagttagtgctcaggagggaggaatctaggagctcacttggccctaaagcccgtggtggctgcgccgtacttctgcccctcctcccgcggtgactgtgacaacaggaggkgccacagccgccctgagcccctggttcccaggtgccggtggctgcagcacggaggccacctacggttcccagagcacgaagagctcctacgtccagcaggggatgttaagggtcacaccctcgaggccacagtgactgccccaaagtctgaggcctccccggttcactcctgcctccctcccctgctttcctgatgtaaacacagacacaagcatacacacttgcatggacacacaggcactcacactcacagatgcacactgcaacacatatacacacattcacacacaccgcacacac

SEQ ID NO: 199016 - DNA, 601 bp, Human
acgccatgcagaagcctcttcagggcaccgccatgagccaccctcagaacctgagctccaggcactacggacgattttaggaaacctgtgtctgttgcatttcgaatattctgacggggcttcccgttatttcaggagaagctaattccccacacagttagtgctcaggagggaggaatctaggagctcacttggccctaaagcccgtggtggctgcgccgtacttctgcccctcctcccgcggtgactgtgacaacaggaggggccacagccgccctgagcccctggttcccaggtgccrgtggctgcagcacggaggccacctacggttcccagagcacgaagagctcctacgtccagcaggggatgttaagggtcacaccctcgaggccacagtgactgccccaaagtctgaggcctccccggttcactcctgcctccctcccctgctttcctgatgtaaacacagacacaagcatacacacttgcatggacacacaggcactcacactcacagatgcacactgcaacacatatacacacattcacacacaccgcacacacattcacacactgcacacacattcacacacactgcaca

SEQ ID NO: 199017 - DNA, 601 bp, Human
cagaagcctcttcagggcaccgccatgagccaccctcagaacctgagctccaggcactacggacgattttaggaaacctgtgtctgttgcatttcgaatattctgacggggcttcccgttatttcaggagaagctaattccccacacagttagtgctcaggagggaggaatctaggagctcacttggccctaaagcccgtggtggctgcgccgtacttctgcccctcctcccgcggtgactgtgacaacaggaggggccacagccgccctgagcccctggttcccaggtgccggtggctgyagcacggaggccacctacggttcccagagcacgaagagctcctacgtccagcaggggatgttaagggtcacaccctcgaggccacagtgactgccccaaagtctgaggcctccccggttcactcctgcctccctcccctgctttcctgatgtaaacacagacacaagcatacacacttgcatggacacacaggcactcacactcacagatgcacactgcaacacatatacacacattcacacacaccgcacacacattcacacactgcacacacattcacacacactgcacacatattca

SEQ ID NO: 199018 - DNA, 601 bp, Human
acaggaggggccacagccgccctgagcccctggttcccaggtgccggtggctgcagcacggaggccacctacggttcccagagcacgaagagctcctacgtccagcaggggatgttaagggtcacaccctcgaggccacagtgactgccccaaagtctgaggcctccccggttcactcctgcctccctcccctgctttcctgatgtaaacacagacacaagcatacacacttgcatggacacacaggcactcacactcacagatgcacactgcaacacatatacacacattcacacacacygcacacacattcacacactgcacacacattcacacacactgcacacatattcacacacactgcaaacattcactgcacacacatacacacattcacacacactgcacacacacatacatacattcacacacatacacacattcacacacactgcacacgcagattcacacactgcaaacattcacgctgcacacacatacatgcacacacactgcacacacattcacacactgcacacatacacacattcacacactgcacacactacacacacattcacacacagcacacacattcaca

SEQ ID NO: 199019 - DNA, 601 bp, Human
tgcacacacacacacaggcacacacacacagccatcttctcccgaccgcatcccacaggaggggcttcctcaccccatgctgcctgggtttggggcaggcccatcagcatctgctcagcttgctctggaggactttgccccaccgttgtttgtgtatttcccatcgctctgccacagagcctctgggtgctgggtgagggtctacttccaaattcctctcccgggcattccagctcctggcttctgtggcctgctggctaaggggaaggcacagccatgggtgggcgcccagcacctcaamggcccttttcccaccagggacccctccaaagcacccgtggcacctggggagaacctcctgccagttgtggacacctccctgcatgggacactgagtgagaggcacttgaaaatgtgaaagcaaggctgcaatgacggccgagccagagagcagcacctccctagcacaccctgcacccagcggaggtggctgaacacccgcgtcactcagcaaactccacggtgatgtgggccagctgaccaacttcatctagagccactgggctccctaaattcaagtccaactctacccctgccactc

SEQ ID NO: 199020 - DNA, 601 bp, Human
tcaaagcaccgtggagtgaaggtagcttcccagggcagtttgctgagctcttcctgcgtgctggacacacacggtccaaagatcgtgctgagctcttcctacatgctggacacacacagcctgaagttcaccgcctaagccacactcctgtccatacgacagatcgccatgggccacacgtgacatgtgcatgggtacctgcagcagccggtggcagcaggtgacagtggggaccatcgagatggcccttgcaacagtctaggaagagactcactgccccagattcacctcgagactccaratggtctcaggtcccttgcggggaccaaaggccgggagccgggagccgtgggctctctcctaatgctcttcctccatgcccaggctccaggactgcctcaagtgtgcactgaaaactgccccattccgaaaagccagcttgcaccttcttgttcctggtagggttccagaacagcgatgctgcttctcacgtggggtccctggtccttgctggcactttccttgatgcccgggaggagctgtcccatggagttttggggtcctcctcctcttccctcccttttctgcctttacacgaaga

SEQ ID NO: 199021 - DNA, 601 bp, Human
atcgagatggcccttgcaacagtctaggaagagactcactgccccagattcacctcgagactccaaatggtctcaggtcccttgcggggaccaaaggccgggagccgggagccgtgggctctctcctaatgctcttcctccatgcccaggctccaggactgcctcaagtgtgcactgaaaactgccccattccgaaaagccagcttgcaccttcttgttcctggtagggttccagaacagcgatgctgcttctcacgtggggtccctggtccttgctggcactttccttgatgcccgggargagctgtcccatggagttttggggtcctcctcctcttccctcccttttctgcctttacacgaagagccccctgaccctcacctgctagagcagtcgaggtccgcctgttcacaacagccctcctggccatgggctctcctactccaggccccacagcccccaagcctggtgacattcccccaggtcactttctatctgctccaggtaggctacctcccagcccccaaggtagtgcatgcttcgtatgtgttccgcaggcccctggcccggtggagcagtgacttgctcagaaactagcaa

SEQ ID NO: 199022 - DNA, 601 bp, Human
acctcccagcccccaaggtagtgcatgcttcgtatgtgttccgcaggcccctggcccggtggagcagtgacttgctcagaaactagcaaggcctctcggtagtggcctcccactgacctggctccccacctgccatccactatgctcctggtgctggaaacacccccatgtggctcagagtggtccccagaggcccctgacacagacacgagcacatacctgcaggcacacacctgcaggggcacacttgtggatgcacacctgcaggcaggtacatacctatgggcacatacttgcaggyaggcacccacctgcgggcacacacctgtgggcacacacctgtgggcacacctgcaggcaggtacacaccgacgggacacacctggaggtaggcacccacctgcaggcacccacccacaggtgcatatatccccccatgtccaccctctgcacagcccccttgccaggctgccctctgcacatttctgtttggtcccagactctgggtgaagggatcacctggtgccatcatcagtctatcaccagccctcagagaagtgcctcagcaggaggcctggcagaactgtgtgaggctgcccag

SEQ ID NO: 199023 - DNA, 601 bp, Human
gaagctgcaggggaggtgcctcatctgcagcgtcctgtccagtgactggcacctcagacagccccacacccgcggcaggtcccgcctggcactcgggaagctcttgcatttaagagatctagaaatgttgacactttgcgtggaattttaaaagctgcttaatcaggaaggagccagtcaggaaaagggacctgccaacctgcttgttagccgagcagcgaggcactgtgagcacacgggatgatgggtgctgggtgctggagttgaccggctggcccggcagagctggttcccgcggggaccccgggggcgtggtgctcacagcaaccctgttagaaaggacactggggagggtgtgtgctctctccatctggagccgcctggaagccagggagcatgtttttgtgtgagtgttgattgtggacaacgcccagaccctgcctgcagcacagaggaattccaggtgtcaaagcgataggaattcagggagatgatggacgtgggctccacaccccaccttccacctcaaggaggtggcagtgggaacccttacacgggggtgactgagcatctgagcgggatcaccgtggcctgggggcct

SEQ ID NO: 199024 - DNA, 601 bp, Human
gcgtcctgtccagtgactggcacctcagacagccccacacccgcggcaggtcccgcctggcactcgggaagctcttgcatttaagagatctagaaatgttgacactttgcgtggaattttaaaagctgcttaatcaggaaggagccagtcaggaaaagggacctgccaacctgcttgttagccgagcagcgaggcactgtgagcacacgggatgatgggtgctgggtgctggagttgaccggctggcccggcagagctggttcccgcggggaccccgggggcgtggtgctcacagcaaccytgttagaaaggacactggggagggtgtgtgctctctccatctggagccgcctggaagccagggagcatgtttttgtgtgagtgttgattgtggacaacgcccagaccctgcctgcagcacagaggaattccaggtgtcaaagcgataggaattcagggagatgatggacgtgggctccacaccccaccttccacctcaaggaggtggcagtgggaacccttacacgggggtgactgagcatctgagcgggatcaccgtggcctgggggcctgcccctcgcccctgagagctcctggttag

SEQ ID NO: 199025 - DNA, 601 bp, Human
ccagtgactggcacctcagacagccccacacccgcggcaggtcccgcctggcactcgggaagctcttgcatttaagagatctagaaatgttgacactttgcgtggaattttaaaagctgcttaatcaggaaggagccagtcaggaaaagggacctgccaacctgcttgttagccgagcagcgaggcactgtgagcacacgggatgatgggtgctgggtgctggagttgaccggctggcccggcagagctggttcccgcggggaccccgggggcgtggtgctcacagcaaccctgttagaarggacactggggagggtgtgtgctctctccatctggagccgcctggaagccagggagcatgtttttgtgtgagtgttgattgtggacaacgcccagaccctgcctgcagcacagaggaattccaggtgtcaaagcgataggaattcagggagatgatggacgtgggctccacaccccaccttccacctcaaggaggtggcagtgggaacccttacacgggggtgactgagcatctgagcgggatcaccgtggcctgggggcctgcccctcgcccctgagagctcctggttagagccgttgt

SEQ ID NO: 199026 - DNA, 601 bp, Human
ccggcagagctggttcccgcggggaccccgggggcgtggtgctcacagcaaccctgttagaaaggacactggggagggtgtgtgctctctccatctggagccgcctggaagccagggagcatgtttttgtgtgagtgttgattgtggacaacgcccagaccctgcctgcagcacagaggaattccaggtgtcaaagcgataggaattcagggagatgatggacgtgggctccacaccccaccttccacctcaaggaggtggcagtgggaacccttacacgggggtgactgagcatctgagygggatcaccgtggcctgggggcctgcccctcgcccctgagagctcctggttagagccgttgtgggcacagcctaagcttctgcaggccttctctctcacctctctcatatccttccatcatttaagtagattaaactcagaaacatttttagtgctgtgtacaaaccaagggcagcaaaaaacccaacctctatgccaggctgagcttctgttcttcctgactctacagcaagagctctgggcatctctccacgtgaccagctgtgaccacggacttaggaacactgtttcctacctcct

SEQ ID NO: 199027 - DNA, 601 bp, Human
agaaaggacactggggagggtgtgtgctctctccatctggagccgcctggaagccagggagcatgtttttgtgtgagtgttgattgtggacaacgcccagaccctgcctgcagcacagaggaattccaggtgtcaaagcgataggaattcagggagatgatggacgtgggctccacaccccaccttccacctcaaggaggtggcagtgggaacccttacacgggggtgactgagcatctgagcgggatcaccgtggcctgggggcctgcccctcgcccctgagagctcctggttagagccrttgtgggcacagcctaagcttctgcaggccttctctctcacctctctcatatccttccatcatttaagtagattaaactcagaaacatttttagtgctgtgtacaaaccaagggcagcaaaaaacccaacctctatgccaggctgagcttctgttcttcctgactctacagcaagagctctgggcatctctccacgtgaccagctgtgaccacggacttaggaacactgtttcctacctccttcacctcacctccctgccacctccagcccgtaatttagagagaagctgatgcagttga

SEQ ID NO: 199028 - DNA, 601 bp, Human
cttacacgggggtgactgagcatctgagcgggatcaccgtggcctgggggcctgcccctcgcccctgagagctcctggttagagccgttgtgggcacagcctaagcttctgcaggccttctctctcacctctctcatatccttccatcatttaagtagattaaactcagaaacatttttagtgctgtgtacaaaccaagggcagcaaaaaacccaacctctatgccaggctgagcttctgttcttcctgactctacagcaagagctctgggcatctctccacgtgaccagctgtgaccacrgacttaggaacactgtttcctacctccttcacctcacctccctgccacctccagcccgtaatttagagagaagctgatgcagttgactcttcccagcttgccatttaaacgcacactgggttatgtgcacagagatgctgccccagtgactgtatttgggtaactgtttcaccctcgtggtgtgacagcccatttgagcgctcttcaaggcacgagatcctcagcaccgtcaacaagtctgtgtctcacctgcaatcacagctcattgagccgccagctaattagagagcccctaagtga

SEQ ID NO: 199029 - DNA, 601 bp, Human
agagatgctgccccagtgactgtatttgggtaactgtttcaccctcgtggtgtgacagcccatttgagcgctcttcaaggcacgagatcctcagcaccgtcaacaagtctgtgtctcacctgcaatcacagctcattgagccgccagctaattagagagcccctaagtgaatcagtgacacaatgccgcctgcaaaagcatcagagccgcggccgcacgcacacagagcggggtgtgagatatcccagccgcacacacacagagcggggtgtgaaatatcccagcccagacgcgtgcacasggggcgggtgtgaaatatcccagccgcacgcacacagggcgggtgtgaaatatcccagctgcacgcacacagagtggggtgtgaaatatcccagccgcacgcacacagggcgagtgtgtaatatcccagccgcatgcacacagggcaggtgtgaaatatcccagctgcacacacacagggtgggtgtgaaatatcccagcccagccacaaacagggcgggtgtgaaatatcccagccacacgcacacagggcgggtgtgtaatatcccagccgcacgcacacagggcgggtgtgaaatat

SEQ ID NO: 199030 - DNA, 601 bp, Human
gatatcccagccgcacacacacagagcggggtgtgaaatatcccagcccagacgcgtgcacacggggcgggtgtgaaatatcccagccgcacgcacacagggcgggtgtgaaatatcccagctgcacgcacacagagtggggtgtgaaatatcccagccgcacgcacacagggcgagtgtgtaatatcccagccgcatgcacacagggcaggtgtgaaatatcccagctgcacacacacagggtgggtgtgaaatatcccagcccagccacaaacagggcgggtgtgaaatatcccagccrcacgcacacagggcgggtgtgtaatatcccagccgcacgcacacagggcgggtgtgaaatatcccagccgcaggcacacagggcgggtgtgaaatatcccagccgcacacacacagggcgggtgtgaaatatcccagccgtgtgcacacagagagggtgtgaaatatcccagcccagccgcacacagagagggtgtgaaatatcccagcccagccgcacacagggcgggtgtgaaatatcccagccgcacacacacagggcgggtgtgaaatatcccagccgcacgcacacagggtgggt

SEQ ID NO: 199031 - DNA, 601 bp, Human
tgtgaaatatcccagcccagccacaaacagggcgggtgtgaaatatcccagccacacgcacacagggcgggtgtgtaatatcccagccgcacgcacacagggcgggtgtgaaatatcccagccgcaggcacacagggcgggtgtgaaatatcccagccgcacacacacagggcgggtgtgaaatatcccagccgtgtgcacacagagagggtgtgaaatatcccagcccagccgcacacagagagggtgtgaaatatcccagcccagccgcacacagggcgggtgtgaaatatcccagccacacacacacagggcgggtgtgaaatatcccagccgcacgcacacagggtgggtgtgaaatatcccagccgcacacacacagggcgggtgtgaaatatcccagccgcacgcacacagagtggggtgtgaaatatcccagccgcgtgcacacagggcgggtgtgaaatatcgcagccacattgttgttgaaagccgttgccgggcctgaaaatcgcagctttttgaacgcacacactgaacctccccggctttgttttctaggaaggacgtggcggctgctgcccaactttgaacggaggag

SEQ ID NO: 199032 - DNA, 601 bp, Human
tgaaatatcccagcccagccacaaacagggcgggtgtgaaatatcccagccacacgcacacagggcgggtgtgtaatatcccagccgcacgcacacagggcgggtgtgaaatatcccagccgcaggcacacagggcgggtgtgaaatatcccagccgcacacacacagggcgggtgtgaaatatcccagccgtgtgcacacagagagggtgtgaaatatcccagcccagccgcacacagagagggtgtgaaatatcccagcccagccgcacacagggcgggtgtgaaatatcccagccgcacacacacagggcgggtgtgaaatatcccagccgcacgcacacagggtgggtgtgaaatatcccagccgcacacacacagggcgggtgtgaaatatcccagccgcacgcacacagagtggggtgtgaaatatcccagccgcgtgcacacagggcgggtgtgaaatatcgcagccacattgttgttgaaagccgttgccgggcctgaaaatcgcagctttttgaacgcacacactgaacctccccggctttgttttctaggaaggacgtggcggctgctgcccaactttgaacggaggagca

SEQ ID NO: 199033 - DNA, 601 bp, Human
aaatatcccagcccagccacaaacagggcgggtgtgaaatatcccagccacacgcacacagggcgggtgtgtaatatcccagccgcacgcacacagggcgggtgtgaaatatcccagccgcaggcacacagggcgggtgtgaaatatcccagccgcacacacacagggcgggtgtgaaatatcccagccgtgtgcacacagagagggtgtgaaatatcccagcccagccgcacacagagagggtgtgaaatatcccagcccagccgcacacagggcgggtgtgaaatatcccagccgcacrcacacagggcgggtgtgaaatatcccagccgcacgcacacagggtgggtgtgaaatatcccagccgcacacacacagggcgggtgtgaaatatcccagccgcacgcacacagagtggggtgtgaaatatcccagccgcgtgcacacagggcgggtgtgaaatatcgcagccacattgttgttgaaagccgttgccgggcctgaaaatcgcagctttttgaacgcacacactgaacctccccggctttgttttctaggaaggacgtggcggctgctgcccaactttgaacggaggagcaca

SEQ ID NO: 199034 - DNA, 601 bp, Human
agccacacgcacacagggcgggtgtgtaatatcccagccgcacgcacacagggcgggtgtgaaatatcccagccgcaggcacacagggcgggtgtgaaatatcccagccgcacacacacagggcgggtgtgaaatatcccagccgtgtgcacacagagagggtgtgaaatatcccagcccagccgcacacagagagggtgtgaaatatcccagcccagccgcacacagggcgggtgtgaaatatcccagccgcacacacacagggcgggtgtgaaatatcccagccgcacgcacacagggygggtgtgaaatatcccagccgcacacacacagggcgggtgtgaaatatcccagccgcacgcacacagagtggggtgtgaaatatcccagccgcgtgcacacagggcgggtgtgaaatatcgcagccacattgttgttgaaagccgttgccgggcctgaaaatcgcagctttttgaacgcacacactgaacctccccggctttgttttctaggaaggacgtggcggctgctgcccaactttgaacggaggagcacaggaggagctccaaggcccctcaggagtcgccactgttgcctccgg

SEQ ID NO: 199035 - DNA, 601 bp, Human
gtaatatcccagccgcacgcacacagggcgggtgtgaaatatcccagccgcaggcacacagggcgggtgtgaaatatcccagccgcacacacacagggcgggtgtgaaatatcccagccgtgtgcacacagagagggtgtgaaatatcccagcccagccgcacacagagagggtgtgaaatatcccagcccagccgcacacagggcgggtgtgaaatatcccagccgcacacacacagggcgggtgtgaaatatcccagccgcacgcacacagggtgggtgtgaaatatcccagccgcacrcacacagggcgggtgtgaaatatcccagccgcacgcacacagagtggggtgtgaaatatcccagccgcgtgcacacagggcgggtgtgaaatatcgcagccacattgttgttgaaagccgttgccgggcctgaaaatcgcagctttttgaacgcacacactgaacctccccggctttgttttctaggaaggacgtggcggctgctgcccaactttgaacggaggagcacaggaggagctccaaggcccctcaggagtcgccactgttgcctccggtcacccccaccttctgttggagtgg

SEQ ID NO: 199036 - DNA, 601 bp, Human
tgtgagcagctgccatcctgtgcccagtccccggggcatacctgcagcccaggctggctgtctttgcttcccagacacctgggaagtctgggctctggggaagacattctgcagctctaattttaaaactatttggcattttcaaatccagttttcaagtccctggggtgggtaaaggatgcttcaagaagaaagtgctctgagccagagtaggaacaatggtgaagggtccaggatggcacaggacgggagcctgccaggtggttctgccagggcccaggaggacagcaaagtcagctgmcggctgggaccaagagacagaaacagagagacagagacagagagagacagagacagaggaacagagacagagagagagacaaagggagcaggagagggacagagacagagatagaaagagacagagggatagggagtcggagacacagagacagagagagacagaaagagacagagagagacagagagacagagacatagagacagagaaacagagagacagagatagagagacacagggagacagagagaaagaatcagagacagagatagccagagaacagcagagacagagtcccag

SEQ ID NO: 199037 - DNA, 601 bp, Human
ccatcctgtgcccagtccccggggcatacctgcagcccaggctggctgtctttgcttcccagacacctgggaagtctgggctctggggaagacattctgcagctctaattttaaaactatttggcattttcaaatccagttttcaagtccctggggtgggtaaaggatgcttcaagaagaaagtgctctgagccagagtaggaacaatggtgaagggtccaggatggcacaggacgggagcctgccaggtggttctgccagggcccaggaggacagcaaagtcagctgacggctgggaccaagagacagaaacagagagacagagacagagagagacagagacagaggaacagagacagagagagagacaaagggagcaggagagggacagagacagagatagaaagagacagagggatagggagtcggagacacagagacagagagagacagaaagagacagagagagacagagagacagagacatagagacagagaaacagagagacagagatagagagacacagggagacagagagaaagaatcagagacagagatagccagagaacagcagagacagagtcccagcagttgcccgtc

SEQ ID NO: 199038 - DNA, 601 bp, Human
atcctgtgcccagtccccggggcatacctgcagcccaggctggctgtctttgcttcccagacacctgggaagtctgggctctggggaagacattctgcagctctaattttaaaactatttggcattttcaaatccagttttcaagtccctggggtgggtaaaggatgcttcaagaagaaagtgctctgagccagagtaggaacaatggtgaagggtccaggatggcacaggacgggagcctgccaggtggttctgccagggcccaggaggacagcaaagtcagctgacggctgggaccaagagacagaaacagagagacagagacagagagagacagagacagaggaacagagacagagagagagacaaagggagcaggagagggacagagacagagatagaaagagacagagggatagggagtcggagacacagagacagagagagacagaaagagacagagagagacagagagacagagacatagagacagagaaacagagagacagagatagagagacacagggagacagagagaaagaatcagagacagagatagccagagaacagcagagacagagtcccagcagttgcccgtcca

SEQ ID NO: 199039 - DNA, 601 bp, Human
ggcatacctgcagcccaggctggctgtctttgcttcccagacacctgggaagtctgggctctggggaagacattctgcagctctaattttaaaactatttggcattttcaaatccagttttcaagtccctggggtgggtaaaggatgcttcaagaagaaagtgctctgagccagagtaggaacaatggtgaagggtccaggatggcacaggacgggagcctgccaggtggttctgccagggcccaggaggacagcaaagtcagctgacggctgggaccaagagacagaaacagagagacagagacagagagagacagagacagaggaacagagacagagagagagacaaagggagcaggagagggacagagacagagatagaaagagacagagggatagggagtcggagacacagagacagagagagacagaaagagacagagagagacagagagacagagacatagagacagagaaacagagagacagagatagagagacacagggagacagagagaaagaatcagagacagagatagccagagaacagcagagacagagtcccagcagttgcccgtccactctctgcctgacctgcaat

SEQ ID NO: 199040 - DNA, 601 bp, Human
catacctgcagcccaggctggctgtctttgcttcccagacacctgggaagtctgggctctggggaagacattctgcagctctaattttaaaactatttggcattttcaaatccagttttcaagtccctggggtgggtaaaggatgcttcaagaagaaagtgctctgagccagagtaggaacaatggtgaagggtccaggatggcacaggacgggagcctgccaggtggttctgccagggcccaggaggacagcaaagtcagctgacggctgggaccaagagacagaaacagagagacagagacagagagagacagagacagaggaacagagacagagagagagacaaagggagcaggagagggacagagacagagatagaaagagacagagggatagggagtcggagacacagagacagagagagacagaaagagacagagagagacagagagacagagacatagagacagagaaacagagagacagagatagagagacacagggagacagagagaaagaatcagagacagagatagccagagaacagcagagacagagtcccagcagttgcccgtccactctctgcctgacctgcaatct

SEQ ID NO: 199041 - DNA, 601 bp, Human
gcagcccaggctggctgtctttgcttcccagacacctgggaagtctgggctctggggaagacattctgcagctctaattttaaaactatttggcattttcaaatccagttttcaagtccctggggtgggtaaaggatgcttcaagaagaaagtgctctgagccagagtaggaacaatggtgaagggtccaggatggcacaggacgggagcctgccaggtggttctgccagggcccaggaggacagcaaagtcagctgacggctgggaccaagagacagaaacagagagacagagacagagrgagacagagacagaggaacagagacagagagagagacaaagggagcaggagagggacagagacagagatagaaagagacagagggatagggagtcggagacacagagacagagagagacagaaagagacagagagagacagagagacagagacatagagacagagaaacagagagacagagatagagagacacagggagacagagagaaagaatcagagacagagatagccagagaacagcagagacagagtcccagcagttgcccgtccactctctgcctgacctgcaatctgcctctt

SEQ ID NO: 199042 - DNA, 601 bp, Human
cccgtccactctctgcctgacctgcaatctgcctcttctgaccttggatgtgccccaaccagagcttttgcaggaggggctgctcactgtggaggggagcccagagctggaccatcaggagacccaggacagacgccccacagcaaaagccaggacacctgaactggtcaggccagcagtgactcagggcctggagagccccgtgggcagaggctgcctggaaggctccaccggccaagggcaggtcagcaaggcaagtcatggccagaaggcagaagggccagcacaaaggccagctttrtaggtgcagagcgggagccaggcgggggcactgggagcacaggcatggttctcggggtgaggacgcctccttggccccactccatgtcactggtgactggtcaacaaggtgcaagctgctaccttcacagagggtgatcctaccggagacagatgagcctcactcactggccataacgtgcccccgaccccctggctccctctgcctatgaccaggccaggccccctgcagtgggtgctgctatcacaattgagggctgaacaccccaggggaaactgagtcctttcagggcagtaataa

SEQ ID NO: 199043 - DNA, 601 bp, Human
acagaggtttctttctcacagttctggagatacccacagattcggtgtcggtgagcgcccactttttggttgggccttcccctgtcatctcacagcagaaggggtgaagaagcgtcctgaggcctctttcagaagcgcattagcccatccgtgaggctcttcctcagggcctcagcgccttgcaaaggcccctaacaccatggccttgggtgaggatttccatgtaggaactggaggcgtggggtaggcggacacaaaccttcagtcgctatggcaattgtgactaataagtaatttgtamttatatacaaaaatgaattcgtttgacattcttttagggttaaaagctgcaccatcaaaagacggtcaggttgttccctcctcatttaagccaattttaaaacgatttttcctcctacaacgtgaaaatgaccacagggtgccatcaggtgactatgcacacttcgtgctgagctggcagaggagggtctagagtgaagcccatctcaagccaagtggaactggtccaaatggaaaaacagccccccgggacgtcttgtcttcggagagccgcgtctccggggcccgggcaggccctgtg

SEQ ID NO: 199044 - DNA, 601 bp, Human
gcgcccactttttggttgggccttcccctgtcatctcacagcagaaggggtgaagaagcgtcctgaggcctctttcagaagcgcattagcccatccgtgaggctcttcctcagggcctcagcgccttgcaaaggcccctaacaccatggccttgggtgaggatttccatgtaggaactggaggcgtggggtaggcggacacaaaccttcagtcgctatggcaattgtgactaataagtaatttgtacttatatacaaaaatgaattcgtttgacattcttttagggttaaaagctgcaccrtcaaaagacggtcaggttgttccctcctcatttaagccaattttaaaacgatttttcctcctacaacgtgaaaatgaccacagggtgccatcaggtgactatgcacacttcgtgctgagctggcagaggagggtctagagtgaagcccatctcaagccaagtggaactggtccaaatggaaaaacagccccccgggacgtcttgtcttcggagagccgcgtctccggggcccgggcaggccctgtggtctccctgcctgggctgtacttgctcagccttttgcaactgcccggtaccaac

SEQ ID NO: 199045 - DNA, 601 bp, Human
tttggttgggccttcccctgtcatctcacagcagaaggggtgaagaagcgtcctgaggcctctttcagaagcgcattagcccatccgtgaggctcttcctcagggcctcagcgccttgcaaaggcccctaacaccatggccttgggtgaggatttccatgtaggaactggaggcgtggggtaggcggacacaaaccttcagtcgctatggcaattgtgactaataagtaatttgtacttatatacaaaaatgaattcgtttgacattcttttagggttaaaagctgcaccatcaaaagacrgtcaggttgttccctcctcatttaagccaattttaaaacgatttttcctcctacaacgtgaaaatgaccacagggtgccatcaggtgactatgcacacttcgtgctgagctggcagaggagggtctagagtgaagcccatctcaagccaagtggaactggtccaaatggaaaaacagccccccgggacgtcttgtcttcggagagccgcgtctccggggcccgggcaggccctgtggtctccctgcctgggctgtacttgctcagccttttgcaactgcccggtaccaacggtcaaggat

SEQ ID NO: 199046 - DNA, 601 bp, Human
tcagaagcgcattagcccatccgtgaggctcttcctcagggcctcagcgccttgcaaaggcccctaacaccatggccttgggtgaggatttccatgtaggaactggaggcgtggggtaggcggacacaaaccttcagtcgctatggcaattgtgactaataagtaatttgtacttatatacaaaaatgaattcgtttgacattcttttagggttaaaagctgcaccatcaaaagacggtcaggttgttccctcctcatttaagccaattttaaaacgatttttcctcctacaacgtgaaartgaccacagggtgccatcaggtgactatgcacacttcgtgctgagctggcagaggagggtctagagtgaagcccatctcaagccaagtggaactggtccaaatggaaaaacagccccccgggacgtcttgtcttcggagagccgcgtctccggggcccgggcaggccctgtggtctccctgcctgggctgtacttgctcagccttttgcaactgcccggtaccaacggtcaaggatgagaattgcagcagagctttaaagacttgggtcccaacgtcactgtctattgactgagtttttc

SEQ ID NO: 199047 - DNA, 601 bp, Human
agtagggatataccttcaattagagtcctgaattttaggcattacttaccaaaaacactgagcaggtttgcccagaaaatacagtctgcatggaacttccacatcccctcactctctaccagaacggcagcccacctcaaagacaccgcacgcggcccacctgccttgcaccccagacaccagggttgaaagcctgagtccaggcaggagccaacctcacagagtcaaatctcggagcaccaggtgaggggaggtctcagcgccactgccgggataagccctcaggatggagacagtcgcrtctgccagatccctttcaccagactgcagagtgaggtgaaaccagggcctcataggtgtgagggccatcggggaggtgccgccggcagaaggagaggtgggaaggctgagtggatggaaggatcaggaatgaccaggaggaagctacagtcaatagctgatggggcttggctgtgttgccccccagcccggtgcatgcagactctgctgacagtcccacggtttgggactctcgtttcactcattcatcatttattgagcatcagggaatatgaaagtggccatggacctccaaacagct

SEQ ID NO: 199048 - DNA, 601 bp, Human
tggagacagtcgcatctgccagatccctttcaccagactgcagagtgaggtgaaaccagggcctcataggtgtgagggccatcggggaggtgccgccggcagaaggagaggtgggaaggctgagtggatggaaggatcaggaatgaccaggaggaagctacagtcaatagctgatggggcttggctgtgttgccccccagcccggtgcatgcagactctgctgacagtcccacggtttgggactctcgtttcactcattcatcatttattgagcatcagggaatatgaaagtggccatggrcctccaaacagctcagaatgtaaaggggaagagctctgtgctgtagctgcaactccagccacaaggaagacaagacccagggctgtgggacgaaggggagagaggactcaggccccagctgcaggattcgagtgcccttcgggagtgagctcgcaggggaggaaccctcctaggacagggcacgtggagctccaggcagcctctccagggccctgcgtgtgctgtttctctgtcttgaaaatgacaccgaacgtttatggccagtgagcacccaccacaagcccacactgtgagctcctt

SEQ ID NO: 199049 - DNA, 601 bp, Human
tgccagatccctttcaccagactgcagagtgaggtgaaaccagggcctcataggtgtgagggccatcggggaggtgccgccggcagaaggagaggtgggaaggctgagtggatggaaggatcaggaatgaccaggaggaagctacagtcaatagctgatggggcttggctgtgttgccccccagcccggtgcatgcagactctgctgacagtcccacggtttgggactctcgtttcactcattcatcatttattgagcatcagggaatatgaaagtggccatggacctccaaacagctcakaatgtaaaggggaagagctctgtgctgtagctgcaactccagccacaaggaagacaagacccagggctgtgggacgaaggggagagaggactcaggccccagctgcaggattcgagtgcccttcgggagtgagctcgcaggggaggaaccctcctaggacagggcacgtggagctccaggcagcctctccagggccctgcgtgtgctgtttctctgtcttgaaaatgacaccgaacgtttatggccagtgagcacccaccacaagcccacactgtgagctccttgcctgccggggaggcc

SEQ ID NO: 199050 - DNA, 601 bp, Human
aggggctgggacgtacagctctggccttgcctccaagtctgtctccaaaacaatgagctggggaagagaaactctgtacggtcctccctactcccttgcccggccggggttgtggtcaggccaccctgggaaagaggagcagcccagggcagctacagaggctcctcctcccacctggggagaggaatccgccttcagggagcagcccatgccctccctggcttctcctgtctggcatcacggctgcggcagagtctaagagaaaggctctcagccgggcaggaccaccaggcacacaagsgggggatgggagttagaggtgccagccctgctcctgacctccctgacctccagcacataacagggaggccaggtccttgtctgacacacccagagaatcatcagatccaaggcccggggtggccggggaccaagtatggctcctatgagaaaacaggcgtctgcaggaggcctgagcctgccccaccagcctcagcacgtaacatgtctagaacattcctagagccagaaggatgtaggaacttccttccagaatacacttcccagtggacagggaaatgggaatcgaatgcagggacca

SEQ ID NO: 199051 - DNA, 601 bp, Human
gtcctccctactcccttgcccggccggggttgtggtcaggccaccctgggaaagaggagcagcccagggcagctacagaggctcctcctcccacctggggagaggaatccgccttcagggagcagcccatgccctccctggcttctcctgtctggcatcacggctgcggcagagtctaagagaaaggctctcagccgggcaggaccaccaggcacacaagggggggatgggagttagaggtgccagccctgctcctgacctccctgacctccagcacataacagggaggccaggtccttgyctgacacacccagagaatcatcagatccaaggcccggggtggccggggaccaagtatggctcctatgagaaaacaggcgtctgcaggaggcctgagcctgccccaccagcctcagcacgtaacatgtctagaacattcctagagccagaaggatgtaggaacttccttccagaatacacttcccagtggacagggaaatgggaatcgaatgcagggaccacccaccacctgccaggggacctctgaccccagggaggaggaaacaaggtcaaatcccaagaccagcctgtgcaacatgat

SEQ ID NO: 199052 - DNA, 601 bp, Human
ggtgggcgcctgtaatcccagctacgtgggaggctgcagcaggagaattgcttgaaccggtagcagtgagctgagatcgcaccatttgggcaacaaactgaaattctctctcgaaaccaacaatcaatacaaaccaataagcccagaacccacaacttcctgatgtagatggacatgttgtgtccggaattggtgggttcttggtctcgctgacttcaagaatgaagccgcggaccctcgcggtgagtgttacagtttttaaagatggtgtgtccagagtttgttccttcaggtgtgtccrgagtttctttcttccggtgggttcatggtctccctgacttcaggagtgaagctgcagacctttgcagtgggtgtcacagctcataaacacagcgcatccagaattgttcattcctcccagtgggttcgtggtctctatggcttcaagagtgaagctgaagaccctcacagtgagtgttacagctcataaaggtagcatatccggagttgttcattcctcgtggtggatttgtggtctcactggcctcaggagtgaagctgcagaccttcgaggtgagtgttacagctcacagacgtagtg

SEQ ID NO: 199053 - DNA, 601 bp, Human
actgaaattctctctcgaaaccaacaatcaatacaaaccaataagcccagaacccacaacttcctgatgtagatggacatgttgtgtccggaattggtgggttcttggtctcgctgacttcaagaatgaagccgcggaccctcgcggtgagtgttacagtttttaaagatggtgtgtccagagtttgttccttcaggtgtgtccagagtttctttcttccggtgggttcatggtctccctgacttcaggagtgaagctgcagacctttgcagtgggtgtcacagctcataaacacagcgcrtccagaattgttcattcctcccagtgggttcgtggtctctatggcttcaagagtgaagctgaagaccctcacagtgagtgttacagctcataaaggtagcatatccggagttgttcattcctcgtggtggatttgtggtctcactggcctcaggagtgaagctgcagaccttcgaggtgagtgttacagctcacagacgtagtgaggacccaaagagtgagcaccagcaaaacttactgtgaacagcaaaaaaacaaaccctccacactgtggaatgggacccaaccggtttgctgctgc

SEQ ID NO: 199054 - DNA, 601 bp, Human
gaatgaagccgcggaccctcgcggtgagtgttacagtttttaaagatggtgtgtccagagtttgttccttcaggtgtgtccagagtttctttcttccggtgggttcatggtctccctgacttcaggagtgaagctgcagacctttgcagtgggtgtcacagctcataaacacagcgcatccagaattgttcattcctcccagtgggttcgtggtctctatggcttcaagagtgaagctgaagaccctcacagtgagtgttacagctcataaaggtagcatatccggagttgttcattcctygtggtggatttgtggtctcactggcctcaggagtgaagctgcagaccttcgaggtgagtgttacagctcacagacgtagtgaggacccaaagagtgagcaccagcaaaacttactgtgaacagcaaaaaaacaaaccctccacactgtggaatgggacccaaccggtttgctgctgctggctctggcagcctgcttttatccccatatctggccgcacctacatcctgctgattggtccattttacagagagttgattggtccattttacagaggctaactggtccgttttgacagagtg

SEQ ID NO: 199055 - DNA, 601 bp, Human
gaacttgccagtgaatgtagaagtactgcggggccatgcgtcagaggtgtgtgggtctaggagacgcagatcaggagtctggcctggctcagatgtccacagccaggaagccgcgggcagagcagcggggtcgaggctgcggctgagtttgtgagctgtggcagccatacttactctgcagggcatgttgagtcctgaaggagacagcactgctgaagtgagcacagcagcaggacagacggctgatccctccttgtgctcccacacacagcagcgagacacaaacggctcgtccctcctsgtgctccacacacagcagccggacagacggctgatccctcctcgtgctcccacatgcagcagccagacacagacggctcatccctcctcgtgctcccacacacagcagccggacagacagctgatccctcctcgtgctcccacacacacagcagccggacacagatggcttgtccctccctgtgctcccacacacagcagcgggacacagagggctcatccctcctcatgctcccacacagcagcgggatacagacggtggtccctcctcgtgctcccacgcagcagcaggacatagacg

SEQ ID NO: 199056 - DNA, 601 bp, Human
cacagcagccggacagacagctgatccctcctcgtgctcccacacacacagcagccggacacagatggcttgtccctccctgtgctcccacacacagcagcgggacacagagggctcatccctcctcatgctcccacacagcagcgggatacagacggtggtccctcctcgtgctcccacgcagcagcaggacatagacggctcgtccctcctcatgctcccacacgcacagcagccggacacagatggctgatccctcctcgtgctcccacatgcaggggcctcagctctcaggaggaaracactcttgagagaagagaactgaggaaaggtagcgctgatgtcaggggaagacgcattcgacaacacgcatgaaaaaaaacacttcttgttacgttcatgccatgcttttgtattcgccacaataagaaaaccaagcaagtacttcagtcaggcggcagccgtcacaggtaaacaaactcctatgtgggaaatgaaccgaggctgtgagcctcaggcagctccccagacccccaagaggagagggagcagtgaccgagcaggccccgtctgcagttcacaccgtctgccatccgtccca

SEQ ID NO: 199057 - DNA, 601 bp, Human
ccacatgcaggggcctcagctctcaggaggaagacactcttgagagaagagaactgaggaaaggtagcgctgatgtcaggggaagacgcattcgacaacacgcatgaaaaaaaacacttcttgttacgttcatgccatgcttttgtattcgccacaataagaaaaccaagcaagtacttcagtcaggcggcagccgtcacaggtaaacaaactcctatgtgggaaatgaaccgaggctgtgagcctcaggcagctccccagacccccaagaggagagggagcagtgaccgagcaggccccrtctgcagttcacaccgtctgccatccgtcccagagcccagcctcttgtagccaagacggggcaggagacagagcaaaaccactgagaccaccactgagagggtaaccaggcttctcagtagaaccaggggcttgccgcagggacgggagctctgactggccacgtcgtggagtctgcagctgcccatggtggagggaatggcatgcaggtgacaaggacatagggaccttgctgtggccacccgccggggtcacagcatgtccacggcaccctgatggaagctttaatcatcaacggtgt

SEQ ID NO: 199058 - DNA, 601 bp, Human
tgtgccaggcactctccgagtcagtgtacatgaatgcacttggccctcttgatgctctatgagtaagtgctgctgggacacacccatttcacaggtactaaagctgagacagagatccactctgcaaacccttgcccagtgccactctggtaataggaagagtgagaatttgagctcaggcagagccactgtcggtggttttgacagaaattatggactctttctgaacttcctaatgagaatttaggaggctctcaggtgccccttcctgtcccactccatagtttggcgtacggactcsgcttattcctgaccctccctgccatcccacctctgtcccctctacccacacctcccgcaggaaggcattcccacccagctcctctgcccgcatccaatggagtgagcaggtgcaggcgatgaatgtactatcaccaataattttggaacttctactacatatgtgtatctaccacatgctgcctgagctcgttgagctggacttttaaagcagcagtgcctcaatatgcctggcctggctggcacacgccgcctgcctagattgcatagggtgagcagtctgcctgtgcccccacgagcc

SEQ ID NO: 199059 - DNA, 601 bp, Human
cccagtgccactctggtaataggaagagtgagaatttgagctcaggcagagccactgtcggtggttttgacagaaattatggactctttctgaacttcctaatgagaatttaggaggctctcaggtgccccttcctgtcccactccatagtttggcgtacggactccgcttattcctgaccctccctgccatcccacctctgtcccctctacccacacctcccgcaggaaggcattcccacccagctcctctgcccgcatccaatggagtgagcaggtgcaggcgatgaatgtactatcaycaataattttggaacttctactacatatgtgtatctaccacatgctgcctgagctcgttgagctggacttttaaagcagcagtgcctcaatatgcctggcctggctggcacacgccgcctgcctagattgcatagggtgagcagtctgcctgtgcccccacgagcccggctgtgcccatatgctgacgttatcctccactgggtacaaaaaggatgacaggaaccctcctcatcacgctcgtcatctcagtaattccctgggagcttttgtttgttttttgttttgtttttctccctgca

SEQ ID NO: 199060 - DNA, 601 bp, Human
ggctctcaggtgccccttcctgtcccactccatagtttggcgtacggactccgcttattcctgaccctccctgccatcccacctctgtcccctctacccacacctcccgcaggaaggcattcccacccagctcctctgcccgcatccaatggagtgagcaggtgcaggcgatgaatgtactatcaccaataattttggaacttctactacatatgtgtatctaccacatgctgcctgagctcgttgagctggacttttaaagcagcagtgcctcaatatgcctggcctggctggcacacgscgcctgcctagattgcatagggtgagcagtctgcctgtgcccccacgagcccggctgtgcccatatgctgacgttatcctccactgggtacaaaaaggatgacaggaaccctcctcatcacgctcgtcatctcagtaattccctgggagcttttgtttgttttttgttttgtttttctccctgcatctgtcttgctgttgctctcagtggaaaacatacaatatttctgacgtgcccaggctttgggccatgctgcaaatgtatcctgccattgtgaaatgaccttcactgcgctcctgc

SEQ ID NO: 199061 - DNA, 601 bp, Human
cgcttattcctgaccctccctgccatcccacctctgtcccctctacccacacctcccgcaggaaggcattcccacccagctcctctgcccgcatccaatggagtgagcaggtgcaggcgatgaatgtactatcaccaataattttggaacttctactacatatgtgtatctaccacatgctgcctgagctcgttgagctggacttttaaagcagcagtgcctcaatatgcctggcctggctggcacacgccgcctgcctagattgcatagggtgagcagtctgcctgtgcccccacgagcycggctgtgcccatatgctgacgttatcctccactgggtacaaaaaggatgacaggaaccctcctcatcacgctcgtcatctcagtaattccctgggagcttttgtttgttttttgttttgtttttctccctgcatctgtcttgctgttgctctcagtggaaaacatacaatatttctgacgtgcccaggctttgggccatgctgcaaatgtatcctgccattgtgaaatgaccttcactgcgctcctgcccagaatgtgtgggaagaaaagggcactcgcggtcccatgggccaaacaaa

SEQ ID NO: 199062 - DNA, 601 bp, Human
ccctcagaggacaccaaaggtttcacagagagagctccacacacctctgaggttggatccagccacacagaggtgtctgctatgcagcaagctaaacacaaccaattcctggtgttgggattaacaagcagcagggcagaccacgagaatgaacatttatcaacagccatcgggaaacatgccctccagctctcacatgttctccaggctccctgggcaaatggagtcctaagtattttatattttttgagctactataaatgggattattatctgatttctttttcagacagttcattcycagtgtataaaaatgctctttatttttgtctgtggattttgtatcctgcaaatttactgaatttattagctctaacagtgtttttggtggcatctttaggattctatatgtaagatcatgtcatctgcaaacagggacaattttaacttcttttgttccaatttggatgccttttgtttcttccttttgcctaattgccctggctaggttttgcaatacagtgttgaaagaagtggcgagagttagcatccttatctggttcctgatcttagaggaaaagctttcagcttttcaccattg

SEQ ID NO: 199063 - DNA, 601 bp, Human
cttttgtatgttttcatgttgctagttagcattcttttctttcagcttgaagaactctctttagaatttcttgtaggacagctctggtggtgattaatccctcagcttttggttggctaggaaggtcttttcctctccttcatttctgaagaacagctttgccaagtacagtattcttggttggccatttttttccttcagcaccttgaatatatcattctactctctcttgcctatagggtttctgctgagaagtctgctataaaccttcctgtaactcctttatatgtgatttgcttcytttctctcactgcttttaagatcctctttgtctttgatttttgacagtttgattataatatatctcagtatagtcttatttggattcaatctaatcggagacttttgatcttcctgtacctagatatttatatatttccccagaattggaatgttttctcatattatttaaatatgctttcagtcccttggtctctcttctccttcttgaatacctgtaactcaaatatttgatcttttggtgttatctcacaaatcccataagctttcttcattcccgtttactctttttctcctctga

SEQ ID NO: 199064 - DNA, 601 bp, Human
caataataaattacctttaaatagtaactttgggctgggcacggtgactcacgcctataatcccagcagtttgggaagctgagacaggtgatcacctgaagtcaggaattcaagaccagcctggccaacatggttaaaccccgtctctactaaaaatacaaaaattagccaggtgtggtagtgtgcacatgtaatcccaggtactcgggaggctgaggcaggagaatcgttcaaacctaggaggcagaggttgcagtgagctgagatcgcaccactgttctccagcctaggtgacagagcmagactctgtctcgaaaaaaaaaaatagtaacttgtgtactttataaatgttttaactacttttaactttttcttataacacttagcttaaaacaaacacatagtacagcagtataaaaatagtctctttatatccttattctataagctttttcctatttacacttttcttccacttttaaaacttttttgttaaaaaaaaaaaaaactaagacacaaacacacaccctagcctaggcctacacagggcaggctcatcaatatcactgtcttccacctccacatcttgtcccacaggaag

SEQ ID NO: 199065 - DNA, 601 bp, Human
aatgcatgttttaatgaatatagactaactcaagttttctttactttttgagtcacttttatcaacttacaggttttttttctaattgccttttcaaatttcttagaacaaagtcattagtagtgttttcttacgattcttgaattcaatttacctatggtggaattccctttttcctctcattaattgtgtacttatgcccttttttgtcattgtcggtaaaaagagctctgtaagtcttttcaaagacccagagatatttctgctgtttgtgttcttgatgcttgccctcatttcttcrtacctatttcagtattttctgctcttgtcttcattattttcttctttttaatgtcttttgcttgctttgttcgtccttttattcttattatgaaacgtttcaggcacacaaaaaggaataaaataatatgacacaggttgaatatccctcatctgaaatgtttgggactagaagtgctttggatttcagatatgtttggatttattctggaatatttgcatgtacataatgaaatatcttggggacaggacccaagtcgaaacatgaaattacttgtgtttccttataccttatatagaa

SEQ ID NO: 199066 - DNA, 601 bp, Human
ggtgcagctcagcccgttttcaaatccagcaggatgttcatgacctccctgcagacactaatggacagaacgtcacagcagtctggtgagcgatgatgtcagtgcattattaaattcaaactggaggggaagttttgacactaatcaatgctttttatcccacccaagactggcatattcccgagacaaatctcagtggttactgaatagcttgcagacctgggctgccctggggaaactgccatgcaagtctgtccttcccacctttctgcagatgcacgcagggctctcaggaagcaattttttttttttttttgagatggagtctcactctgttgcccaggctggagtgcaatggcatggtcttggctcactgcaacctctgcctcccaggttcaagcaattctcctgcctcagcctcaggagtagctgggactacaggtgcatgccaccacacccggctaatttttgtatttttagtagagatggggtttcaccatgttggccaggctggtcgtaaactcctgacctcttgatccgctggcctcagcctcccagagtgctgggattacatgtgtgagccaccacgcctgaccaggaa

SEQ ID NO: 199067 - DNA, 601 bp, Human
caaatccagcaggatgttcatgacctccctgcagacactaatggacagaacgtcacagcagtctggtgagcgatgatgtcagtgcattattaaattcaaactggaggggaagttttgacactaatcaatgctttttatcccacccaagactggcatattcccgagacaaatctcagtggttactgaatagcttgcagacctgggctgccctggggaaactgccatgcaagtctgtccttcccacctttctgcagatgcacgcagggctctcaggaagcaattttttttttttttttgagakggagtctcactctgttgcccaggctggagtgcaatggcatggtcttggctcactgcaacctctgcctcccaggttcaagcaattctcctgcctcagcctcaggagtagctgggactacaggtgcatgccaccacacccggctaatttttgtatttttagtagagatggggtttcaccatgttggccaggctggtcgtaaactcctgacctcttgatccgctggcctcagcctcccagagtgctgggattacatgtgtgagccaccacgcctgaccaggaagcaattttttttagctcatt

SEQ ID NO: 199068 - DNA, 601 bp, Human
gctgtcttgaaattctcaaagattttatctcccaacctatattttgtgtgagacatcccatgaggcgacgtggtgcgcgcacctgcagagaagacaccccaatctgcacgcccacagcgcctcgcccgccacccagtcccgcagcgcctcgcccgccacccagtcccgcagcgcctcgccccccacgtgtctgtctgtgctcatgtggccctaagaggccactcctctgcttacccagagcttgctgcaaaccacaaagtgcaacagtgttctaagaaacacaaacgaccaagggtcccaccctctctcccactcacattgctttcccacataagccaccatttatgctgaacgtggccgtgtggagggaggggaggtgggcagcccacagtccttctcatgtgtgagcaaaggtggagaatctcggtggacaggggctgtttcatgaagggaaataaacacagccgagtgagtttcacacagcatttccaccgctgtaatgagaatgaaatacatatgcatgtttgagctgtgacagatgaactatgtagttgttcagattctgcatgtgaattaaatgttctttcatttgcatttgaaa

SEQ ID NO: 199069 - DNA, 601 bp, Human
atactataactagttcctttaggggcacttttccttgatttctgaactaaggacctgtatttgcactttgcacgggccgtgcaaattaaacagacagcattgcagggcatgaacacagacgaaccacgaccaactcagctgtcccgaggctctgtgttaacggctcctgacacactcccctcctccctgttctgatctgtttgcattaatatgcgctcaattgtaagaagctgaacagatgtatttattcagaattcccaagcagctaactagaactcccaattctgagtcatcgtcttakctcccgaggtgcttagcagaatgctctgtatttatcagcttcccggttaacctacacaccactccccagctcttgctggtttgagttatgtgaaccttcaacatcattagggaagcttctaccacacttagtactgataagcaaagtgcattcacacttcctgaggatttaatgagtggcaccatctaaattaatcttaagaacaatcccatttgctgggcgtggtggcccattcctataatcccagaactttgggaggccaaggcaggtgcattgcttgagcccaggagtttgagacca

SEQ ID NO: 199070 - DNA, 601 bp, Human
cattatactaatttaccatacaggattaaaatgtcattaagcttgcaatgtgtaaaccttaaaacagctggataaaaatttaagacaggaataagaagaaagccattcatattgttggtatataaaacaagcttcagagagtgttagtcccattttattcatggaagaaaataaatatgaagacactgaaatcacctggagaatttttaggagatgctgatggcaggcctcatatgagacaaatcaattcagaatctttgaagggtaagccccagacaccatggtttccgaggctcccaarttattttaatataacgtcagggctgacaactactgctcctgttgatgaagagggtcaaactctgaaaactatttgaagaaatgtattctgagccacatgtgggtgaccaatggcccaggccacagccccaggagagcctaagatcatgtgcccaaggtggatgggcttcagcttggatttctacacactagggaggcataagacatccaacaatacactaagatgtgcacaggcttggatttctacatgctagggaggcataagacacccatcaatacacataagatgtacacaggcttg

SEQ ID NO: 199071 - DNA, 601 bp, Human
cacatgatgaaaaaacacaaactttacagaattagttcagaatagtcactaagcaagcaaccaacaataaacagcaacaacaacaacaacaacacctaaggagagggaaattctggttttcaaagttgccacactatgttatttaaaatattgagttttactaaaaatttttgaggcattcaaagaaacatgcaaatgtgcctcttccacaggaaaacaatagaagctgttcttggggaagccaaatggcttacaagacaaagactttaaatgagctgttttttgttttttttttttttgkttttttttttttagacagagtcttgctctgtcatccaggctggagtgcagtggtgtgatcccagcctactgcaacttctgcctcccaagttcaattgattcccctgcctcagcctcccaagtaactgggattacaggcatgcaccaccatgcccagctaatttttgtatttttagtagagacggggtttcaccatgttgggcagactagtcttgaactcctgacctcaagtgatccacccgcctcggcctcccaaagtgctgggattataggcatgagccactgtgcccagactaaatga

SEQ ID NO: 199072 - DNA, 601 bp, Human
atgctgggaggatgcagacagagcattctgtgaggcctgggaaaggaggaacacgctatcggacggtggagaagaggctgtgctcctcgcagagtggtgaggaccatggccgaatgcgttcatgctctgggctcctgtggaaggtagagcttgtgaatgaggaattggaaacagtgcacctcagtggcagagggcctcacaaatggccggccggagatgggggctgggtggaaggagccgctgggcctgctcgggaggttcctccattgccctgcgcagcctgagccagacagagcgcaartcccacggagggcgagccctgagccggacagagcgcaagtcccacggagggcgagccctgagccggacagagcgcaagtcccacggagggcgagccctgagccggacagagcgcaagtcccacggagggcgagccctgagccggacagagcgcaagtcccacggagggcgagccctgagccggacagagcgcaagtcccacggagggcgagccctgagccggacagagcgcgagtcacacggagggtgagcaccacgcgtgactccaacacacccacctgtgctcaccagacgtgagcca

SEQ ID NO: 199073 - DNA, 601 bp, Human
aagattcttaccaggaaatgaatccacagtcgttttcatgacagcaaattgcatgccaacgagtgacatttaaatgctgaattttaatggcttgtcagaaaaagtgaaatgtatttaaaaaaaaatcatacatgagagagcagtgtgtctgcccatgaaataatgctgcctgtagtagacaagaatggtaaaaacacagtgaacgtattttgttctgtgatgtacacatctacctggaggaagaaggttgtgaaattaactcccatttaccctcctcttcgtgcagaagactctgaaggcygcgcaagcagctgtctgtcaatgaatctgacaactgcacctgcaagaagtggcctggatgaagacgacaggcagaagcacaggatcaactctgtttcaagcgcagttaccaagacagaatcatttctggaatcctgaaaaacctgcatatgaacatgctcacgtgtagacacccacacacatgcacacacacctgcacacacactcacatgctcatgtgtagacacccacacacctgcacgtgtagacacccacacacgcacacacctgcacacacatgtgctcacgtgtagacacccac

SEQ ID NO: 199074 - DNA, 601 bp, Human
cttctgaccaagagccctcacttcacagtcaaagaagggcagcagtgggccggtgctgtgggaattccctggtcctaccatgttgccatatataatttttaaattatcataattttaaaaattatcttctcatcacccctgcagggaccacctgcaacaaaaatttcacaacagtgacaggcagaggctgattctctccaggccgagccacgcctgcactggacccagccaggcccagataagcagccgacgcctgcctactttgtgccaggcccagctgcgggccactgcagcctcctgkcatctcctccctcagacacaggaggcagcaggcctgggctcctccaaacccaggaacggacgatcccagtaggaagcacccatgagcccagcgcccggctcccacctgccccttccaccaccacactcgtggattcagtccgtcccagctcctcaccgcccaggaggagaagccaagcccgtgcggtcgctcagtgcggcagccgccgagcctcggcccacgcccgccctacctgtgccggaaagcttctgcaacgccacgcgcaggcgctgcagggccacgggcgacacctcgtagcgg

SEQ ID NO: 199075 - DNA, 601 bp, Human
ttctgaaatgttctttaaaatgcttcacctagtttttcttgtctatcagtatattctgtatatcacaaccaccaggtaggcacataacgcagagtgggtgctggcaggccaaggaggaactgctgttattaagattgtgctgtggggctgtgtttggtggtttctgaggttagaagggaacctgggtaaagagttgggagagaagtgtgctgataatttttcagctttgaggttcgtgtgatggtgattgcttggaagtcacttgtgctccagaactaagtactgtgcagttaagggtggkcgtggtagcacttagggtcttccacgttaatgaaaatgttttatgagatcaaaggatttctacagttaggagagacttcagagaatctcagggccaaatcgccttgcttacaagttcggaaggtgagctgcagaacatttgaaggagtgcccattcacacagcaagctagtggcagaccatctgagactccatgccatttacacagcgccgcgcggcctctgttgcaggcaggaacaccccacgggccacggatgttggtcccttttcaccaaggagtgcatctctgctctgagggagtg

SEQ ID NO: 199076 - DNA, 601 bp, Human
caaacactaaagagatccttgtgcaagtgaaattgaggaggaagggcgagagggaagctgggtagggaaggaaaaggcgtctcagctggaggctagcgttaaccccatctcaccaggagcatgctacaattggccctaattgcggcagaggggttggtggctgcaggctgctgcccctccgggatgagggtgggagtgtggcactgctaaccctgagccgagggccattcttctgggagagagtggcagtaaagagcccttagtaggaactggcagcagctggggcatgggtgccctggcstggttaaggaatctgggtggggagccagctgtatgtacagcttgaaggatttttgcatatggacactctcctgtagatggaacaccactcacatcaaaggaagaccatccccagcattccagaggctcccctgcactctcacccattcattacagtcatatgtgacttaaagagggggacgctgtcactagtccagttggttgttgtgggaccgtcctagagtgcacttaacagaaacctatagccagtgttgcccactgcacacctagctgcttggtacagcccgttgcccctatgcta

SEQ ID NO: 199077 - DNA, 601 bp, Human
tcccctgcactctcacccattcattacagtcatatgtgacttaaagagggggacgctgtcactagtccagttggttgttgtgggaccgtcctagagtgcacttaacagaaacctatagccagtgttgcccactgcacacctagctgcttggtacagcccgttgcccctatgctacacacctggacagcgtgtttctgtgctgaatactgtaggcagctcttcatgcaatggtgagtgtctgtgcatccaaacgtagatacagtaaaaatacaaattataatcttatgggaccacggtgtayatgtggtctgttgtcgacagactgagaggtcattatgccatgtatgtctgtagccccacaaaggtgactgtccttctgacctccattactgtagatgagcgttacctgttgaacttcaggggcatggagccactcaccacttgtcgtttgtgcccggctgctttggcttggcttctgtctgagaggtggactccatccgcctcggtgcacggcattgccctttgtgtgaacgcaccgtggctgattctgttttcttacagacctttgctgtgtgtgccttttggtgcacataatactctt

SEQ ID NO: 199078 - DNA, 601 bp, Human
cttggtacagcccgttgcccctatgctacacacctggacagcgtgtttctgtgctgaatactgtaggcagctcttcatgcaatggtgagtgtctgtgcatccaaacgtagatacagtaaaaatacaaattataatcttatgggaccacggtgtatatgtggtctgttgtcgacagactgagaggtcattatgccatgtatgtctgtagccccacaaaggtgactgtccttctgacctccattactgtagatgagcgttacctgttgaacttcaggggcatggagccactcaccacttgtcstttgtgcccggctgctttggcttggcttctgtctgagaggtggactccatccgcctcggtgcacggcattgccctttgtgtgaacgcaccgtggctgattctgttttcttacagacctttgctgtgtgtgccttttggtgcacataatactcttgtgctgggtcctagatgatacgcatgttcagctgttgtgcacaccgctgccacagtttccccgtgtcgcacgcccacagcatctgaaggtatccaggtttccacatccttgccaacacttgatattgcaagtcctttaattttagt

SEQ ID NO: 199079 - DNA, 601 bp, Human
tgctacacacctggacagcgtgtttctgtgctgaatactgtaggcagctcttcatgcaatggtgagtgtctgtgcatccaaacgtagatacagtaaaaatacaaattataatcttatgggaccacggtgtatatgtggtctgttgtcgacagactgagaggtcattatgccatgtatgtctgtagccccacaaaggtgactgtccttctgacctccattactgtagatgagcgttacctgttgaacttcaggggcatggagccactcaccacttgtcgtttgtgcccggctgctttggctyggcttctgtctgagaggtggactccatccgcctcggtgcacggcattgccctttgtgtgaacgcaccgtggctgattctgttttcttacagacctttgctgtgtgtgccttttggtgcacataatactcttgtgctgggtcctagatgatacgcatgttcagctgttgtgcacaccgctgccacagtttccccgtgtcgcacgcccacagcatctgaaggtatccaggtttccacatccttgccaacacttgatattgcaagtcctttaattttagtgaggatgtagtttctttgtggtt

SEQ ID NO: 199080 - DNA, 601 bp, Human
ctaaatttcccttggtcctgattcagaaaaagtagaattgtttggagcttagtcctgaaggatgggtgtaattaggatgggtggaagacgagaaggcattccaggttcgtggagcggggtgtgtggagtacatgtagattggattacattgattcaaagtcactttggggagctaaacattgattacacatggacataaagatgggatgatagacaccagggactactagagggggaaagagagggacggggacaagggctgggaagctacctgttggtaactgtgctcactccccgggtratgggatcattcacaccccaaacctccgcgtcctgcagtatattcttgtaacaaacgtgcataggtaccccctaactctaaaataaaagttgaattttttttttttttttgagatggagtttcgctcacgctggagtgcagtgttgcccaggctggagtgcaatggtgcgatctcagctcaccacaaacctccacctcccgggttcaagcgattctcctgcctcagcttcccgggtagctgggattacaggcctgcaccaccacgtctggctaattttgtatttttagtagagatggggt

SEQ ID NO: 199081 - DNA, 601 bp, Human
aaaagtagaattgtttggagcttagtcctgaaggatgggtgtaattaggatgggtggaagacgagaaggcattccaggttcgtggagcggggtgtgtggagtacatgtagattggattacattgattcaaagtcactttggggagctaaacattgattacacatggacataaagatgggatgatagacaccagggactactagagggggaaagagagggacggggacaagggctgggaagctacctgttggtaactgtgctcactccccgggtaatgggatcattcacaccccaaacctcsgcgtcctgcagtatattcttgtaacaaacgtgcataggtaccccctaactctaaaataaaagttgaattttttttttttttttgagatggagtttcgctcacgctggagtgcagtgttgcccaggctggagtgcaatggtgcgatctcagctcaccacaaacctccacctcccgggttcaagcgattctcctgcctcagcttcccgggtagctgggattacaggcctgcaccaccacgtctggctaattttgtatttttagtagagatggggtttctccatgtcggtcgggcgggtctcg

SEQ ID NO: 199082 - DNA, 601 bp, Human
attggattacattgattcaaagtcactttggggagctaaacattgattacacatggacataaagatgggatgatagacaccagggactactagagggggaaagagagggacggggacaagggctgggaagctacctgttggtaactgtgctcactccccgggtaatgggatcattcacaccccaaacctccgcgtcctgcagtatattcttgtaacaaacgtgcataggtaccccctaactctaaaataaaagttgaattttttttttttttttgagatggagtttcgctcacgctggagygcagtgttgcccaggctggagtgcaatggtgcgatctcagctcaccacaaacctccacctcccgggttcaagcgattctcctgcctcagcttcccgggtagctgggattacaggcctgcaccaccacgtctggctaattttgtatttttagtagagatggggtttctccatgtcggtcgggcgggtctcgaactcccgacctcaggtgatccgcctgcctcagcctcccaaagtgctgggattacaggtatgagccactgcgctcagcctgaaatttttttttaagtcacactgatttct

SEQ ID NO: 199083 - DNA, 601 bp, Human
gagaccagcctggccaacgtggtgaaaccccgtcactactaaaaatacaaaaaattagctgggcgtgggaggctgaggcaggagaattacttgagccctggaggtggaggttgcagtgagcctggattgtgccagcgcattccagcctgggtgacagagcatgactctgtctccaaaaaaaagaaaaaaggaggaggcccggcactttggaaggccaaggagggtgtatcacctggagtcaagagttcgagaccagcctggtcaacatggtgatactctatctctactaaaaatacaaaarttagccaggcgtggtgacaggtgcctgtaattgcagctactcaggaggctgaggcaggagaattgcttgaacccgagaggcagagattgcagttagctgagatcacgccattgcactccagcctaggtgacgagagtgatactcttttaaaaaagaaaaaaggaagaaatcctcattgcatattcatccatccctcccatccctgtaacacctggcaaccactgatctttttactgtttctactctagccttttccagaatgtcatatagttggaatcatatactatgtaatcttttcag

SEQ ID NO: 199084 - DNA, 601 bp, Human
tgcctgcctttgctcctttgtcaaagatcagttggctatatttttatggatctatttcttttttttttttgagacgaagtctcgctctgtctcccaggctggagtgcagtggcgcaatctcggctcactgcaacctctgtcaagcagttctccggcctcagcctaccgagtagctaggattacaggtgtgcaccaccacacctggctactctagtacagacgggggtttcaccatgttggtcaggctggtctcgaactcctgacctcgtgatctgcccgcctgggcgtcccaaagtgctgsgattacaggcatgagcccctgcgtccggcctttacgatctgtttctaagctctgttatggctttattctctcctccattgatctctctcccttttgtcaataccataccatcttgattactgtaacagatctgtagtaaactgtactacttagtatatatattaaactaaacttttttttaatttgagagggagcctcctgttgcccaggctggagtgcagtgttgtgacctcagctcactgcaaactctgccttctgggttcaagtggttcttctgcctcagcatcctgagtagctggg

SEQ ID NO: 199085 - DNA, 601 bp, Human
tgttggtcaggctggtctcgaactcctgacctcgtgatctgcccgcctgggcgtcccaaagtgctgcgattacaggcatgagcccctgcgtccggcctttacgatctgtttctaagctctgttatggctttattctctcctccattgatctctctcccttttgtcaataccataccatcttgattactgtaacagatctgtagtaaactgtactacttagtatatatattaaactaaacttttttttaatttgagagggagcctcctgttgcccaggctggagtgcagtgttgtgacctcrgctcactgcaaactctgccttctgggttcaagtggttcttctgcctcagcatcctgagtagctgggtgggcatgtgccaccacacctggttaatttttgtatttttagtagaaactggatttcaccatgttggccaggctggtcttgaactcctgacctgaagtgatccgcctgcctcagcctcccaaagtgctggggttacgggagtgagacaccgcgcccaaccatagtaagcattgaagtctggtagtgtgagtccttcgacttccttcttctttagtattgtgttggctattgtgg

SEQ ID NO: 199086 - DNA, 601 bp, Human
aggattatagttgaaaaggagtggtgagaacttgccttgttcttaatcttagtgggaaagctttgagtttctcatcatgaagtatgatgtttggtgggttttttggtagatattctttatcaaattggggaaattcccctctattcctagtttgcagaattttatcatgaatgaaggttgggttttgtcagatgctttttctgtatctgttaatgttatgtgattttccttctgcagcttgtggatatgatggatcacattaagtcattttagaatattgagcccgtcttgcgtatctggrataaatcccacttgactgtgatgcataattctttgtatacgatgttagattgagcttgttgatattttgttcaggatttttgcatctcttttgatgagggacatcaatttagggtgtttttgtgatgtctttgtctggtttggtattagggtgatactggccttatggaatgaggatactctagggcctaccaaaaccaattactatagtttttttgttttattttgtttttttgagacagagtctccctctgtcgcctaggctggagtgcctggagtacagtggtgcgatctcactgcc

SEQ ID NO: 199087 - DNA, 601 bp, Human
cttctgcagcttgtggatatgatggatcacattaagtcattttagaatattgagcccgtcttgcgtatctggaataaatcccacttgactgtgatgcataattctttgtatacgatgttagattgagcttgttgatattttgttcaggatttttgcatctcttttgatgagggacatcaatttagggtgtttttgtgatgtctttgtctggtttggtattagggtgatactggccttatggaatgaggatactctagggcctaccaaaaccaattactatagtttttttgttttattttgtttttttgagacagagtctccctctgtcgcctaggctggagtgcctggagtacagtggtgcgatctcactgccacctccatctcccgaattcaagtgattctcctgtctcagcctcccaagtagctgggcttacaggcgcccaccaccaggcctggctaatttttttgtatttttagtagagatggggtttcgccatgttgtccatactggccttgaactcctggcctcaagtgatctgcccacctcagcttcccaatgtgctgggattacaggtgtgagccaccatgcttggcctcaatt

SEQ ID NO: 199088 - DNA, 601 bp, Human
tatcaagagtctaacaaggccaggcatggtggctcacacctgtaatcctagcacttttggaggtggaggctggcagatcacttgaggtcaggagttccagaccagcctggccaacgtggtgaaaccccatctctactaaaaatacaaaaaattagctgagtgtggtggcacccgcctgtaatcccagctacttgggaggcagaggcgggagaatcgcttgaacccaggaggcagaggttgcagtgagctgagatcataccactgtcctccagcctgggtgacagggcaagactctgtctcaaaaaaaaaaaagagtctaacaagatatgtcccctctaatccagcagaacaaatttctacatttagaaacgtaaaaatttattctagtgaactaatatgcataagagaagatgcatgggaaaggtgatttatggcattacttataatactgaaaaatactgaaacagcctacatgtctaaatacaggacatttgttaaataaccgttaatataacaatgcagtgaaatactgtgcagccatttaaaatggtcatgatgcgtattaatgtctgtcattaatttattaacatacttgtattta

SEQ ID NO: 199089 - DNA, 601 bp, Human
ggcgggagaatcgcttgaacccaggaggcagaggttgcagtgagctgagatcataccactgtcctccagcctgggtgacagggcaagactctgtctcaaaaaaaaaaaagagtctaacaagatatgtcccctctaatccagcagaacaaatttctacatttagaaacgtaaaaatttattctagtgaactaatatgcataagagaagatgcatgggaaaggtgatttatggcattacttataatactgaaaaatactgaaacagcctacatgtctaaatacaggacatttgttaaataacygttaatataacaatgcagtgaaatactgtgcagccatttaaaatggtcatgatgcgtattaatgtctgtcattaatttattaacatacttgtatttatgaacatgatttattgttaatggaaataagtagattacaaaacaggattgcagtctgcatttaaattatgtttatctgaacagtaaagatagctagtttcccagtttcttaatttccattgaataaaagaaagatactagttgcttattgctgtgtaatagagcttaaagcaatacgtttttgttaccttggtcagttctgtg

SEQ ID NO: 199090 - DNA, 601 bp, Human
aacaagtaaatagagacctgacttaaaatgctatttttctagatgtgccctcctgatcatgtgctggcttttcttgtgaactgttaccttctcccgtatgctgcttggaaatgcttaggttcctgcattatcctgccggaaatactatctattaagccgtttaagtgtcttcctcaaaaaagcccagtagaaccataaggagtaattttttgtaacaatgcaaattcactgatttagatcatttagctttttaatccatttgcccttggagagaagagggggctatgcaattggaccaagrggagtcaatgattttgaagtcagtcagcccttggtttgtcaccatgacaaccgtggagcaggaggtagccacatcatgacagggaggagaggtgagtgaagtgagaagcaggggagcatcacagtaaagtggccgtcatctgagaactcttctgcacagcctcgtacccagaagtttgttccccttctgttctagtaccatgtgtgtatcctatttccagaaccccaagcaagcatcagtttttgtgtgctggactgggtaggattcttaggactatttacatattaacattactgtcac

SEQ ID NO: 199091 - DNA, 601 bp, Human
gcccttggtttgtcaccatgacaaccgtggagcaggaggtagccacatcatgacagggaggagaggtgagtgaagtgagaagcaggggagcatcacagtaaagtggccgtcatctgagaactcttctgcacagcctcgtacccagaagtttgttccccttctgttctagtaccatgtgtgtatcctatttccagaaccccaagcaagcatcagtttttgtgtgctggactgggtaggattcttaggactatttacatattaacattactgtcaccagttagagggacagcatgggcaaagstgtccaaccatggagacgtggtgttcagctacaggttgtggccagaatgggggtgggcaaagggtgtagggaaagtggaagagaaggctgggaggaaggtagtcagggacagagctgggaggaaggtagtcagggagagagctgggggaaaggtaattagggacagagctggggagcattgtaggccacactaaggcatattcagggaggactggaaagccgctaaagagttttaagcacattaatgagacttaggttttagagatgcgtggggggcagtttgggtgtttgaatctaggg

SEQ ID NO: 199092 - DNA, 601 bp, Human
gttcatcttttctgggcttttctttgttgtattgcgtaatgggagagtcacaattctctttctaatttgtttttaacagagtccaggtctcacggcgttgcccaggctggtcttgaaccgagctcaattgatcctcccaccttggcttccccaggtaatcccaagtgttgggattacaggtgtgagccacacgcccagccagaaagtcataattcttgataaggataaaaccaaactagattatcacgaatcttccttgctctaagaatggttgcgtttctactctgcagtcagtggcctwtttaaaaagttaacttttcctcccggcactctgggaggctaaggcaggcagatgccttgagcccaggagttccagatcagcctgggcaacatggcgagatcccgtctatactaaaaatacaaaacaaacaaacaaacaaaaaaacgggcatggtggtatatgtacctgtggtttcagttactcgggaggctgaggtgggaggacggcttggtggggcgggggcgaggttgcagtgagtgagccaagaccgcgccactgcactccagcttgggtgacagagcgaggccctgtctggggggg

SEQ ID NO: 199093 - DNA, 601 bp, Human
atacaaaacaaacaaacaaacaaaaaaacgggcatggtggtatatgtacctgtggtttcagttactcgggaggctgaggtgggaggacggcttggtggggcgggggcgaggttgcagtgagtgagccaagaccgcgccactgcactccagcttgggtgacagagcgaggccctgtctggggggggaaaagttaactttttctgtttaaaaaaaatgataggccgggcacggtggctcacacctgtaatcccagcaccttgggagggaggccgaggtgggtggatcacgaggtcaggagttyagaccagtctggccaagatggtgaaatcccgtctctactaaaaatgcaaaaattagccaggtgtggtggcaggcggctgtaatcccagcaacttgggagactgaggcggagaattgcttgaacctgggaggtggaggttgcagtgagccaagatcacaccactgcactccagcctggtgacagttcgagattctgtctaaaaaaaaaagataaaaggtcagaccttctaaagagtatccatgaaatcatcttctcactgaatcccctaacttcccaccattattttctcagtatcctctc

SEQ ID NO: 199094 - DNA, 601 bp, Human
cttggtggggcgggggcgaggttgcagtgagtgagccaagaccgcgccactgcactccagcttgggtgacagagcgaggccctgtctggggggggaaaagttaactttttctgtttaaaaaaaatgataggccgggcacggtggctcacacctgtaatcccagcaccttgggagggaggccgaggtgggtggatcacgaggtcaggagttcagaccagtctggccaagatggtgaaatcccgtctctactaaaaatgcaaaaattagccaggtgtggtggcaggcggctgtaatcccagcwacttgggagactgaggcggagaattgcttgaacctgggaggtggaggttgcagtgagccaagatcacaccactgcactccagcctggtgacagttcgagattctgtctaaaaaaaaaagataaaaggtcagaccttctaaagagtatccatgaaatcatcttctcactgaatcccctaacttcccaccattattttctcagtatcctctcagaacaagtctaaacataaacatgtcctcccctctcattttcagttaaaatgagagatcatattgctttttcacctcaacaaaatatctt

SEQ ID NO: 199095 - DNA, 601 bp, Human
cagcaacttgggagactgaggcggagaattgcttgaacctgggaggtggaggttgcagtgagccaagatcacaccactgcactccagcctggtgacagttcgagattctgtctaaaaaaaaaagataaaaggtcagaccttctaaagagtatccatgaaatcatcttctcactgaatcccctaacttcccaccattattttctcagtatcctctcagaacaagtctaaacataaacatgtcctcccctctcattttcagttaaaatgagagatcatattgctttttcacctcaacaaaatrtcttagtgattccatatcggcatctttatatttgttatttttcatggtatataatactccatagcatagtttgatacttaatataaccactttcctatcaatggatacatataaattgtctttagagttttgctattaaaatagtgccttatttaccacacaattctgaggtaagaaaagaaagtctcttggcgtatattgtgatatttaaatgattgcgttttgcattggatacttcattttttctctagtcaagtgaagcagaaggagtggagaaggaacaaagaaatctataactgg

SEQ ID NO: 199096 - DNA, 601 bp, Human
aaagaaagtctcttggcgtatattgtgatatttaaatgattgcgttttgcattggatacttcattttttctctagtcaagtgaagcagaaggagtggagaaggaacaaagaaatctataactggttgtagtcagactttatttttaaaaatgagctcttgtgattgtaaaataatatttataattggaaatgtaggctatactgaaatgtatttaataattacctattggaaccctacccatcccttagaaatgaaatgctgttaatgcatagtcagtttttttccccatctttgtgatgrtaaatggtcaaatattttcctagcattttaaaaactttcttttgaacttgcatcatcttgtgcattatgttttataaatatgatttttagtggctgatgatgatgcacctgtaagtatgttttgcatttgtgaaattggcggttctcatattttcatagagattcttatttcatgtaggtctgcaaaaaagaatcccaccccctccacacgcacacacacacattgtagcttatgcattactcacaaatgttaacttttaacattttcctttactcaaaggcaatgttctttgaagtgta

SEQ ID NO: 199097 - DNA, 601 bp, Human
gtgaagcagaaggagtggagaaggaacaaagaaatctataactggttgtagtcagactttatttttaaaaatgagctcttgtgattgtaaaataatatttataattggaaatgtaggctatactgaaatgtatttaataattacctattggaaccctacccatcccttagaaatgaaatgctgttaatgcatagtcagtttttttccccatctttgtgatggtaaatggtcaaatattttcctagcattttaaaaactttcttttgaacttgcatcatcttgtgcattatgttttataaatatgatttttagtggctgatgatgatgcacctgtaagtatgttttgcatttgtgaaattggcggttctcatattttcatagagattcttatttcatgtaggtctgcaaaaaagaatcccaccccctccacacgcacacacacacattgtagcttatgcattactcacaaatgttaacttttaacattttcctttactcaaaggcaatgttctttgaagtgtataaaatggctagcattatgttagtgcctgagagccagaaaatactgaactgaaacagatgtgaagctgataattctgtg

SEQ ID NO: 199098 - DNA, 601 bp, Human
tatttagtgaagaaagcattttccccccatttgaaatcatcttggtaagacaaaacgaaaagaaaatcaccttggtaaatggcatttgtaagatttggtcatatttaatgttcagagaagataacgatagtacctaaagctccacaggcacccagagcagttggctgtgctcactgtggatttcacattggtgggtagttacagcagggagcgtgcacgctgtcaggacgatggcctcggtcgtttcagagaccctttgggtgtttgatggaccttgtctgtaactgctactaggcatccytacgggttctacatctgcataatttgaaagataaggatgttttcaactatgagtacaataaattgaaaccaaaaacttgttaatcaataggaagttcagtcctttttcaaaatcaaactgctttctcctggtaccttatttgcccctttcctcccagccactcagtggtgaacttgttcctcattatattgagctgtttttagaacttgttctcatattgctttgttactactttgtttaaaagtgagaaaatattataagtacatgggtgatcattcagatgggaatgtaaacagtcaa

SEQ ID NO: 199099 - DNA, 601 bp, Human
ctccacaggcacccagagcagttggctgtgctcactgtggatttcacattggtgggtagttacagcagggagcgtgcacgctgtcaggacgatggcctcggtcgtttcagagaccctttgggtgtttgatggaccttgtctgtaactgctactaggcatccctacgggttctacatctgcataatttgaaagataaggatgttttcaactatgagtacaataaattgaaaccaaaaacttgttaatcaataggaagttcagtcctttttcaaaatcaaactgctttctcctggtaccttayttgcccctttcctcccagccactcagtggtgaacttgttcctcattatattgagctgtttttagaacttgttctcatattgctttgttactactttgtttaaaagtgagaaaatattataagtacatgggtgatcattcagatgggaatgtaaacagtcaaataaaatactagagcctttcacctccactcctcacacccccagttcttttttttttttttttttttttttgagacagagtcctgctctgtcacctgggctggagtgcagtggcatgatctcggctcactgcagcctcca

SEQ ID NO: 199100 - DNA, 601 bp, Human
atttgaaagataaggatgttttcaactatgagtacaataaattgaaaccaaaaacttgttaatcaataggaagttcagtcctttttcaaaatcaaactgctttctcctggtaccttatttgcccctttcctcccagccactcagtggtgaacttgttcctcattatattgagctgtttttagaacttgttctcatattgctttgttactactttgtttaaaagtgagaaaatattataagtacatgggtgatcattcagatgggaatgtaaacagtcaaataaaatactagagcctttcasctccactcctcacacccccagttcttttttttttttttttttttttttgagacagagtcctgctctgtcacctgggctggagtgcagtggcatgatctcggctcactgcagcctccacctcccaggttcaagtgattcttgtgcctcagcctttcaagtagctgggactacaggcgcacgtcaccacccccggctaatttttgtatttttcatagagacagggtttcactacgttggctgggctggtcttgaactcctaacctcaagtgatccactaccctggcctccaaaactgctagc

SEQ ID NO: 199101 - DNA, 601 bp, Human
cctggccctagagtcagctttaacttggaggctgcgaagaaaattcaaaggaaacacaaatataatgaagccttttgaaaaccagtttttcatggactggccgagagagggaacctattctattacatgccaaattccagtgtgaaaccatgcactcatactttattttgaaaccgtaagccatagcacccaaaacctgttaaacttttgggaacaaacaggttgaaagtagatgcacagagtggcaggaccggtgtagagaacactgcatctgtgcgttgtatttaatcacaaaggctasagctgctaattggccaagtgggaagctgctgccaaagctgtgattaaaagtgatgattagtcacaaagcaaataaaataatggacaagattcctttgtctaatgatttagctcattgtccatttttagatagggacaaatacattgagcagctgttattttcctggggaagacaaacttggttctgttcactagagactgatgagcccactgatactctgaactcagctaatcctttgctttgtcaggcatgagctgaatagacaagcccatggggacgttttttttctagctcgtcaat

SEQ ID NO: 199102 - DNA, 601 bp, Human
aatcactcctgtgaaaggcggagacttaattctctagccttgtgaagtcatgggcggtaactaccagcacccacttctccttcatcctgaaagcttgtaggtaggaaagtctctctctccttgactgttatctcaagaagagtgtcacatctttgtggagtcaaactttcaccatggcatacacaccatgattgtggaggaaagaattgtggaaaacttgaaaaaagtattttgaatatggcatttacaaagttaggagtatttgacacagcaggcatgtggggaaaaaaagaaaagattaaaaaaaaaaaacagaattaggattaaaggtctccatgaatgttttcctaaaccagttggtggcggtgaatggataaagacagtctccccctaccctgttttattaatatgtgaatattaccaagtaaaaggacacattcaaaagatcagactgtggatggtttcttgaagcaaaagtttgttaaagcaaaatggcattttggttaggaattccttttcagaatccagttgtatcagagaacgtgattaaataccatttgcagctgggtgcgatggctcatgcctgtaataccagcacttt

SEQ ID NO: 199103 - DNA, 601 bp, Human
ctctccttgactgttatctcaagaagagtgtcacatctttgtggagtcaaactttcaccatggcatacacaccatgattgtggaggaaagaattgtggaaaacttgaaaaaagtattttgaatatggcatttacaaagttaggagtatttgacacagcaggcatgtggggaaaaaaagaaaagattaaaaaaaaaaaacagaattaggattaaaggtctccatgaatgttttcctaaaccagttggtggcggtgaatggataaagacagtctccccctaccctgttttattaatatgtgartattaccaagtaaaaggacacattcaaaagatcagactgtggatggtttcttgaagcaaaagtttgttaaagcaaaatggcattttggttaggaattccttttcagaatccagttgtatcagagaacgtgattaaataccatttgcagctgggtgcgatggctcatgcctgtaataccagcactttgggaggctgagacgggtggatcacttgaggtcaggagtttgagaccagcctgaccaacatggtgaaaccttgtctctactaaaaatacagaaacagccgagcgtggtggcacat

SEQ ID NO: 199104 - DNA, 601 bp, Human
ttatgtaattccgtagttacttttttttttcttttttttttctgagatggagtctcgttctatcacccaggctggagtgcagtggcatgatttcggctcactgcaacttctgcctcccaggttcaagtgattctcctgcctcaggcctccaagtagctgagactacaggtgcgcgccaccacgcccagctgatttttgtatttttagtagagacggggttccaccatgtaggtcaggctggtctcgaactcctgacctcaggcgatctgccggccttggcctcccaaagtactgggattayaggtgtgagcccctgcagcagccactttcaaatttaactttaaaaatacagttttcattgtatttaatttggggggatgccttctgtttgtgaccagtgatgctgtttttctgtttagtgatgaaagatttccccttaagataaatatatttaggttaaaaagagtctttttggcaagactaacacaatagttgattgtatcatttgtatggtaccaagtagtagttcattatgccgttatgttttattactgagccagttgatgtcttagttggtgtctgcaaaatttctcccctttaa

SEQ ID NO: 199105 - DNA, 601 bp, Human
actaccaaatgtcccagggagggcactgctcaaccaagaaagatatttgttggttggtgtttttaatcttgttttatggaaaattctcggccattatctcttccattagtgcttttgcttcattcttctcctcctctcctacttggacgcaaactgtaaatgtttttgacctttgcgtcgtttcccatatttccctcatgtgcttttctctgtgtttatccttttgaatatctctgcttcagtttggatattttcacctgacctaatttctgatttacagctgatctctttagcattgactttttttttttttttttgaggtggagtctcactttgtcaaccgggctggactgcagtggcacgatctcagctcactgcaacctccgccttccaggttcaagcgattctcctgcctcagcctcccgagtagctgggactacaggtgcacgccaccgcacccagctaattttttgtatttttagtagagatggggttttgccatgttgggcaggctagtcttgaactcctaacctcaagtgatctgcctgtctcagcttcccaaagtgctgggattacaggcgtgagccaccctgctgcctaa

SEQ ID NO: 199106 - DNA, 601 bp, Human
gaagtgtccagaataagcacatccataagatagaagtagatgagtgattgccaggggcaagagaagggacggcaggaaacggggggtgactgcgaatggagacggggcttctggttgtggtgatgaaggtattctaagatcagtggtgatggttgcatagctcttaatatattaaatgcatatttagtgggtgttaccttttaaagaatgaattttatggtatgtgaattacatagctgttagtgtttttaaagtctttactagcaaaatgtcattttcactggattctgaccaattgctmcctcactcctccttttattgtttaggaagaaaggcgaaggttgaaaaatgcaataattatccagtcatttattcgaggctatagagacagaaaacagcaagtaagtttgttttaaaatgaggagattagtagggcatgggagagcttattttaaatatggtatctttgtacaccttgttaattgaagtcaatgctgacagtagtattcttcccaataaataattttatttgttctaattattgtgaagatttatagataggtgagtttttaggtaatttttaaataataaaatacaaaca

SEQ ID NO: 199107 - DNA, 601 bp, Human
aataattatccagtcatttattcgaggctatagagacagaaaacagcaagtaagtttgttttaaaatgaggagattagtagggcatgggagagcttattttaaatatggtatctttgtacaccttgttaattgaagtcaatgctgacagtagtattcttcccaataaataattttatttgttctaattattgtgaagatttatagataggtgagtttttaggtaatttttaaataataaaatacaaacatgggcctcaccacagttgaaaatcaaaatagaaggaagtcatgagagatcctttttttttttttttaaattgagactgagtctcactctgttgcccaggccagagtgcagtggcatgatctcggctcactgcaacctctacctcctgggttcaagcaattctactgcctcagcctcccgagtagctgggattacaggcatgtgccaccacgtgcagctgatttttgtattgttagtagagtcggtgttttgccacgttgaccaggctggtctggaactcatgacctcaaatgattcgcctgccttggcctcccaaagtgctgggattacaagcataagccactgcgcctggc

SEQ ID NO: 199108 - DNA, 601 bp, Human
cagaaagttaaacagctctccactgcatccaggctttgcaaacttctcagctagctgtgagaggttacctatgtggtgatgtgttttacctcttaaaatttgatacacataaaaatgtgtatccaaaaataggctttttcgtattttttgcagtggaaaaccttaagcatttaaaaagcagaatattttgcccacctatcatgtaccctgacacagccttagcagttgccagcacgcctaggtcagtgggacgtgcaccctgaataccacatcatgattacttgcaaactctaaaatacarggtctcagtgtttacattttattattattatattagagatggggtcttactcagttgtcttgaattcccaggcttaagcagtcctcccacctcagcctcccaggtagctgggactacaggtgtgtgtacaccttgttaatgttaaggctaatttttttttttgtagagatgaggtcttgctatgttgcccaggctggtcgtgaactcctagcctcaagtgatttttccctccctggcctctcaaagtgctggaattataggcgtgagccactgtacatgatttagggtctctttttgtgg

SEQ ID NO: 199109 - DNA, 601 bp, Human
ctgacacagccttagcagttgccagcacgcctaggtcagtgggacgtgcaccctgaataccacatcatgattacttgcaaactctaaaatacagggtctcagtgtttacattttattattattatattagagatggggtcttactcagttgtcttgaattcccaggcttaagcagtcctcccacctcagcctcccaggtagctgggactacaggtgtgtgtacaccttgttaatgttaaggctaatttttttttttgtagagatgaggtcttgctatgttgcccaggctggtcgtgaactyctagcctcaagtgatttttccctccctggcctctcaaagtgctggaattataggcgtgagccactgtacatgatttagggtctctttttgtggggagggcactgagggagtagagccttgctcttgtcacctaggctggagtgcagtggtgcattcttggctcactgcaaccttcccctcccgggctcaagcaatcggtggtgtctcagccacctaagtagctggaattacaggcgtgttaccaacatgcctggctaatttttgtatttttagtagagacagggtttcaccatgttggcc

SEQ ID NO: 199110 - DNA, 601 bp, Human
acagagtcttgctctgtcacccaggctggaatgcagtggcatcatctcggctcactgtaacctccgcctcacgggttcaagcgattctcctgcctcagcatcccaagtagctgggattacagacgtgtaccaccacgcccagctaatttttgtatttttagtggagatgggatgtcgccatgttgggcaggctggtctcgaactcctggcctcaggtgatccacctgcctcggccacccatagtgctgggattacaggcatgagcactgcacctggcctaggttaaatatgctatttatcttttttttttttcctttttgagacggagtcttgctcactctgtcgcccaggctggagtgtagtggtgcgatctcagctcaccgcaacctcgcctcctgggttcaagcgattctcctacctgagcgccctgagtaactggggttacaagcttatgccaccacccctagcttaaatttttttgtatttttagtagagtcaggtttcaccatgttggccaggctggtctgtactcctgacatcaagtgatccacttgctttgacatcccaaagtgctgggattacagacatgaaccaccacacc

SEQ ID NO: 199111 - DNA, 601 bp, Human
caggctggtctgtactcctgacatcaagtgatccacttgctttgacatcccaaagtgctgggattacagacatgaaccaccacacccagccaggttaaatatataatttatttttggaaatttttgtttatctgtgttaaaaatttcaaattgcatgaaaggggagtatacagtgaaaaataagtcttcctcgctacaaaccatccctactagaatgatcctacttgaattaattacagcggacaaaggaatacatgattattcctctagtgtttggctttaaaacccagcattgcctccrgagttgagctaaggtggaacatggtgaagactttctgtaaaccgagaacgtgcagagaaggaactgagagccagtctagagaggcagtgaaagccgttgaatctacccattctggacttcagttaagtgcaggctctttccaggcttgctttctgaagttgttgaaaaaaagaatcagaatagtacaacggcagataatcgggcttgctttctggaacaggatgtcctggcctcacatactctaatcttgtagattgcaagatcaccaaggagcacagacaggcaggtgctgtgagatgt

SEQ ID NO: 199112 - DNA, 601 bp, Human
ggattacagacatgaaccaccacacccagccaggttaaatatataatttatttttggaaatttttgtttatctgtgttaaaaatttcaaattgcatgaaaggggagtatacagtgaaaaataagtcttcctcgctacaaaccatccctactagaatgatcctacttgaattaattacagcggacaaaggaatacatgattattcctctagtgtttggctttaaaacccagcattgcctccggagttgagctaaggtggaacatggtgaagactttctgtaaaccgagaacgtgcagagaargaactgagagccagtctagagaggcagtgaaagccgttgaatctacccattctggacttcagttaagtgcaggctctttccaggcttgctttctgaagttgttgaaaaaaagaatcagaatagtacaacggcagataatcgggcttgctttctggaacaggatgtcctggcctcacatactctaatcttgtagattgcaagatcaccaaggagcacagacaggcaggtgctgtgagatgtcgattggtgtctctccagagcacctattgcctttgagtgaggtcctcaatcttagtcatc

SEQ ID NO: 199113 - DNA, 601 bp, Human
gaaaagtgggctggacacagtggctcaggcctgtaataccaacactttgtggggctgaggtgggaggatcccttcaggccaggagtttgagaccagcctggccaaaataccagaccccacctgtaaaacaaagcaaaaaataaattagctggctgcggtagcttgctgctgtagtccagctacttaggaggctgaggcaggaggatcgtttgagcccaggtattcaaggctgcagtgagctatgatcctgcgactgcactccagcctgggcggttgaatgttgattcagttctcaagcatrgatgcgatagcaataaattaatcttaacgtaggggaaaatgtctcctgccccagtcttcacattgtttgccttctactctaggagtaagcataatgccacttttgatgggttttcaaagttattctatgcaaaaatcaacatatatggctatttcttcctcacctcctttttaaaaaatttttcttacgactttaagtcaaatatggtactaagattatattttatgtatagtttaattctggaattaattgcctcactttttagttgcttaattttctttgaatcttttgataaagtct

SEQ ID NO: 199114 - DNA, 601 bp, Human
gacgaactacatgtcagatggtgaagggagtattcataccttattcattcctgagaaaatgtgggcaaggtggctccaaacacctcaagagaaagcctgtgtgtaggcaaattaactaatattcggagtagttcagaattatttcatcccagtttaagacatgcgctaatttattatgcagagtgcttttgtgttggtaatttcattgtttaataacgttttatggcaaagaaatgttaatgtcgaagaaactacttaaaaatataggcaaagacaaggctatgtggcgtatttatgactrgctacacttaagaggctatctttgccgagggtggtggctcacgtgtataatcccagcgctttgggaggctgaggttggtggatcactcgaggccaggagttcgagaccagcctggccaacatggcaaaccccgcccctactaaaaatataaaaattagctgggcgtggtggcgggcacccgtaatccgagctacttgggaggctaaggcatgagacttatgcctaatatatgagaaataccgtatttctcatatatttttattacagatttctgatatttgcaagtgaactatttttgtt

SEQ ID NO: 199115 - DNA, 601 bp, Human
ccagccaaaagaggactcctgatgtgtgagaatgattccattccataggggtctccaccaaaatgcagtttgaaagccccatctttagaatacacctttcatcaggctttttattatttatgtaggaacgcagcataagccactgccgtgactttcttgcattcagtgtccgaaagaacacgtgtaagtgatgtgagttacattacctgaatataacacctttaccagcttttaataaattgcttatatctcaactgtagtaaaattttcaaatgatcctgagccttccatataatttcasttaattttctggacactgtctgtaatatttgtttaggattactgtcagaactagtctttattaactgatttttccaaaatacttagctggaccaaaggtaggaataaagaacctattagaagagagaaccaagaggatcctagatgccagtaattcatattttttctaacttatttctttaataaacttttagtttgaaaaacacattgtatacattctttttgtgaagcaggagtttgcaaactttttatgtaaatggcgagatagcaaatattttagggtttgtggtccacatatggt

SEQ ID NO: 199116 - DNA, 601 bp, Human
agccttccatataatttcacttaattttctggacactgtctgtaatatttgtttaggattactgtcagaactagtctttattaactgatttttccaaaatacttagctggaccaaaggtaggaataaagaacctattagaagagagaaccaagaggatcctagatgccagtaattcatattttttctaacttatttctttaataaacttttagtttgaaaaacacattgtatacattctttttgtgaagcaggagtttgcaaactttttatgtaaatggcgagatagcaaatattttaggrtttgtggtccacatatggtctctattatgtatttttcttgccttttgcttacaactctttaaaaataaaggaatcatgcttcactcaacagccgtacaaaaaacagccctagggctggtttggcctgtgggttgtagtttgcaaaacacctttaacgtaacttttgaatgtatttgtataagcaaataattttgatacatgatatatgtaaatataattattcttttcccaacttttatttttaaaaatttctaataccagaaacacctgaagcccaggagttcgaggctgcagtgagct

SEQ ID NO: 199117 - DNA, 601 bp, Human
tcagcctctcaagtagctgggaccacaggcacgtgccaccacgcccagctaatttttgtatttttagtagagatggggttttgccatgttggccaggctggtctcaaactcctgacctcaggtcatccgcctgccttggcctcccaaagtgctgggattacaggcgtgagccaccgtgcccagccaaacccatgtttctttaacaacaagaaaacactcctcctcatctttcctctttaatctcagtaaggtctcatgtattttttaaaatacagtgtgtgacagatgacttttaatggtstgcttataggtagagagcaccctgtaagcagcccgtttttcttggcttggcctcatttgtattttgagagatctttgttttctgtgaggtcacaaagccttaagtgctctctctgccccaggcctggggctgttttctctaaggagcactgattctttttgatgagaaatggaattttaacaaaatgtaaatgttagaaattgtacttcaagtgtatgttagtaagtcgacagtcttatctgccacgtgccagaacattgaatttttctttttctgtaaatgtggccttccagaaccacc

SEQ ID NO: 199118 - DNA, 601 bp, Human
tcactgggtcacatagtagttatatatttcactttagaagaaactaccaaacttaggacagcagcataggagaggcgcagttcctccatatcctgaacccttggtattgacatttgtcaaaacccagccattctgatgggtgtgtagctgtattttattgtgattggaatttgtatttcctggattactaatgatgacgggtgtttctcaggagcatactggtcactcagatggctctttttcaagagtctgttcaaatcttttacttcattttttaaggtgggttgtctcttgacaatayggatatccttttcccgtccaaggctgtcccgataaacctggagctacatcctatgttgtctctcacacgaggcaccgttccagcacttctctctgttgcattatcaggtttacctctcacatgggattatcagcacacatgctgctgacttttccaggttgacaagaggctctcccaccgcccgccgctgccctttgcgtcccagcggcttgttatgtgtagccccgctcctcctgcactcgtacacccctcgagagacaccagtgtggtgctgaggggaaagttgtgaaaagggcaaag

SEQ ID NO: 199119 - DNA, 601 bp, Human
cagatggctctttttcaagagtctgttcaaatcttttacttcattttttaaggtgggttgtctcttgacaatatggatatccttttcccgtccaaggctgtcccgataaacctggagctacatcctatgttgtctctcacacgaggcaccgttccagcacttctctctgttgcattatcaggtttacctctcacatgggattatcagcacacatgctgctgacttttccaggttgacaagaggctctcccaccgcccgccgctgccctttgcgtcccagcggcttgttatgtgtagccccrctcctcctgcactcgtacacccctcgagagacaccagtgtggtgctgaggggaaagttgtgaaaagggcaaagacaaaacaaggtctggctgggtgtcctgcccagcctgcccgctgggtcctcaccccctgtctctcctgggctttgcggctgttgagacagaaggcagcctgcagtaagcggataagccgtgtagacacaccccacccagaaccctgcacgttattcccctcctggcagggcagaaggcttttgtcacatagagaagttagtttcagtgaggcattgaaacagcctcc

SEQ ID NO: 199120 - DNA, 601 bp, Human
ggcagatgtgctctgtgtcttgattggtgcggcctgcccgactgcttgtgctgccctctctaaacggatagttaacctgcagttcttctcatagtaagaagggaagcctcagtcaaaatgagagttgacttaggaccagaaatatatcattgttctatttgggggatattgcaggcgtggaaagtctcaaaagcatctttaaggagatgagatgcactgttaaagagattcgtatctgagtttaattaaatgcagcttcttggtacaattcatggattataatacttcttacagtgttttrtaatctttaatttttcgtgttcatttctccactgtccatttttcttgtctgtgaacttagtgccagcataccgtttggcacataacgagaattcttttaaaaactgtctgaatgactgaatgttagttggatgatttccctgtctatctgtaagatgtccctattttcagagataatcttgtactggaatagtttcttaaccattgtcactgagagtaacttggggaaactggtgacattttgccatcctgtaagtgtgtgaatacttttttcatttttacaggttgctgcaaaactgta

SEQ ID NO: 199121 - DNA, 601 bp, Human
gtactggaatagtttcttaaccattgtcactgagagtaacttggggaaactggtgacattttgccatcctgtaagtgtgtgaatacttttttcatttttacaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatggtaagtagtaggcaggatcagaactgtggctcagcatccygatggggagtgagcagaggccagcctgctgctgtgagcctgtgccctcagtctcaatgtcagagcggtactggtgtcccagacgccttgtgctccatccacaggtgcccaccagagtcccagattccaaaatctgtccttggctccacccactctgaaaattcagaaacatgctactctctttgcctttttcttttgcttggaagtgaaccaaaattgacatatgctttcatcagttgtcccgtcatccaagattggtgtctgcagtgcagctgccggtccttcacctgaccaggaaggg

SEQ ID NO: 199122 - DNA, 601 bp, Human
tccaagagtgaggtcctttcacattagttcagtagaagagaataggatatttagtttgaattttctaactcagtgctaaagttttaatacattgataatgctcctaaaatgactgcatcgtagaagctatactgaactgcatctgaaacccttgaggacacattagtgacactttctggagaaaaaggatgaaataaacatgatttttaaaaattttatgaagtgagcagtataaatcctaacacaaaagaacctttggtctcgacatcctcataggtagaaacccaagcacttcaggacwcctgggctcgagaagtatttgtcagcattaaaaatgtgcgtgagactagttgtgaagggaggtctggagagccgtggctgcagacagaattataagcagctgtgctttccttcacctgaagtcatagtctgggttacatctaacggacttgaagtctggaccacttggtcctcttggtcctctgtcaaaactacagaaattaaacgcatactcatttcagccttgctgcttggcgtgttactattttttagactccttagtttgttgaaaacttagggaaacagtattccgagttaatta

SEQ ID NO: 199123 - DNA, 601 bp, Human
aatttctaacatgagacagttggagacttgaatactgactagatatttgtgatgttaaggaactactcttcatttattttagctgtgataatgtttttaaaaatagtctcttaatgatacactaaaataattatatcttagacttccttccaaatgagtggtatacaggtgaaatgagattggctgtagttgacagttgttggtacatgaggtttgtataccgttcggctgcctatatatttgtttagttttccttgctagcatgttaaagaactaacttaagtttggacctgtagagatkgttaaaagcatttaaaaattggcaagttttttcccttattacaggaaaaggcactaaattttaaatatgtgtttttccttttagggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggtgagactggaatggatttattgattttgtcctttcacaagatctatatctgatggtaactt

SEQ ID NO: 199124 - DNA, 601 bp, Human
ggccatgcagtggcaggtgttatggaaaggtgggcctctcctggaggagtgtatttgctggagggatgtggtctgggcagtgtgttcctggggacagtttccagatacagtggaaaagactgacatatatatgtgtcttatgaggccacacagattattttaatagagttaacagagttaaatgggaaagctcttctgtgagtcaggcctgtttccctccctctgctaaatttccagtgtgcctcttctagaataacatcttcctgtagtatgtttgaaaacatacatacatacatacatrcatgaattattcatgaaagaaatataggaaaatgtgaaaaccaaacttttgggggttgggtgcgggggggtatatagagtctcgctctgtcactaggctggagtgcagtggctccatctcagctcactgcaacctccgcctcccgggttcaagtgattctcctgcctcagcctcctgagtagctgggactacaggtgcacgccaccacacccagctaatttttgtatttttagtagagacggggtttcactatgttggccaggatggtctcaatctcttgacctcgtgatccacccgcct

SEQ ID NO: 199125 - DNA, 601 bp, Human
acatgcatgaattattcatgaaagaaatataggaaaatgtgaaaaccaaacttttgggggttgggtgcgggggggtatatagagtctcgctctgtcactaggctggagtgcagtggctccatctcagctcactgcaacctccgcctcccgggttcaagtgattctcctgcctcagcctcctgagtagctgggactacaggtgcacgccaccacacccagctaatttttgtatttttagtagagacggggtttcactatgttggccaggatggtctcaatctcttgacctcgtgatccaccmgcctcggcttcccacagtgctgggattacaggcttgagcccctgtgcccagcccaaactgtttttcttactctctcactcaacactgaaaaattctgtgagcagaaatgtggggttttttttcccacacaccaagcaattcttcagtggacaccaactaggtattctacaattcagttcaattctgatgccgtccacccggagataatgtcagatcccatcatctgagggcttagtcctgcaagactacacccacttcagaggccgattacaagtagtaggttgtcacctatacttctga

SEQ ID NO: 199126 - DNA, 601 bp, Human
ctcagcctcctgagtagctgggactacaggtgcacgccaccacacccagctaatttttgtatttttagtagagacggggtttcactatgttggccaggatggtctcaatctcttgacctcgtgatccacccgcctcggcttcccacagtgctgggattacaggcttgagcccctgtgcccagcccaaactgtttttcttactctctcactcaacactgaaaaattctgtgagcagaaatgtggggttttttttcccacacaccaagcaattcttcagtggacaccaactaggtattctacrattcagttcaattctgatgccgtccacccggagataatgtcagatcccatcatctgagggcttagtcctgcaagactacacccacttcagaggccgattacaagtagtaggttgtcacctatacttctgaccaacctgcaaaaatgggggttcctcagcccctccttgggattggtaattgactaagacagttcacagaactcgggaagtcgaggtgtgcgggaatggggagcttccatgccttctccaggcactccacactctcggcacctccctgtgttgagctcattgtgtcttcct

SEQ ID NO: 199127 - DNA, 601 bp, Human
ctctgaggaggagagtgaagaagccgacaagccctcaagcccggtaagccccgtgccctgcatctggggggctgcgatgcaggcagccccgtcggatcttctagctttctgtccacccgtagtttcagttacacaagtcagaccctcaagcagcctttgcagagaagccccgtcagccccactaccacagtttctagtgatgggaaagtctctcccaccgctttgttagcacgttcatggaagtgtaaatggagacacatagctttgtgtttggttttttaggcaaaataggatcatactrtatgttaacttagttattaggaaatattttctggaagtgaaattgttgggtcaaaaagatcctttttaccctatcctgtgaacaccgggtagtgtcttccattaattcctgctgattttatagaggataaatgttatttacttaaaaattactttcaagttcttatctcttttcttccttactattgagtttacagtatattttcagggaataaaaaactttaaaattatatatacatgcatacataatttgtgttttacttaaagaatttaaccgccaatgactttttttggtcttaag

SEQ ID NO: 199128 - DNA, 601 bp, Human
aactttatactttaattttcctttttttgtttattctcttcattcttcctttgtcttgggtattgtccacatttgggctgagaactaaagaccccattttgagccaggcactcataggtttcactgcaagtcattctttctttgccatgtctcttacctgtatgtttctgtgttgccttttctttcccctggcacttaattatataaaacctaatgtgattgtatgagatttttccaaggtcaaagttcacccttgataagctcttttgcctttaggtttctgtataatctgttcacttayagcttatgtacaatttattttaaaattgtacactacaaaaatagtagtgctaggattcctttctcattctgacgtacttttgttagtcttaatgttaaagattcaggtttgacagatgaatttactgcttttatctataaagcagtgttttgtttggtaagttattataaattatataaattgtattcatccaagtttccagacaatacagtcagcaatacccaatgttatatatattcacattcatatatatatattcatatatacacatacatatgaaaaaagtatatatctttggtt

SEQ ID NO: 199129 - DNA, 601 bp, Human
tgggctgagaactaaagaccccattttgagccaggcactcataggtttcactgcaagtcattctttctttgccatgtctcttacctgtatgtttctgtgttgccttttctttcccctggcacttaattatataaaacctaatgtgattgtatgagatttttccaaggtcaaagttcacccttgataagctcttttgcctttaggtttctgtataatctgttcacttatagcttatgtacaatttattttaaaattgtacactacaaaaatagtagtgctaggattcctttctcattctgaygtacttttgttagtcttaatgttaaagattcaggtttgacagatgaatttactgcttttatctataaagcagtgttttgtttggtaagttattataaattatataaattgtattcatccaagtttccagacaatacagtcagcaatacccaatgttatatatattcacattcatatatatatattcatatatacacatacatatgaaaaaagtatatatctttggttactgccccaaatgagtaaattgcatagattggcttgggttatattcagtgaatcaaatcttctggagagatta

SEQ ID NO: 199130 - DNA, 601 bp, Human
gggctgagaactaaagaccccattttgagccaggcactcataggtttcactgcaagtcattctttctttgccatgtctcttacctgtatgtttctgtgttgccttttctttcccctggcacttaattatataaaacctaatgtgattgtatgagatttttccaaggtcaaagttcacccttgataagctcttttgcctttaggtttctgtataatctgttcacttatagcttatgtacaatttattttaaaattgtacactacaaaaatagtagtgctaggattcctttctcattctgacstacttttgttagtcttaatgttaaagattcaggtttgacagatgaatttactgcttttatctataaagcagtgttttgtttggtaagttattataaattatataaattgtattcatccaagtttccagacaatacagtcagcaatacccaatgttatatatattcacattcatatatatatattcatatatacacatacatatgaaaaaagtatatatctttggttactgccccaaatgagtaaattgcatagattggcttgggttatattcagtgaatcaaatcttctggagagattaa

SEQ ID NO: 199131 - DNA, 601 bp, Human
tgccatgtctcttacctgtatgtttctgtgttgccttttctttcccctggcacttaattatataaaacctaatgtgattgtatgagatttttccaaggtcaaagttcacccttgataagctcttttgcctttaggtttctgtataatctgttcacttatagcttatgtacaatttattttaaaattgtacactacaaaaatagtagtgctaggattcctttctcattctgacgtacttttgttagtcttaatgttaaagattcaggtttgacagatgaatttactgcttttatctataaarcagtgttttgtttggtaagttattataaattatataaattgtattcatccaagtttccagacaatacagtcagcaatacccaatgttatatatattcacattcatatatatatattcatatatacacatacatatgaaaaaagtatatatctttggttactgccccaaatgagtaaattgcatagattggcttgggttatattcagtgaatcaaatcttctggagagattaaggtataaaatagatttgtgtagcctttgattttaaaaaattcgttaataggctgggagcagtggctca

SEQ ID NO: 199132 - DNA, 601 bp, Human
ctttgattttaaaaaattcgttaataggctgggagcagtggctcatacctgtaatctcagcacttgggaaggctgaggcagctggatcatttgaggttaggagttcgagaccagcctgaccaacatggtgaaaccctgtctctactaaaaatacaaaaattagctgggtgtggaggcgggcaagtcccagctacttgggaagctgaggtgggagaattgcttgaacctgggaggcggaggttgcagtgagccgagattgtgccactcagtccagtctgggtgacagagcaagactgtctcaaaaaaaaaaaaaaatttatgtaatactctcacttattttgcttaaactgtgatctcaaattaaaatgaaaatgccattagatgatgatagtttcactatgtatggttgtcttagtgcagcttgatgtaaaaaaaaaaagtaggaaatgaagtttttttgaaatgtaaatactgaagctactgttatatcataggcaaaaaccgggtattcagagtttactgtgttaggcaaaatggatgcctactgttgactggatccctagaggatttcacactaagtgtactgtgatgtagataattt

SEQ ID NO: 199133 - DNA, 601 bp, Human
gagactggttgttctggtatgttctaggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcaagtgtccgtgggcgtctgtgccagggggtgccagccagagaacataccttcctccctgggaattgctctcctcttaagttttktctgctcttttctggtagagattgatgtaggatattctactgtccaagcgtttcataaaaaataatttgtgtttttcttttctaaaccaacaaatactgagaccttttcctggcccgtgaggctctcaagtaccctatctgtaatattttctgtagtaccttatgaatgtgagtttattcacccatctgaaaggctggactcatacctgcattagtgaaacactatgttacatatctttttaggcttttttcatagtactcgtgttttatggggttttttttttttttcttcttcttcag

SEQ ID NO: 199134 - DNA, 601 bp, Human
gggaattgctctcctcttaagttttgtctgctcttttctggtagagattgatgtaggatattctactgtccaagcgtttcataaaaaataatttgtgtttttcttttctaaaccaacaaatactgagaccttttcctggcccgtgaggctctcaagtaccctatctgtaatattttctgtagtaccttatgaatgtgagtttattcacccatctgaaaggctggactcatacctgcattagtgaaacactatgttacatatctttttaggcttttttcatagtactcgtgttttatggggttttttttttttttcttcttcttcagacagcatctcactctgttgcccagagtgcagtggtgtgatcatagctcactgcagccttcacttcctgggctcaagcgatcctttcaccccaaccttctgagtagctgggaccacaggtgtgcaccaccacacctggctaattttttgtttttgtgtgtgtgtgtgtttgttttttgtttttttttttgagatggagtcttgctgttgcccaggctggagtgcagtggcgcgatctcggctcactgtaggctctgcccccctgggttcatgccat

SEQ ID NO: 199135 - DNA, 601 bp, Human
tcctcttaagttttgtctgctcttttctggtagagattgatgtaggatattctactgtccaagcgtttcataaaaaataatttgtgtttttcttttctaaaccaacaaatactgagaccttttcctggcccgtgaggctctcaagtaccctatctgtaatattttctgtagtaccttatgaatgtgagtttattcacccatctgaaaggctggactcatacctgcattagtgaaacactatgttacatatctttttaggcttttttcatagtactcgtgttttatggggtttttttttttyttcttcttcttcagacagcatctcactctgttgcccagagtgcagtggtgtgatcatagctcactgcagccttcacttcctgggctcaagcgatcctttcaccccaaccttctgagtagctgggaccacaggtgtgcaccaccacacctggctaattttttgtttttgtgtgtgtgtgtgtttgttttttgtttttttttttgagatggagtcttgctgttgcccaggctggagtgcagtggcgcgatctcggctcactgtaggctctgcccccctgggttcatgccattctcctgcctc

SEQ ID NO: 199136 - DNA, 601 bp, Human
gccgaggaagctggggctggagcagaagtgctcttctgagtacactatttttatatcacttttaagttttggattaggtgaatgacttaatattttaaaattggttaagtaataaatgaattgccagctccttttctgagaggaaattttagatatattaccattggacgtggaaatttggatttaacatttttaatatccactattttaaaatatgattaaatattcactggctatattttaagggggcaaaaaataaaggctctactgcagtatcagacaactaaaataagaaagtagrctaccaaagatagcctgttagaaaagtgcttggctttcatctggcatacgtggggtttttagtgggtactgtttcagagtttcattgactgcatttgtgaccctacttacatgtagatgaggcctgcggtgcccactcagccccgcggcattcctggcctttgtgtgtatttcacattcctcgtccttccttttcctgactctttcaccggcttctttcatagataccatattcatgtgatttttcctttacttgggcttctcagtttcctttgtgggttcttttttcccctctttctca

SEQ ID NO: 199137 - DNA, 601 bp, Human
ataagaaagtaggctaccaaagatagcctgttagaaaagtgcttggctttcatctggcatacgtggggtttttagtgggtactgtttcagagtttcattgactgcatttgtgaccctacttacatgtagatgaggcctgcggtgcccactcagccccgcggcattcctggcctttgtgtgtatttcacattcctcgtccttccttttcctgactctttcaccggcttctttcatagataccatattcatgtgatttttcctttacttgggcttctcagtttcctttgtgggttcttttttcccctctttctcactctttcctaaacttctttttgtattcagttttttagggttgttagtttgtgacggagtcttgccttgtcgcccaggctggagtgcagtggtgtgaactcggctcactgcaacctccacctccagggttcaagcgatcctcctacttcagcctcccgagtagctgagattacgggcacccatcaccatgcccagctaatttttgtatttttagtagagatggggtttcaccatgtaggccaggctggtctcgaactcctgacctcaggtgatctcccgcctcagcttt

SEQ ID NO: 199138 - DNA, 601 bp, Human
aagtaaattaaatacaagcacagactcaggtcctcggctaccaaagccacatttcaagtgcccagtagccacatgtggccaggggctaccttattggacatcacagattagaacacacccaccctcacggaaggtgctggtgggcggtgctgcccagggttttggctcagtattcccaccatggtgctcgagagctgtattctctatgtcatggtttgccagcctgacttgtggaaaatacaaccctgattattgcattctcttgaacagtgtagactccctttgcttttaggaaaaaatycacattccttggattattgatttgtgcagtatccccttgttatcaagcatttgtttacctctcaactttatttctagcacaaaatactttttctccaaccataaatgaggcaaaaaggcatatcttgcattttcttgatcccattgcgcttttttatgcctccatggtgtttcgtgcccctttccttttgcgtatgccagtctcttccagttaatgtctgggctggcatgttctcaggggcttggctcttttaccccattgatggatctaaaagttttgaagcagaattttgaagatagt

SEQ ID NO: 199139 - DNA, 601 bp, Human
gaggttgatgttataatttgcccgtagtttcatttaaatacataaatcataagacacctagttttatttcaacatatgcttgatttttccaccaaaaagtagtacagtgaagcagcttaattatgtcttgtgttgttaatcattgtgatttagataaacagcggtgcgcctcgaagcgcagtgcttcttttctgtgcacgcgcgtgtgtatgtgtgtgtgtagtgtttgttggttttgtctttatttttgtttttgttttctgaaacaaggtctcactttgtcacccaggctggagtgccrtggcgtgatctcagctcactgaaaccccgcctcccaggctcaggtgatcctcctacctcagcacccttgagtagctgggacgataggcgtgccaccacacctggctaattttttgtaatttttgtagaaacggggttttgccatgttgcctaggctggtctcgaacacctgggcccaagtaatctgcttgtctcagccctcagcctcccagagtgctgggattgcaggtgcaagtcactgcgcccagcccctcgtgtgttttctaaccatttctttgccatgtgttttctaagaactgtg

SEQ ID NO: 199140 - DNA, 601 bp, Human
ctttatttttgtttttgttttctgaaacaaggtctcactttgtcacccaggctggagtgccgtggcgtgatctcagctcactgaaaccccgcctcccaggctcaggtgatcctcctacctcagcacccttgagtagctgggacgataggcgtgccaccacacctggctaattttttgtaatttttgtagaaacggggttttgccatgttgcctaggctggtctcgaacacctgggcccaagtaatctgcttgtctcagccctcagcctcccagagtgctgggattgcaggtgcaagtcacygcgcccagcccctcgtgtgttttctaaccatttctttgccatgtgttttctaagaactgtggtgtatgtggtggggatgaatgctctttagctctgagagatttatagcttcatatcttatactttaataatttgggataaaatgattacacagatgacttcaaagcagaaaaatacagatttgtttttcattgtatgtgtagaattaaatatatataccgtccatgtgtttgtaaacaagtttttataatattttggaaaaaatattgaggatgtgcctggagagagaagtaaattttg

SEQ ID NO: 199141 - DNA, 601 bp, Human
acggggttttgccatgttgcctaggctggtctcgaacacctgggcccaagtaatctgcttgtctcagccctcagcctcccagagtgctgggattgcaggtgcaagtcactgcgcccagcccctcgtgtgttttctaaccatttctttgccatgtgttttctaagaactgtggtgtatgtggtggggatgaatgctctttagctctgagagatttatagcttcatatcttatactttaataatttgggataaaatgattacacagatgacttcaaagcagaaaaatacagatttgtttttcrttgtatgtgtagaattaaatatatataccgtccatgtgtttgtaaacaagtttttataatattttggaaaaaatattgaggatgtgcctggagagagaagtaaattttgtctataatttcatagctgcttttattatcagtgatattttcattataatcaatagaattaataagctattgattcatgttaaaaattgcattctctttcatgaagttcaaataacattgatgagcttttaaacatttcagcacatagtgatcttaaaattaaatgtattttgaaatcctatctagattata

SEQ ID NO: 199142 - DNA, 601 bp, Human
cttcatcttgtgttgagacttcgtggtggtgctaagaaaaggaaggagtcttaccccactcccaagaagaataagcgcaagagaaagaaggggaagctggctgtcctgaagtattagaaggtggatgagaatgacaaaatgagctgccttcgtcgagagtgcccttctgatgaatgtggtgctggagtgtttatggcaagtcactttgacagacattattgtggcaaatgttgtctgactactgcttcaacaaaccagaagacaagtaactgcgtatgagttaataaaagacatgaacttaaaaaaaaaaaaaagaagggattatcaaagaagacatttgaggtagtgaatgccactttcccccattttaatttaaactgtagcatgagggaaagtatgttttttgaatctgtaaatcttttaattaaagaaaatcagttgccagtaagaagggctggctgtttaaattggttctggtgtcaatgctggaatgctagcgcgcctgagtgtctaaggcttacctcctactcttagctcctagtttgtgaagagcaatttttagcagcttgtctccagacgaaatacaccttaaaatttttat

SEQ ID NO: 199143 - DNA, 601 bp, Human
aagtcactttgacagacattattgtggcaaatgttgtctgactactgcttcaacaaaccagaagacaagtaactgcgtatgagttaataaaagacatgaacttaaaaaaaaaaaaaagaagggattatcaaagaagacatttgaggtagtgaatgccactttcccccattttaatttaaactgtagcatgagggaaagtatgttttttgaatctgtaaatcttttaattaaagaaaatcagttgccagtaagaagggctggctgtttaaattggttctggtgtcaatgctggaatgctagygcgcctgagtgtctaaggcttacctcctactcttagctcctagtttgtgaagagcaatttttagcagcttgtctccagacgaaatacaccttaaaatttttattagtaaggacattggaatttattttgaatcttgcattatctgatgcaaattattatatatctgttttattgctttttatggcattagaagtgtccagtaatatttttttaaaaagaaaaatttcagagaagaacaaattattgcctttgtacttgtgtgctataagagttcgacagatcattgggtgtctcgctgtt

SEQ ID NO: 199144 - DNA, 601 bp, Human
ttttacctgtggcacctggacttagaggggaattctcagaggatgccatgctgtggtggccttgactccttgtgtgggagccagtgtcttccattgtgttctctttcataactcaagagagtccccgtggaaaactggcctgaatttatgacccggcttactgattaactcataggattgttacagctaaataaagcttaatgagtaatttttaatctatcccactatgtgggagaagaatatcacttctttacattttagaagtagagccccagactaaataaccttcagaaatttgtctttttttttttttttttggtgaaaacattctttattagtaagcagacatttgaaactttttgattacatgcatcatgcaaaatgactgacctcacacatggttgtctgttcattgtgacatcttttttgagatgattacaaatttaagatgactgcagtagtaaaaataattcatgaaaatgactctcaatgaagcaaaacactacatagcacacatgaaatactgttcatccctcctggatgtttaattctctcctaacgtaaatctctattttggaagactattatttacaaaaatggc

SEQ ID NO: 199145 - DNA, 601 bp, Human
agtaaaaataattcatgaaaatgactctcaatgaagcaaaacactacatagcacacatgaaatactgttcatccctcctggatgtttaattctctcctaacgtaaatctctattttggaagactattatttacaaaaatggcagttgtttttgtatgtgcatctataggcactgaactgatatgaacaaaatttcaaataattttacaaggtttggttgttttttcctgttttgttaatccaaaacaggacaatgccctttgatttacaatgttcagttcttttaagaaatcattttcttyggaagatgattttgacccatgaaaaagttgttttacccctggtaatctttttgaaatggggctggctgttatacattatacaggttgttttcagttaagtgaaaaggagttgggcttgtcttgagaagaattcctctaaattatggcactgagaaaacttctctgcagtggtgggctcaccacttccatcctgtggtagttctggtagcactcctggtatgaaaaccctagcacaggtaatttcacctctttgaaataagcagtgatcctggagaaaggtgaatattccaaatctagtag

SEQ ID NO: 199146 - DNA, 601 bp, Human
tgtgaaaaagtaaagatgattgagacagtcacaagcccagagaactgagcagtgagctgaagattactcccaggccttgaaactgaaaggagggtgcctggctggttttgtaaattgatggtgctgatggctccttttttcatcccaatttctgctttttgaacaggaatgtgtatagctgttactgtatgcctgtcacaccatcatacatgggagcagataacttgttttctaggttcgcaagtgcacagatggaggagaattatgccccagaaatcacacccagatcctctcccaaatktagatggctttagtgtgagatttgagacttttgagttggtgagactcagataagattttggatttagagttgatgctgtaataatgggttgtgacttttgagcacctatgagtgacgtaaatttatttgtgatggatctgaatcttttaacacaggggtggagtggtggcggggcgggggttgcactgtagtaggcaagaagaataatgttccatgtaaaacgttaatgtcctaatctccaaacctgtatgtaaccttaaatggtaaaagagattttgcagatgtaattaaggttactat

SEQ ID NO: 199147 - DNA, 601 bp, Human
ataatgggttgtgacttttgagcacctatgagtgacgtaaatttatttgtgatggatctgaatcttttaacacaggggtggagtggtggcggggcgggggttgcactgtagtaggcaagaagaataatgttccatgtaaaacgttaatgtcctaatctccaaacctgtatgtaaccttaaatggtaaaagagattttgcagatgtaattaaggttactatggatttcaagacgaggcgataagcccagattatgcaatgggactaatttaatcatgagtcctgcagagaacctctccaggstggtgtcagagagatgtggtaacagaagggtcatagagatgaaacagtgctggtttttaagatagaaggccgcaagccaaggaatgcggatgttctctagaaggtggaatgacaaggaaataaataattctcctatgcaacgctgccgacaaactgatgttaaaagcaccgcgaaacccgtttggactcctaacctatagaattgttaagataataaatttgtgctattttaagccacattttgtaacttgttatggtggcaatgggaaactaaccagaagtgataactaaggatgaagt

SEQ ID NO: 199148 - DNA, 601 bp, Human
tcatctgttcccacatggtactgcatggataggaacaatattattttagttgatggagtaacacagtgttaagaatatctgcttctagcagtgtcaggctttcatctgttagctctttattcggaaatgaagtcacaagaataaagtcaagagctgcaaattcaggacaagactgtacaataaagttccggacatccaggatcctgtgtgtactattgaatctttgtatcaaacgactcccatctgctaacctgatttgaatttttgttgttggcactgaatcatcaataagaacaaccgygttaagtattgatttatcctcctcttctggagaggaaggtgtactgactatttcaggtgtaagccttccaagtttttgcccttctccactaaaagccttgaacctcaatctaggttttatgtattcttgatcctgatggtcctccatatcccaattcacttggccaccatgaacaaggcactgaagctccagggggatctctcctcttttaacaaactccagaaattgagcatttgttggttcattgtaaggtctcaattctccatcatctaaactgaaaccattgctccacagtttaag

SEQ ID NO: 199149 - DNA, 601 bp, Human
gttggcactgaatcatcaataagaacaaccgcgttaagtattgatttatcctcctcttctggagaggaaggtgtactgactatttcaggtgtaagccttccaagtttttgcccttctccactaaaagccttgaacctcaatctaggttttatgtattcttgatcctgatggtcctccatatcccaattcacttggccaccatgaacaaggcactgaagctccagggggatctctcctcttttaacaaactccagaaattgagcatttgttggttcattgtaaggtctcaattctccatcawctaaactgaaaccattgctccacagtttaagcaaaatctgaacatcttgtagctgattttctccatgcatatattcagaccgcttacaaaaggaattacccaatctgtatcctccacctgtaaatgacattgaggtggtgtccgtgggctcttgaagactgcagctttaggtctgtcagacttggaagatttgcgcttcacttcatcttcatacagttcttccaaggccagtttatttcttgatatgtcatccctttggctgttttcaagtttctttgcaggttcttcacattaagttct

SEQ ID NO: 199150 - DNA, 601 bp, Human
gatgttaattataatcttagtgacaaactcttagaacctgtaggaagaactcatttttgtttctatgtctacacacaagggtctggatggatttatagcagggtattaactgatgatttctgggtagataagatgccatgtggctaacattcttttgccttgttttgttttaataacattttttaaaaactcaatttctcaactgaagagaaaataagcaaataataccttttcaaattattttgaaagttcgtatttttcgtagcttttttcttactcttttttccgtatgactgttgcrtattcttagcaaataaaactccacaaaggcaagaaaaaacgttaacactcttatcaggcatatggtaaggattttaaatatctcagagatagggtatctattatcattttctaatacagcttcccttttcaacagtatagtctttttcagagtgaattttttttatttttattttattttattttatttttttgagtctgagtcttgttctgtcacccaggctggagtgtaatggtgtgatctcggctcactgcaacctcagcctctcaggttcaggcaattctcctgcctcagcctcct

SEQ ID NO: 199151 - DNA, 601 bp, Human
ttttattttattttatttttttgagtctgagtcttgttctgtcacccaggctggagtgtaatggtgtgatctcggctcactgcaacctcagcctctcaggttcaggcaattctcctgcctcagcctcctgaatagctgggattacaggcgcctgccaccacgcccagctaatttttctatttttagtagagacggggtttcaccatgttggccagtctggtctcgaactcctgacctcaagtgatccacccgcctcagcctcccaaagtgctgggattacaggcgtgatccaccaggtccrgccatatttcagagtgaattttaagtggaaatttgctcgaacattaatgacagacagcatacttagttacctgtcttaattggtctcctttaacttgtattattaccattttttcgtttttccaatattattaaatatttattattaagtaatattttccaataatattaaataatatttgttggagaccccgtttgagattctgctcttactggaatgaatgcagtgtgcccccactttgtcatggcgtgtgactgataaacatcatgcatgttttcataaaatcataatacttctgag

SEQ ID NO: 199152 - DNA, 601 bp, Human
acccaggctggagtgtaatggtgtgatctcggctcactgcaacctcagcctctcaggttcaggcaattctcctgcctcagcctcctgaatagctgggattacaggcgcctgccaccacgcccagctaatttttctatttttagtagagacggggtttcaccatgttggccagtctggtctcgaactcctgacctcaagtgatccacccgcctcagcctcccaaagtgctgggattacaggcgtgatccaccaggtccagccatatttcagagtgaattttaagtggaaatttgctcgaacrttaatgacagacagcatacttagttacctgtcttaattggtctcctttaacttgtattattaccattttttcgtttttccaatattattaaatatttattattaagtaatattttccaataatattaaataatatttgttggagaccccgtttgagattctgctcttactggaatgaatgcagtgtgcccccactttgtcatggcgtgtgactgataaacatcatgcatgttttcataaaatcataatacttctgagctggaaggaccttagaacagatgtatcactgccccttcatttt

SEQ ID NO: 199153 - DNA, 601 bp, Human
ctaggaaatttcacatgctctttcatgcttttactgttttttcagtgatgtacccttattgccatctggatatctcaaaatgcattacattaaaataagaatggagtttagttgttgtttatttttaatcagtacttcatgattcctatggtgtactcagaaagtgccaatatggaacaatgcatttgatgttttggattgagtgcaggaaattactcgaccaatcaaatatgagatttttttattggattttgaaagacctcatctcttaaaaaaatatttatgctagctgattacacarttgtggctagaatgtttatcctgtcacaaacatgcagtataaaacagagctaatttaaatgctcatgcattcttcacaaagttcatcttttttaaatctaatattatagaggaaaagtttttaatttttatttatttttattgttttgagataggatctcactttgtcacacaggctggagtgtagtggtgcaatcttggctcactgcagccttgaactcctgggctctatcgattctcctacctcaacctcatgagtagctgggactacagccaccacacccaacttttcatagagatg

SEQ ID NO: 199154 - DNA, 601 bp, Human
gaaaagtataagcagtaataacaatagtaattataatattgtgatatattaatacgatatgtagcagagggggagcaggttcaacttgtgcatgaaaacagcttatatctttatcttttggggtaggtctcacagccacaggggagggagggcgggctttcctagcttggtaacagcacagatttacacctttgggagccgtgtctcggtgtctcatcaaatggctggttgtctgaggcagctttttgtggtattagtacagagatttgctaaattgtacgttgatcttcagtgtatcgctttttttttttttttttttttaagaaatgttttgaataagtaattgctttactgttctgtgtttttctcctattcctttttaggcttctctacagtttagcctttaatgccaggtttctgagacatctttggtttctaatatcttccatgtcaacacggatgatcacagggtatgtattatacagacttataaattgagctcaagggcacaggaagtggcagcctaatcaaaaatgttgccagaacctgtttttaagtcctgtttatactgggcttatttcatattagaaggtaagttcca

SEQ ID NO: 199155 - DNA, 601 bp, Human
gtgtctaatcttaacagttacttatctgtatatattatagagagtatggttttatctgaaggtaagtttcctttaaacatcctagccatgtttttaaaaaagcagacatttggaaattgctttgctccatatgactttactcctcttttcacagtgaaaatacagatttgaagtaaattaaagactgctgcaaacattagaacagtgtagaagtttttaaacatttgttgaaataatttgatttttcttatttgaatcgtgtaatttaaaaaatatcatctttgacttaacatattttaaytgagtatgtaataggtaggaatttcatacttaaaatccttcatggtaaactgacttagcctagtactctgttgttgaatttttcctctgccagaagtctaagccggccgggcgcggtggctcacgcctgtaattccagcactttgggaggccgaggccagcggatcacctgaggtcaggagttcaaaaccagcctggccaacatggtgaaaccccatctctactaaaaatacaaaaattagtcgggcatggtggtgcgtgcctgtaatcccagctacttgggaggctgaggcaggagaat

SEQ ID NO: 199156 - DNA, 601 bp, Human
tttcttatttgaatcgtgtaatttaaaaaatatcatctttgacttaacatattttaactgagtatgtaataggtaggaatttcatacttaaaatccttcatggtaaactgacttagcctagtactctgttgttgaatttttcctctgccagaagtctaagccggccgggcgcggtggctcacgcctgtaattccagcactttgggaggccgaggccagcggatcacctgaggtcaggagttcaaaaccagcctggccaacatggtgaaaccccatctctactaaaaatacaaaaattagtygggcatggtggtgcgtgcctgtaatcccagctacttgggaggctgaggcaggagaatcgcttaaacctggaaggcggaggttgcagtgagtcgagatcatgccactgcagtccagcctgggtgagagcaagacttcctctcaaaaaaaaagaaaaaaagaagtctatgccaatccccctgtgctgtaatcggaaaagatgaagtgtgtaattcagttaattggagactaaacttacaagatgcaactgtgtgtcatgctcatggtagtagtgataatagcagtcactgttactgactcca

SEQ ID NO: 199157 - DNA, 601 bp, Human
ttgagctttttcatgcaatatgtagagcaaaagatattcatatgttgttcagccaggcacagtcagcccctttatgatgggactggtgttcaaatcatctggacaaaacagttcatactaatgaaaggggaatgtcagtttctcaatattattacttcaaatttttcatttttttaattgaatcttaagtgaggaaaggggagttttactgctgccgctgtgactggtgaaactcataaaggttaagtgagttatcttgcatcaacagtgggtggctaaagcagagacaaaagactcctasaatgatttactgtcttgagaaattcttttctttcatttccaaaccaaaatacaagattttaagtatgttttgttgtgttttttttggtgcatttcagccacttctgactacgccagctttggttttcattagtgacaggtttgttttgggcagaagggaattgagaatcattaggacaggaaattatcgtttacccataagtgccccagcttagcaacagaaacactgtcatagttctgcctgataattgcttatttgtttatggcatttgtctcttgctaaggaaatggagtcatggtg

SEQ ID NO: 199158 - DNA, 601 bp, Human
tactgctgccgctgtgactggtgaaactcataaaggttaagtgagttatcttgcatcaacagtgggtggctaaagcagagacaaaagactcctagaatgatttactgtcttgagaaattcttttctttcatttccaaaccaaaatacaagattttaagtatgttttgttgtgttttttttggtgcatttcagccacttctgactacgccagctttggttttcattagtgacaggtttgttttgggcagaagggaattgagaatcattaggacaggaaattatcgtttacccataagtgccycagcttagcaacagaaacactgtcatagttctgcctgataattgcttatttgtttatggcatttgtctcttgctaaggaaatggagtcatggtgtgtgaaagaaaagtgggatattgttaattatattaaattattaatactattttatgatagggtagttttacaaatcttattaaaagacagtttgataatttgaatgtctttttacttgtttattagaatgaagtccctcaagaaactgacagtgtattaatgcgttcccaatacagatactccttgaggtacaatggggctttgtc

SEQ ID NO: 199159 - DNA, 601 bp, Human
cacccctgtccagttaaggcagccctgtgccttttttatcctccatataaacaacctttttgtgtcatcctggctttggcaatgaggtaggacaattgtgctttgtccctttttgaatgtcccacaatgtttaaattttggaagaatggcattcattcattgatgaatctgttcagcatagtgctaaatgcagagtatcacaactgcaaacatggatcatgtatgctcaggttgtgtagcatgtggacatagtgtatcttctctgtgggaacacagtttcaggtgcacatatgggttcctkttctcaaagcggttgatgatggcagtgccctcccctgaaccatgcaccatggagactcagaagctccaggtggctcagccaagctccttacggccccgctaattagaacaagtggccttaccttctgctttgctttcatacatgatttgtagatcctgactcctggttacatctcatctaatatatacctgtagttttgtggaaatggatatttggggagataagagagtgatcttgctcacagtgtctgttaacctgtgattgatttgacttggtagaggggaccatggactttataga

SEQ ID NO: 199160 - DNA, 601 bp, Human
tcccctgaaccatgcaccatggagactcagaagctccaggtggctcagccaagctccttacggccccgctaattagaacaagtggccttaccttctgctttgctttcatacatgatttgtagatcctgactcctggttacatctcatctaatatatacctgtagttttgtggaaatggatatttggggagataagagagtgatcttgctcacagtgtctgttaacctgtgattgatttgacttggtagaggggaccatggactttatagaaagagcttgcaggtgagcctattagctaaawgttccataagacaaggaaccagacttaaaaacgagagaaaaggaagaagttctaggtgaaataagtcaatttaatatatcgtagctcttttttatttatttattttttttggaaacggagtctcgccctgttgcccaggctggagtgcaatggcacgatctcggctcactgcaacctccgctgctcgggttcaagtgattcccctgcctcagcctcccaagtagctgggattacaggcacgtgccaccacacccagctaattttttgtatctttagtagagatggggtttcaccatgttg

SEQ ID NO: 199161 - DNA, 601 bp, Human
tatttggggagataagagagtgatcttgctcacagtgtctgttaacctgtgattgatttgacttggtagaggggaccatggactttatagaaagagcttgcaggtgagcctattagctaaaagttccataagacaaggaaccagacttaaaaacgagagaaaaggaagaagttctaggtgaaataagtcaatttaatatatcgtagctcttttttatttatttattttttttggaaacggagtctcgccctgttgcccaggctggagtgcaatggcacgatctcggctcactgcaacctcygctgctcgggttcaagtgattcccctgcctcagcctcccaagtagctgggattacaggcacgtgccaccacacccagctaattttttgtatctttagtagagatggggtttcaccatgttggccaggctggtctcgaactcttgaccttgtgatccacccacctcggcctcccagagtgctgggattacaggcgtgagccaccatacccagccttttttcttttctttttttttttccttaatattttaaacttctttgaaacagagtctggctctgttccccaggctggagtgcagtgg

SEQ ID NO: 199162 - DNA, 601 bp, Human
cccaggctggagtgcaatggcacgatctcggctcactgcaacctccgctgctcgggttcaagtgattcccctgcctcagcctcccaagtagctgggattacaggcacgtgccaccacacccagctaattttttgtatctttagtagagatggggtttcaccatgttggccaggctggtctcgaactcttgaccttgtgatccacccacctcggcctcccagagtgctgggattacaggcgtgagccaccatacccagccttttttcttttctttttttttttccttaatattttaaacttytttgaaacagagtctggctctgttccccaggctggagtgcagtggcgcaatctcagctcatggcaacctctgcctcctgggctcaagccattctcctgcctcagcctcctatgtaactaggaaggactacaggcacctatcaccacacctggctaattaatttaatatatcatagctcttgatgggtgaaaggctgctgagtaaagaccaccttagctgctgtgaaagcaggagcaggatgggagctggtgaataaagtggacagtgggagcaaggccaccatagagaactggaaacttt

SEQ ID NO: 199163 - DNA, 601 bp, Human
aagattaatgggttggtatgctattttttgtattaatctatgctgtttattaacctgcattgccatggtgactttaccttgcctttaaatagtttaattcctaatgcaaatgttactttccctgattatatttgtttgatgttatgttttaattagttcccaaactaagactaattttaaagtgactggtttttttcttcttttctttaattcaaggtctatggtaccgttgcttcaggtgatatccaggggttctcctatgtcttttgaagattctagtcgaatcatcccactcttttayctttttagctccttgtttagtcattcactaatttccatacatgataacgaattcttcggtgatcccatagaaggtaaggattttgagaaaccagtttgctgctggccacttggcccatcagttttcatagacagtagaaaagttttaagctttttaagtctttcagtgtgtgttaaaagatggaaaaagaaacaatagaaaactggattgtgttttttagttgtaggtcaaagacaatcatcaatgatgccttttactttagaagagctgataatgttgtctcgatgccttcgagatgca

SEQ ID NO: 199164 - DNA, 601 bp, Human
caacgtaaagtaggtcattaatttttaatgctagttgtatataaattattttaacatatcttcgttcttaaccagaaagtgaagttttgagttactgtggctggaatgttggcaggaaaccaccaccagtgagaatgtaactgttgggatggaaaaaaagaaaaggaaaagggtgcttgacttcccatgaaatttctgcagcaaacacatctagtcagctaaaattgctcattaaaggagtgagagcagaagaaatgcattttccaaattgaatgctagatttacagtccgtttaataccrgcgacctctcgcacactaatgttcagttcgagtcatcagctgtccctttgggtcttttatcactgcttttgtcaagctatctatttaattgaaagaagttaattgaatgaaaatgatcaactaagcttgtattaatattgctaatggaactttcttcttggccatgtttggagaaagatgtcaagctagactttaggaagggcccattaatgcttgcacttaacctgatgggctaattaaggaatgcttattcatcctccaagtccacgagagtctctctccagcccgttctgcctggtt

SEQ ID NO: 199165 - DNA, 601 bp, Human
ttaattacctatttctgtattcctaagtaaactgggacggtcacatggtaagcctttactatatcctttcttaaagattgacaaatttgcaatttttctatgttaaaaaataagcagtctcacctatttaaaacttataattcttacataagcttttcctggatgtgggtgttaacggtagcatatttgttttcctttcaatatttgattaaaccctggggtctttgttaataaagctttccatgatgtgcaatatcaggtgttgtgtatgatatcagataatttcactgttttatggcayctgttgagagtttcataatttccgtgacaggcttatctttagtatgtagaaatctctgaacttaataatgccatataagatattttccaccctggccttattttgttttggttaagcgttaaatgaaaagtttgtacagaatttttttatgcctcaaaatgactccctgccactttattcatcattgaaagttttaagagttagggcaaggccgggtgtggtggctcacgcctataatcccagcactttgggaggccaaggcgggtggatcacgaggtcaggagtttgagaccagcctgg

SEQ ID NO: 199166 - DNA, 601 bp, Human
aagtaaactgggacggtcacatggtaagcctttactatatcctttcttaaagattgacaaatttgcaatttttctatgttaaaaaataagcagtctcacctatttaaaacttataattcttacataagcttttcctggatgtgggtgttaacggtagcatatttgttttcctttcaatatttgattaaaccctggggtctttgttaataaagctttccatgatgtgcaatatcaggtgttgtgtatgatatcagataatttcactgttttatggcacctgttgagagtttcataatttccrtgacaggcttatctttagtatgtagaaatctctgaacttaataatgccatataagatattttccaccctggccttattttgttttggttaagcgttaaatgaaaagtttgtacagaatttttttatgcctcaaaatgactccctgccactttattcatcattgaaagttttaagagttagggcaaggccgggtgtggtggctcacgcctataatcccagcactttgggaggccaaggcgggtggatcacgaggtcaggagtttgagaccagcctggccaagatggtgaaaccccatctct

SEQ ID NO: 199167 - DNA, 601 bp, Human
gaacttaataatgccatataagatattttccaccctggccttattttgttttggttaagcgttaaatgaaaagtttgtacagaatttttttatgcctcaaaatgactccctgccactttattcatcattgaaagttttaagagttagggcaaggccgggtgtggtggctcacgcctataatcccagcactttgggaggccaaggcgggtggatcacgaggtcaggagtttgagaccagcctggccaagatggtgaaaccccatctctactaaagatacaaaaaattagctgggcgtgatgyacgcctgtaatcccagctactagggaggctggggcaggagaattgctagaacccgggaggcagaggttgcagtcagccgagatagcgccactgcactccagcctgggcgatagggtgactctctctccaaaaaaaaagagggtgaaaatttaccttttttttgttggtggtggtgattgttttaggtttgaaatcaagttgttgtaagaccttttgagtttagaattgtttaaagacctttttttttttaaaggatttctgttctttggtcacctgtcccccaaaccattttatgctacc

SEQ ID NO: 199168 - DNA, 601 bp, Human
tgccactttattcatcattgaaagttttaagagttagggcaaggccgggtgtggtggctcacgcctataatcccagcactttgggaggccaaggcgggtggatcacgaggtcaggagtttgagaccagcctggccaagatggtgaaaccccatctctactaaagatacaaaaaattagctgggcgtgatgcacgcctgtaatcccagctactagggaggctggggcaggagaattgctagaacccgggaggcagaggttgcagtcagccgagatagcgccactgcactccagcctgggcgrtagggtgactctctctccaaaaaaaaagagggtgaaaatttaccttttttttgttggtggtggtgattgttttaggtttgaaatcaagttgttgtaagaccttttgagtttagaattgtttaaagacctttttttttttaaaggatttctgttctttggtcacctgtcccccaaaccattttatgctacctgctattgagctgagcccccaaaataaaaatcactgcataatttttgagtaatcagctgctgttagctgttcttttaagaaaatactatctctattatgaagttgtatga

SEQ ID NO: 199169 - DNA, 601 bp, Human
ctggccaagatggtgaaaccccatctctactaaagatacaaaaaattagctgggcgtgatgcacgcctgtaatcccagctactagggaggctggggcaggagaattgctagaacccgggaggcagaggttgcagtcagccgagatagcgccactgcactccagcctgggcgatagggtgactctctctccaaaaaaaaagagggtgaaaatttaccttttttttgttggtggtggtgattgttttaggtttgaaatcaagttgttgtaagaccttttgagtttagaattgtttaaagacctttttttttttaaaggatttctgttctttggtcacctgtcccccaaaccattttatgctacctgctattgagctgagcccccaaaataaaaatcactgcataatttttgagtaatcagctgctgttagctgttcttttaagaaaatactatctctattatgaagttgtatgaacttacacctctgtagttaactgtgttttaggcagtattctaagagttttgcatatattcatttaatacaatagttctgtgagaaagatactataatttgttttacagatgaggtcatgtatatgatgg

SEQ ID NO: 199170 - DNA, 601 bp, Human
ctgttcttttaagaaaatactatctctattatgaagttgtatgaacttacacctctgtagttaactgtgttttaggcagtattctaagagttttgcatatattcatttaatacaatagttctgtgagaaagatactataatttgttttacagatgaggtcatgtatatgatggtagaaccagctgctattctacactccccttctgaaaagaatacaaattgtatcagcatttttcatattattgttgtgccaaatttgagttgaagaattcgaggtagaatcaaccaaagaacgcagaarcgtttagcccatgatctcctgccttccattgattttgacagaattgcaaacgatgagacctgactccttcaacaccgaccattttcatttttcagtcctatcatggtcctcccaaagtcatttgtgtgagaggctctgctggctggtcacagagcatagaattttaagtggatagagtcatctttctttgtcactgtaagaattgaggtcactttctaagccctgtcttgacactgctaaaacagtttatgcatttatcaaatttataaactcctcttgaagtgtaatttagagctataa

SEQ ID NO: 199171 - DNA, 601 bp, Human
accgaccattttcatttttcagtcctatcatggtcctcccaaagtcatttgtgtgagaggctctgctggctggtcacagagcatagaattttaagtggatagagtcatctttctttgtcactgtaagaattgaggtcactttctaagccctgtcttgacactgctaaaacagtttatgcatttatcaaatttataaactcctcttgaagtgtaatttagagctataattactttagcttgatgagataggaaatcctgttttgagatgtctgtgtgcatccaccaaacttaacaggagttwcctcctgtgatagggaaacaggaggaagtggcagggaatgaggaggaaggttcccatgccctcattatccatatgtctggagagagagagagagagagagagagagagagagccatactatgagtgatttttttacttccttagtggttaagttgtattttttcagttccaaaaagctatttttaaaaagtaataaagcaacagcagtgccctgttaatataatcctaacatgcgaccatttgactatgttacaaccaagagatccaaagcttgtagcgctgtgccttatccttttctgt

SEQ ID NO: 199172 - DNA, 601 bp, Human
cttgatgagataggaaatcctgttttgagatgtctgtgtgcatccaccaaacttaacaggagtttcctcctgtgatagggaaacaggaggaagtggcagggaatgaggaggaaggttcccatgccctcattatccatatgtctggagagagagagagagagagagagagagagagagccatactatgagtgatttttttacttccttagtggttaagttgtattttttcagttccaaaaagctatttttaaaaagtaataaagcaacagcagtgccctgttaatataatcctaacatgcgrccatttgactatgttacaaccaagagatccaaagcttgtagcgctgtgccttatccttttctgttattgaagattttgattgattttgtttttgttttttgactactaaagtggatgctatatgcagtaattttatagtgttttaaatatgtgctgaagaatactgtttttcaaaatactccagtttttaacccgtttgtgccagaggttgcgaattttttgtgtgaaaaatcaggccttggcaatgaccttgagcagtagaatataaatcccacaagcttagcgttccagtaatggaac

SEQ ID NO: 199173 - DNA, 601 bp, Human
agggatcataaatgaattcacacagggtgcctgttcctgcagtatcaccacgtagtgaaggagacatgcattcagctaatgacagtgggaaacagcaaaccacagaggccggtcctgtggaagcacacaggagagaagcaccagctgctgcgtcatctggcacttgactcacttgaggaaaacggttgttttccaacgaggtcatgttcttagagctttttctgacatgttacttttatatattcttcttatgaagtcaaattgtaaaaatccattctcatttgatgtatttcccacattrcacatttattgcacttcagaacctggaaattgtatgctaagtatgctttgtattttgctttttaaagaactaactcatctggtttcaggactagatctactgtagaaagaaaaaaaaaaattaactcagttgtttggttttagttaccagattttacatatcacatttaagataaaaaagatacttttattttatgttatgatgcaatttagtctttcagttgcccttcaaaacttggactatatgtacttaattttttggttgcaatactatatctaaatatccgtcatctccatacag

SEQ ID NO: 199174 - DNA, 601 bp, Human
aacagttgtcaagtgtgatttttataaggagttggtatgtttctaagcagttatctacttgatctttttaatattggggttaagggaaacctgcttacagcatcacctatttttcattcaaatggcacataatagagcatgtgtaacagttgtgtacctttgtggggtttttttgttttttgtttttctttttgagacagggtttcgttctgttgcccaagctggagtacagtggctcgatctcactgcaacctccaccccccaggctcaagtgattctttcacctcggcctcctgagtakctgggactacaggcatgtgccaccacacccggctaatttttgtattttttgtagagatagggtttcaccatgttacccaggctggtcttgaactcctaggctcgagtgatctgcctgcctcggcctcccaaaatgctaggattacaggtgtgagccaccacgcccggcagtgtgtgcatttctgaataaatttattagtacttgaataatgtattagtttctgcatttatttaatgtaacgttttgatctggcgtggaagaacatgagaggaggcacaagagttaacacatcagatggac

SEQ ID NO: 199175 - DNA, 601 bp, Human
cacctcggcctcctgagtagctgggactacaggcatgtgccaccacacccggctaatttttgtattttttgtagagatagggtttcaccatgttacccaggctggtcttgaactcctaggctcgagtgatctgcctgcctcggcctcccaaaatgctaggattacaggtgtgagccaccacgcccggcagtgtgtgcatttctgaataaatttattagtacttgaataatgtattagtttctgcatttatttaatgtaacgttttgatctggcgtggaagaacatgagaggaggcacaagrgttaacacatcagatggacataatgctattgtatttcagaacttaaaatccactaaaatttgtatattcagctagatacagctagttgttccagtgtttgctatcttacttcatataacttaccacactggttctcaagtcgtaactacctatcagagtcatctgggggagcagttgaaaactcgactggctccacctcagactaattgaattggagtcagtgatggcggcacgcctgtggtgggcttgtcttagtgctccaggtgattctaaaatgcagcaaaggttaagagccacagg

SEQ ID NO: 199176 - DNA, 601 bp, Human
tttatatttttcattaaaacttaggagaaaaatagttgatatgaaggagggaaaaatgttctcagttgaattttaaggtttggtatttgatattctaaataagtattttgggaattggtccgggactagtcatgccatatttagcaaataaaaagacaggtcacctagttaaaattgaattacggataaatcacaattactttaaaaaatgtagttatgtcccatgcaatattgtggacatactttaaagaaagcaatattttggacatacttctactaaaaatgtattatttgatataartaaatataaacatattatttgatgtttattaaaccatccattaccacagtgccgtctatcttgatatcccatccttaacataactcccttggctggactcacttttttaccttctcctttcctcctcctttctccccatctccctccaccgcctttttttgattgaccaaggatccatggtactggcatgttatattggtaacatgtgattacttcttttttcatatttaggataggaaatatgaaagaggatacactatattgaaatttttttaacatttaattgtataataatttagt

SEQ ID NO: 199177 - DNA, 601 bp, Human
cattaaaacttaggagaaaaatagttgatatgaaggagggaaaaatgttctcagttgaattttaaggtttggtatttgatattctaaataagtattttgggaattggtccgggactagtcatgccatatttagcaaataaaaagacaggtcacctagttaaaattgaattacggataaatcacaattactttaaaaaatgtagttatgtcccatgcaatattgtggacatactttaaagaaagcaatattttggacatacttctactaaaaatgtattatttgatataaataaatataaayatattatttgatgtttattaaaccatccattaccacagtgccgtctatcttgatatcccatccttaacataactcccttggctggactcacttttttaccttctcctttcctcctcctttctccccatctccctccaccgcctttttttgattgaccaaggatccatggtactggcatgttatattggtaacatgtgattacttcttttttcatatttaggataggaaatatgaaagaggatacactatattgaaatttttttaacatttaattgtataataatttagtagaagaatgta

SEQ ID NO: 199178 - DNA, 601 bp, Human
taacataactcccttggctggactcacttttttaccttctcctttcctcctcctttctccccatctccctccaccgcctttttttgattgaccaaggatccatggtactggcatgttatattggtaacatgtgattacttcttttttcatatttaggataggaaatatgaaagaggatacactatattgaaatttttttaacatttaattgtataataatttagtagaagaatgtaaatgagaacttaattgtctcatataatttgataatgtttgtaatctgtagaaaatatatgttctyatgaacagagattgaatagaaatagatatctaggagttaggcagacctgatctttccgttgcctgacctggagcaagttaccccctcaataaagctaagtttccttggggatgataaattcatggggaccccaggattccatgggatgatgcaattaaatatgtaaatatgtcagaaaggatgacctttgttaacggttggggtgattatgaaagggctaatttcagcatggtaactattaaatctggatttatttaaagtatcaatttaattggtcacaaaaatggaaagaccagacac

SEQ ID NO: 199179 - DNA, 601 bp, Human
agagaacttcaggtctttttaaagtaatgctattatatctctttaatcatgtattataaaatttacaattattgatctcaagtcagtcatttagtacctgctaggttccaaggtggctagttggattctatttgtgaggaactcactgcacaacaaccagagaggaactgttctgaaagaatattgtaattttttaaaaccataataaaatactaagctgtgatgacatagtgaagtgtgtccaggccagcctgtttggaaaggttatcaaggagatcagactcgatttttctggagttawgatcacagatctgactccatttgcttacgtgaggcaagtgctgcaattgttttctctttgggagatgtgacagtgatatctggggtgctgcttttttcccctagtgccgttagtacattatttctcagaaaactcagaaatactctttcaggaaaaagttgtacaaaattgcaccacttagaggtatctttcattagaactcagatgagctaagacatttccaaattcgtgggtttttttttttttaatattttaggtttgggggtacatgtgaagttttgttacatagataaacatgtc

SEQ ID NO: 199180 - DNA, 601 bp, Human
gacatagtgaagtgtgtccaggccagcctgtttggaaaggttatcaaggagatcagactcgatttttctggagttaagatcacagatctgactccatttgcttacgtgaggcaagtgctgcaattgttttctctttgggagatgtgacagtgatatctggggtgctgcttttttcccctagtgccgttagtacattatttctcagaaaactcagaaatactctttcaggaaaaagttgtacaaaattgcaccacttagaggtatctttcattagaactcagatgagctaagacatttccarattcgtgggtttttttttttttaatattttaggtttgggggtacatgtgaagttttgttacatagataaacatgtcatcggagtttgttgtacgcatccttagatcactcaggtattaagctcggtccccagtagtcatcttctctgccctctccctcctcccaccctcccccttcaagtagatcccagtgtctgttctttccttctttgtgttcatgggttcttatcatgtagctcccgccaaatttgtgtttcaaagcttaatcgccacctccgttgtaacttaaaaattatcatgta

SEQ ID NO: 199181 - DNA, 601 bp, Human
tagccgggcatggtaagtgtccccctgtagtcccagctactcaggaggctaaggtatgagaatcccttgtgccctggaggcggaggttgcagtgagccaagatcgtgccactgcactgcagcctgggtgacagagcgagattctgtctccagaaaaaacaaaaaatataagtgatgttaacagagggacataaggtattttcagttcttgagaaaaagtcgtaactggattcatttcagaatcttgggagtaggagatggagtggtggagggtataaaagaaaccatgtcggctgggcgcrgtggctcatgcctgtaatcccagcactttgggaggccaaggcaagtggattgcctgagcttaggagtttgcgaccagcctgggcaacatggtcaaacccagtctctactaaaataaaaaaattagccaggcacggtggtgtgcgcctatagtcccagctacttgggactgaggctgaggcaggagaatcgcttgaacctgggatgcggaggttgcagtaagctgagatcacgccactgcactccagcctgggcgacagagcaagattccgtctcaaaaaataaaaaaaaaaaaccatgtc

SEQ ID NO: 199182 - DNA, 601 bp, Human
cccagtctctactaaaataaaaaaattagccaggcacggtggtgtgcgcctatagtcccagctacttgggactgaggctgaggcaggagaatcgcttgaacctgggatgcggaggttgcagtaagctgagatcacgccactgcactccagcctgggcgacagagcaagattccgtctcaaaaaataaaaaaaaaaaaccatgtcacagaaatattcgaggagagaaaacaggagtgtttcagaacaattttataagcatgactatgtcctcataagatatttgtgagttaagcctgttgcwtctaactctgcccactgacaaggtagagcaatggtggcagatcccccagcagtgaacagttctggggcccaggctggggttgcttcacagcaaaagaagcagtcctggcagggtgcttggctccaggtctggggaagaccctgcaagatgggtgtggagtgctctgtcatgctggagagcgaggaagctattgcagggtggctggggctgggagacagggttaggagcctgtctctagctggtcatgggcagaaacttgaagcattcatgaaaacagctaactctgagttcgcaagggtg

SEQ ID NO: 199183 - DNA, 601 bp, Human
aggagatgaccagggcggtgccactccaggtgcagcgcatgtctagggtctgctggtctgagatggtgtgttggcctcccaggagaggagggtctggtcccagaatgcaaatagctgcacctcttccttactccagaaagttgtgcgatgggaaaatgtcagctgaacccagcagtgtgcttagtgatttaattgatttatattttggcacaagtcccttatctcatcaccagctggtagtacggtgcacacacccacacttgaagtaggtttcacttctgcagtgaaaagcagagatggrgcctctcagtgatcgagcatcccacaccacctaggaaacgttctcgccagaaagttaaatctaaatgtggtggaacctctacatctaactacaaaattacaggaaacataggggttagaagtacatctttaacaacaccatgagggtgcaattagcaaaatctagattatgggaaattttacaggatgaaagtttcttcattaaaaattgcaagggtggctgggcacggaggctcacatctgtaatcccagcactttgggagaccgaagtatgtggatcacctgaggtcagttcgagacc

SEQ ID NO: 199184 - DNA, 601 bp, Human
gttattttttctgtctctgggaatacgagtacagctgctataaacatctatgtacaggtttttctgtgaacatacattttgtttgacatggagtaagtttcactgggagtaagaatcctgagacatttggcaagtttatgtttaacttgatgagaagctgcagaactgtgttccagggtggctgcacggctttgcattcagaccagcaatgaatgagagcctctgttgttcccagtcctcatcagcacttacagttgtcatttaaaaaaaaaaaattctatgggccaggcgtggtggctcwcgcctgtaatccccagcactttaggaggccgaggtgggcggatcatcaggtcaggagttcaagaccagcctgaccaacatagtgaaaccccgtctctactaaaaatacaaaaaactagctgagcgtagtggcgggcacctgtaatctcagctacttgggaggctgaggcaggagaatcgcttgaacccaggaggtggaggttgcagtgaaccaagatcacaccactgcactccagcctgggtgacagtataagactgtctaaaaaaaaaaaatttggccattgtaaaaggtgggaaatgg

SEQ ID NO: 199185 - DNA, 601 bp, Human
agtgaaaccccgtctctactaaaaatacaaaaaactagctgagcgtagtggcgggcacctgtaatctcagctacttgggaggctgaggcaggagaatcgcttgaacccaggaggtggaggttgcagtgaaccaagatcacaccactgcactccagcctgggtgacagtataagactgtctaaaaaaaaaaaatttggccattgtaaaaggtgggaaatggtatcttcttgtggttttaatttgtgtctaccagccgactaatgatattcagcatctttttcatgaatttgtttttttgttktgttttcttggttgttttttgtttttttggagacagggtctcactgtgtgctcaggctggagtgcagaggcgcaatcacggctcactgcagccttgacttcctgggcttcagcgatcttcctgccgtagcttccaaagtagttgtgaccacaggcgtgtgccaccacacctggccaattttttaatttttttgtagagatggaatctccatgtgttgcccaggctggcctttaactcctgggctcaagggatcttcccaccttggcctcccaaagtactacgattacaggtgtgagccac

SEQ ID NO: 199186 - DNA, 601 bp, Human
gtctgtgtctgaggaaagacagcttgctgtcctgacagagttgccttttgtggttccatttgaggaacgagtaaaggtatgcaatttggcttctttattgtcactacgtatcatattagtgttaagaaattaacacacacccaccagagaaatctctaaaggtgcctagtgcctggctgattacataacatacttttctcattaggctgaaatagctaagaatgatttataaaacccaaccagatacctctttttacaaactgaaagtattttcttagttacaactgattgaaagccagtaacactatagatttcttataatgagggtctaacgtcatttttctctattaaattttgcattatttggccaggtacagtggctcatgcctgtaatcccagcactttgggaggccgaggcaggtggatcgagcccatgagtttaagaccagcctgggaaacatagtgaaaccctgtctctacaaagaatacaaaagttagttgggcgtggtggcatgtacctgtagtcccagctacttgggatgctgaggtaggaggatcatttgagcctaggaggcagaggttgcagtgagccaagatcgtg

SEQ ID NO: 199187 - DNA, 601 bp, Human
tctgcgtttttgtataaatatttatatgaaatcacaaattgtaagccaaattaaacatattaaaataagtgccattgcaatccaagtttcttatgaaaagataagtgtgctccaatgacactgccgttagtaaaggagaattatactgtgatagcatttggagctcactggcacgtttcgtcgtatgttcatatttgatactcagtcttgaaagttcgtgtgctattaacctctaatatattagcagttttaacttccaaatattgtgcttatggtaatacattaattccatgttggtcartgccgaggggattaaaatgaaagtttaggctggatctaaaattaaaaatgaaatcatcttacccagcttttggaaggtgatgagttgtccaatgtgaaatgacaattgccttttcctctaggggagcaacttaattttcttctaaggaaatgaaacctgatttctaataatttttattgcttacataaagaactaattttatcataatgttggaacagtggaggaaagctgacatcagttgtttccttactctatttcaagctttttttttttttttacacaatttaccgttgccattga

SEQ ID NO: 199188 - DNA, 601 bp, Human
tgggcgtggtggtaggcacctgtagtcccacctactcaggaggctgaggcaggagaatggcatgaacccgggaggcggaggttgcagtgagccgagatcgcaccactgcactccagcctggcaacagagtgagacttcatctcagaaaaaaaaaagaaaaaactactccctgtagatgattttttgatgttactgtccaattataacaagcctcaaatttcctaatgaatccttaagctttaaaaattgttaaaaaactgatcacacccacctccctaggggcatgctaataattgcattsaagttaaaagatttggaagaatcttctcatattgtttatactgtaatgcttgaaatctttataaatgttctcaactcaaatactgtaagcatgattaagccatgtgttaaaatgtggtgttttgctacgcaaattagtaaagtcagatatcatctcagaataattaatttacttgtgagagaatggtttgaggtgcatttttgactaaaaatttacatataatcaactaatgtgattattccacgtgtcatctagtcattgaagtgaatccatgctttacgatgctcgttgtcttatctc

SEQ ID NO: 199189 - DNA, 601 bp, Human
gccgagatcgcaccactgcactccagcctggcaacagagtgagacttcatctcagaaaaaaaaaagaaaaaactactccctgtagatgattttttgatgttactgtccaattataacaagcctcaaatttcctaatgaatccttaagctttaaaaattgttaaaaaactgatcacacccacctccctaggggcatgctaataattgcattcaagttaaaagatttggaagaatcttctcatattgtttatactgtaatgcttgaaatctttataaatgttctcaactcaaatactgtaagmatgattaagccatgtgttaaaatgtggtgttttgctacgcaaattagtaaagtcagatatcatctcagaataattaatttacttgtgagagaatggtttgaggtgcatttttgactaaaaatttacatataatcaactaatgtgattattccacgtgtcatctagtcattgaagtgaatccatgctttacgatgctcgttgtcttatctccgaacgattctctgcagtgtgcatgttagcccctgttacccataagttgactgagtggaatgcagagattgatggctgttcctgcagttg

SEQ ID NO: 199190 - DNA, 601 bp, Human
ccagggcagatatgtttgggtgactatgcaccaaagccaacagagggcagcagcgcatggggcctgtgaaagtgtcgaatgtacactacgtgcggttgctttcccctgacttcatgcagcagcctgtccccaactctcgtcccctctccttccccctatcttttctgcaaagcacctgtagaacattcttagggaaagataaaggacatttcacttacttccccaaagctgttctctgattcagcctgtttatcagagcacatcttaacttggtccaccttgtgttttttttggttttggrtttttgtttgtttgttttttgaaatggaacttctctcttgttgcccaggctggagtgcaatggcacaatcttgactcactgcaacctccacctcctgggttcaagcgattctcctgcctcagcctcctgagtagctgggattacaggcatgcaccaccacgcccggctaatttttttttgtatttagtagagacggggtttcaccatgttagtcaggctggtctcaaactcctgccctcaggtgacccacctgccttggcctcccaaagtgctgggattacaggcatgtgccactgcacc

SEQ ID NO: 199191 - DNA, 601 bp, Human
tttttaaatttttattttagagatgggggtctcactttcagccaggctggagtgcagtggtgcaatcatagctcactgcagcctcaaactcctgggctcaagtgatcctcttgagtagctggaattacaggcacataccaccatgcccagcttttcttatattttgtagagacagggtcttgctagtgttgcccaggctggtcttggactcctggcctcaggcagtccttctgccttggcttcccaaagtgctgggattacagaagtgagcctctgtgcaatgttttaatttatttatttatttttttttttgagactgtcacgcaggttgggatgcagtggcacgatcttggcttactgcaacctctgtctcccagattcaagtgattctccggcctcagccacccaagtagctgggattacagacatgtgccaccttgcctggctagtttttatatttttagtagggatggggtttcaccatgttggccaggctggtctcgaactcctgacctcaaggcgatccgcccacctcagcgtcccaaagtgctgggattacagacatgagccactgcacctggccttaatttactcttcgtag

SEQ ID NO: 199192 - DNA, 601 bp, Human
aaatttttattttagagatgggggtctcactttcagccaggctggagtgcagtggtgcaatcatagctcactgcagcctcaaactcctgggctcaagtgatcctcttgagtagctggaattacaggcacataccaccatgcccagcttttcttatattttgtagagacagggtcttgctagtgttgcccaggctggtcttggactcctggcctcaggcagtccttctgccttggcttcccaaagtgctgggattacagaagtgagcctctgtgcaatgttttaatttatttatttattttwttttttgagactgtcacgcaggttgggatgcagtggcacgatcttggcttactgcaacctctgtctcccagattcaagtgattctccggcctcagccacccaagtagctgggattacagacatgtgccaccttgcctggctagtttttatatttttagtagggatggggtttcaccatgttggccaggctggtctcgaactcctgacctcaaggcgatccgcccacctcagcgtcccaaagtgctgggattacagacatgagccactgcacctggccttaatttactcttcgtagcaaat

SEQ ID NO: 199193 - DNA, 601 bp, Human
aatttggatgctaaatgttgcaaaagcactgcacgaaacaaatttgtatggttgtaagtaggtgctatggtttgaatgtcccctccaaactcatgttgaaacttgatccccagtgtgccagtattcagaggtggaatctttaagaggtgattagatcatgtgagctcggccgtcatgaatggatgagtggtttattgtgggaagggccctggtgactttttacaggagggagcccctagctttgtgatgccctgtgccgcctccggactctgcagagtccccaccaatgagaagacctcascaggggctgcctctggaccatgggctcctggccttccagctataagaaatggatttcagtttttattaattactcagtttcgggtcttctgttataagcagtcaaaacggactaagacagtaagttactgcctagtgactattagtttaataggactgccgcaacaaattaccacactctttgggggggagggaggcttagaaaaactgaaatttattatttgacagttctggaggctggaagtccaaactcagggtgtcagcagcagcatagattcctttttagaggctctagaagaat

SEQ ID NO: 199194 - DNA, 601 bp, Human
ctccaaactcatgttgaaacttgatccccagtgtgccagtattcagaggtggaatctttaagaggtgattagatcatgtgagctcggccgtcatgaatggatgagtggtttattgtgggaagggccctggtgactttttacaggagggagcccctagctttgtgatgccctgtgccgcctccggactctgcagagtccccaccaatgagaagacctcaccaggggctgcctctggaccatgggctcctggccttccagctataagaaatggatttcagtttttattaattactcagtttcrggtcttctgttataagcagtcaaaacggactaagacagtaagttactgcctagtgactattagtttaataggactgccgcaacaaattaccacactctttgggggggagggaggcttagaaaaactgaaatttattatttgacagttctggaggctggaagtccaaactcagggtgtcagcagcagcatagattcctttttagaggctctagaagaatccattcttctggttttgccagtagcccttgaccttttttggcttgtagattcatcattttgatctctgcctctgtggacttc

SEQ ID NO: 199195 - DNA, 601 bp, Human
tgagtggtttattgtgggaagggccctggtgactttttacaggagggagcccctagctttgtgatgccctgtgccgcctccggactctgcagagtccccaccaatgagaagacctcaccaggggctgcctctggaccatgggctcctggccttccagctataagaaatggatttcagtttttattaattactcagtttcgggtcttctgttataagcagtcaaaacggactaagacagtaagttactgcctagtgactattagtttaataggactgccgcaacaaattaccacactctttgggggggagggaggcttagaaaaactgaaatttattatttgacagttctggaggctggaagtccaaactcagggtgtcagcagcagcatagattcctttttagaggctctagaagaatccattcttctggttttgccagtagcccttgaccttttttggcttgtagattcatcattttgatctctgcctctgtggacttctccctgagtgtctctgtccaacattgccttattttttttaataaggacacctgtcattgtattggggtcttccctgatccagtgtaacttcatcttaattt

SEQ ID NO: 199196 - DNA, 601 bp, Human
cccccagccctggccaaccactagtctactttcagtctgtatggatttttttttttctagacatttcatataagtggaatcatttgttatatcaactataaatttgtgaccttttgtgattggcttctttgatttagcatgttttcaggtttcattcatgtcgtagtatgtcagagcttcactcatttgaagggccaaatcttatttcattgtatggatataccacactttggggtttgtttttttcattttgaaacaggtctttctctgccacctaggctggagtgcactgctacaaacrcggctcagtcctgcgcttaaggaggcctcctgctttcagcctcccgagtagctgggaccaccgttgcttgctaccacacctggctaattatttcattttatcgtagaggcagggtcttgccatgttgcccaggctggtcttgaactcctggcgtcaagcaatcctcctgcctcaacctctcaaaaggctagaattacaggtgtgagccaccacacccagtcaccgcattttgtttacttactcatcccaggctggagtgcagtggtgcatttgcattgggaatttgcattgtttccacct

SEQ ID NO: 199197 - DNA, 601 bp, Human
aatttgcattgtttccaccttttagctattgtgaataatgttactgcaaacatttgtatacaagctgttatttggacataggttttttgtttttcttgggcatatacctagacatggaagtgttaggtcatacagtactccacgtcaaagtgtctgcaaccttttacaatcccaccaacaatttgtgaaggtttcagtgactccacatcgttgtcagcacttacttagtgttgtctttttcattacagccattctagtgggtgggaattggtatctcattgtggttttaatttccctggtractaataatgttgaccatcttttcatgtgcttcatgacttctgttgagaaatgtctattcaagtccattgcctatttttttattggattgtcttttattattaagtccctgcaatgcaatgaattatgaaatttatattctctgaggaagctgaaacattgtcagataaatgatttgcaagtattttcttctctggattgtctcttcactttcatgatgatttcctttgaagaacgaacatttttaattttgaagtctaacgtgtttttttcttttattgcttgtttttgatgtcttatc

SEQ ID NO: 199198 - DNA, 601 bp, Human
ccttttagctattgtgaataatgttactgcaaacatttgtatacaagctgttatttggacataggttttttgtttttcttgggcatatacctagacatggaagtgttaggtcatacagtactccacgtcaaagtgtctgcaaccttttacaatcccaccaacaatttgtgaaggtttcagtgactccacatcgttgtcagcacttacttagtgttgtctttttcattacagccattctagtgggtgggaattggtatctcattgtggttttaatttccctggtgactaataatgttgaccrtcttttcatgtgcttcatgacttctgttgagaaatgtctattcaagtccattgcctatttttttattggattgtcttttattattaagtccctgcaatgcaatgaattatgaaatttatattctctgaggaagctgaaacattgtcagataaatgatttgcaagtattttcttctctggattgtctcttcactttcatgatgatttcctttgaagaacgaacatttttaattttgaagtctaacgtgtttttttcttttattgcttgtttttgatgtcttatccattccctgacctaaaa

SEQ ID NO: 199199 - DNA, 601 bp, Human
aggtttcagtgactccacatcgttgtcagcacttacttagtgttgtctttttcattacagccattctagtgggtgggaattggtatctcattgtggttttaatttccctggtgactaataatgttgaccatcttttcatgtgcttcatgacttctgttgagaaatgtctattcaagtccattgcctatttttttattggattgtcttttattattaagtccctgcaatgcaatgaattatgaaatttatattctctgaggaagctgaaacattgtcagataaatgatttgcaagtatttttttctctggattgtctcttcactttcatgatgatttcctttgaagaacgaacatttttaattttgaagtctaacgtgtttttttcttttattgcttgtttttgatgtcttatccattccctgacctaaaatcacaaagatttacacctgtatgttcttctgacggtgttgtagttttagctcttacattttggtctttgatcctttttgagttaatttttgtagattgtatgagttaggcatcctcatattcttggcacccttgttgaaaattagttgaccgtacacgtaacactctgggt

SEQ ID NO: 199200 - DNA, 601 bp, Human
ctccaacctgacttcactaccgtaacggtatgtgttatatcatcatcttcaggctcaccgtatttcaggtggcagatttcaggtgttgatttgatgttgatttgtgagttggctttggtggcagttttcagatagcatctctctctttgttgatggtcacacagcctacttctcagtttcagcttcccctggaggatgtacatttcataattcattgtatgaaaatctttacaatgggccaggcatggtggatcacacctgtaatcccagcactttgggaggcctaggcaggcggatcacytgaggtcgggagctcgagaccagcctgaccaacatggagaaaccccgtctctactaaaaatacaaaattagctgggcgtggtggtgcatgcctttaatcccagctactccagaggctgaggcaggataatggcttgaacctggaggcggaggttgtggtgagccaaggccttaccattgcactccagcctggcaacaagagcaaaactctgtctcaaattaaaaaaaagaaaagaaaagaaaatctttacaatgaaatcccttagttctttctgttaaagtgagcccaagaaccttctaa

SEQ ID NO: 199201 - DNA, 601 bp, Human
ttgatttgatgttgatttgtgagttggctttggtggcagttttcagatagcatctctctctttgttgatggtcacacagcctacttctcagtttcagcttcccctggaggatgtacatttcataattcattgtatgaaaatctttacaatgggccaggcatggtggatcacacctgtaatcccagcactttgggaggcctaggcaggcggatcacctgaggtcgggagctcgagaccagcctgaccaacatggagaaaccccgtctctactaaaaatacaaaattagctgggcgtggtggygcatgcctttaatcccagctactccagaggctgaggcaggataatggcttgaacctggaggcggaggttgtggtgagccaaggccttaccattgcactccagcctggcaacaagagcaaaactctgtctcaaattaaaaaaaagaaaagaaaagaaaatctttacaatgaaatcccttagttctttctgttaaagtgagcccaagaaccttctaacttaatatatatgtgaaaataaaggtgagtgttctgctagactaacctgaaatactctaaacttggtggtttttacacagtacag

SEQ ID NO: 199202 - DNA, 601 bp, Human
atagcatctctctctttgttgatggtcacacagcctacttctcagtttcagcttcccctggaggatgtacatttcataattcattgtatgaaaatctttacaatgggccaggcatggtggatcacacctgtaatcccagcactttgggaggcctaggcaggcggatcacctgaggtcgggagctcgagaccagcctgaccaacatggagaaaccccgtctctactaaaaatacaaaattagctgggcgtggtggtgcatgcctttaatcccagctactccagaggctgaggcaggataatsgcttgaacctggaggcggaggttgtggtgagccaaggccttaccattgcactccagcctggcaacaagagcaaaactctgtctcaaattaaaaaaaagaaaagaaaagaaaatctttacaatgaaatcccttagttctttctgttaaagtgagcccaagaaccttctaacttaatatatatgtgaaaataaaggtgagtgttctgctagactaacctgaaatactctaaacttggtggtttttacacagtacagtcacagaagatagagcaataattttacctgcatgaattaaatctta

SEQ ID NO: 199203 - DNA, 601 bp, Human
tcaggctgcagacagggaataaataaacagcccaaggatgtggtaatgtcatcttgaacttttttttacagatagaagcacctaggtccatttaagccaattaagttcagaatatttattgaggttaatcctttatcatatttgaattctatttgaaaatggctttttttcttgctttaggatattgatttaattgggatggcatgcctataaatcagattatttgatatgatcttggttatatatttgaaaatttcaattagattgtataactttggcgtggtttataattttttatcgyggtagaattcagtgtgcatttaatgtattctgtagtgtaatattggcacttaacagtttatcttgagattttcaaaagttggaaagtttctttttctccatcattagcatccttttgtaaaatgctcactgaatttgctgaggctttaaacatctaaattgaggtgaatactagtcattttggttgccttagtccttaaaggggcagagcttctcttgtataataccttgttttgaaccctaaactcttttttttttctctttttttgagatggagtctcactctgttgcccaggctgga

SEQ ID NO: 199204 - DNA, 601 bp, Human
aagtctgctgtttatctttggctcttatttgtgcaataaagacaacaaataatctaaaaaatagtgttgggtgcagtagctcatacctgtagtcccagcactttgggaggccgaggtgggaagaacacttaagcccaggagttcaagaccatcctaggcatacatagggagacctggtctctaccactaaaaaaaaaaaaaaagtagccaggcatggtggtgtgtgtctgtagtcccagctacttgggaggctgaggtgggaggattgcttgagcctgaaatgtagaggctgcagtgagcmgtgatggcaccaccacactccagcctgggtgacagagaccctgtctcaaaataataataaaatagggcccatgtaaatccttttaaacatttaaatattcaatttaatttagatttagatttagcaaatgtaactttatgaaataaaagccaaatgaaggtatatggtgttaattttattgtttctaaacttaaaatcagctttgagaggcggcagtaagtagagtggtggaggtcacgctctggagtaagacaggccagtggggactcctggcgtcaccaacagagggcagcagaatcc

SEQ ID NO: 199205 - DNA, 601 bp, Human
tagggagacctggtctctaccactaaaaaaaaaaaaaaagtagccaggcatggtggtgtgtgtctgtagtcccagctacttgggaggctgaggtgggaggattgcttgagcctgaaatgtagaggctgcagtgagcagtgatggcaccaccacactccagcctgggtgacagagaccctgtctcaaaataataataaaatagggcccatgtaaatccttttaaacatttaaatattcaatttaatttagatttagatttagcaaatgtaactttatgaaataaaagccaaatgaaggtatrtggtgttaattttattgtttctaaacttaaaatcagctttgagaggcggcagtaagtagagtggtggaggtcacgctctggagtaagacaggccagtggggactcctggcgtcaccaacagagggcagcagaatccggcctgtgttgtcgtgggcctccttggctttggtgtaagtagctagcattggtcaagcactcaagctgggagaccggatggagtgtcacatcgttcaggtggagtgatgctgctgcccatgtcccggtggtagtgctggtaagaagtcatcatattcaaggaga

SEQ ID NO: 199206 - DNA, 601 bp, Human
gtgtctgtagtcccagctacttgggaggctgaggtgggaggattgcttgagcctgaaatgtagaggctgcagtgagcagtgatggcaccaccacactccagcctgggtgacagagaccctgtctcaaaataataataaaatagggcccatgtaaatccttttaaacatttaaatattcaatttaatttagatttagatttagcaaatgtaactttatgaaataaaagccaaatgaaggtatatggtgttaattttattgtttctaaacttaaaatcagctttgagaggcggcagtaagtaragtggtggaggtcacgctctggagtaagacaggccagtggggactcctggcgtcaccaacagagggcagcagaatccggcctgtgttgtcgtgggcctccttggctttggtgtaagtagctagcattggtcaagcactcaagctgggagaccggatggagtgtcacatcgttcaggtggagtgatgctgctgcccatgtcccggtggtagtgctggtaagaagtcatcatattcaaggagatttgctgatgaatgagatgttgggatgtgtgaggacaggagaaggtaagggaaccacct

SEQ ID NO: 199207 - DNA, 601 bp, Human
gtagaggctgcagtgagcagtgatggcaccaccacactccagcctgggtgacagagaccctgtctcaaaataataataaaatagggcccatgtaaatccttttaaacatttaaatattcaatttaatttagatttagatttagcaaatgtaactttatgaaataaaagccaaatgaaggtatatggtgttaattttattgtttctaaacttaaaatcagctttgagaggcggcagtaagtagagtggtggaggtcacgctctggagtaagacaggccagtggggactcctggcgtcaccarcagagggcagcagaatccggcctgtgttgtcgtgggcctccttggctttggtgtaagtagctagcattggtcaagcactcaagctgggagaccggatggagtgtcacatcgttcaggtggagtgatgctgctgcccatgtcccggtggtagtgctggtaagaagtcatcatattcaaggagatttgctgatgaatgagatgttgggatgtgtgaggacaggagaaggtaagggaaccacctgggttctgttatgagaactagaaggatggaggtcatgctgactaagctggggaaggtgc

SEQ ID NO: 199208 - DNA, 601 bp, Human
gtcaccaacagagggcagcagaatccggcctgtgttgtcgtgggcctccttggctttggtgtaagtagctagcattggtcaagcactcaagctgggagaccggatggagtgtcacatcgttcaggtggagtgatgctgctgcccatgtcccggtggtagtgctggtaagaagtcatcatattcaaggagatttgctgatgaatgagatgttgggatgtgtgaggacaggagaaggtaagggaaccacctgggttctgttatgagaactagaaggatggaggtcatgctgactaagctgggraaggtgcgggcaggagcaggtgtggagagggaggcattcttatggaggcttagtgaggggcagttgaggataggggcctcaagttagaggcagtatctgggctgagccatcagcattcccagggtccttaaggtcatgagcctgaattagatcacccagggtgtaggtgtcactggagaagagaagagatgaagaactgagccccagggctctccaaggtttagagtccagagagtagagaattgactaatagaagttcaggagatgaagctggaaaggaagggagaaaaccagagaagt

SEQ ID NO: 199209 - DNA, 601 bp, Human
ctgcccatgtcccggtggtagtgctggtaagaagtcatcatattcaaggagatttgctgatgaatgagatgttgggatgtgtgaggacaggagaaggtaagggaaccacctgggttctgttatgagaactagaaggatggaggtcatgctgactaagctggggaaggtgcgggcaggagcaggtgtggagagggaggcattcttatggaggcttagtgaggggcagttgaggataggggcctcaagttagaggcagtatctgggctgagccatcagcattcccagggtccttaaggtcatkagcctgaattagatcacccagggtgtaggtgtcactggagaagagaagagatgaagaactgagccccagggctctccaaggtttagagtccagagagtagagaattgactaatagaagttcaggagatgaagctggaaaggaagggagaaaaccagagaagtgggatttcaggtgccaaataaagacagtgtttgaaaggaagagaaaggtgggtattgtgtgatggtactgttagaccaagtaaggtttagcactgagaagtggccatgtcatttagcactctggacaagtgatttctg

SEQ ID NO: 199210 - DNA, 601 bp, Human
aagacttactgaatgaacagactacagctactcaaaatggtatgagtgaacggcacagacctaacattgagttgaagaatccagacacacaaaagtacattttgtcagatttcatttatggaagttcagaaacaagcaaagctccttgcagtttttggaaggcaggatcctgatgctcctgggagggtaacactggaagggggtgcagggggcttccaaggtgctaggcattttctgcgctgtggactaagtgcttttccataagtgtgttcactgggtaaaaatggatggaaccacaggsttgtgattagggcactctgcagcagtagacttcagagcagttacaagaggaaggatcggagaagaattgggggactggttatcaagaaaacttgagcagccgcttaagggatatggggctaggaaagctgtgttctaaagatgggagaaataacagcatgtgtatttgctgctggaaataagtcagtggaattgctgagggagagaggaaccacaccctgcaaagtgagggtgtggggtctggtgctgaagcagggggcgccacaggctgcgtgtccaagaagaggtagaggaacactgg

SEQ ID NO: 199211 - DNA, 601 bp, Human
ggagaaataacagcatgtgtatttgctgctggaaataagtcagtggaattgctgagggagagaggaaccacaccctgcaaagtgagggtgtggggtctggtgctgaagcagggggcgccacaggctgcgtgtccaagaagaggtagaggaacactgggtgcagctgcatgagctggggagcaggagctcattctgactgcatcccactgttgctgctttctgggtgatgcagcagagagcaaggatgggaagagcagtgttcccagaccagccacatctgcatcaccgggggatctattaraaatgcaaattcttgggctccaccccagaccttctgaatctggaactctagggctagggctcagcaagctgtgtgttttggtttttggttttttggggttttttgagacagagtcttgctcttggcatggctcactgcaacctctgcctcctggttcaagcaattctcgtgcctcagcctcccaagtaactgggactacggacacccaccaccacgcccggctaatttttgtggtttttgtagagatggggtttcgccatgttggccaggctggtctcgaattcctggcctcaagtgatc

SEQ ID NO: 199212 - DNA, 601 bp, Human
gagagcaaggatgggaagagcagtgttcccagaccagccacatctgcatcaccgggggatctattaaaaatgcaaattcttgggctccaccccagaccttctgaatctggaactctagggctagggctcagcaagctgtgtgttttggtttttggttttttggggttttttgagacagagtcttgctcttggcatggctcactgcaacctctgcctcctggttcaagcaattctcgtgcctcagcctcccaagtaactgggactacggacacccaccaccacgcccggctaatttttgtgktttttgtagagatggggtttcgccatgttggccaggctggtctcgaattcctggcctcaagtgatccgcccacctcagcctcccaaagtgctgggattatgggtgtgagccatagcacccggccagcaagctgtgaataggcttcaattaataagtgtgactctgatgcatgctgaaatttgagaattactggacaatggaaatacaataggattgccagttagtgtagggcccacttgacgttaatatcataaagtgaagtgagaccagccgtgtgggttactttttctacacccgtaa

SEQ ID NO: 199213 - DNA, 601 bp, Human
gttcatggatgctttcgttctaaagctggaaggagtatagtgattagagcatgagctgttgttagggaaacatagtacctgatggtaacgaaatctgttatcatcgaaggcatcattgtcctcaaatttctcaagaggtggctcgacagatttctagtctgatattttattctcctatatggcaaaagtagaattttgaaacttgaaagatgttttcttctaattgttgaaaatagttcttggttatgtggggtaccttgagactgagcctgagttgtttttttttttttttttttttttaaattcctactgtctttcagaagcaggagtgtaaaactgtcctcagatgctcagatgtttgcttcttgtcagtggaagtgggaatatgggtttgctactttagcgaacttccttgttcatgaagatgttttttatcttctagaaatattttggtgagcagggtcaggggtttctgtgttttggagcctgaacctggaagccatagaactagaagtcgaggaaaaaaaggaagggtcgagccaggtctggtggctcaagcctgtaatcccagcactttgggaggccaaggcgggagaatcac

SEQ ID NO: 199214 - DNA, 601 bp, Human
aaatattttggtgagcagggtcaggggtttctgtgttttggagcctgaacctggaagccatagaactagaagtcgaggaaaaaaaggaagggtcgagccaggtctggtggctcaagcctgtaatcccagcactttgggaggccaaggcgggagaatcacgaggtcaggagttctagaccagcctgaccaacatggtgaaaccccgtctctactcaaaatacaaaaataagctgggcgtggtggtggttgcctctaattccagctacttgggaggctgaggtaggaaaatcgcttgaaaccrgaaggcagagattatggtgagccaagattgtgccactgctctccagcctgggtgaaagagggaaactccatctcaaaaaaaaaaggaagcgtcaactccaagctgctcaaaatgtatcatattgtggctcgatcgctggaagccactatgaggaaaataggacaggagatgtgcacgtgtcctccacggtccccatcccccatcctctgtgccctgcagggcttccgaagtgaaagccgagttggagatgagaagggcaatctgtgcaggctttccttgtctttatggagtgccagggtc

SEQ ID NO: 199215 - DNA, 601 bp, Human
acttgggaggctgaggtaggaaaatcgcttgaaaccagaaggcagagattatggtgagccaagattgtgccactgctctccagcctgggtgaaagagggaaactccatctcaaaaaaaaaaggaagcgtcaactccaagctgctcaaaatgtatcatattgtggctcgatcgctggaagccactatgaggaaaataggacaggagatgtgcacgtgtcctccacggtccccatcccccatcctctgtgccctgcagggcttccgaagtgaaagccgagttggagatgagaagggcaatctstgcaggctttccttgtctttatggagtgccagggtctcaaggaagaaaaggtacgagcactgtgaggcctcggcagctctgcatgctggggatttgggcagcctctgtagagaagtaagagtgcagcacccgtgtcctggtgtggtggttcaggatttgcaaggcagagttgctctttttctctgagtaacagctagtgggctctgctcagttatccgtggtagacatctgctgaatgaggagtgagttcacctcagctcatgtttagagattggctttagggcacctgccagtggagta

SEQ ID NO: 199216 - DNA, 601 bp, Human
cgaagtgaaagccgagttggagatgagaagggcaatctgtgcaggctttccttgtctttatggagtgccagggtctcaaggaagaaaaggtacgagcactgtgaggcctcggcagctctgcatgctggggatttgggcagcctctgtagagaagtaagagtgcagcacccgtgtcctggtgtggtggttcaggatttgcaaggcagagttgctctttttctctgagtaacagctagtgggctctgctcagttatccgtggtagacatctgctgaatgaggagtgagttcacctcagctcaygtttagagattggctttagggcacctgccagtggagtattagagtgaggcccacggcctggcccctcccagggagcttggtgtcctcctgctgctgttcctgcatgtgaggcgcaggggacactgggacaacacggattttttagtgccagggtagctgtgtagaccaagtgttgcgggagttgatggtgtagaaagctctctggaataggattgtgaagatctaggacttgaaatgggtgttgacgtatacataacctgaaacccacaatccgaaaactcttaacacaagaatgaaagg

SEQ ID NO: 199217 - DNA, 601 bp, Human
acctggaatcaatcatgtagttgtatgcagaatgttccccttggctttgaactcgtcattcatttcgaagtgatgccgtttatcagtgctccaggttaatagtattaaccatccttaactttaaacaaactgtgacttttcaacacaactttctttacattatcaggagatgatgactatgtgcctgttgccattttattcattctctcattaagaaacccttttttgctatcttttcaaaattaattgggtaatcattagtcctcaaatcagaaataaaagcacaaggacataatacttyggtttacctggcagaggccagccgcagtcttcctggaggggatgttatgccggctctagttatcagacatgtgcctgagctacttaaaaaacagcattcttcagtcaggagttcgagaccagcctggccaatatggtgaaactccatctctactaaaaatacaaaaattagctgggcctggtggtgcacacctgtagtcccagctactcaggaaactgagacaggagaatcgcttgaactcgggaggcggaggctgcagtgagccgagatcgtgccactgcacactccagcccgggcaac

SEQ ID NO: 199218 - DNA, 601 bp, Human
ccattttattcattctctcattaagaaacccttttttgctatcttttcaaaattaattgggtaatcattagtcctcaaatcagaaataaaagcacaaggacataatacttcggtttacctggcagaggccagccgcagtcttcctggaggggatgttatgccggctctagttatcagacatgtgcctgagctacttaaaaaacagcattcttcagtcaggagttcgagaccagcctggccaatatggtgaaactccatctctactaaaaatacaaaaattagctgggcctggtggtgcacrcctgtagtcccagctactcaggaaactgagacaggagaatcgcttgaactcgggaggcggaggctgcagtgagccgagatcgtgccactgcacactccagcccgggcaacagagggagactccgtctcaaaaaaaaaaaaaaaaaaaaaaaacagtgttcttcacaatgtctgtcattttctgaaacaaaaagccagtggtactctagatgtttgcttttgggaaaacctcaacagctattttctcgttttctccagtcgtatcagtggacgagtccttaaaatgtgaatctcaaggggt

SEQ ID NO: 199219 - DNA, 601 bp, Human
tgaaactccatctctactaaaaatacaaaaattagctgggcctggtggtgcacacctgtagtcccagctactcaggaaactgagacaggagaatcgcttgaactcgggaggcggaggctgcagtgagccgagatcgtgccactgcacactccagcccgggcaacagagggagactccgtctcaaaaaaaaaaaaaaaaaaaaaaaacagtgttcttcacaatgtctgtcattttctgaaacaaaaagccagtggtactctagatgtttgcttttgggaaaacctcaacagctattttctcrttttctccagtcgtatcagtggacgagtccttaaaatgtgaatctcaaggggtgtctgagcatgccctgttggagtgtataagttctggaatacttatttaaggatgcgcattttatagactacacatacgaagtagattattactaaatacggtaactggttggaagctgtgactaagcaaaggactcactccccacaggagcagtggctcacagttgaaacgtttctcctttgctggaagcttgcagaagcacagtcccggctctctggaagctacttactcccatgttattaattca

SEQ ID NO: 199220 - DNA, 601 bp, Human
actgtctcatggatgaatgactaccccataaagttttgttttgattttggtattccctgggtagcaccatagcacttgaatcttaaaacagtaggataaagagggtctgggtctatcacagcatctcctgcagcacagctcatagtagtcatttgcaaggtatggttagtccagccttcaccttccctctctctgtccttcctgccgtccctcattctcgggcaaaaattccagtgctgcacctccagacagtaggaaggcccgtgactgcctctgttgagagggtttctttctctaaaaytgttctccacctgttctccacacccccgggggtaattagactacctctgtttgacctgggaaaataggatcactgtaaatacacatctctctgaagactggatgttttctctttttttgagacggagtttttgctcttgttgcccagactggagtgcagtggcacaatctcggctcactgcaacctccacctcccgggttcaagcgattctcctgcctcagcctcccaagtagctgggattataggcatatgccaccacacgtagctaatttttttttatttagtagagacggggtttca

SEQ ID NO: 199221 - DNA, 601 bp, Human
gtctgggtctatcacagcatctcctgcagcacagctcatagtagtcatttgcaaggtatggttagtccagccttcaccttccctctctctgtccttcctgccgtccctcattctcgggcaaaaattccagtgctgcacctccagacagtaggaaggcccgtgactgcctctgttgagagggtttctttctctaaaattgttctccacctgttctccacacccccgggggtaattagactacctctgtttgacctgggaaaataggatcactgtaaatacacatctctctgaagactggatrttttctctttttttgagacggagtttttgctcttgttgcccagactggagtgcagtggcacaatctcggctcactgcaacctccacctcccgggttcaagcgattctcctgcctcagcctcccaagtagctgggattataggcatatgccaccacacgtagctaatttttttttatttagtagagacggggtttcaccatgtcggttggtctggaactcctgacctcaggtgatccagccgcctcagcctcccaaagtgctgggattacaggcgtgagccaccgcacctggcctgactag

SEQ ID NO: 199222 - DNA, 601 bp, Human
tctcctgcagcacagctcatagtagtcatttgcaaggtatggttagtccagccttcaccttccctctctctgtccttcctgccgtccctcattctcgggcaaaaattccagtgctgcacctccagacagtaggaaggcccgtgactgcctctgttgagagggtttctttctctaaaattgttctccacctgttctccacacccccgggggtaattagactacctctgtttgacctgggaaaataggatcactgtaaatacacatctctctgaagactggatgttttctctttttttgagayggagtttttgctcttgttgcccagactggagtgcagtggcacaatctcggctcactgcaacctccacctcccgggttcaagcgattctcctgcctcagcctcccaagtagctgggattataggcatatgccaccacacgtagctaatttttttttatttagtagagacggggtttcaccatgtcggttggtctggaactcctgacctcaggtgatccagccgcctcagcctcccaaagtgctgggattacaggcgtgagccaccgcacctggcctgactagatatattctaacacgaatg

SEQ ID NO: 199223 - DNA, 601 bp, Human
acctagtaagtgctcaaggaatggtaactgttgtctctattgtctttattagaaaacttttggccgggcaggatggctcacacctataatcccagcactctgggaggccgaagtgggtggatcacctgagctcaggagtttgagaaaagcctggccaatatggcaaaaccccgtctctactaaatatacaaaaattagctgggcatggtggtggatgcctgtaatcccagctactggggaggctgaggcaggagaatcgcttgaacctgggaggcggaggttgcagtgagctgagatcgcrcggctgcactccagcctgggcaacagagcaagactccgtctccaaaaaaaaaaagagcataagtaatatttcttgacatgtgaaaatcacatgaaacccaaatttggaacatagccaccctcactcattgacacattgtccatggctgcttttgtgctgcagggcagagtggcatatgcggttatgaactgggaccccccaaaactgtgctcaaatcctaataccccatcctgtgggcatggccttgtttggaaatagggtccaatagctgcgaggccttgtttggaaatagggtccagt

SEQ ID NO: 199224 - DNA, 601 bp, Human
ggctgaggcaggagaatcgcttgaacctgggaggcggaggttgcagtgagctgagatcgcacggctgcactccagcctgggcaacagagcaagactccgtctccaaaaaaaaaaagagcataagtaatatttcttgacatgtgaaaatcacatgaaacccaaatttggaacatagccaccctcactcattgacacattgtccatggctgcttttgtgctgcagggcagagtggcatatgcggttatgaactgggaccccccaaaactgtgctcaaatcctaataccccatcctgtgggcayggccttgtttggaaatagggtccaatagctgcgaggccttgtttggaaatagggtccagtagctgcgaggcgtgagttcatgtggttttcagtctcgcagtgtgtgatcatttgccgtagccaccttgggagactaacaaacctgcagttcctgaaggattcaccatccttctgttgaggaggagcatttgttggcttctgtctcacaagaaggatctgtctcttcataattccacgatttcgctcctaggtggtctgttccagagttctctgcatgcttagtgcgtgcattgaatgcct

SEQ ID NO: 199225 - DNA, 601 bp, Human
aacctgggaggcggaggttgcagtgagctgagatcgcacggctgcactccagcctgggcaacagagcaagactccgtctccaaaaaaaaaaagagcataagtaatatttcttgacatgtgaaaatcacatgaaacccaaatttggaacatagccaccctcactcattgacacattgtccatggctgcttttgtgctgcagggcagagtggcatatgcggttatgaactgggaccccccaaaactgtgctcaaatcctaataccccatcctgtgggcatggccttgtttggaaatagggtcyaatagctgcgaggccttgtttggaaatagggtccagtagctgcgaggcgtgagttcatgtggttttcagtctcgcagtgtgtgatcatttgccgtagccaccttgggagactaacaaacctgcagttcctgaaggattcaccatccttctgttgaggaggagcatttgttggcttctgtctcacaagaaggatctgtctcttcataattccacgatttcgctcctaggtggtctgttccagagttctctgcatgcttagtgcgtgcattgaatgcctgcacgggatcctggagcacagta

SEQ ID NO: 199226 - DNA, 601 bp, Human
cacggctgcactccagcctgggcaacagagcaagactccgtctccaaaaaaaaaaagagcataagtaatatttcttgacatgtgaaaatcacatgaaacccaaatttggaacatagccaccctcactcattgacacattgtccatggctgcttttgtgctgcagggcagagtggcatatgcggttatgaactgggaccccccaaaactgtgctcaaatcctaataccccatcctgtgggcatggccttgtttggaaatagggtccaatagctgcgaggccttgtttggaaatagggtccartagctgcgaggcgtgagttcatgtggttttcagtctcgcagtgtgtgatcatttgccgtagccaccttgggagactaacaaacctgcagttcctgaaggattcaccatccttctgttgaggaggagcatttgttggcttctgtctcacaagaaggatctgtctcttcataattccacgatttcgctcctaggtggtctgttccagagttctctgcatgcttagtgcgtgcattgaatgcctgcacgggatcctggagcacagtacctgcccactgaatatcagcttccatcttcggtact

SEQ ID NO: 199227 - DNA, 601 bp, Human
agcttgggctgaacttcactgtggtgaacaatgacctgggagaggcgcaggtgaggggtcaggaggaggattcacatacctgtatagcaagtagcagcatctccttgtgtgtggaagtccatttgtgttacagcgtttgacttccgcacattttagttagaatgactgtggctgtgagttagacgtcgaagcatatagctccaaagcaccttagccctggcgtctgagctgagtgcagttcctgctcccacgcatgaagcctgttcctgcccggcagcccctcctgcggagctccactctygaggctgcggcccaggcttgctgcttgtctggctcttcccggtgctgggggtggccgttcagcagcttcccggcaggaccccttgcttagtcctcactccttgcccgctcagagccacctcagctgctccagcactgtctagggggtgtgttcattacccatctggttacttttgttacttatatcctttttaaaaaagaaaaaagaaaggtctatattagagattcaaactgattttcttaataacagctttatcaacatgtaactcacataccataaaatctgccctttttagtacat

SEQ ID NO: 199228 - DNA, 601 bp, Human
tgccttggcctcctgaagtgctgggattacaggcgtgagccaccgtggccggcacgacagagccttttacgtggtcttccttcacttgtagttgcatggatcaggacttcattccttttctggccaaatgatattccattatatggatataccacaaggtctttactggttgatggacatttgggttgttcctatgtttgggctaataagaatattactgttataaacatccacatacagcatactaaaataattattaatgagttagtaacatctgggatttgcttcaaatacactctgwgcatccataatctgaaaatccaaaatgttccaaaatccaaaactttctgagtgccaacatgaagctcaaaggaaatgctgattggaccatttcaggtttttggattaaggactcttactgataagtataatgcaaatattccaaaatttggggggaaaaaatacaaatccaaacacttctggcccaagtatttcactcagataagggatactgaccctgtgtggtgagaacaggggcaggaagtggggctatcagttccagagactggccgggaggtgtgatgcctgatgaactggctgt

SEQ ID NO: 199229 - DNA, 601 bp, Human
tcctggctaatttttgtgttttttatagacatgggtgtctccctatgttgtccaggctggtctcaaagtcctgggctcaagtgatcctcctgcctcagcctcccaaagtgctgggattacagatgcaagccaccatgcctgtccaagagccatatttatttggttacaacttatttagttgcttttgtttctgcatatttttccataccatagagctgaattttcaccaatgcaaaatttagataatttggcgggggggctgttactgtcattaggaagtactcgacatccagtgatgtcrcttgctgctaggtcttgcaccacctagtggcctgatttctaaatggcataaaagccttcggacggtgagtgttgtggtgacctgcctgaggcctttgctaatgcgagtatttcccatttttccttctgaaataaatgttaatagtgaaacgtcgcatatgcaagaattccattaaagcactgccgataatactggaatctgttaaaagcaaaagtgtgaagttaagatgttccagttattcatagagattcccactgagttaaaaaattatagataatgtatgagaataattatactaaa

SEQ ID NO: 199230 - DNA, 601 bp, Human
acaatctttctgtaaatggtaagagactgggacatcagtgccattgcccagaggcagcagtcttgtctgttactctgggaatattaaagctaccaggaaaactgaaggctgtgaaaagaaaagaatggaaaggtagggaagttgaaatgtctttgttcatttattttgggcttattttatattttcattgtccacagtataggttgctctcatctaaccccaggaatgcagttggggtgtttttgttgtttttttgttttgttttagaaatacaggtgggggtcttgctttatctcaaacycctgggcttaagggatcctcttgccttggcctcccacagtgctgggattagaggcgtgagccactatacccggcctgtttttttggttttcttaataaatactttttaaaaatttttttatttaaaatacactctttataaattatgattacatgtttatattgtattttgctcgtgtactgttttgtatttatgaattcatataatcatgtaatcacagcaattccaagtcagacaaacaaatatcaccattttattaatggccaaaagtttcaaggtgtaaagtgacttgtctgtcat

SEQ ID NO: 199231 - DNA, 601 bp, Human
ctgttttgtatttatgaattcatataatcatgtaatcacagcaattccaagtcagacaaacaaatatcaccattttattaatggccaaaagtttcaaggtgtaaagtgacttgtctgtcatacaagtgggggacagtaagacccaggtctgtgtttccgctgtgttgcttttctcatgagcactcttgtggtgtttatgggagctccacgttatacctgcaaattctgtgagtatagccacgtactaataaaaagtgttcttactcactctgtttatatacataagaaattggctgatctrttatcactgatcgttaccaccaccctttgtatcgtaattaaagtgctttatagtaatggcattgtggaagcacacaggtaagtgtgtgctgcttatatggatgaaaatgagaaatcactttactacagcctttgcgtttcctccagaatgagtcgctttttctcttctgacttaacggtgattgtttgcttcatgtctttgccctctgtgatttctcatttttgtttaagtaaaattgccatggtgacattgctgcacaattccctagtgcttcggaggaaacatggatggttagtgatc

SEQ ID NO: 199232 - DNA, 601 bp, Human
tgaggaaatggaaatgttctaaaactggattgtgctgatggttgcaaaactctaaacttacaaaaaatcatttttacatataacctgtgtgtatccatgcgtatgtatctcttatctgtagtttgcattgtcctacatctgaagtctaatctttatgtaaaagcaaataatgcctaaggtcacgttgtccccatgatcgggtcataagtttaaggaaatgaaatcagtctgacctttcctttgccaagagattgtcttcggttgttttcattacccatctgcactgagggcttgcaccttyaataatctcagctatgccagtaaataggtttaaaatattatattcattttggtgccaattaatgcacttaagacattttattggtgttatttctgtagtatattaacaatgagggaacaatatacagcaattattttaggtttagggagcactttactagattaaaagctgtaagtggcagacattacatttcagaatagtggtctcatcatatagtgagattggttgttagccatggtattaatatcagaatgataataagttagaaggaaagatgataaaattaatttagccaccaaa

SEQ ID NO: 199233 - DNA, 601 bp, Human
aacctgtgtgtatccatgcgtatgtatctcttatctgtagtttgcattgtcctacatctgaagtctaatctttatgtaaaagcaaataatgcctaaggtcacgttgtccccatgatcgggtcataagtttaaggaaatgaaatcagtctgacctttcctttgccaagagattgtcttcggttgttttcattacccatctgcactgagggcttgcacctttaataatctcagctatgccagtaaataggtttaaaatattatattcattttggtgccaattaatgcacttaagacattttaytggtgttatttctgtagtatattaacaatgagggaacaatatacagcaattattttaggtttagggagcactttactagattaaaagctgtaagtggcagacattacatttcagaatagtggtctcatcatatagtgagattggttgttagccatggtattaatatcagaatgataataagttagaaggaaagatgataaaattaatttagccaccaaatcatgctgggaaaacacccagctgtgttagtactagacacccattgtctgtcatgttagatctgtggccacgtgcaagccc

SEQ ID NO: 199234 - DNA, 601 bp, Human
aagctgtaagtggcagacattacatttcagaatagtggtctcatcatatagtgagattggttgttagccatggtattaatatcagaatgataataagttagaaggaaagatgataaaattaatttagccaccaaatcatgctgggaaaacacccagctgtgttagtactagacacccattgtctgtcatgttagatctgtggccacgtgcaagccccttctctgccgtctgttcagcggcggctttgaactgcagcacggttcttcaaaataaggctcctctgcagtagttcttggtgccygcattcatctttatagttacagggtgatccttattctagctttttatgtatttatttatttattttgagggcgaatctcaccctgtcacccaggctggagtgcagtgatgcaatctcagctcactgcagcctctgccttctgggttcaagcaattctcccacctcagcctcccaagaagctgagattatgggtgcgcgccacaacatccagcgaatttttgtacatttggtagagacagggtttcaccatgttggccaggctgctctcgaactcccgacctcaagtgatccgccagcccg

SEQ ID NO: 199235 - DNA, 601 bp, Human
ccaaatcatgctgggaaaacacccagctgtgttagtactagacacccattgtctgtcatgttagatctgtggccacgtgcaagccccttctctgccgtctgttcagcggcggctttgaactgcagcacggttcttcaaaataaggctcctctgcagtagttcttggtgcctgcattcatctttatagttacagggtgatccttattctagctttttatgtatttatttatttattttgagggcgaatctcaccctgtcacccaggctggagtgcagtgatgcaatctcagctcactgcagsctctgccttctgggttcaagcaattctcccacctcagcctcccaagaagctgagattatgggtgcgcgccacaacatccagcgaatttttgtacatttggtagagacagggtttcaccatgttggccaggctgctctcgaactcccgacctcaagtgatccgccagcccgggcctcccaaagtgctgggattacaggtgtgagccactgtgcctggccctgctttgaccctccttaagttgctctccccttctcgtactttgcccatcgcctccacataattggcggtgggtggggtggg

SEQ ID NO: 199236 - DNA, 601 bp, Human
ccagctgtgttagtactagacacccattgtctgtcatgttagatctgtggccacgtgcaagccccttctctgccgtctgttcagcggcggctttgaactgcagcacggttcttcaaaataaggctcctctgcagtagttcttggtgcctgcattcatctttatagttacagggtgatccttattctagctttttatgtatttatttatttattttgagggcgaatctcaccctgtcacccaggctggagtgcagtgatgcaatctcagctcactgcagcctctgccttctgggttcaagcrattctcccacctcagcctcccaagaagctgagattatgggtgcgcgccacaacatccagcgaatttttgtacatttggtagagacagggtttcaccatgttggccaggctgctctcgaactcccgacctcaagtgatccgccagcccgggcctcccaaagtgctgggattacaggtgtgagccactgtgcctggccctgctttgaccctccttaagttgctctccccttctcgtactttgcccatcgcctccacataattggcggtgggtggggtgggggcggggggaggcagagaattc

SEQ ID NO: 199237 - DNA, 601 bp, Human
gcagagaattccgcttttgcatttacaatcggtccttcatatctgtgggttctgtccacatccatggcttcaaccaattgcagattttaaatatttgaggaaaaagcaatggttgtgtctgcactgaatgtgtgctaagcaatatagtgtcacagccatttacacagcctcggcatgagatgggattgtaccagtgctctagagatcatggaagtgcacagcacgtacacaggtgatacacacatgccacgccgttttagagaagggacttgaggatccatggactttagtttccgtgggkgtctggaccaatccctgtgggtcctgaagggtgggtgtgctttgcatttcataaagcatgtgttcattttgccataggaggctattctgcagaccatcctgttattaaggtcttctggagagttgtggaagggttcactgatgaagaaaagcgcaaactgctgaagtttgtaacaagctgctctcgaccccctctcttggggtttaaggtacacaactttcatgacatttgctttaaagaccacttcataataagaaaggcagcagaacattcagtagggttaaatgaagtccttttaca

SEQ ID NO: 199238 - DNA, 601 bp, Human
atggactttagtttccgtgggggtctggaccaatccctgtgggtcctgaagggtgggtgtgctttgcatttcataaagcatgtgttcattttgccataggaggctattctgcagaccatcctgttattaaggtcttctggagagttgtggaagggttcactgatgaagaaaagcgcaaactgctgaagtttgtaacaagctgctctcgaccccctctcttggggtttaaggtacacaactttcatgacatttgctttaaagaccacttcataataagaaaggcagcagaacattcagtagrgttaaatgaagtccttttacatacacttttgtttttatcttcagctagatttttaattaagtactggttatgatgtatatattttggtgctagttttatttggggttgctttttttgtttgttcacaataacctagtcatatgatagttacacattgtggttatgattgcctgtgaacaaaccgtacatttggagggactatttgcaatattaataatgtctcataaatctgtaacacatcttgggctttttgctactgaactgaagcaggtacaacgtagagatgttgatggagtgtat

SEQ ID NO: 199239 - DNA, 601 bp, Human
ccaccgttgggagtgtacagatggcaacatattttcacacagtgtgtttatgaatgttcagagcaagccttcataatggccaaaaacgaaataattcacagtacatgaactgctagtaaatactatagattaagagatatttagaatttaaaaggaataaatgatatctactacactgtgtatgaacattgaaaacactgtgctaagtgaacgaagcaagacacaagactacgtattattatatgtaattccactcggataaactgtcctttgaaaggcacatttagagacacagagcggrtcaggggctgcacagggctggaggtggcagcgggagcttcggagaagtggagcgacccaaaaccggattgtgggggtcgctgcggaactctgtaaatttgctaaaatcattggattgtacatttaaagggataatcttatagtaagtcaagtacacctcaattaagctgttcttaaaaattgactataaactaacacagcatctcagttagtgccctcagaactggagttgggacccagtagagaggtggaaagaagtgaggcctaagtgcagtgagtttgtttcaaataggtcaatcat

SEQ ID NO: 199240 - DNA, 601 bp, Human
caaggcttctagtatctttgtttcaaaactggtttgttccaaagctagagataagaaaattatgcatctcatctagtttcataaaaggaagtttggaggacctgctcccatcaaaacactggaagatgcagagacttttgtcagctcctggctaattagataatgctaatcatgtgagtagcaataaaaattcgaagtcctgccagacgtaggttctagacattctgacagccaactaaagagccagcaataacgtgtgcctaggagtgcgagagccttctccacctccgtgatgcctccrggttcgtgcatggccacttgtgctgcgtgagcgtcgtaggtttaggggaacagaagtagagggatttacatgagcttttaaaatcccaaatagactggccaggtgcggtggctcacacctgtaatcccagcactttgggaggccaaggcgggtggatcccctgaggccaggagttcaagacgaacctgaccaacatgatgaaaccccgcctctactaaatacaaaaaaaaaatcagccgggcatggtggtgcatgcctgtagtcccagctacttgggaggctgaggcaggagaatggctt

SEQ ID NO: 199241 - DNA, 601 bp, Human
gaagtttacatttaacagtaaagagacctacaaagatcagtaataagaatcatgtaagtctcttcataggctttttttttttttttttttttttttttttttgagatagagtttcgctcctgttgcccaggctggagtacaatggcccatctcagctcgctgcaacctctgcctcctgggttcaagtgattctcctgccgcagcctcccgagtaggtgggattacaggcacctaccaccacccccagctaatttttttgcatttttagtagaggcaggatttcaccatgttggccaggctrgtctcgaactcctgacctccggtgatccacccacctcagcctcccaaagtgctgggattacaggcatgagccaccgcgcccatcctcttcatagcattttgtgggctgtgctcttactagttttacccttaacataaattatatgctaaactcaacatataattgaaacaaaatccaactgaaatgtgggtgtggccagttgggtgcctgttgtgctttgtgacagcttcagtgcttccaaaggttcctgcagaatgggacattgctctagtttgattcacatttgactacaatggttag

SEQ ID NO: 199242 - DNA, 601 bp, Human
ttagtctgcccaccgtagccgctatgcttcgtgtcctaacaccaccttccccgggcacctgtcctaacgccaccttcccaggcacctgtcgtaacgccaccttccccgggcgcctgtcctaacgccaccttcccgggcatacagagaatccgtgcccttttgtgccgtgtcgctttgtgggcttgccacacttacagaaagtcgaacgggggccgggtgtggtggctcacgcactttgggaggctgaggcgggcggatcacctgagttcaggagttctcgaccagcctggccaacatggcraaaccccatctctactaaaaatacaaaaattagctaggtgtgatgatgggcacatatagtcccagctactcgggaggttgaggcaagagaattgcttgaacctgggaggcagaggttgcagtgagccgagattgtgccattgtacaccagccttgttgagagagcaagacgccaactcaaaaaaaaaaaaaaaagtctagcaagtattaggaacattcactttgtgggagcgctgttggcaccgaaagcactttttttatattggattttttttttttttttttacctttcagtaaaagt

SEQ ID NO: 199243 - DNA, 601 bp, Human
taatggtgtttgtgtatacgaggaaggtggagtcaccggttcttcgtggccatcagaggaccgacacgcccataggtctcatgcattaagtctgcgttgagcaatccctaacacggtttttgcctacagatacatttgcacaactgtgaaaaccaggtacgtattcattgcatcattttttgtaaaaagctgagagaagtgcccagcaacacgtcgtgccgcgcgtgtgcatggaacaccatatagcctcaccattaataggcaagatgagcgagacccattatcagatgagaaaagcacrgcacggaatactgtgtccaatgtgctcaccgtctcaattttaaacctaaaggagggagaacattttctcatgcgtgcatttcatctctgggagcacttaagacgctgaagcgttggttgccagtgggaatgggaactgggtatctgtgatacagggatgagaattttcacactgtacctttaaataccagaacatcatgaacacatctgaaaaacaatattcaaatttccctgatcatctttcttttttgttaacaattatttaaattctggcacaagcaagccacttttcatcatgcat

SEQ ID NO: 199244 - DNA, 601 bp, Human
agaagtgcccagcaacacgtcgtgccgcgcgtgtgcatggaacaccatatagcctcaccattaataggcaagatgagcgagacccattatcagatgagaaaagcacggcacggaatactgtgtccaatgtgctcaccgtctcaattttaaacctaaaggagggagaacattttctcatgcgtgcatttcatctctgggagcacttaagacgctgaagcgttggttgccagtgggaatgggaactgggtatctgtgatacagggatgagaattttcacactgtacctttaaataccagaacrtcatgaacacatctgaaaaacaatattcaaatttccctgatcatctttcttttttgttaacaattatttaaattctggcacaagcaagccacttttcatcatgcatttggtctatagatgttctacctccctcaatttcgtcttgtaatttaatgaataggggaactggggccgggcacggtggctcacgcctgtaatcccagcactttgggaggctgaggcgggtggatcacgaggtcaggagatcgagatcatcctggctaacatggtgaaaccccgtctctactaaaaatacaaaaa

SEQ ID NO: 199245 - DNA, 601 bp, Human
cccccagctaggcctcccaaagtgctgggactacaggtgtgagctatgcgcctggcctggaatgttatttatccctttttatgcctgaagcacagtgcataatcttttatgtaagttagaactaagccatcaatgtaattttttaaaaaagcaaatgtgggccaggcacggtggctcacgcctgtaatcccagcactttgggaggcagaggtgggcagatcacaaagtcaggagttcaagaccatcctggccaacgtggtgaaaccccttatctaggaaaaatccaaaaattagccaggcrtggtggcaggcacctgtaatcccagctacttgggagactgaggcaggagaatcgcttgaacctgggaggcagaggttgcagtgagctgagatggcgccattgccctccagcctgggcgacagagctagactccatctcaaagaaaacaaacaacaacaacaaagcaaatgtggtttcgggaaaatgtgactgcaatggtaactttactgattggagcaggcacattttgtgtactttgtattaaaactcatgtaatgccatgcttgttacagtgacatcttgcacacatgctgtttttca

SEQ ID NO: 199246 - DNA, 601 bp, Human
ttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctmgtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatc

SEQ ID NO: 199247 - DNA, 601 bp, Human
gccttccgggttgcagccgccgggaaatgagctggcgtctcctgccgccccgcccctgccctcctggccgctcccgctgctcccacccgcctcccccgggccaggtccgaggggtcccgtacggggcgggcctggctggcggggtcccggaacgcaccccctcagctgcagggctccgcggccagggcagatccgagcagcccctccctttccggaggcgctgggagagcagccaggccgcctagggcggggcggggccgggctgcacccgcgggcagtgaagggatcaggagtgcaagcctggggagtcagacctccccctgcctcctctgccaatgcagcccggaggctaccaccacccatcccggccgggcgcggtggctcacacatagaatcctagcattttgagaggcccaggcgggaggatcgcttgaggccaggagttggaggccagcatggacagcattgcgagaccctttctctattaaaataaataaataaaatgtagccaggcgctgtggctcatgcctgtaatcccaacactttgggagtcgaggtggacggatcacttgaggtcaggagttcgagactagcctgaccg

SEQ ID NO: 199248 - DNA, 601 bp, Human
cccacccgcctcccccgggccaggtccgaggggtcccgtacggggcgggcctggctggcggggtcccggaacgcaccccctcagctgcagggctccgcggccagggcagatccgagcagcccctccctttccggaggcgctgggagagcagccaggccgcctagggcggggcggggccgggctgcacccgcgggcagtgaagggatcaggagtgcaagcctggggagtcagacctccccctgcctcctctgccaatgcagcccggaggctaccaccacccatcccggccgggcgcggtggstcacacatagaatcctagcattttgagaggcccaggcgggaggatcgcttgaggccaggagttggaggccagcatggacagcattgcgagaccctttctctattaaaataaataaataaaatgtagccaggcgctgtggctcatgcctgtaatcccaacactttgggagtcgaggtggacggatcacttgaggtcaggagttcgagactagcctgaccgacatggtgaaaccctgtctctactaaaaatacaaaaattacccaggcatggtggcacgcacctgtaatcccagctactcag

SEQ ID NO: 199249 - DNA, 601 bp, Human
ccaggtccgaggggtcccgtacggggcgggcctggctggcggggtcccggaacgcaccccctcagctgcagggctccgcggccagggcagatccgagcagcccctccctttccggaggcgctgggagagcagccaggccgcctagggcggggcggggccgggctgcacccgcgggcagtgaagggatcaggagtgcaagcctggggagtcagacctccccctgcctcctctgccaatgcagcccggaggctaccaccacccatcccggccgggcgcggtggctcacacatagaatcctagyattttgagaggcccaggcgggaggatcgcttgaggccaggagttggaggccagcatggacagcattgcgagaccctttctctattaaaataaataaataaaatgtagccaggcgctgtggctcatgcctgtaatcccaacactttgggagtcgaggtggacggatcacttgaggtcaggagttcgagactagcctgaccgacatggtgaaaccctgtctctactaaaaatacaaaaattacccaggcatggtggcacgcacctgtaatcccagctactcaggaggctgaggcaggagaat

SEQ ID NO: 199250 - DNA, 601 bp, Human
gttcgagaccagcctgaccaacgtggtgaaaccccgtcactactaaaaatacaaaattagccaggtgtggtggtgggcacctgtaatcccagctactcaggaggctgaggcaggagaatcgctagaacctgggaggcggaggttgcggtgagccaagatcatgccgttgcactccagcctggggttacaaagcgagactctgtctccaaaaaaaaaaaaaaaagcaaacaaaaaatgtctcaggcttgcttcagggggagaatggtgaaaggtctgggtaaaatcgccctgatagatgccrgtaaagtttgtttcttacatatgtctgtacataatccattgataggtctttttctttttttctggagtccgggtctcattgtgttgcccaggctatagtgccatggcttgatcataactcactttagccccaaactcctgggctcaagggatcctcctgagtagctgggattacaggtatgttcctccatgcccagctaatttttaaatgtttagtagaggtagggttttgctgtgttgtccaggctggcctcaaactcctggccttaagcgatcctcctgccttggcctcccaaagtgc

SEQ ID NO: 199251 - DNA, 601 bp, Human
agacagtgtcttgttctgttgcccaggctggagtgtggtgacactaccttgactcactgcagcatctgcctcccgggttccagtgattctcctgcctcagcctctcaggtagctgggattacaggtacatgccaatatgcccggctaatttttatatttttagtagagacggggtttcaccatgttggccaggctggtctcgaactgctgacctcaggtgatccgcccacctcggcttcccaaagtgctaggattacaggcgtgagccaccgcgcccagcttcttcttcttcttcttcttcttttttttttttatttggaggtggcggagtttcactctgtcgcccaggctgcagtgcagtggcacaatctcagctaactgcaacctcttcctctcgagttcaagtgattctcttgcctcgaccccccgagcagctgggattacaagtgcccaccaccaagcccagataaattttgtatttttagtagagagggttttaccatgttgggcaggctggtctcaaactcctgacctcaggtgatccacctgcctccgcctcccaaagtctgggattacaggtgtgagccaccgcacccgtcgg

SEQ ID NO: 199252 - DNA, 601 bp, Human
ggcctcctggggctgaaagggagggaaaaattggcctcagctggagtcctggggccaaccagagcctgggtggagtgtgaaagtgggcttctggccttcaccctgcccctgccctgctggtgaccttggaccatgggggttgtcggggtgtagatgagcaccgtgaatcagtcacaggccttgagcttctctctgcacagtgctggcatcagatgtgggtggtgatgtcccagcctgggaacacaggaaacgctcagggaaacccccatcagacctgctgacatggctgagggcgctgagrtggtgcttccggggccctcaccttacacaaagaggccttataaggagagagaggctgcagaggcagccccagtgggtgccgggtgcttgttctgggtaaggctgcccacacgtgcaaagtgtgcttgtggacacagtgcgcttgcgtgtgtgcaaggctgaacatacatgtgtgcaggcctgcagtgtgcctgtgtgtgaggctcaacacgtgcatgtggggagtatggtcatgtgtgcaaggctaaacatgtgcttaaagtgtggggaggtgcagtgtgcatgtgtgtgtgcaaggctt

SEQ ID NO: 199253 - DNA, 601 bp, Human
gcatcagatgtgggtggtgatgtcccagcctgggaacacaggaaacgctcagggaaacccccatcagacctgctgacatggctgagggcgctgagatggtgcttccggggccctcaccttacacaaagaggccttataaggagagagaggctgcagaggcagccccagtgggtgccgggtgcttgttctgggtaaggctgcccacacgtgcaaagtgtgcttgtggacacagtgcgcttgcgtgtgtgcaaggctgaacatacatgtgtgcaggcctgcagtgtgcctgtgtgtgaggctsaacacgtgcatgtggggagtatggtcatgtgtgcaaggctaaacatgtgcttaaagtgtggggaggtgcagtgtgcatgtgtgtgtgcaaggcttaacatgcaaagtgtgcttgtgtgtgtgaggctgaacacgcatgtgtttgtgtgcgtggcctgaccctgcgctgcgtgtgtctacttgctcagcaaatgctgactggggacccaccggggtcctgttctaagcatggaggaaacatgaggtccctgccccgtgcatgtacacatgtgcatgtgtgtgtgtcctgtgctgctccagg

SEQ ID NO: 199254 - DNA, 601 bp, Human
agtactggggttacaggcatgagccactgcgcctggccctatttaataaaattatttatttatttattatttttaagttattttttcacacacattcattcctaaccttttttttttttttttttttgagacagagtcttgctctgttgcccaggctggagtgcagtggtgtgattttggctcactgcgacctctgcctctcaggttcaacagattctcctgcttcagcctcccaagtagctgggactacaggtgtgcgccaccacgcccagctaatttttgtatttttagtagagacagkctttcaccatgttggccaggctggtcttgaactcctgacctcaggtgatccgcccgcctcggcctcccaaagtgctgggattacaggcatgagccaccgtgcctggcctcattcctaacctatgtaatgataatatttttgagggctgggtagggtggcgtgagcctgtagtcccagctacttgggaagcagaggcaggaggatcacttgagcctgggaagtcgaggctgcagtgagctgtgatcacaccactgcactccagcctgggcaacagagcgagaccctttctcaaatatacac

SEQ ID NO: 199255 - DNA, 601 bp, Human
ttcctaaccttttttttttttttttttttgagacagagtcttgctctgttgcccaggctggagtgcagtggtgtgattttggctcactgcgacctctgcctctcaggttcaacagattctcctgcttcagcctcccaagtagctgggactacaggtgtgcgccaccacgcccagctaatttttgtatttttagtagagacagtctttcaccatgttggccaggctggtcttgaactcctgacctcaggtgatccgcccgcctcggcctcccaaagtgctgggattacaggcatgagccacygtgcctggcctcattcctaacctatgtaatgataatatttttgagggctgggtagggtggcgtgagcctgtagtcccagctacttgggaagcagaggcaggaggatcacttgagcctgggaagtcgaggctgcagtgagctgtgatcacaccactgcactccagcctgggcaacagagcgagaccctttctcaaatatacacacacacacacgtttctgagaacgtactctgttggtcactaatggcaatgaaaaatttgttcagcggatatttcttgagcacctactatgtgctaagca

SEQ ID NO: 199256 - DNA, 601 bp, Human
tgcttcagcctcccaagtagctgggactacaggtgtgcgccaccacgcccagctaatttttgtatttttagtagagacagtctttcaccatgttggccaggctggtcttgaactcctgacctcaggtgatccgcccgcctcggcctcccaaagtgctgggattacaggcatgagccaccgtgcctggcctcattcctaacctatgtaatgataatatttttgagggctgggtagggtggcgtgagcctgtagtcccagctacttgggaagcagaggcaggaggatcacttgagcctgggargtcgaggctgcagtgagctgtgatcacaccactgcactccagcctgggcaacagagcgagaccctttctcaaatatacacacacacacacgtttctgagaacgtactctgttggtcactaatggcaatgaaaaatttgttcagcggatatttcttgagcacctactatgtgctaagcatttaagcagtggaaatagaaacgagaacaagatagaacaaaaatgtgtctctgccaagctggttctattccagcaggggaggaaggcagcgggccagatcagtgagtgcatgtctgatggtg

SEQ ID NO: 199257 - DNA, 601 bp, Human
gagcgagaccctttctcaaatatacacacacacacacgtttctgagaacgtactctgttggtcactaatggcaatgaaaaatttgttcagcggatatttcttgagcacctactatgtgctaagcatttaagcagtggaaatagaaacgagaacaagatagaacaaaaatgtgtctctgccaagctggttctattccagcaggggaggaaggcagcgggccagatcagtgagtgcatgtctgatggtgactgctgagaaaatttaatcggaaatagggaattacgaagtgccggaccgtggraggtgctgcagtttccagggaaggcctccccaaaagttgacatttgagtacagacttgagtggcagcaccagagcgagagccgtgtgtgccggtatctgggggaagagtgtcacaggcctagggaacagccagcacggaagcccgaggcaggtgcatgcctgtgtgccccaggattggcctctggttggctggggaggcctgctcctcaaagggctggtatatcacatccatcacaggctaagagtaaccgcctcgtggttcctcctcatagaggccaggtgcggtgtgtcatctgcttc

SEQ ID NO: 199258 - DNA, 601 bp, Human
agagagaccctgtctcaagaaacaaaaatctccctccttcagttccccaaggctgggtcaccctggggcctccccaagagccatcacccaggcctcgcctagccctgtgcctcctcccagccctgggtgcagccagtggatgtctggatggagaatgggatgtatctgttaaatatctgcctttgcctcagccatgagcccctgcagaccggccacctcccttctccccgtctgagcagtgtgggggaagaccagggctctgggcacggcagggccaactgccatgtgctggacacctttytaggtggtttatgagattacttcatttcttttttttttttttttttctgagatgagtcttgctctgtcacccagcctcctgagtagtggggattacaggcaggtgccaccacacctggctaatttttttttttttttttttttttttttttgagacggagtctcactctgtcgcccaggctggagtgcagtggtgcgatctcggcttactgcaagccccgcctcccaagttcacgccattctcctgcctcaggctgggactacaggtgcccgccaccacacccgactaattttttgtagt

SEQ ID NO: 199259 - DNA, 601 bp, Human
cattgctgcgagtaaaggacagccagttccaggagaagacagggtggcctagcagggcctgaaggacttcagggggcccctgcaaggcagaagaggagagactgagtcatgaaaggtgaggtgttgttgcctaggtgcactgtgtagtgtgtcctggcagagggcagtcatggagagggcccctcaatctccctccatctccccttcagagattgccatctgccccaacaaccatgaggtgcatatctatgaaaagagcggtgccaaatggaccaaggtgcacgagctcaaggagcacaaygggcaggtgacaggtatgtcagggtggctgggaccaccgtcctgaaaggaggtggtgggttgggggggtggtgcaaggcagggcatggccactcattgtggagcatctgcccactcaccgtgaaacccggattcaaactggcttcaattttaaggggactgtgttggctcatgttaccaaaaactcacagggttgagggcttcaggagaggcttgatccagcagctccacatgaccaagaacccatcttttctgcctcttggctttgccctccagcatgtttgctgatagcatggagggc

SEQ ID NO: 199260 - DNA, 601 bp, Human
aaaaattagccaggcatgatggcgggtgcctgtaatcccagctacttgggaggctgatatgtgagaattgcttgaacccggaagatggtggttccagtgagctgagatcgtgccagtgcactccagcttgggcggctgagcgagactctgtctcaaaaaaaaaaaaaaaaaaaaaagattggtggtacacacctgtagtcccggctactcaggaggctgaggcacgaggattgcttgaacctgggaggcagaggctgcagtgagctgagatcatgccactgcactccagcctgggtgacasagcgagactctgtttcaaaaaaaaaaaaaagtgcctgctgggcagatacagcttccacctggatggtggcctttcagcctctcccatgtggccaccatacagccacctctgcctgagtgtcatcagcctcctgtgttccctccatccccccacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggc

SEQ ID NO: 199261 - DNA, 601 bp, Human
gatggagtctcactctgtcacccaggctggagtgcagtggcacgatcttggctcacggcagcctctgcctgccgggttcgagcagttctctgcctcagcctcccaagtagctgggattacaggcacctgctaccatgcccggataatttttatatttttagtagagatggggtttcaccatcttggccaggttggtctagaacttctgacctcatgatccacccgcctcggcctcccaaagtgttgggattacaggcgtgagccaccgtgcccagccaattttttttttttttttttttttgagacacagtcttgctctgtcgtccaggctggagtgcagtggcacaatctcagctcaccgcaacctctgcctcccaggttcaagcaattctcctgcctcagcctactgagtagctgggactacaggcacgcaccaccacgccaggctaattttgtattttttagtagagatggggtttctccatgttggtcaggctggtcttgaactcctgacctcaggtggtcctcctgcctccgcctcccaaagtgctgggattacaggcgtgaaccactgcgcccggccatatatatatttttgaga

SEQ ID NO: 199262 - DNA, 601 bp, Human
gtgcagtggcacgatcttggctcacggcagcctctgcctgccgggttcgagcagttctctgcctcagcctcccaagtagctgggattacaggcacctgctaccatgcccggataatttttatatttttagtagagatggggtttcaccatcttggccaggttggtctagaacttctgacctcatgatccacccgcctcggcctcccaaagtgttgggattacaggcgtgagccaccgtgcccagccaattttttttttttttttttttttgagacacagtcttgctctgtcgtccaggctrgagtgcagtggcacaatctcagctcaccgcaacctctgcctcccaggttcaagcaattctcctgcctcagcctactgagtagctgggactacaggcacgcaccaccacgccaggctaattttgtattttttagtagagatggggtttctccatgttggtcaggctggtcttgaactcctgacctcaggtggtcctcctgcctccgcctcccaaagtgctgggattacaggcgtgaaccactgcgcccggccatatatatatttttgagacaaggtcttgctctgtcgctcaggctggagt

SEQ ID NO: 199263 - DNA, 601 bp, Human
aaaaatttttttttttttttgagacagtctcactctgttgcccaaactggagcacagtagcgcaatcacagctcactgcagccttgacctcctgggttcaagcaatcctcccgcctcagcctcctgagtagctgagagtacaggtgcgcaccaccatgcctggctactttacctctactttgcctatcccggtaggatcttttcagcctacatcaaggaggtggaggaacggccggcacccaccccgtggggctccaagatgccctttggggaactgatgttcgaatccagcagtagctgyggctgggtacatggcgtctgtttctcagccagcgggagccgcgtggcctgggtaagccacgacagcaccgtctgcctggctgatgccgacaagaagatggcgtgagtcgaggccatccccaggggaggaggtgagtgcagaggagtgggacaccgtgactcacagctctctcccctcagcgtcgcgactctggcctctgaaacactaccactgctggcgctgaccttcatcacagacaacagcctggtggcagcggtgaggaatagggaggggagggagggtgtgtggtcacagcaggcc

SEQ ID NO: 199264 - DNA, 601 bp, Human
ggtgcggtggctcacacttaaaatcccagcactttgcgaggttgaggtggaagtatcactggaggccacgagtttgagaccagcccgggcaacacagtgtgagacccttgtctctacaaaaagttaagaaattagctgggtgtggtggtgcacctgtaatctcataatcccagttacttgggaggctgaggcaggaggataacttaagcatgggaggtcgaggcttctgaactgagctatggtcgtacctctgcacttcagcctcggcgacacaaaacctgtctcaaaaaaaaaaaaaaaagagccaggcccggtggctcacacctgtaatcccagcaatttgggaggccaaggagggcagatcacctgaggtcaggggttcaagaccaacctggccaacatggcaaaaccccatctctactaaaaatacaaaaattagccgggtgtggtggtgggcgcccatggtcccagctgctcgggaggctgaggcaggagaattgcttgaacccagaggcagaagttgcagtgagccaagggtgagccaccgagactccatctcaaaaacagaaaaaaaaagatatttacttcttgctcacatttt

SEQ ID NO: 199265 - DNA, 601 bp, Human
gctatggtcgtacctctgcacttcagcctcggcgacacaaaacctgtctcaaaaaaaaaaaaaaaagagccaggcccggtggctcacacctgtaatcccagcaatttgggaggccaaggagggcagatcacctgaggtcaggggttcaagaccaacctggccaacatggcaaaaccccatctctactaaaaatacaaaaattagccgggtgtggtggtgggcgcccatggtcccagctgctcgggaggctgaggcaggagaattgcttgaacccagaggcagaagttgcagtgagccaagrgtgagccaccgagactccatctcaaaaacagaaaaaaaaagatatttacttcttgctcacattttatgtccagtgtgggtgttgtgaggtgctctgatggaagctgtccccagcatgctgtcccagatgccacgagggagccggaacctgcggaatcatgccctgggtcttaacatttctgcccacattttattggcaggtgcaatggcaaggccacgcctaatgcaaagggcgagagttcggggtgtgcggttcctccaggtgtccaggaagggcactgctctccctcccctccgccca

SEQ ID NO: 199266 - DNA, 601 bp, Human
ggtgcgaccgacataagacggggtcgacctctttaggttgcataaaaatagcatcagatggggctgagcagctagcctcgctctgcatttccgggacttaggtggggactgtcgtagggctggcccctacggttctctggggtggccaggcagtgaccagcgggcttcctgggcggggtcacagctggggcgggtctattgctagcacttagcgaggtgggggcggagctgagggtctctccgcagccttctatggatctagggtgggatggggaagaggctcttcaaagcccaaaagctkccagccacacgtgtccaccccgcggcgaatcagagggagcgggagctgtatggcaagactggccaagcccttcggtctgtaaaacctcctgtgtccgccagatccgatggcttcctcagatgaaacacctttgtccagctatcagcttagtccctggctgcccccacccccatctccttttttgtcctgtccagctgcactgctggcactgtgtacactccgcagacacacgtgtctttcctgcctcccaggacttgagtgtcctgtcccatttgcctgcacctcgcatgccactgtccc

SEQ ID NO: 199267 - DNA, 601 bp, Human
acagctgagaaccagcctgtccgttctgcctccctgcagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactgtgtaaaaaaaaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctga

SEQ ID NO: 199268 - DNA, 601 bp, Human; identical to SEQ ID NO: 40065

SEQ ID NO: 199269 - DNA, 601 bp, Human; identical to SEQ ID NO: 40066

SEQ ID NO: 199270 - DNA, 601 bp, Human; identical to SEQ ID NO: 40067

SEQ ID NO: 199271 - DNA, 601 bp, Human; identical to SEQ ID NO: 40068

SEQ ID NO: 199272 - DNA, 601 bp, Human; identical to SEQ ID NO: 40069

SEQ ID NO: 199273 - DNA, 601 bp, Human; identical to SEQ ID NO: 40070

SEQ ID NO: 199274 - DNA, 601 bp, Human; identical to SEQ ID NO: 40071

SEQ ID NO: 199275 - DNA, 601 bp, Human; identical to SEQ ID NO: 40072

SEQ ID NO: 199276 - DNA, 601 bp, Human; identical to SEQ ID NO: 40073

SEQ ID NO: 199277 - DNA, 601 bp, Human; identical to SEQ ID NO: 40074

SEQ ID NO: 199278 - DNA, 601 bp, Human; identical to SEQ ID NO: 40075

SEQ ID NO: 199279 - DNA, 601 bp, Human; identical to SEQ ID NO: 40076

SEQ ID NO: 199280 - DNA, 601 bp, Human; identical to SEQ ID NO: 40077

SEQ ID NO: 199281 - DNA, 601 bp, Human; identical to SEQ ID NO: 40078

SEQ ID NO: 199282 - DNA, 601 bp, Human; identical to SEQ ID NO: 40079

SEQ ID NO: 199283 - DNA, 601 bp, Human; identical to SEQ ID NO: 40080

SEQ ID NO: 199284 - DNA, 601 bp, Human; identical to SEQ ID NO: 40081

SEQ ID NO: 199285 - DNA, 601 bp, Human; identical to SEQ ID NO: 40082

SEQ ID NO: 199286 - DNA, 601 bp, Human; identical to SEQ ID NO: 40083

SEQ ID NO: 199287 - DNA, 601 bp, Human; identical to SEQ ID NO: 40084

SEQ ID NO: 199288 - DNA, 601 bp, Human; identical to SEQ ID NO: 40085

SEQ ID NO: 199289 - DNA, 601 bp, Human; identical to SEQ ID NO: 40086

SEQ ID NO: 199290 - DNA, 601 bp, Human; identical to SEQ ID NO: 40087

SEQ ID NO: 199291 - DNA, 601 bp, Human; identical to SEQ ID NO: 40088

SEQ ID NO: 199292 - DNA, 601 bp, Human; identical to SEQ ID NO: 40089

SEQ ID NO: 199293 - DNA, 601 bp, Human; identical to SEQ ID NO: 40090

SEQ ID NO: 199294 - DNA, 601 bp, Human; identical to SEQ ID NO: 40091

SEQ ID NO: 199295 - DNA, 601 bp, Human; identical to SEQ ID NO: 40092

SEQ ID NO: 199296 - DNA, 601 bp, Human; identical to SEQ ID NO: 40093

SEQ ID NO: 199297 - DNA, 601 bp, Human; identical to SEQ ID NO: 40094

SEQ ID NO: 199298 - DNA, 601 bp, Human; identical to SEQ ID NO: 40095

SEQ ID NO: 199299 - DNA, 601 bp, Human; identical to SEQ ID NO: 40096

SEQ ID NO: 199300 - DNA, 601 bp, Human; identical to SEQ ID NO: 40097

SEQ ID NO: 199301 - DNA, 601 bp, Human; identical to SEQ ID NO: 40098

SEQ ID NO: 199302 - DNA, 601 bp, Human; identical to SEQ ID NO: 40099

SEQ ID NO: 199303 - DNA, 601 bp, Human; identical to SEQ ID NO: 40100

SEQ ID NO: 199304 - DNA, 601 bp, Human; identical to SEQ ID NO: 40101

SEQ ID NO: 199305 - DNA, 601 bp, Human
agtctcgcagctccccgcagaccccgctcgtggcggccacggtgtccggggcctgagtaaggcgagctccagctgcggccttttcttcaggcctgggtctactcccggggccctgactcctcctgcgaaatcacctccttctagagccttttctctttctatttattgccccggaaggcctaggataagtgacagtggaggaaggaacggtgccttgggtggggtaggctgtttgtcttctctaaattctggttgctattccgggcattcctactgtcaggagccaggtggggggatcagyctacctgtgccggtgacctggggcttccacccacaaaccactttctgggccagaagctgccatacgaagactctttttcccattccgacctcccgggggaatgcctgggcacgtagagggtctggggtcattggcttaattgaggtgaacgatttatatcagattacatccctgtgcctggttccatcctggcgacaggtgagctggagactggaatttatgtacttgagggcaggggtttccatgtccactcttgtcttccctacagtttgtcatttttgctcctgccttctccaacct

SEQ ID NO: 199306 - DNA, 601 bp, Human
accttggccgaggtccctggggaagtgacccattacactgaacgttctagtctaagtggctttcatagttccctgtacttgagcgctgtcgtggttgcagtgtgcttatttgtgtggttatttaactctttcctccgccagactgcttcgtgaaggcagggtcctcgtgtccactactgtatccccattactcagtgcctggcacgtggcatccacttcttacggctttgtggagtgagtcacacatgccacacacacatacactctaaagaggaacaagagttcagtgggcctccttcaytcaagtgccatggctgcttcagcccagccccatgtccctgctagagaaatctggggctggaggtaaaggagcagagagcacagtacccccttgattagcctggaagttgggcttctggcaccttgacctctaatcctttcataattgccaacaggtctctcggccagaacacgtggatgcccacccaccactgagcctcatggtaggaagcttgactgcctccttcccctcgcatgtcctgtgaaggcccacctcctgctctgcccactggccctgggcccagaccctaccttggccctt

SEQ ID NO: 199307 - DNA, 601 bp, Human
ctaatcctttcataattgccaacaggtctctcggccagaacacgtggatgcccacccaccactgagcctcatggtaggaagcttgactgcctccttcccctcgcatgtcctgtgaaggcccacctcctgctctgcccactggccctgggcccagaccctaccttggcccttgctgggcttaggaaggcccccttgcccccaaccccaaggtagtgagcaaacccctgcccaaaccagggcctaattgaggctcttgaggggggagggttgtatgaccaccatggactgggttccttcctcytccccgagactgcccctccccagaatattagaggcagaggagtcctggtgagcgtctcgcccaaccccatggggcagctgcctgagacatgtcatgaggcagcgccagaagggggctggcacccagggattcctggggtgctggtgtgtgtcctttcaggaggtggtaacatttggcgatgtggctgtgcacttctctcgggaggagtggcagtgtctggaccctggccagagggccctctacagggaagtgatgctggagaaccacagcagtgtggctggactaggtgaggctgcacct

SEQ ID NO: 199308 - DNA, 601 bp, Human
gggcatttgcccatattctaggtccgctgtgtcttattgctttgaaggtgttgtttcttcattctgtctaagatgccttactttgtaaaacatgtagttatgtacacatcattattttaagaaagttggaatgctactgattacacgcattttttaatcatttaattttactttatactttttaaagagccctcttagactcatttagatgtggtttaccctgtctcactgaaataggaaaagacacatgcagtgagggtcctttttttttttttttgagattttgagatggagtcttgcyctgtcacccatgccggagtgcaatggcgcgatcttggctcaccgccacctccgcctcctgggttcaagcgattctcctgcctcagcctcccgagtagctgggattacaggtgtgagccaccgtgcccagccggagtaagggtacttctaatgtttcttcacagcttttagtgaccccactctctggtttggttatctgtgtccatgctttccacgtgatggcaacctgtgggcctggccatctagaggtgctgcagcttttcgtaagtggtgttggggttttcttcatccagtgagcttg

SEQ ID NO: 199309 - DNA, 601 bp, Human
tacaaaaattagctgggtgtggtggctcacgcctgtaatcccagctactcagaaggctgagacaggagaatcgcttgaacctgggaggttgaggttgcagtgagctgagatcgtgccactgcacttcagtctgggcaataagcgagactttgtctcaaaaaaaaaaaaaaaaaagactatctccttttcctgttgacatgtggagccaccattttcatctatgaaatgggatgtttctgaaccctgttctcttccctgaatctctcttgtgggccagcttcctgcttttggtttgttttgktttttttttgtttgtttgttcatttgtgtttttggcttttttttgaaataaagtctcaccctgtcacctgggctggagtacagtggtgcgatctcggctcactgcaacctctgcctcccaggttcaagcaattcttgtgcctcagcctcctgagtagctgggattacagctactcaggcatgtgccaccacacccggccaattttttgtatttttactagagatggggtttcgccatgttggccaggctggtctggaactcctgacctcaggttatccacccaccttggtctcccaaagt

SEQ ID NO: 199310 - DNA, 601 bp, Human
tttgttcatttgtgtttttggcttttttttgaaataaagtctcaccctgtcacctgggctggagtacagtggtgcgatctcggctcactgcaacctctgcctcccaggttcaagcaattcttgtgcctcagcctcctgagtagctgggattacagctactcaggcatgtgccaccacacccggccaattttttgtatttttactagagatggggtttcgccatgttggccaggctggtctggaactcctgacctcaggttatccacccaccttggtctcccaaagtgctgggattacaggygtgagccaccgtacctggccagtttggctttgttttttattttggggtggtttttgttttttgctttaattttgtagtgtttcttaatactacaagaatactaaaagaattaaactcacccgtttaattcttttttttctgggacggagtttcgctcttgttgcccaggctcgagtgcaatggcgcgatctcagttcactgcaacctccggctgttgggttcaagtgattcgccgcctcagcctcctgagtagctgggattacaggcatgtgccactacacccggctaatttttatattt

SEQ ID NO: 199311 - DNA, 601 bp, Human
tgtgcctcagcctcctgagtagctgggattacagctactcaggcatgtgccaccacacccggccaattttttgtatttttactagagatggggtttcgccatgttggccaggctggtctggaactcctgacctcaggttatccacccaccttggtctcccaaagtgctgggattacaggtgtgagccaccgtacctggccagtttggctttgttttttattttggggtggtttttgttttttgctttaattttgtagtgtttcttaatactacaagaatactaaaagaattaaactcaccygtttaattcttttttttctgggacggagtttcgctcttgttgcccaggctcgagtgcaatggcgcgatctcagttcactgcaacctccggctgttgggttcaagtgattcgccgcctcagcctcctgagtagctgggattacaggcatgtgccactacacccggctaatttttatattttaagtagagatgaggtttcaccatgttggccaggctggtctcgaactaacctcaggtgatccgtctgcctcgacctcccaaagtgctgggattacaggcttgagccaccatgcccggctgc

SEQ ID NO: 199312 - DNA, 601 bp, Human
ggctggtctggaactcctgacctcaggttatccacccaccttggtctcccaaagtgctgggattacaggtgtgagccaccgtacctggccagtttggctttgttttttattttggggtggtttttgttttttgctttaattttgtagtgtttcttaatactacaagaatactaaaagaattaaactcacccgtttaattcttttttttctgggacggagtttcgctcttgttgcccaggctcgagtgcaatggcgcgatctcagttcactgcaacctccggctgttgggttcaagtgattygccgcctcagcctcctgagtagctgggattacaggcatgtgccactacacccggctaatttttatattttaagtagagatgaggtttcaccatgttggccaggctggtctcgaactaacctcaggtgatccgtctgcctcgacctcccaaagtgctgggattacaggcttgagccaccatgcccggctgcatactaattttagaataagttgagttcctaaaagccactggaatttttattgggagtgctttgaaactgttttctgtcaatgtaaaagttttgatttttttgctttgtga

SEQ ID NO: 199313 - DNA, 601 bp, Human
aggagttttttttgtttttaatcataaatactgaatttcaaattctttttctgcatcatttgagacacgtgatttattttctttattaatgcaggaaattacattgttatattttcttgtattcctggaataagccttacttaaatcacgatatttatatataaattttgatatgcctttggattcaactagccaatattgtatttttgtgtttctgttcataagtgaaatggatatatatatatatgtatatatatttccttttttttttttttttgagacggagtctcgctctgttgcscaggctggagtgcagtggcgtgatctcggctcactgcaagctccgcctcccaggttcacgccattctcctgcctcagcctcccgagtagctggcactacaggtgcctgccaccatgcttggctaaatttttttgtatttttagtagagatggggtttcactatgttagccaggatggtcttgatctcctgacctcgtgatccacctgccttgggctcccaaagtgctgggattacaggcatgagccaccacgactggcctatgtttctttttgtgtattgtccttatgtaattttgacat

SEQ ID NO: 199314 - DNA, 601 bp, Human
gaaattacattgttatattttcttgtattcctggaataagccttacttaaatcacgatatttatatataaattttgatatgcctttggattcaactagccaatattgtatttttgtgtttctgttcataagtgaaatggatatatatatatatgtatatatatttccttttttttttttttttgagacggagtctcgctctgttgcgcaggctggagtgcagtggcgtgatctcggctcactgcaagctccgcctcccaggttcacgccattctcctgcctcagcctcccgagtagctggsactacaggtgcctgccaccatgcttggctaaatttttttgtatttttagtagagatggggtttcactatgttagccaggatggtcttgatctcctgacctcgtgatccacctgccttgggctcccaaagtgctgggattacaggcatgagccaccacgactggcctatgtttctttttgtgtattgtccttatgtaattttgacatgtttgataaatggcatttggcatacaagtagaacttggtggagctaatctgtaaaaccatcgggaccttgagcttttggggaaggaaagtcttg

SEQ ID NO: 199315 - DNA, 601 bp, Human
agcatttatgcatttatattttctttttttttttttttaaagagttggggttttgctctgttgtccagcctagagtacagtggtgcgattatagctcactgcagccttgaactcctgggctcaagtgattcttccacttgagtttccctagtagctgggactataggtgtgcgccaccatgctcagctgttttttctttctttgtagagttggggtctgtcatgttgccgcaggctagtcttaaacttctggcctcaagcagtcctgccttggccttccaaaatgctgggattataggcakgagacaccttgcctggcatttcctttggttttaatctgttatatttgtaattgtgtctcttattctctgttttttggcagcatcttctcactaagtggaccttgattggttttgtcatgagtcatattcatgttttcaaataactggcttttggttttgccttttttggggggttgggttggaggatgtttttatttgtctttgttctctagctctctgaatcctgccccggatttattattttcttcctttttatttatgtgagtttgatgtgtgtggtgtttgtttgttttgcttttt

SEQ ID NO: 199316 - DNA, 601 bp, Human
ctcaagtgattcttccacttgagtttccctagtagctgggactataggtgtgcgccaccatgctcagctgttttttctttctttgtagagttggggtctgtcatgttgccgcaggctagtcttaaacttctggcctcaagcagtcctgccttggccttccaaaatgctgggattataggcaggagacaccttgcctggcatttcctttggttttaatctgttatatttgtaattgtgtctcttattctctgttttttggcagcatcttctcactaagtggaccttgattggttttgtcatsagtcatattcatgttttcaaataactggcttttggttttgccttttttggggggttgggttggaggatgtttttatttgtctttgttctctagctctctgaatcctgccccggatttattattttcttcctttttatttatgtgagtttgatgtgtgtggtgtttgtttgttttgcttttttaattttttgagacaaagtttcactctgtttcccagggtggagtgcagtggcttactgcagcctggactgcctgggttccagcgatcctcccaccgtgttggccaggctggtctcgaac

SEQ ID NO: 199317 - DNA, 601 bp, Human
cttattctctgttttttggcagcatcttctcactaagtggaccttgattggttttgtcatgagtcatattcatgttttcaaataactggcttttggttttgccttttttggggggttgggttggaggatgtttttatttgtctttgttctctagctctctgaatcctgccccggatttattattttcttcctttttatttatgtgagtttgatgtgtgtggtgtttgtttgttttgcttttttaattttttgagacaaagtttcactctgtttcccagggtggagtgcagtggcttactgmagcctggactgcctgggttccagcgatcctcccaccgtgttggccaggctggtctcgaactcctgaccttcaggtgatccacccgccttggcctcccaaagtgctggaattacaggtgtgagccaccacgcctggccattctcaacttcttgaacttactatttacctcatttgtgttttaaaatgatcatttctagtaaatgtatctaaaagtataaaatttttctgggtatagtggcatatgcctataatctcagttacttaggaggctgaggcaggaggattgtttgagcccaggag

SEQ ID NO: 199318 - DNA, 601 bp, Human
ctgcactccggcctgagtgctagagcaagaccgtatctctaaataaataacattttatctttacatactgcttgggctgcatcctataaattctgactcataataaatacagttgccacttagtcatttattatgtagtttccaagtagctaatggcatctaagcaccattttgtggtgagtttcacactgagttgcatttgcctgggcgcgtgttctgtggtatgttctttggcatgtctgtgactcagtttgtggcttgacccaaggctgtttctttgttccacatgtacttggagagratatgcattttctgttgaatgtggagtcctgcctgcatctgggggtttcagcttattggctataggcctttggaatctctgcctgcctctttccttccagttgggggaaccctgaaggaagcttctaaacagaggccttggctggcccatggatcaactgctcatctctgtactgaccggcacaaagagggtatgggggcaggtggccccaagaaggcagggtgccaggtgggcccccacaggtctctgccacccagtctgcagcgagggaggcaggccctgaggcatcctttgtgcagg

SEQ ID NO: 199319 - DNA, 601 bp, Human
ttttatctttacatactgcttgggctgcatcctataaattctgactcataataaatacagttgccacttagtcatttattatgtagtttccaagtagctaatggcatctaagcaccattttgtggtgagtttcacactgagttgcatttgcctgggcgcgtgttctgtggtatgttctttggcatgtctgtgactcagtttgtggcttgacccaaggctgtttctttgttccacatgtacttggagaggatatgcattttctgttgaatgtggagtcctgcctgcatctgggggtttcagyttattggctataggcctttggaatctctgcctgcctctttccttccagttgggggaaccctgaaggaagcttctaaacagaggccttggctggcccatggatcaactgctcatctctgtactgaccggcacaaagagggtatgggggcaggtggccccaagaaggcagggtgccaggtgggcccccacaggtctctgccacccagtctgcagcgagggaggcaggccctgaggcatcctttgtgcagggacttgaggctggaaggacactggctgaggactggaccttggagctttctga

SEQ ID NO: 199320 - DNA, 601 bp, Human
tgcccctttccatttggaaactggggaagacttagccctgtgctgcacacttcccgtcatgctgacactgttgtcttctctgccgcacacacagcaggattcctggttttcaagcctgagctgatctctcggctggagcagggagaagagccatgggtcctcgacctgcagggagcagaggggacagaggcaccaaggacctccaagacaggtgaggcttagatcccatcgcagagaagccctggggtgaggagaaactgcaggaggggcctcacaactgtgggtagctgtgggtgagtcrcgggggctacactgggatgcctgggaatgctactggggaagcagcatccagcacctagaagggagcatagacccgttgtggggctgccttgggagaggccaaactgcagaagagccaagacacaaaaacccatgcatttccacaaaaacggagcttgtttttgaatcatgtcacattttgttctatttttaattttactcatactttcgttaagcaaagatacaaacctatggatccaagtgaagggttaggtttggcattcagtaacctctcctcgggtaagcatattccctgaggcag

SEQ ID NO: 199321 - DNA, 601 bp, Human
aatgctactggggaagcagcatccagcacctagaagggagcatagacccgttgtggggctgccttgggagaggccaaactgcagaagagccaagacacaaaaacccatgcatttccacaaaaacggagcttgtttttgaatcatgtcacattttgttctatttttaattttactcatactttcgttaagcaaagatacaaacctatggatccaagtgaagggttaggtttggcattcagtaacctctcctcgggtaagcatattccctgaggcagctcccttcagaccctctcaggctccrggagtgcattactttcctgtggctgccataacaatgaaccacagactaggaagcttaaaacaacagaaatttattgtctcacagctgtggaggccggaaatctgaaaccggggggtcagcaagcagggccgtgcccccctgtgaaggctttagggaaggatcctgtcctgcctctccgggcagctggtggttttctggcagtccttgggttccttggcttgtggatgcgtccctcactctgatctccgactccttcacacggctgccttctccctgcgtgtctgtgttcatgtggccatc

SEQ ID NO: 199322 - DNA, 601 bp, Human
tttaaagagggtgccatggcagaaaagccagctacagttggcagaaatagttcagtgggtttatatgtagcaggtggtcctcactgtgataaagcaacaacaaaaaaatagaatcccacagtaggtgagagctgctgttgatggacccagcacttgctcgcagacctgagagtccggggcagggatgtagcctcttagataaaacatgcagcagcacaaaaccagaatacatgaagcaaggcagaaatgcccagatatgttacttgtccccagctggtacagtcagcatcagatactgaargatattggcccagagcagtggaggagcggccaggtcccagctgtgcacccccacgcttttgaccaccaccgtgccccctgctgggtggttcctggcatcccccaacaaagccttgctgtcagcttggccctgctctctctgccgctgctctttatttttttattttttgagatggagtctttgttgcccaggctggagtgcagtggcatgatcttggctcactgcaacctctgcctgccaggttcaagtgattcttgtgcctcagcctcccaagtagctgggattacaggcgtgagccac

SEQ ID NO: 199323 - DNA, 601 bp, Human
cagtcagcatcagatactgaaggatattggcccagagcagtggaggagcggccaggtcccagctgtgcacccccacgcttttgaccaccaccgtgccccctgctgggtggttcctggcatcccccaacaaagccttgctgtcagcttggccctgctctctctgccgctgctctttatttttttattttttgagatggagtctttgttgcccaggctggagtgcagtggcatgatcttggctcactgcaacctctgcctgccaggttcaagtgattcttgtgcctcagcctcccaagtagcygggattacaggcgtgagccactgcacctggccaccctgctctcttatcttcacagcaggggaaggcttgggaggagtgtcaagcaagccctgttgaaagagcaggcatgctgaggtggtgtggttgtgcagggaaagcagcacatgaggaccaggcctggagatgcctcctgtcctcacaggccttgagcatccctgctacacaatgaggttgaaagggcttcctgctctgattctccaggactgataggaagacctttggagatccctggaagccggagactcaccaccaatggttagg

SEQ ID NO: 199324 - DNA, 601 bp, Human
agtgggcaggaaccgaagcttgaagccctgtaactgggctgtgcattcatgtggggtagactcgggctggttatagctgtggctgcgtggttgtggttgtgaacgtgattgtgtcgtggtggggaccgtggttgtcatgatcatagccgtgtgttgtggttgcatcctgtcatggtttgatcacagacatcaaggagatgtctgacctcagcagaggtgccctctagggttacagagtaggacagaagcctgtgcttacttggagagtccagaaggaacgcagatgtctggaaggcctccygggggcctccagaaacttgcagccccagggaagaagtcagtgtggtcttagaggtggccacgcacagcccagggagaagcaggggaggtggccaggtgcaagttggcagcagcagccaggaggcagctgagggggctgggtcctgctcagagaagcccaccccagggagtagccatgaacggcctaggtgcccagtgctcttctgagctcacgtagtaagtcccttggcagctcttccagccttgtttcctcatcacaatccatgctctccattcagaactcagaccctgtactgtttcc

SEQ ID NO: 199325 - DNA, 601 bp, Human
gagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctacagccttaacttacttattttatatggaatcgtttatactgacaaacatgtagaatgttggtaaaggttcagaattgctctcaagaatatccaacttcaggccgagtgtggtggctyatgcctgtcatcccagcactttgggaggccaaggcgggcacatcacgaggtcaggaggttgagaccatcctgggtaacaggtgaaaccccatctctactaaaaatacaaaaatttagctgggcgtggtggcaggcacctgtggtcccagctgctcgggaggctgaggcaggagaatggcatcagcccaggaggcggagcttgcagtgagctgagatcgcgccactgcactccagcctgggtgacagagtgagactccctctcaaaaaaaaaaaaaaaaaaaaaatccaacttcatacaaa

SEQ ID NO: 199326 - DNA, 601 bp, Human
catataaatgtgtatatatgtgaataaacctacagccttaacttacttattttatatggaatcgtttatactgacaaacatgtagaatgttggtaaaggttcagaattgctctcaagaatatccaacttcaggccgagtgtggtggctcatgcctgtcatcccagcactttgggaggccaaggcgggcacatcacgaggtcaggaggttgagaccatcctgggtaacaggtgaaaccccatctctactaaaaatacaaaaatttagctgggcgtggtggcaggcacctgtggtcccagctrctcgggaggctgaggcaggagaatggcatcagcccaggaggcggagcttgcagtgagctgagatcgcgccactgcactccagcctgggtgacagagtgagactccctctcaaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgctagactga

SEQ ID NO: 199327 - DNA, 601 bp, Human
ataaatgtgtatatatgtgaataaacctacagccttaacttacttattttatatggaatcgtttatactgacaaacatgtagaatgttggtaaaggttcagaattgctctcaagaatatccaacttcaggccgagtgtggtggctcatgcctgtcatcccagcactttgggaggccaaggcgggcacatcacgaggtcaggaggttgagaccatcctgggtaacaggtgaaaccccatctctactaaaaatacaaaaatttagctgggcgtggtggcaggcacctgtggtcccagctgctygggaggctgaggcaggagaatggcatcagcccaggaggcggagcttgcagtgagctgagatcgcgccactgcactccagcctgggtgacagagtgagactccctctcaaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgctagactgagta

SEQ ID NO: 199328 - DNA, 601 bp, Human
ttttatatggaatcgtttatactgacaaacatgtagaatgttggtaaaggttcagaattgctctcaagaatatccaacttcaggccgagtgtggtggctcatgcctgtcatcccagcactttgggaggccaaggcgggcacatcacgaggtcaggaggttgagaccatcctgggtaacaggtgaaaccccatctctactaaaaatacaaaaatttagctgggcgtggtggcaggcacctgtggtcccagctgctcgggaggctgaggcaggagaatggcatcagcccaggaggcggagctygcagtgagctgagatcgcgccactgcactccagcctgggtgacagagtgagactccctctcaaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgctagactgagtaggttaaaataatttacctaaactcttttcccttaagtatcagtggc

SEQ ID NO: 199329 - DNA, 601 bp, Human
gccgagtgtggtggctcatgcctgtcatcccagcactttgggaggccaaggcgggcacatcacgaggtcaggaggttgagaccatcctgggtaacaggtgaaaccccatctctactaaaaatacaaaaatttagctgggcgtggtggcaggcacctgtggtcccagctgctcgggaggctgaggcaggagaatggcatcagcccaggaggcggagcttgcagtgagctgagatcgcgccactgcactccagcctgggtgacagagtgagactccctctcaaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgctagactgagtaggttaaaataatttacctaaactcttttcccttaagtatcagtggctcacactggcttcaacaatacggaaatgcattagctcatgttggaggaggtccaggagtgcctagaattccaacttcaaatta

SEQ ID NO: 199330 - DNA, 601 bp, Human
ctgctcgggaggctgaggcaggagaatggcatcagcccaggaggcggagcttgcagtgagctgagatcgcgccactgcactccagcctgggtgacagagtgagactccctctcaaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgctagacygagtaggttaaaataatttacctaaactcttttcccttaagtatcagtggctcacactggcttcaacaatacggaaatgcattagctcatgttggaggaggtccaggagtgcctagaattccaacttcaaattaggtccttgtcttagaacttaacccagccacccaggaccagagggcccagccctatccccttcctcagagaggcaggctgggctagcaggtacacgccatcattactggtgtggttggcatttatggagcacataccagtgccaggcacagaagcaaggtgtcacag

SEQ ID NO: 199331 - DNA, 601 bp, Human
ggtactgagaggaaacaatgtagagaaacatgccttactgggcctgtcagagaacgagcactcaagcaaatgcaagtaccaacccccccatccatgccagcatctccagcacacccgtgtgcgcacaggccctgaggctgatgactgtcttgtactggcctagttgccccacttttttttggtaggggggaacgcggtgaggaggaaataaagacagtggagaaaaagacgaaaatgggccgggcgtggtggctcacgcctgtaatcccagcactttgggaggtcgaggtgggtggatcaygaggtcaggagatgaagaccatcctggctaacacagtgaaaccccgtgtctactaaaaatacaaaaaattagccgggcgtggtggcgggcacctgtagtctcagctacttgggaggctaggcaggaaaatggtgtgaacctgggaggcagagcttgcagtgagccaagatcacgccactgcactccagcctgggtgacaagagtgtgactctgtatcaaaaaaaaaaaaaaaaaaaaaaaaaacgaaaatgggatggaaagaaggtggttgggaaacaaatatggggagaagaacctgag

SEQ ID NO: 199332 - DNA, 601 bp, Human
acaatgtagagaaacatgccttactgggcctgtcagagaacgagcactcaagcaaatgcaagtaccaacccccccatccatgccagcatctccagcacacccgtgtgcgcacaggccctgaggctgatgactgtcttgtactggcctagttgccccacttttttttggtaggggggaacgcggtgaggaggaaataaagacagtggagaaaaagacgaaaatgggccgggcgtggtggctcacgcctgtaatcccagcactttgggaggtcgaggtgggtggatcatgaggtcaggagatsaagaccatcctggctaacacagtgaaaccccgtgtctactaaaaatacaaaaaattagccgggcgtggtggcgggcacctgtagtctcagctacttgggaggctaggcaggaaaatggtgtgaacctgggaggcagagcttgcagtgagccaagatcacgccactgcactccagcctgggtgacaagagtgtgactctgtatcaaaaaaaaaaaaaaaaaaaaaaaaaacgaaaatgggatggaaagaaggtggttgggaaacaaatatggggagaagaacctgagaaggggtgatgaga

SEQ ID NO: 199333 - DNA, 601 bp, Human
caatgtagagaaacatgccttactgggcctgtcagagaacgagcactcaagcaaatgcaagtaccaacccccccatccatgccagcatctccagcacacccgtgtgcgcacaggccctgaggctgatgactgtcttgtactggcctagttgccccacttttttttggtaggggggaacgcggtgaggaggaaataaagacagtggagaaaaagacgaaaatgggccgggcgtggtggctcacgcctgtaatcccagcactttgggaggtcgaggtgggtggatcatgaggtcaggagatgragaccatcctggctaacacagtgaaaccccgtgtctactaaaaatacaaaaaattagccgggcgtggtggcgggcacctgtagtctcagctacttgggaggctaggcaggaaaatggtgtgaacctgggaggcagagcttgcagtgagccaagatcacgccactgcactccagcctgggtgacaagagtgtgactctgtatcaaaaaaaaaaaaaaaaaaaaaaaaaacgaaaatgggatggaaagaaggtggttgggaaacaaatatggggagaagaacctgagaaggggtgatgagag

SEQ ID NO: 199334 - DNA, 601 bp, Human
tactgggcctgtcagagaacgagcactcaagcaaatgcaagtaccaacccccccatccatgccagcatctccagcacacccgtgtgcgcacaggccctgaggctgatgactgtcttgtactggcctagttgccccacttttttttggtaggggggaacgcggtgaggaggaaataaagacagtggagaaaaagacgaaaatgggccgggcgtggtggctcacgcctgtaatcccagcactttgggaggtcgaggtgggtggatcatgaggtcaggagatgaagaccatcctggctaacacrgtgaaaccccgtgtctactaaaaatacaaaaaattagccgggcgtggtggcgggcacctgtagtctcagctacttgggaggctaggcaggaaaatggtgtgaacctgggaggcagagcttgcagtgagccaagatcacgccactgcactccagcctgggtgacaagagtgtgactctgtatcaaaaaaaaaaaaaaaaaaaaaaaaaacgaaaatgggatggaaagaaggtggttgggaaacaaatatggggagaagaacctgagaaggggtgatgagagggagtggggaaagaagatac

SEQ ID NO: 199335 - DNA, 601 bp, Human
agctggggggccattacctcacccctcagttttttttttgctgctgacacaaccttgagaagtggcccaggtggagcacggtggggttcttggcacatgcaggaacatggagggaggcgtggctgatggcaggtggcttgctcaaggcctgatgcttttttgctgaaattgaattttcacgtgaatctgctgctcaaccctaatctaacaggctgggaccttgtccatttgattttctcacacagcatctaattaaggctgatattcacaggcatgaggccaactgtaagacctcaaccctgtctccacagtccttgtcattcagggggaacctggaactcctgactggtgacctcccacctgcctcttcaggggctcctcccggtgtacaagggtgatggtgctctccacagccatggagtcagtgcatccactgtaactgcctcttctccagccatgccctactcacaccggaacttctgtgcacgtggagtatgtgtgcagtgtccctgccttgggtcacgtggctgctgagaagggtcttggcaggtaatgtgcttagccaggtggtcaccttcaggtctagcacaggggttgctgt

SEQ ID NO: 199336 - DNA, 601 bp, Human
accttgtccatttgattttctcacacagcatctaattaaggctgatattcacaggcatgaggccaactgtaagacctcaaccctgtctccacagtccttgtcattcagggggaacctggaactcctgactggtgacctcccacctgcctcttcaggggctcctcccggtgtacaagggtgatggtgctctccacagccatggagtcagtgcatccactgtaactgcctcttctccagccatgccctactcacaccggaacttctgtgcacgtggagtatgtgtgcagtgtccctgccttgsgtcacgtggctgctgagaagggtcttggcaggtaatgtgcttagccaggtggtcaccttcaggtctagcacaggggttgctgttgctttttctctacttcaggctttctgggccgcccaaccatgggacaagagccaaggcacccacatgcaccgcctgcaactcctgttcctggccttccaaaacactgctcacaaagactgaccctgcctcctcctgggctctcgtcatctcctcttggccacttcctggttcatgatcaggacagaaggaggggaacgtcagccatatggatggtct

SEQ ID NO: 199337 - DNA, 601 bp, Human
gcaaccagccaaaaaggggctggggtgcaagcttcattctgcttcagcacctggattctctctggattgacatggtcctaagtcaggggctggcaaaccattcgtagctttttacatttctgaatggttggggagaaaataagagacttgtgacatttgaaaactatgttaaaatcgaatttgactgtgcacagtgtccctgggcttggtgatgcccaagcgtcttcatggagcctctggcggctttcttgctgcagcagtgtttaccacaccagccaagtcaccttgaacttggaaaatracttcatgccctccagccactgaaggattatttttcctctcagcccttagtggtttctttacctaaatgtcacggtacaactgagaataaggcagctgggtcagttcaatagaagtaaacctaaagtccaacaatccaggttagatattagccacggagggatgggaggaggagtcttctttttttttgagacggaatctcgctctgtccctcaggctgaagtgcagtggtgcggtctcggctcactgcaagctccgccacctgggttcacgccattctcctgcctcagcctcccgagta

SEQ ID NO: 199338 - DNA, 601 bp, Human
cagccaagtcaccttgaacttggaaaatgacttcatgccctccagccactgaaggattatttttcctctcagcccttagtggtttctttacctaaatgtcacggtacaactgagaataaggcagctgggtcagttcaatagaagtaaacctaaagtccaacaatccaggttagatattagccacggagggatgggaggaggagtcttctttttttttgagacggaatctcgctctgtccctcaggctgaagtgcagtggtgcggtctcggctcactgcaagctccgccacctgggttcacrccattctcctgcctcagcctcccgagtagctgggactacaggtgcctgctaccacgcccggctaatttttttgtatttttaatagagacggggtttcactgtgttagccagctggtctcgatcttctgacctcgtgatccgcccgcctcggcctccctaagtgctgggatgacaggcgtgagccaccatgccgagctgaggaggagtcctcttctagctgcacgatgtggaaatgacacatcatgtccatggggcagcttgctgagagccaagggtgtgagcacatgacttaaattcaag

SEQ ID NO: 199339 - DNA, 601 bp, Human
taaacctaaagtccaacaatccaggttagatattagccacggagggatgggaggaggagtcttctttttttttgagacggaatctcgctctgtccctcaggctgaagtgcagtggtgcggtctcggctcactgcaagctccgccacctgggttcacgccattctcctgcctcagcctcccgagtagctgggactacaggtgcctgctaccacgcccggctaatttttttgtatttttaatagagacggggtttcactgtgttagccagctggtctcgatcttctgacctcgtgatccgccygcctcggcctccctaagtgctgggatgacaggcgtgagccaccatgccgagctgaggaggagtcctcttctagctgcacgatgtggaaatgacacatcatgtccatggggcagcttgctgagagccaagggtgtgagcacatgacttaaattcaagctactgcacagctttgagatctgagtatcacatggaagcatccaggtggcccctggcacacaggctggtggttcttttgtggagagggagaggaagaggggctgctcatggggtagtgcaggtgctagaatatcctgttaacct

SEQ ID NO: 199340 - DNA, 601 bp, Human
ggaggaggagtcttctttttttttgagacggaatctcgctctgtccctcaggctgaagtgcagtggtgcggtctcggctcactgcaagctccgccacctgggttcacgccattctcctgcctcagcctcccgagtagctgggactacaggtgcctgctaccacgcccggctaatttttttgtatttttaatagagacggggtttcactgtgttagccagctggtctcgatcttctgacctcgtgatccgcccgcctcggcctccctaagtgctgggatgacaggcgtgagccaccatgccsagctgaggaggagtcctcttctagctgcacgatgtggaaatgacacatcatgtccatggggcagcttgctgagagccaagggtgtgagcacatgacttaaattcaagctactgcacagctttgagatctgagtatcacatggaagcatccaggtggcccctggcacacaggctggtggttcttttgtggagagggagaggaagaggggctgctcatggggtagtgcaggtgctagaatatcctgttaacctgttcacactgcactgcaattcgggcttcggtaagctcatctaaagagtt

SEQ ID NO: 199341 - DNA, 601 bp, Human
gtttcactgtgttagccagctggtctcgatcttctgacctcgtgatccgcccgcctcggcctccctaagtgctgggatgacaggcgtgagccaccatgccgagctgaggaggagtcctcttctagctgcacgatgtggaaatgacacatcatgtccatggggcagcttgctgagagccaagggtgtgagcacatgacttaaattcaagctactgcacagctttgagatctgagtatcacatggaagcatccaggtggcccctggcacacaggctggtggttcttttgtggagagggagaggaagaggggctgctcatggggtagtgcaggtgctagaatatcctgttaacctgttcacactgcactgcaattcgggcttcggtaagctcatctaaagagtttccaggccaggcacggtggctcacgcctgtaattccagcactttgagaggccaaggaaggatcacgtgaccccaggagttcggagaccacagtgagctgtgatcgcaccactgcactctagcctgggtgacagagtgaggccctgtctccacaatatataaataaaaacattttgggtttctgttttggagacaataaat

SEQ ID NO: 199342 - DNA, 601 bp, Human
gtgtgagcacatgacttaaattcaagctactgcacagctttgagatctgagtatcacatggaagcatccaggtggcccctggcacacaggctggtggttcttttgtggagagggagaggaagaggggctgctcatggggtagtgcaggtgctagaatatcctgttaacctgttcacactgcactgcaattcgggcttcggtaagctcatctaaagagtttccaggccaggcacggtggctcacgcctgtaattccagcactttgagaggccaaggaaggatcacgtgaccccaggagttcrgagaccacagtgagctgtgatcgcaccactgcactctagcctgggtgacagagtgaggccctgtctccacaatatataaataaaaacattttgggtttctgttttggagacaataaattaaatctataacctaggcctggaattgctttttatctcaactatcagaataatctttcatttatgacactgaattgaaactatctggacctttctggaagcttcacaaagtgaagcagagcaagggccgggtccaggccattttataaatcctcaagtccccagtgcatgcagcttgactca

SEQ ID NO: 199343 - DNA, 601 bp, Human
aaggaaggatcacgtgaccccaggagttcggagaccacagtgagctgtgatcgcaccactgcactctagcctgggtgacagagtgaggccctgtctccacaatatataaataaaaacattttgggtttctgttttggagacaataaattaaatctataacctaggcctggaattgctttttatctcaactatcagaataatctttcatttatgacactgaattgaaactatctggacctttctggaagcttcacaaagtgaagcagagcaagggccgggtccaggccattttataaatccycaagtccccagtgcatgcagcttgactcagagccccagaaatgtttgctgaatgagtgagtgatgcaggtggggaggcatccaggctttgagctcaggacagtgccacaggagagggaaatcaccagcaagtttccacagagaactaaggccaagaaaaccaagggagtaatttcccagatgcagacatccgttctctgtgcaaggccttgtgcaagccacggggacaaagatggacagggctggcctctgccctggagtccaggtctaatggagactggccactgacaaggatggacag

SEQ ID NO: 199344 - DNA, 601 bp, Human
aggaaggatcacgtgaccccaggagttcggagaccacagtgagctgtgatcgcaccactgcactctagcctgggtgacagagtgaggccctgtctccacaatatataaataaaaacattttgggtttctgttttggagacaataaattaaatctataacctaggcctggaattgctttttatctcaactatcagaataatctttcatttatgacactgaattgaaactatctggacctttctggaagcttcacaaagtgaagcagagcaagggccgggtccaggccattttataaatcctsaagtccccagtgcatgcagcttgactcagagccccagaaatgtttgctgaatgagtgagtgatgcaggtggggaggcatccaggctttgagctcaggacagtgccacaggagagggaaatcaccagcaagtttccacagagaactaaggccaagaaaaccaagggagtaatttcccagatgcagacatccgttctctgtgcaaggccttgtgcaagccacggggacaaagatggacagggctggcctctgccctggagtccaggtctaatggagactggccactgacaaggatggacagg

SEQ ID NO: 199345 - DNA, 601 bp, Human
tgtttgctgaatgagtgagtgatgcaggtggggaggcatccaggctttgagctcaggacagtgccacaggagagggaaatcaccagcaagtttccacagagaactaaggccaagaaaaccaagggagtaatttcccagatgcagacatccgttctctgtgcaaggccttgtgcaagccacggggacaaagatggacagggctggcctctgccctggagtccaggtctaatggagactggccactgacaaggatggacaggtgctctgtactggaggggtccagtgggctcatggggttggygccaaccatgcctggactaagaatggtttttcaatggaaaaaaatactttgtgacacatgaaattaaaatttcatggctgggtgtggtggctcattgctgtaaaaccagcactttgggaggccgaggtgggcagatcaccagagcccaggaattcaagaccagcctgggcaacgtggcaaaaccccatctctacaaaaaatctgaaaattagccgggtgtggtgtggtgtgcctgtgagcccaggaggttgaggctacagtgagccatgatcgtgccattgcattccagactggatgatg

SEQ ID NO: 199346 - DNA, 601 bp, Human
gaaatcaccagcaagtttccacagagaactaaggccaagaaaaccaagggagtaatttcccagatgcagacatccgttctctgtgcaaggccttgtgcaagccacggggacaaagatggacagggctggcctctgccctggagtccaggtctaatggagactggccactgacaaggatggacaggtgctctgtactggaggggtccagtgggctcatggggttggcgccaaccatgcctggactaagaatggtttttcaatggaaaaaaatactttgtgacacatgaaattaaaatttcayggctgggtgtggtggctcattgctgtaaaaccagcactttgggaggccgaggtgggcagatcaccagagcccaggaattcaagaccagcctgggcaacgtggcaaaaccccatctctacaaaaaatctgaaaattagccgggtgtggtgtggtgtgcctgtgagcccaggaggttgaggctacagtgagccatgatcgtgccattgcattccagactggatgatggggagaccttgtctcaaaaaaaaaggaaaatttcaatatccattaaaaaaatatcattggaggccaggctcggtg

SEQ ID NO: 199347 - DNA, 601 bp, Human
tcatggcccacaaaatctaaaatgtttactctctggccctttgtgggaagagtttgctcactgctgagtcagaggaagtggcctctaagtctgctccacgctgtagggatctcaagtccaactggatcatgtctgccctgattaaaaccccactgctcccccttgccccagtggaatgaccaaaatcctgtgtgtggccttgaggccagccgctgtccctgcacttgatcccccatccctcaatcccctatactcgggcagtgccagccccagtcccaggaatggcccactcccctgcctrtgtctcataagctgtcttttcatggctgtgtcttgatttgcctgggtccccgcttgagacaagcccaagggttcacagatgaattgaggcaaacacagattcccaatgagagacggcgagaggtcagcctgaggaccgagggcaggtccatgctctgggctccacacaggctttgctaagcagctgggagaagcagaaggatggggctgtccctaaagctgctgttcctgcagggccagggccagtgagtgagaaaggcaacatggtcccagctgccccagccccatccacatctgggga

SEQ ID NO: 199348 - DNA, 601 bp, Human
aagctgagtgatcgaccagatggcaggacccacaagcatgcaccttagagggcacctgggctcctcccagagtctactgaccccacccccaggtactcctctgtaccctgacatgtcagaactgcccatggagggatgaggaagaaatccaggctagtggaggagacaacccaaaaactgcagacaagacaaacagccaagcaaccccaggcactcaaagacaaggggaggtttctcagcagagaacagactagacatggtccagaagtgctccacggaggcaggaacagtcagctggaasccagctgaccgaaaatggctctgcagagaccgagcaccaaggcccctcctggaacacagttatgctggaagctgcaaagctggctacaacccctgcacacacctgccctagaggcacccgggagaggtccctgccaccaactccaccctggtgacagcctctctgctgggctctagcctcctcccttgcacccctccacacagcagccaatcaccagatcacgtctctcctctgctgaaaaccctcagaagggctcctctgtcactcagaattgagccaaagtccttaaaaggctctcag

SEQ ID NO: 199349 - DNA, 601 bp, Human
aaactgcagacaagacaaacagccaagcaaccccaggcactcaaagacaaggggaggtttctcagcagagaacagactagacatggtccagaagtgctccacggaggcaggaacagtcagctggaagccagctgaccgaaaatggctctgcagagaccgagcaccaaggcccctcctggaacacagttatgctggaagctgcaaagctggctacaacccctgcacacacctgccctagaggcacccgggagaggtccctgccaccaactccaccctggtgacagcctctctgctgggctcyagcctcctcccttgcacccctccacacagcagccaatcaccagatcacgtctctcctctgctgaaaaccctcagaagggctcctctgtcactcagaattgagccaaagtccttaaaaggctctcaggccttgacctctgtaccctccccaacgtcgcctccccacaatgatctccacctgcttggctgcagccaggcgggccttaagcacgtcaggcctccccacactggccgcctgagccccgtcctccccaccttgtgctgctcccctcagagcgctgtgcccccggctccttcaagt

SEQ ID NO: 199350 - DNA, 601 bp, Human
tggaagccagctgaccgaaaatggctctgcagagaccgagcaccaaggcccctcctggaacacagttatgctggaagctgcaaagctggctacaacccctgcacacacctgccctagaggcacccgggagaggtccctgccaccaactccaccctggtgacagcctctctgctgggctctagcctcctcccttgcacccctccacacagcagccaatcaccagatcacgtctctcctctgctgaaaaccctcagaagggctcctctgtcactcagaattgagccaaagtccttaaaaggcyctcaggccttgacctctgtaccctccccaacgtcgcctccccacaatgatctccacctgcttggctgcagccaggcgggccttaagcacgtcaggcctccccacactggccgcctgagccccgtcctccccaccttgtgctgctcccctcagagcgctgtgcccccggctccttcaagtcctcgctcagatgtcacaccctcaaggaaggtcgccccatcagcacgcagaccccaccctacttgctgcatcacacgccatcctctgatgagctattccagttaatttttatgatttattt

SEQ ID NO: 199351 - DNA, 601 bp, Human
aggcacccgggagaggtccctgccaccaactccaccctggtgacagcctctctgctgggctctagcctcctcccttgcacccctccacacagcagccaatcaccagatcacgtctctcctctgctgaaaaccctcagaagggctcctctgtcactcagaattgagccaaagtccttaaaaggctctcaggccttgacctctgtaccctccccaacgtcgcctccccacaatgatctccacctgcttggctgcagccaggcgggccttaagcacgtcaggcctccccacactggccgcctgrgccccgtcctccccaccttgtgctgctcccctcagagcgctgtgcccccggctccttcaagtcctcgctcagatgtcacaccctcaaggaaggtcgccccatcagcacgcagaccccaccctacttgctgcatcacacgccatcctctgatgagctattccagttaatttttatgatttattttacaatgtttcccctcccctcagccgcactagaatgtcagctccatggggtcagggatttaaggcagaagagtgaaaatgcccaacctaaaacacaagatctacaaaagcacctggc

SEQ ID NO: 199352 - DNA, 601 bp, Human
cagcctctctgctgggctctagcctcctcccttgcacccctccacacagcagccaatcaccagatcacgtctctcctctgctgaaaaccctcagaagggctcctctgtcactcagaattgagccaaagtccttaaaaggctctcaggccttgacctctgtaccctccccaacgtcgcctccccacaatgatctccacctgcttggctgcagccaggcgggccttaagcacgtcaggcctccccacactggccgcctgagccccgtcctccccaccttgtgctgctcccctcagagcgctgygcccccggctccttcaagtcctcgctcagatgtcacaccctcaaggaaggtcgccccatcagcacgcagaccccaccctacttgctgcatcacacgccatcctctgatgagctattccagttaatttttatgatttattttacaatgtttcccctcccctcagccgcactagaatgtcagctccatggggtcagggatttaaggcagaagagtgaaaatgcccaacctaaaacacaagatctacaaaagcacctggctacatggggccaggctgagcaactgtatgttgtctacaaaggg

SEQ ID NO: 199353 - DNA, 601 bp, Human; identical to SEQ ID NO: 17978

SEQ ID NO: 199354 - DNA, 601 bp, Human; identical to SEQ ID NO: 17979

SEQ ID NO: 199355 - DNA, 601 bp, Human; identical to SEQ ID NO: 17980

SEQ ID NO: 199356 - DNA, 601 bp, Human; identical to SEQ ID NO: 17981

SEQ ID NO: 199357 - DNA, 601 bp, Human; identical to SEQ ID NO: 17982

SEQ ID NO: 199358 - DNA, 601 bp, Human; identical to SEQ ID NO: 17983

SEQ ID NO: 199359 - DNA, 601 bp, Human; identical to SEQ ID NO: 17984

SEQ ID NO: 199360 - DNA, 601 bp, Human; identical to SEQ ID NO: 17985

SEQ ID NO: 199361 - DNA, 601 bp, Human; identical to SEQ ID NO: 17986

SEQ ID NO: 199362 - DNA, 601 bp, Human; identical to SEQ ID NO: 17987

SEQ ID NO: 199363 - DNA, 601 bp, Human; identical to SEQ ID NO: 17988

SEQ ID NO: 199364 - DNA, 601 bp, Human; identical to SEQ ID NO: 17989

SEQ ID NO: 199365 - DNA, 601 bp, Human; identical to SEQ ID NO: 17990

SEQ ID NO: 199366 - DNA, 601 bp, Human; identical to SEQ ID NO: 17991

SEQ ID NO: 199367 - DNA, 601 bp, Human; identical to SEQ ID NO: 17992

SEQ ID NO: 199368 - DNA, 601 bp, Human; identical to SEQ ID NO: 17993

SEQ ID NO: 199369 - DNA, 601 bp, Human; identical to SEQ ID NO: 17994

SEQ ID NO: 199370 - DNA, 601 bp, Human; identical to SEQ ID NO: 17995

SEQ ID NO: 199371 - DNA, 601 bp, Human; identical to SEQ ID NO: 17996

SEQ ID NO: 199372 - DNA, 601 bp, Human; identical to SEQ ID NO: 31693

SEQ ID NO: 199373 - DNA, 601 bp, Human; identical to SEQ ID NO: 31694

SEQ ID NO: 199374 - DNA, 601 bp, Human; identical to SEQ ID NO: 31695

SEQ ID NO: 199375 - DNA, 601 bp, Human
cccgggttcaagtgattctcctgcctcagcctcctgagtagctgggattacaggcgcccaccaccatgcccagctaattattgtatttttagtagagacggggtttcatcatgttggccaggctggtctcgaactcctgacctcaggtgatccgcctgcctcggcctccctaagtgctaggattacaggcgtgagctaccgcgcccggccagaattgtgactttcttataagttctttcatcttcaaaagcacttaaaaaatttcagtttaacactgagggaaagtttatacatgtgatawgaacaattgaattctttaaataatataagttaaaatcatatttaagtctatttttctgatggtttttggtaataatgtggctagatgatttgctaaattccgtaattcatttgatataaagaaccaaagacaaaaaccaaaactcccaacccaacagggccccatagaaagacattcatgccctacccataacacagctccaccagcccccatctccagctggagcacctggcggcctccacctctgagcgggagccagaacaggtgtggtgtgagcctcacctgggcctgtctcaaaca

SEQ ID NO: 199376 - DNA, 601 bp, Human
ggtgatccgcctgcctcggcctccctaagtgctaggattacaggcgtgagctaccgcgcccggccagaattgtgactttcttataagttctttcatcttcaaaagcacttaaaaaatttcagtttaacactgagggaaagtttatacatgtgatatgaacaattgaattctttaaataatataagttaaaatcatatttaagtctatttttctgatggtttttggtaataatgtggctagatgatttgctaaattccgtaattcatttgatataaagaaccaaagacaaaaaccaaaactyccaacccaacagggccccatagaaagacattcatgccctacccataacacagctccaccagcccccatctccagctggagcacctggcggcctccacctctgagcgggagccagaacaggtgtggtgtgagcctcacctgggcctgtctcaaacacatcctctgaactcacaaaaccagagtcccccacagcaccaactcgaactttgtatgctgttcctggcattagaccctttaacccaaagaagctccgagaaccatttacaatttcttttctccattcttctttgcctatggaaat

SEQ ID NO: 199377 - DNA, 601 bp, Human
tataagctaaagacaagatgtaggatgcttaggtttaccattttagattattataaatgtagtcatgtcaaacaaatcaattaaaatgacctacaggaaaatatcctcaaagaaaaatagactgggtatctagcttgtttattaattgtatatattcccattgtattaattctcctctttaatacaaaggaaggttctttatctgcaccttgccttatgaaactgttgagtttctctaaagatgtttctcaaaagaactgatacacattaattagcttaagtgaactatgggaagaattgtttttttatgattcacaagatgaatcttttagtaaacttaaatgccttccaacgtatccaattaatcgattcaacctttcccaagtaccggtttttctaaagggatcgtcatttctaaaaacatttacttgcatgataaaggcttaaacagaaagttggactctgttcaacattttgtcacaaacatttattggccacctcatttgttctatgtaagcacactgcacttaggaggggggtactggcttttcataaactgctgaaagtgaaagctgccccatctcccagtagatgtggccag

SEQ ID NO: 199378 - DNA, 601 bp, Human
acttctttgagtatcactgggaaactcagggaccccaggtaagaaacccctgctttagagaatgatggatggtaagggtatgttggaagagaagctgcaaaaggaatttccagatgtgttctatcagaagttaagaaagaataaataaaaggagtaaaaactatttcatgtaacatttcctagagagcaagacaatcttacctgttaactgtttgttacaaagcattttctgaaaaatcatagtgcaacctaaatagcttcttaaaaatccaaattatggagaccagatgatgctacatgyttgctactgggtaaagacaacatctaaagtcattaaaaaatgttatttgaatacctgaggcaggcaattctatcagtcctacctcaatagcttaaactaaaaatgaaacatttacagatgtgttaatttgggtagttaaaaaagaagatcaatttattatctcacataaaatttactaggatagtcaatcagacagcatcaataggtttaccaagacactaaaattatattctaagatatgtttataaaatgtagacgctaaagacctttgttcaaataaatgtaataaaattacatttc

SEQ ID NO: 199379 - DNA, 601 bp, Human; identical to SEQ ID NO: 31696

SEQ ID NO: 199380 - DNA, 601 bp, Human; identical to SEQ ID NO: 31697

SEQ ID NO: 199381 - DNA, 601 bp, Human
gaaaacttttttattatatttcgtaccctagaagtcccgctttcccgctttacctgaggctttcgtcaaatactgctcagaggcctcgctgggcaagctcttcccaatgctgttcactgccatcacgcggaaggagtagttcacgtaaggagacagcttcagctgggctgtggtctgtgttccagaaacttcagtttggtggtgccacagccctggcttgtgcattgcatcttcatattcgatgatgaattctggtcacgacacacacacaccaaacccaagaccgtgaattcagtcaacycaggggtagctgccagcaataactaacagggcaacccaacacaagcaaccaaacatgaattattttactttcaagaaaaatgccattaaaatattttgatttcagagttgtcattatcctcaacatataaacacacatgataacattttagtggaaaaatggcatctcactgtatttaatttaatttctcctattacaaaaaaaatttgaccaccttttcatatatttaaactttttagggatatatggattaattctaaacagttttagattttaccaaatctggtattgctttctcta

SEQ ID NO: 199382 - DNA, 601 bp, Human
tgttcactgccatcacgcggaaggagtagttcacgtaaggagacagcttcagctgggctgtggtctgtgttccagaaacttcagtttggtggtgccacagccctggcttgtgcattgcatcttcatattcgatgatgaattctggtcacgacacacacacaccaaacccaagaccgtgaattcagtcaacccaggggtagctgccagcaataactaacagggcaacccaacacaagcaaccaaacatgaattattttactttcaagaaaaatgccattaaaatattttgatttcagagttrtcattatcctcaacatataaacacacatgataacattttagtggaaaaatggcatctcactgtatttaatttaatttctcctattacaaaaaaaatttgaccaccttttcatatatttaaactttttagggatatatggattaattctaaacagttttagattttaccaaatctggtattgctttctctagcatgctgaatttagttacttaaaactgtttagaattaatccatatatccctaaaaagtttaaatatatgaaaagatgatcaaatttttttcataataggataaattaaa

SEQ ID NO: 199383 - DNA, 601 bp, Human
cttctatataagacagtttagaaaatctgtcaatatttaaggcgcatactaaatttcacttctggcaatttattttgaataaatgggctcacacaaatggctcaaacacacatgagaaataatttacattgtagtattatttgcaattgaaacaacctaattgcaaacaacctaaacatccatcaacaggacactgactaaacaaattacactaggtccacacaatggaatactctgaagctgttaaaaatgactgtcagccaagtgcggtggctcacacctgtaatctcagcactttggragacccaggtggatggagtccaggagtctgagacaacctgggcaacctagcaaaaccccgtctctgcagaaaattaactgggtgtggtggcgtgcacctatagttccagctatgggggaggctgaggtaggaggatcacctgagcccagaaagtcaaggctgcagtgaaccatgatcaagccactgcactccagcctggacagagtgaaaccctgtctcaaaaaagagagagagagaggaaaaaaaaaaaaaaaaaagaatagggctgttccatacgtactgaaatggaatgatttctaa

SEQ ID NO: 199384 - DNA, 601 bp, Human
aatttattttgaataaatgggctcacacaaatggctcaaacacacatgagaaataatttacattgtagtattatttgcaattgaaacaacctaattgcaaacaacctaaacatccatcaacaggacactgactaaacaaattacactaggtccacacaatggaatactctgaagctgttaaaaatgactgtcagccaagtgcggtggctcacacctgtaatctcagcactttggaagacccaggtggatggagtccaggagtctgagacaacctgggcaacctagcaaaaccccgtctctrcagaaaattaactgggtgtggtggcgtgcacctatagttccagctatgggggaggctgaggtaggaggatcacctgagcccagaaagtcaaggctgcagtgaaccatgatcaagccactgcactccagcctggacagagtgaaaccctgtctcaaaaaagagagagagagaggaaaaaaaaaaaaaaaaaagaatagggctgttccatacgtactgaaatggaatgatttctaaagtgtattattaagtgaaaccaagcagccaagcagggtatagaatcgtgtgtgctggatactatgc

SEQ ID NO: 199385 - DNA, 601 bp, Human
attgtagtattatttgcaattgaaacaacctaattgcaaacaacctaaacatccatcaacaggacactgactaaacaaattacactaggtccacacaatggaatactctgaagctgttaaaaatgactgtcagccaagtgcggtggctcacacctgtaatctcagcactttggaagacccaggtggatggagtccaggagtctgagacaacctgggcaacctagcaaaaccccgtctctgcagaaaattaactgggtgtggtggcgtgcacctatagttccagctatgggggaggctgagstaggaggatcacctgagcccagaaagtcaaggctgcagtgaaccatgatcaagccactgcactccagcctggacagagtgaaaccctgtctcaaaaaagagagagagagaggaaaaaaaaaaaaaaaaaagaatagggctgttccatacgtactgaaatggaatgatttctaaagtgtattattaagtgaaaccaagcagccaagcagggtatagaatcgtgtgtgctggatactatgcttgtgtaaatgtaaaacgaaattactacaacaaataaacagacatattcacttgcatataa

SEQ ID NO: 199386 - DNA, 601 bp, Human
aggaaaaaaaaaaaaaaaaaagaatagggctgttccatacgtactgaaatggaatgatttctaaagtgtattattaagtgaaaccaagcagccaagcagggtatagaatcgtgtgtgctggatactatgcttgtgtaaatgtaaaacgaaattactacaacaaataaacagacatattcacttgcatataaatgcatattacctctcagagaatataaacctataacattggtgtggccagaggagctgggagacaggggcgggaggaagacatatttttcagtgcataccctctgcgtcyactaaaattctgtggtgtgtacacactttacccttgtaaaataataggtatttggatattcactgattgcctactatgtgccaggtaccatgatatgcactataaacacaaagatgaactaaaaatattatatgtgttgcagtggttcaaaactaagtccttggagttctcctttcaatccacattcatctttggatgatctccagtcctataaatggatgactttcatgtttacatctgtagcccagacctcttccctgaactgcagactcaggaagtccaactgtctgctcgacaatt

SEQ ID NO: 199387 - DNA, 601 bp, Human
aaatgtaaaacgaaattactacaacaaataaacagacatattcacttgcatataaatgcatattacctctcagagaatataaacctataacattggtgtggccagaggagctgggagacaggggcgggaggaagacatatttttcagtgcataccctctgcgtccactaaaattctgtggtgtgtacacactttacccttgtaaaataataggtatttggatattcactgattgcctactatgtgccaggtaccatgatatgcactataaacacaaagatgaactaaaaatattatatgtsttgcagtggttcaaaactaagtccttggagttctcctttcaatccacattcatctttggatgatctccagtcctataaatggatgactttcatgtttacatctgtagcccagacctcttccctgaactgcagactcaggaagtccaactgtctgctcgacaattccacttggttgtccatgacagcatctcaaactggatagtaccaaaactaattctaatcttcctctccaattgatagtgacagcccaggtcaaaatctggaatccttcttatttccctacttcttccacactctcgg

SEQ ID NO: 199388 - DNA, 601 bp, Human
tgttgcagtggttcaaaactaagtccttggagttctcctttcaatccacattcatctttggatgatctccagtcctataaatggatgactttcatgtttacatctgtagcccagacctcttccctgaactgcagactcaggaagtccaactgtctgctcgacaattccacttggttgtccatgacagcatctcaaactggatagtaccaaaactaattctaatcttcctctccaattgatagtgacagcccaggtcaaaatctggaatccttcttatttccctacttcttccacactctckgtagtacaatggcctgtaccattaaaatacatccaaaatctgaccatttctcagcctattccaggccaccctcatctcttgtgtgagttatcacataacctcctaactcagtagttcccaaactttctcggttcatggtgtacttagtgtctccataatttatttttcatggctcccttaggccaaaagaattacctaatgttttcatgtattaagtagctaggttcatacatctttatatgtatttatatcttaaataaatgtaagcaatttaattttaaacaattttaaatctattta

SEQ ID NO: 199389 - DNA, 601 bp, Human
agttctcctttcaatccacattcatctttggatgatctccagtcctataaatggatgactttcatgtttacatctgtagcccagacctcttccctgaactgcagactcaggaagtccaactgtctgctcgacaattccacttggttgtccatgacagcatctcaaactggatagtaccaaaactaattctaatcttcctctccaattgatagtgacagcccaggtcaaaatctggaatccttcttatttccctacttcttccacactctcggtagtacaatggcctgtaccattaaaatayatccaaaatctgaccatttctcagcctattccaggccaccctcatctcttgtgtgagttatcacataacctcctaactcagtagttcccaaactttctcggttcatggtgtacttagtgtctccataatttatttttcatggctcccttaggccaaaagaattacctaatgttttcatgtattaagtagctaggttcatacatctttatatgtatttatatcttaaataaatgtaagcaatttaattttaaacaattttaaatctatttatatcttaacattgtaaagcttctcttatat

SEQ ID NO: 199390 - DNA, 601 bp, Human
aatacaaaaaaaaaagtagccgggcgtggtggcgcgcgcctgtagtcccagctactcgggaagctgaggcaggagaatggcgtgaacccgggaggcagagcttgcagtgagccgagattgcgccactgcactccagcctgggcaacaaagcgagactccgtctcaaaaaaaaaagaagtgcaagaggtctatttgggaaaatgtccatggaagaaaaaagggagaggaagcaaggacgcctgaaggagggaagaccttcagaccacaatgctggtctgacatctgtaacaggaagtggggragggaaggaggagtgagtagaagaagcctcagactacagtatagtatagctctgggatagtctcagccaggtcaaccaggagcccagagtacagtctacacaggaggagttctgcattaggcacgtgtgacttctgggacctttgctgtgcccagtcactggagcaccccaaggagcatggcctcacgtgaactctgcagtggagccttagagaaggagaagcagatggaggctgtgggttaacactccttacagcaggttcgcccttgaaggtagatctgagtcctctgtgtgtgtgtg

SEQ ID NO: 199391 - DNA, 601 bp, Human
aggaagtggggaagggaaggaggagtgagtagaagaagcctcagactacagtatagtatagctctgggatagtctcagccaggtcaaccaggagcccagagtacagtctacacaggaggagttctgcattaggcacgtgtgacttctgggacctttgctgtgcccagtcactggagcaccccaaggagcatggcctcacgtgaactctgcagtggagccttagagaaggagaagcagatggaggctgtgggttaacactccttacagcaggttcgcccttgaaggtagatctgagtcctctgtgtgtgtgtgtgtgtgtatatatatatatgtttacatgcagatataatgaaattatgcttaataatgtattattaattttatcttatttatatcctcatctaaaatataaactccataaccacagagatttttgactattttgttttagaacaatgtctggcacacagtaggcactcaaaaatatctgttgaatgaatgagtaaatgaatgaaagagtagaaatgccttgaaatctaatggtattattttaatataggaaaaaagagtctccaagccatctaaccagctaactctggct

SEQ ID NO: 199392 - DNA, 601 bp, Human
gagtagaagaagcctcagactacagtatagtatagctctgggatagtctcagccaggtcaaccaggagcccagagtacagtctacacaggaggagttctgcattaggcacgtgtgacttctgggacctttgctgtgcccagtcactggagcaccccaaggagcatggcctcacgtgaactctgcagtggagccttagagaaggagaagcagatggaggctgtgggttaacactccttacagcaggttcgcccttgaaggtagatctgagtcctctgtgtgtgtgtgtgtgtgtatatatayatatgtttacatgcagatataatgaaattatgcttaataatgtattattaattttatcttatttatatcctcatctaaaatataaactccataaccacagagatttttgactattttgttttagaacaatgtctggcacacagtaggcactcaaaaatatctgttgaatgaatgagtaaatgaatgaaagagtagaaatgccttgaaatctaatggtattattttaatataggaaaaaagagtctccaagccatctaaccagctaactctggctaatgtacccaatgagctagaagactg

SEQ ID NO: 199393 - DNA, 601 bp, Human
caggaggagttctgcattaggcacgtgtgacttctgggacctttgctgtgcccagtcactggagcaccccaaggagcatggcctcacgtgaactctgcagtggagccttagagaaggagaagcagatggaggctgtgggttaacactccttacagcaggttcgcccttgaaggtagatctgagtcctctgtgtgtgtgtgtgtgtgtatatatatatatgtttacatgcagatataatgaaattatgcttaataatgtattattaattttatcttatttatatcctcatctaaaatataarctccataaccacagagatttttgactattttgttttagaacaatgtctggcacacagtaggcactcaaaaatatctgttgaatgaatgagtaaatgaatgaaagagtagaaatgccttgaaatctaatggtattattttaatataggaaaaaagagtctccaagccatctaaccagctaactctggctaatgtacccaatgagctagaagactgggcctggatgaatttgtgttctgatcaaggacattgaacactcaagtagggaaaagagcaccattaaacaacacaagatagaggag

SEQ ID NO: 199394 - DNA, 601 bp, Human
actctgcagtggagccttagagaaggagaagcagatggaggctgtgggttaacactccttacagcaggttcgcccttgaaggtagatctgagtcctctgtgtgtgtgtgtgtgtgtatatatatatatgtttacatgcagatataatgaaattatgcttaataatgtattattaattttatcttatttatatcctcatctaaaatataaactccataaccacagagatttttgactattttgttttagaacaatgtctggcacacagtaggcactcaaaaatatctgttgaatgaatgagyaaatgaatgaaagagtagaaatgccttgaaatctaatggtattattttaatataggaaaaaagagtctccaagccatctaaccagctaactctggctaatgtacccaatgagctagaagactgggcctggatgaatttgtgttctgatcaaggacattgaacactcaagtagggaaaagagcaccattaaacaacacaagatagaggaggggcttttgttaaattttagtggaatagggaggagccaagatggccgaataggaacagctccggtctacagctcccagcgtgagcgacgca

SEQ ID NO: 199395 - DNA, 601 bp, Human
aatgagctagaagactgggcctggatgaatttgtgttctgatcaaggacattgaacactcaagtagggaaaagagcaccattaaacaacacaagatagaggaggggcttttgttaaattttagtggaatagggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagcckaagcagggcgaggcattgcctcacctgggaagcgcaaggggtcagggagttccctttccaagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcagcgaggctgggggaggggcgcccaccattgcccaggctagcttaggtaaa

SEQ ID NO: 199396 - DNA, 601 bp, Human; identical to SEQ ID NO: 31698

SEQ ID NO: 199397 - DNA, 601 bp, Human; identical to SEQ ID NO: 31699

SEQ ID NO: 199398 - DNA, 601 bp, Human; identical to SEQ ID NO: 31700

SEQ ID NO: 199399 - DNA, 601 bp, Human; identical to SEQ ID NO: 31701

SEQ ID NO: 199400 - DNA, 601 bp, Human; identical to SEQ ID NO: 31702

SEQ ID NO: 199401 - DNA, 601 bp, Human; identical to SEQ ID NO: 31703

SEQ ID NO: 199402 - DNA, 601 bp, Human; identical to SEQ ID NO: 31704

SEQ ID NO: 199403 - DNA, 601 bp, Human; identical to SEQ ID NO: 31705

SEQ ID NO: 199404 - DNA, 601 bp, Human; identical to SEQ ID NO: 31706

SEQ ID NO: 199405 - DNA, 601 bp, Human; identical to SEQ ID NO: 31707

SEQ ID NO: 199406 - DNA, 601 bp, Human; identical to SEQ ID NO: 31708

SEQ ID NO: 199407 - DNA, 601 bp, Human; identical to SEQ ID NO: 31709

SEQ ID NO: 199408 - DNA, 601 bp, Human; identical to SEQ ID NO: 31710

SEQ ID NO: 199409 - DNA, 601 bp, Human; identical to SEQ ID NO: 31711

SEQ ID NO: 199410 - DNA, 601 bp, Human; identical to SEQ ID NO: 31712

SEQ ID NO: 199411 - DNA, 601 bp, Human; identical to SEQ ID NO: 31713

SEQ ID NO: 199412 - DNA, 601 bp, Human; identical to SEQ ID NO: 31714

SEQ ID NO: 199413 - DNA, 601 bp, Human; identical to SEQ ID NO: 31715

SEQ ID NO: 199414 - DNA, 601 bp, Human; identical to SEQ ID NO: 31716

SEQ ID NO: 199415 - DNA, 601 bp, Human; identical to SEQ ID NO: 31717

SEQ ID NO: 199416 - DNA, 601 bp, Human; identical to SEQ ID NO: 31718

SEQ ID NO: 199417 - DNA, 601 bp, Human; identical to SEQ ID NO: 31719

SEQ ID NO: 199418 - DNA, 601 bp, Human; identical to SEQ ID NO: 31720

SEQ ID NO: 199419 - DNA, 601 bp, Human; identical to SEQ ID NO: 31721

SEQ ID NO: 199420 - DNA, 601 bp, Human
caaaagaattactattatattaatgatactgaattataatttttcatcagctgggattaaacatgtacagagaaaaactcataaacatatctatgaccataaacctttgtatacatttccatatcaaatggaataattttcctattttacagcagtctatctgatgatgttaactaagtaataagggaaagagctttttttccttagtttcattattagtgacatttaaaaatattattacactaattaagaatagatcaaacttaggtattactcataccatttgtcacccaatgttttktgttttttttttttttgagatggagtcttgctctgtcacccaggctggagtgcagtggcacgatctcagctcactgcaagctccgcctcccaggttcacgccattctcctgcctcagcctcccgagtagctgggactacaggtgcccgccaccatgcctagctaattttttgtatttttagtagagatggggtttcattgttttagtcagtatggtctcgatctcctgatcttgtgatccacccgcctcagcctcccaaagtgctgggattataggcgtgagccaccgcgcctggtccca

SEQ ID NO: 199421 - DNA, 601 bp, Human
aaagaattactattatattaatgatactgaattataatttttcatcagctgggattaaacatgtacagagaaaaactcataaacatatctatgaccataaacctttgtatacatttccatatcaaatggaataattttcctattttacagcagtctatctgatgatgttaactaagtaataagggaaagagctttttttccttagtttcattattagtgacatttaaaaatattattacactaattaagaatagatcaaacttaggtattactcataccatttgtcacccaatgttttttkttttttttttttttgagatggagtcttgctctgtcacccaggctggagtgcagtggcacgatctcagctcactgcaagctccgcctcccaggttcacgccattctcctgcctcagcctcccgagtagctgggactacaggtgcccgccaccatgcctagctaattttttgtatttttagtagagatggggtttcattgttttagtcagtatggtctcgatctcctgatcttgtgatccacccgcctcagcctcccaaagtgctgggattataggcgtgagccaccgcgcctggtcccaac

SEQ ID NO: 199422 - DNA, 601 bp, Human
gaattactattatattaatgatactgaattataatttttcatcagctgggattaaacatgtacagagaaaaactcataaacatatctatgaccataaacctttgtatacatttccatatcaaatggaataattttcctattttacagcagtctatctgatgatgttaactaagtaataagggaaagagctttttttccttagtttcattattagtgacatttaaaaatattattacactaattaagaatagatcaaacttaggtattactcataccatttgtcacccaatgttttttgttktttttttttttgagatggagtcttgctctgtcacccaggctggagtgcagtggcacgatctcagctcactgcaagctccgcctcccaggttcacgccattctcctgcctcagcctcccgagtagctgggactacaggtgcccgccaccatgcctagctaattttttgtatttttagtagagatggggtttcattgttttagtcagtatggtctcgatctcctgatcttgtgatccacccgcctcagcctcccaaagtgctgggattataggcgtgagccaccgcgcctggtcccaactgt

SEQ ID NO: 199423 - DNA, 601 bp, Human
tttagctccagaataactgcaagaacaaacctgctgaaaggactcacagactctctgaaggaattggactgctcctgcaggacccgggagatatcccaaatactgtgagtgcccaaactgcagaagtgaaaaactggtttgtgggagaagtttctgactttacctggagctgagtcaatttagagagctgagtgaaatacaggggtagaggaagcagcaggaaaggccttgggagctcgctgggtccccaagcaggccattcctgcctggcaccacagagatccttcaggagggcagccasaggtgtggggaaaatgccacagggagaaggaagtctccagctgaactttataacaatttgaaccagacgagaaacctcctggccagaactcgggaaagggcatgaatccagcatgcagactccataggctggggaagaactaagcccttttcttttgccgctgggaggtggatagtctggggcaagttctcaagccccgctcacccactgcctggaaacagacttggggctgttagggtaggcactgtgggagtgagactggccttttggtttgcgtgggagctgggtgaggcctgtgac

SEQ ID NO: 199424 - DNA, 601 bp, Human
caacagcagttaaaagagacaaagaaggacattatataatggtaaaaggccttgtcgaacaggaaaatatcacaatcctaaacatatatacacctaacaatggagctcctaaatttataaaacaattactaatagtcctgagagtttttagcatgaagggctgttgaattttgtcgaaggccttttctgcatctattaagatgatcatgtggtttttgtcactggttctctttatgtgatagattatgtttattgatttgcatatgttgaaccagccttgcatcccagggatgaagccgarttgattgtggtggataagctttttgatgtgctgctggattcagtttgccagtattttattgaggatttttgcatcaatgttcatcagggatattggcctgaaattttctactttcgttgtgtctctgccaggttttggtatcaggatgatgctggcctcacaaaatgagttagggaggataccctctttttctgttgcttggaatagcttcagaaggaatggtaccagctcctttttgtacctctggtagaatttggctgtaaatccatctggtcctgggctttttttggttggtaggct

SEQ ID NO: 199425 - DNA, 601 bp, Human
tattggcctgaaattttctactttcgttgtgtctctgccaggttttggtatcaggatgatgctggcctcacaaaatgagttagggaggataccctctttttctgttgcttggaatagcttcagaaggaatggtaccagctcctttttgtacctctggtagaatttggctgtaaatccatctggtcctgggctttttttggttggtaggctattaattactgcctcaatttcagaacttcttattggtctattcagggatttgacttcttcctagtttagtcttgggagggtgaatgtgtcyaggaatttatccatctcttctagattttctagtttatttgcgtagaggtgtttatagtattctctatactctatatggtggtagtttgtatttctgtgggatcagtggtgatatcccttttatcattttttattgtgtctatttgactcttctctcttttcttctttattagtctggctagtggtctattttgttaatcttttcaaaaaaccagctcctggatttattgattttttgaagggtttttcatgtctctatcgcctttagttctgctctgatcttagttatttcttgttttct

SEQ ID NO: 199426 - DNA, 601 bp, Human
ttttttgaagggtttttcatgtctctatcgcctttagttctgctctgatcttagttatttcttgttttctgctagcttttgaatttgtttcggttgcttctctagttcttttaattgtgatgttagggtatcaaatttagatctttcccactttgtcctgtagacattagtgtataaatttccctctaaacactgctttagctgtacattgtgatcctggtacattgtgtctttgttctcattggtttcaaagaacttatttatttctgccttaatttcgttatttacccagtagtcactyaggagcaggttgatcagtttccatgtagttgtgtggttttgaatgagtttctcaatcctgagttctaatttgattgcagtgtggtctgacagactgttatgatttctgttcttttgcatttggtgaggagtgttttacttccaattatgtggtcaattttagaataagtgtgatgtggtgctggaaagaatgtatattctgttgatttggggtggagagttctgtagatgtctatcaggtctgcttggtccagagctgagttcaagtcctaaatatccctgttaattttctgtctcactg

SEQ ID NO: 199427 - DNA, 601 bp, Human
ccattctcctgcctcagcctcccaagtagctgggactacaggtgcctgccaccatgcctagctaattttttgtattttttttagtacagatggggtttcaccatgttagccaggatggtctcgatctcctgacctcatgatccacccgcctcagcctcccaaagtgctgggattacaagcatgagccaccgcgcctggccatctcccactatttttgtgtgggagtctaagtgtctttgtatgtctctaagaacttgctttatgaatctgggtgcttctgtattggctccatatatttttrggatagttagctcttcttgttgcattgatccctttaccattatgtaatacccttgtcttttttgatctttgctggtttaaagtctgttttatcagactacaactgcaacccctgcctttttttttttttttgcttttcatttgcttggtaaatattcctccatccctttattttgagcctatgtgtgtatttgcacatgaggctggtctcctgaatacagcacactgatgggtcttgattcgttatccaatttgccagcctgcgtcttttaatttgggcatttagccctttacatttaag

SEQ ID NO: 199428 - DNA, 601 bp, Human
gtctcgatctcctgacctcatgatccacccgcctcagcctcccaaagtgctgggattacaagcatgagccaccgcgcctggccatctcccactatttttgtgtgggagtctaagtgtctttgtatgtctctaagaacttgctttatgaatctgggtgcttctgtattggctccatatatttttgggatagttagctcttcttgttgcattgatccctttaccattatgtaatacccttgtcttttttgatctttgctggtttaaagtctgttttatcagactacaactgcaacccctgcctttttttttttttttgcttttcatttgcttggtaaatattcctccatccctttattttgagcctatgtgtgtatttgcacatgaggctggtctcctgaatacagcacactgatgggtcttgattcgttatccaatttgccagcctgcgtcttttaatttgggcatttagccctttacatttaaggttaatattgttatgtgtgaatttgatcctgtcattatgatgctagctggttattctgcgcgttagttgatgcagtttcttcatagtgtcgatggtgtttacaattcgttatgtttt

SEQ ID NO: 199429 - DNA, 601 bp, Human
tctgttatcctttcttccacttgtttgattcagctatcaatacttgtgtatgcgtcacgaagttctcgtgctgtgtttttcagctccatccggtcatttatgttcttctctaaactggttattctaattagcaattcctctaaccttttttcaaggttcttagcttccttgcattgggttagaataagctcctttagctcagaggagtttactattacccaccttctgaagcccacttctgtcaattcgtcaaactcattttctgtccagttttgttcccttgctggtgagtagttgtgaycctttggaggagaagaggcattctcgtttttggaactttcagaccttttgtactggtttttcctcatctttgtggatttatctacctttggtctttgatgttggtgaccccttcatatgggttttttgtgtggacgccctttttgttgatgctgatgctatttctttctgtttgttagtttttgttctaacagtcagggccctctgctgcaggtctgctggagtttgctggaggtccactccagacactgtttgcttgggtatcaccagcgaaggctgcagaacagcaaaggttgctgcc

SEQ ID NO: 199430 - DNA, 601 bp, Human
tctaaccttttttcaaggttcttagcttccttgcattgggttagaataagctcctttagctcagaggagtttactattacccaccttctgaagcccacttctgtcaattcgtcaaactcattttctgtccagttttgttcccttgctggtgagtagttgtgatcctttggaggagaagaggcattctcgtttttggaactttcagaccttttgtactggtttttcctcatctttgtggatttatctacctttggtctttgatgttggtgaccccttcatatgggttttttgtgtggacgcsctttttgttgatgctgatgctatttctttctgtttgttagtttttgttctaacagtcagggccctctgctgcaggtctgctggagtttgctggaggtccactccagacactgtttgcttgggtatcaccagcgaaggctgcagaacagcaaaggttgctgcctgttccctcctctggatgcttcatcccagaagggcacctgccagatgtcagccggagctctcctgtatgaggtgtctgtcgacccctgctgggaggtgtctcccagtcaggaggcacgggggtcagggacccacttga

SEQ ID NO: 199431 - DNA, 601 bp, Human
ctgagctagatcacttggctccctggcttcagctccctttccaggggagtgaatggttctgtctcactggcgttccaggcaccactggggtatgaaaaaaaactcctgcagctagctcggtgtctgcccaaatggtcgcccagttttttgcttgaaacccagtgccctggtggtgtaggcaccccagggaatctcctggtctgtggattgcaaagaccatgggcaaagcatagtatctgggccggaatgcactgttcctcctgttcctcatggcacagtccctcacggcttcccttggctggggggggggggagttccccgaccccttgcacttcctgagtgaggtgacacccccaccctgcttcggctcgccctctgtgggctgcttccactgtctaaccagtcccaatgagatgaaccaggtacctcagctgggaatgcagaaatcacccaccttctgcatcgatcttgctgggagctgcagattggagctgctcctattcagccatctttctagccacccagaatacacattctattcaacagcacatggaactttcttgaagatggaccatatgataggccacaaaatgagcctcaa

SEQ ID NO: 199432 - DNA, 601 bp, Human
tatcataggaaaaccccttctagatattggattaggcaaggaattcatgaccaagaacctgaaagcaaatgcaataaaaacaaagataaatacctgggacttaattaaattaaagagcttttgcatggcaaaaacaacagtcagcagagtaaacagacaacccacagagtgggaggaaatcttcacaatctatacatctgacaaaggactaatatccagaatctacaacaaactcaaacaaatcagcaagaaaaaaacagacaatcccatcaaaaactgggctaaggacatgaatagacakttttcaaaagaagatacacaaatggccaacaaacatgaaaaaatgctcaacatcactaatgatcagggaaatgcaaatcaaaaccgcaatgcaataccaccttactcctgcaagaatggccataaccaaaaaatcaaaaaaacagtagatgttggcatggatgcggttatcagggaacacttctacagtgctggtgggaatgtaaactagtacagcccctatggaaaacagtgtggagattccttaaagtaccaaaagtagaactgccatttcatccaggaatcccaccactgggtatct

SEQ ID NO: 199433 - DNA, 601 bp, Human
agcttctagaattaaaacatgctgtaagtataaaaataagtagattttgaaaatctatatacatgtggaatctgataacatattgatatttccttatagtcagactaatctgcatctcagatgatatgaaggtaagaaggagatggagatgaaagcatagtttcatagtttgaaattatgaaaaagccatgaattgttttggaggccagctactgtattgagccattgtcaggaattggaaatattttgattctataagtctgatggctggttggtaagtgatagagtcccaatcttggtyttacaacactccaaagttttaaaaattcttttgggagtattgtgaaatttccaaataccaaccatattttagttttttatgaaatatgtcatttgtgggaaaagaagtcattaaattgtgagaatagataccttctgctcccaaaggttggaggctggcagactatgccactctcttacaccataacgatggaaactgggaggatttttttttcttaattctagcagaagatatagggttttaacatatctttaaaagggggttttgctagttttccgtagcttgaggagctgagtaatg

SEQ ID NO: 199434 - DNA, 601 bp, Human
tatgatttcctgcctcggccagcggaggcctccacgtgcctcctgaagtcaagttttcctggattcaggaaggaatgtgaaaccaatgagttgcctgtcaaggacagcagggatcacatgtgagggcagcacgtttctgagattctattccaggttttcagcagatgcgcccataccaatggtgtttgctctgtgtcaggcagaagacagggactatatagaaattccttgtaacacagagctaacatcacagttgcttttgtatttgggcaaggcctccctgcaactcctgtcaaaggcrcgtcagttctggggtagcttcaattttgaagtgtgcacaactaagttatttcaaagaatctaggcttggccttgtgacctgccaataggaagtaggtgaagggacagtgtgctagttctgaggctaggatttaagaggcaggccctgtgcatgatgtctgttgttaggagaataagccaggacaagactgcaagagagatgttagcaacttatggccatcaactcagatgccccagttaacagccagtagaccccaagagcactgctgagccacctaacagatacatgagcatgcttaac

SEQ ID NO: 199435 - DNA, 601 bp, Human; identical to SEQ ID NO: 31722

SEQ ID NO: 199436 - DNA, 601 bp, Human; identical to SEQ ID NO: 31723

SEQ ID NO: 199437 - DNA, 601 bp, Human; identical to SEQ ID NO: 31724

SEQ ID NO: 199438 - DNA, 601 bp, Human; identical to SEQ ID NO: 31725

SEQ ID NO: 199439 - DNA, 601 bp, Human; identical to SEQ ID NO: 31726

SEQ ID NO: 199440 - DNA, 601 bp, Human; identical to SEQ ID NO: 31727

SEQ ID NO: 199441 - DNA, 601 bp, Human; identical to SEQ ID NO: 31728

SEQ ID NO: 199442 - DNA, 601 bp, Human; identical to SEQ ID NO: 31729

SEQ ID NO: 199443 - DNA, 601 bp, Human; identical to SEQ ID NO: 31730

SEQ ID NO: 199444 - DNA, 601 bp, Human; identical to SEQ ID NO: 31731

SEQ ID NO: 199445 - DNA, 601 bp, Human; identical to SEQ ID NO: 31732

SEQ ID NO: 199446 - DNA, 601 bp, Human
acaccttctccattcacgcagttcagagtgatgataaatgctgggaggctttgactcctgggcctaacagctttaaaacgttaatacttacgatcaagaggtacttccagtgcactaatcatctggcacaggaagagaatcaggggcactctgcccgcagataagcgcttctttttcggcattattttaagctgcattagcttaactcctgctgagactcacacactgaatttccttttcttctttcacaaaagattttgtgaaacgttgtgtgcaacgtttaagtaattttcatgcgggraactgaaaaaggatagagtaggaataataattataatgtattaaaaagaaggaaatgaagagcggaagtctgcagcacagagaactagccgtgtattatacatgaactctaaaagaaagttaacttttaaatatttaactctcaaaactggagtaatcatttattcataaatcagctaaaatcagttcagagatattagtagtgatatgaagcataatctgtctaccatccttatgatttttccattttaaatggtatttgtattatgagtgttcagaggctatcgtgtctttcccaaca

SEQ ID NO: 199447 - DNA, 601 bp, Human; identical to SEQ ID NO: 36701

SEQ ID NO: 199448 - DNA, 601 bp, Human; identical to SEQ ID NO: 36702

SEQ ID NO: 199449 - DNA, 601 bp, Human; identical to SEQ ID NO: 36703

SEQ ID NO: 199450 - DNA, 601 bp, Human
gacagagtgaagggagaatttgtttttcttaatatgggagatactagaacgtatttgtgaaccgataggaatgacctagtagaaagaaagagatctgtggtgcaagaagtacaagagaaataactagaagcaaagtagtaaaaaggggcaaacgtggaggggtttgagaatggaactaggagaactactccttaaaggcaggagggatatttcttccattttcaaaggaagatagcccaaatggtgcagatgcagacgggtttgaaattttgatgaaaagtaacttgggagcatctcatgsattctgtgttttcgattaaatgcagaatatgtcccttaactttgagtctggtggagaagggtttgggcagattgaggtaagtaggggaggtttgaatagttgtctcaaggagaggaaaggcacaccccctgaggaaatgtaactgggtccccaggcagtgttgagtgcccatctagcacttgtggtcacacattttacatgaaattggttagcccagatgtagatgccttcagtccagtttatctagctgctcaaaggctctcatggataaggtagatgtttgaggtcagccaaattggg

SEQ ID NO: 199451 - DNA, 601 bp, Human
atgtaatttttatttgaaattaactttaaagcatatagacttaaagattctactaaaaacaaaacaaagtaatttcctggaacccaaaattattttctaaattacgttgttttaggtcaggtgctaaaatagtaagcaagaccccacttattaaggctcacttatcatcaaagtcagagacagaaaaaagcacagaagaacatgtgtgattcaattgaggatgagagaagggaaatatacgggaatccataaaggagaaaaagtgttctggtgagcggagacacaggaccgaaagccacakaaataagctctgggtttttgcttttctaagtacatgtatagaaatacttcaaggtttttattacacttagttttcaaattttagagtggtggaggaaggggagtgatagggtattaagaaattcatatttttttctaccagtatttttgtgctataggcaggctactagtgttttcattggtattaagcttgatgtaatatttccagagagtaggtttctatctcaggcaaacatttaatttttctttccttttccttatcgtagttgatatttggtggcttgcagattggattcatagt

SEQ ID NO: 199452 - DNA, 601 bp, Human
gaaaaggaacattagattcagagatgattcaccatgcaaaagaaatgcaaaagcaggatgtagatcacactaattagatttgaaaaaggttttggatctaaaaatgtgttctacataaagcatgttattgatgcttgaaaaatggtgataatagtaacatgatgtcatcctagcttggggggaatgataccatacaaaaataacgtgtcaacattaagaatggagtttgagtctttaaagacccacctattagcttctaaaacaatgtaaggccatgtacacatatctaagaattggtgartatgtcaataattgctcaattttataacggtgccataatcccatactattacactccatccattcaacaaatattaccaagtgcttactacaggccaggtactatgctaagcagtgagaatagacagaggaggcagaataacatagtgaataagatcatgaggccaggtgtggtggctcatgcctgtaatcccagcagtttgggagactgacacaggtggatcacttgatcccatgagttcaagatcagcttgggcaacatgacaaaaccttgtccctactaataatacaaaaataatta

SEQ ID NO: 199453 - DNA, 601 bp, Human
acactccatccattcaacaaatattaccaagtgcttactacaggccaggtactatgctaagcagtgagaatagacagaggaggcagaataacatagtgaataagatcatgaggccaggtgtggtggctcatgcctgtaatcccagcagtttgggagactgacacaggtggatcacttgatcccatgagttcaagatcagcttgggcaacatgacaaaaccttgtccctactaataatacaaaaataattagacatgcattgtggcacgcacctgtagtcccagctacttgggaggctgagrtgagaggatcacctgagctcaggaagttgaggctgcagtgagccgagatcatgccactgccttccagcctgggtgatgggagtgagaccctgtctcaaacaacaataacagcaacaacaaacaaaaaaccaaaaacaaacaaaaaagatcatggactttgaacttcaacagacttgagttggcatcttggttctccacccactacccatgatgtttatactcaacttccctaagcctcagtgtcctcaattgtaaaatgggagtagtaatagtagctacctcttagagcagtgaggattg

SEQ ID NO: 199454 - DNA, 601 bp, Human
tgagttcaagatcagcttgggcaacatgacaaaaccttgtccctactaataatacaaaaataattagacatgcattgtggcacgcacctgtagtcccagctacttgggaggctgaggtgagaggatcacctgagctcaggaagttgaggctgcagtgagccgagatcatgccactgccttccagcctgggtgatgggagtgagaccctgtctcaaacaacaataacagcaacaacaaacaaaaaaccaaaaacaaacaaaaaagatcatggactttgaacttcaacagacttgagttggcrtcttggttctccacccactacccatgatgtttatactcaacttccctaagcctcagtgtcctcaattgtaaaatgggagtagtaatagtagctacctcttagagcagtgaggattgaaaaagaaaatacgtgtaaggcacttagcacaatatctgtcacatagtaagaattgagtttattattattattatcacagatgaatagacctcatgaagctcgccgttcatttcctcgggacccagcctattaggaaacattagcaaaagtttttgattcagcattatatgggtcattcttgat

SEQ ID NO: 199455 - DNA, 601 bp, Human
aggactgaagttaatataacaaagatattagtgttcttccttgggattcttccttgctaatttccttgaaaacacccttgattcccagaagtctcctatttacaaaacaaaactagtttttcttgaattgattcatctgtctacttaaagattttttttggccagttgtggtagctcatgcctgtaaccccaacactttgagaggttgggcaggaggatttcttgaggccaggagttcaagaccagtctgggcaacaaagtgagacaccatcccctgcccccacctcctcccgccccaatytctacaaaaaataaaatagcctatttattgtactctctacaataaataaaataaatatagatgcctgcctgtagctccagctactctggagggtgatgtggaaggattgcttgagctcaggagttcgaggccactgtactccagcctgggcaagagagctaaaaaaaaaaaaaaaaaaaaaaaaaaaattttttatgttatcttagttcaagtttgagaaataaaattaagtaccaaatttattcccaaaaatgtatgcttgtcaggagatatacctaatgttaaatgacgagttaatgg

SEQ ID NO: 199456 - DNA, 601 bp, Human
gactgaagttaatataacaaagatattagtgttcttccttgggattcttccttgctaatttccttgaaaacacccttgattcccagaagtctcctatttacaaaacaaaactagtttttcttgaattgattcatctgtctacttaaagattttttttggccagttgtggtagctcatgcctgtaaccccaacactttgagaggttgggcaggaggatttcttgaggccaggagttcaagaccagtctgggcaacaaagtgagacaccatcccctgcccccacctcctcccgccccaatctytacaaaaaataaaatagcctatttattgtactctctacaataaataaaataaatatagatgcctgcctgtagctccagctactctggagggtgatgtggaaggattgcttgagctcaggagttcgaggccactgtactccagcctgggcaagagagctaaaaaaaaaaaaaaaaaaaaaaaaaaaattttttatgttatcttagttcaagtttgagaaataaaattaagtaccaaatttattcccaaaaatgtatgcttgtcaggagatatacctaatgttaaatgacgagttaatgggt

SEQ ID NO: 199457 - DNA, 601 bp, Human
tgagcacagtgaaaggaagagggacagagagattgtgatatgcccccttttgatctcctccctgcttcaatcctccattaaggctgctgctcgtagttccctttatcctattgagggtccataagttaggatcactcctaacctaggaccatacgttaggaccataagttagtccccaataacaatgccccattggacagccaaaaacagtggctccatgcccttccctctactccctttcctggtagaaacatacaacttttccttgtccagtcaacacctaagcgccccactaggattsactcattctcccatcctgggtgctttcttaaccagcagacactatgagggccagtcatgtgcctctcttctcatgcaactggtccttatctgcaactcgtaatctgcccagttcctcactcatcctgcccaggcttctcttttacctcttctgttatagtggtgtgtgtgtgtctgtgtgtatgtgtgtgtgtgtgctcacgcacgtgtatgtgtaaacccataacaagattgacagctctgtcctctaaattttaatccctattcactctcttgcctcctgtccttgccagttccagag

SEQ ID NO: 199458 - DNA, 601 bp, Human
actgtcttgcctcctgtcttcgtcagttccagaggtcctcttgttgtcatgtttgttactctttctttcattctctttctttcttcccttccttccctcccttccctccctttcctaccttccctcccttccctcccttccctccctttcctacctgcactccctttcctccccttcctaccttccctccctttcctccccttccttccttccttcctctctctcttttttctttctttctttctttctttctttctttctttctttctttctttcttttctttctttccttctttctttctttttcttttcctttctttccttttctgaaacagaacctcactctgtcacccagcatggaatgcagtggcatgatctcggctcactgcaacctctgcctcccaggttcaagcaattctcctgcctcagcctcctgagtagctgggacaacaggcacacactgccatgcctggctaatttttagtagagacggggtttcaccatgttggccaggctggcctcaaactcctgacctcaggcgatctgcctgcctcagccacccaaagtgctgggattacaggcactgttatagacccctttt

SEQ ID NO: 199459 - DNA, 601 bp, Human
tgtcttgcctcctgtcttcgtcagttccagaggtcctcttgttgtcatgtttgttactctttctttcattctctttctttcttcccttccttccctcccttccctccctttcctaccttccctcccttccctcccttccctccctttcctacctgcactccctttcctccccttcctaccttccctccctttcctccccttccttccttccttcctctctctcttttttctttctttctttctttctttctttctttctttctttctttctttcttttctttctttccttctttctttctctttcttttcctttctttccttttctgaaacagaacctcactctgtcacccagcatggaatgcagtggcatgatctcggctcactgcaacctctgcctcccaggttcaagcaattctcctgcctcagcctcctgagtagctgggacaacaggcacacactgccatgcctggctaatttttagtagagacggggtttcaccatgttggccaggctggcctcaaactcctgacctcaggcgatctgcctgcctcagccacccaaagtgctgggattacaggcactgttatagaccccttttgt

SEQ ID NO: 199460 - DNA, 601 bp, Human
cctcctgtcttcgtcagttccagaggtcctcttgttgtcatgtttgttactctttctttcattctctttctttcttcccttccttccctcccttccctccctttcctaccttccctcccttccctcccttccctccctttcctacctgcactccctttcctccccttcctaccttccctccctttcctccccttccttccttccttcctctctctcttttttctttctttctttctttctttctttctttctttctttctttctttcttttctttctttccttctttctttctttttcttctcctttctttccttttctgaaacagaacctcactctgtcacccagcatggaatgcagtggcatgatctcggctcactgcaacctctgcctcccaggttcaagcaattctcctgcctcagcctcctgagtagctgggacaacaggcacacactgccatgcctggctaatttttagtagagacggggtttcaccatgttggccaggctggcctcaaactcctgacctcaggcgatctgcctgcctcagccacccaaagtgctgggattacaggcactgttatagaccccttttgtcaggttt

SEQ ID NO: 199461 - DNA, 601 bp, Human
tttcttcccttccttccctcccttccctccctttcctaccttccctcccttccctcccttccctccctttcctacctgcactccctttcctccccttcctaccttccctccctttcctccccttccttccttccttcctctctctcttttttctttctttctttctttctttctttctttctttctttctttctttcttttctttctttccttctttctttctttttcttttcctttctttccttttctgaaacagaacctcactctgtcacccagcatggaatgcagtggcatgatctcrgctcactgcaacctctgcctcccaggttcaagcaattctcctgcctcagcctcctgagtagctgggacaacaggcacacactgccatgcctggctaatttttagtagagacggggtttcaccatgttggccaggctggcctcaaactcctgacctcaggcgatctgcctgcctcagccacccaaagtgctgggattacaggcactgttatagaccccttttgtcaggtttcctaggatgtatcaagttataggtggcccgcagaacatgccctgtcccatcaatctgggttccattcatt

SEQ ID NO: 199462 - DNA, 601 bp, Human
tctttctttctttctttcttttctttctttccttctttctttctttttcttttcctttctttccttttctgaaacagaacctcactctgtcacccagcatggaatgcagtggcatgatctcggctcactgcaacctctgcctcccaggttcaagcaattctcctgcctcagcctcctgagtagctgggacaacaggcacacactgccatgcctggctaatttttagtagagacggggtttcaccatgttggccaggctggcctcaaactcctgacctcaggcgatctgcctgcctcagccwcccaaagtgctgggattacaggcactgttatagaccccttttgtcaggtttcctaggatgtatcaagttataggtggcccgcagaacatgccctgtcccatcaatctgggttccattcattggtttggggaactcaggcctactgttgtttttaaagtatgtgctttgcagttgtacttgaaagtgtggcacaggggcaaagccaacaaaaccacagggtttttttcctggctgctttctgagggctactcttctcctctagctggagtggtggtgcatttgccaagtgttcagacccag

SEQ ID NO: 199463 - DNA, 601 bp, Human
aatataagtcgggcacagtggctcatgcttgtaatcccagcactttgggaggctgaggtgggcggatcaattgaggtcaggagttcgagactaacatggccaacatggtgaaaccccttctctactaaaaatgcaaaaattagccaggtgtggtggtagatgcctgtaatcccagctacttgggaggctgaggcaggagaatcacttgaacctgggaggtggaggttgcagtgagccaatatcgtgccactacattccagcctgggcgacaagagctagactctgtgtcaaatatatatayacacacacacacacacacacacacacacacacacaaacatatatatatatatattctcatatatatatacgagaataactgaaaaaactaatgactccaacagtgacttgcccagggagggctttaattgtccccaatatgcatgtgatgctcctttcctatttataatggatcttgtgacagacttggaagaattggcctcttccagttttttggctgcttttcaacaaaaaattttattttcagaatttttcttaattttttattttttttgcaaatatttccagctctgagggagca

SEQ ID NO: 199464 - DNA, 601 bp, Human
tataagtcgggcacagtggctcatgcttgtaatcccagcactttgggaggctgaggtgggcggatcaattgaggtcaggagttcgagactaacatggccaacatggtgaaaccccttctctactaaaaatgcaaaaattagccaggtgtggtggtagatgcctgtaatcccagctacttgggaggctgaggcaggagaatcacttgaacctgggaggtggaggttgcagtgagccaatatcgtgccactacattccagcctgggcgacaagagctagactctgtgtcaaatatatatatayacacacacacacacacacacacacacacacacaaacatatatatatatatattctcatatatatatacgagaataactgaaaaaactaatgactccaacagtgacttgcccagggagggctttaattgtccccaatatgcatgtgatgctcctttcctatttataatggatcttgtgacagacttggaagaattggcctcttccagttttttggctgcttttcaacaaaaaattttattttcagaatttttcttaattttttattttttttgcaaatatttccagctctgagggagcagg

SEQ ID NO: 199465 - DNA, 601 bp, Human
aatcccagcactttgggaggctgaggtgggcggatcaattgaggtcaggagttcgagactaacatggccaacatggtgaaaccccttctctactaaaaatgcaaaaattagccaggtgtggtggtagatgcctgtaatcccagctacttgggaggctgaggcaggagaatcacttgaacctgggaggtggaggttgcagtgagccaatatcgtgccactacattccagcctgggcgacaagagctagactctgtgtcaaatatatatatacacacacacacacacacacacacacacacamacaaacatatatatatatatattctcatatatatatacgagaataactgaaaaaactaatgactccaacagtgacttgcccagggagggctttaattgtccccaatatgcatgtgatgctcctttcctatttataatggatcttgtgacagacttggaagaattggcctcttccagttttttggctgcttttcaacaaaaaattttattttcagaatttttcttaattttttattttttttgcaaatatttccagctctgagggagcaggtaaaataatacagctcatatccggaggcat

SEQ ID NO: 199466 - DNA, 601 bp, Human
cccagcactttgggaggctgaggtgggcggatcaattgaggtcaggagttcgagactaacatggccaacatggtgaaaccccttctctactaaaaatgcaaaaattagccaggtgtggtggtagatgcctgtaatcccagctacttgggaggctgaggcaggagaatcacttgaacctgggaggtggaggttgcagtgagccaatatcgtgccactacattccagcctgggcgacaagagctagactctgtgtcaaatatatatatacacacacacacacacacacacacacacacacaccaacatatatatatatatattctcatatatatatacgagaataactgaaaaaactaatgactccaacagtgacttgcccagggagggctttaattgtccccaatatgcatgtgatgctcctttcctatttataatggatcttgtgacagacttggaagaattggcctcttccagttttttggctgcttttcaacaaaaaattttattttcagaatttttcttaattttttattttttttgcaaatatttccagctctgagggagcaggtaaaataatacagctcatatccggaggcatagc

SEQ ID NO: 199467 - DNA, 601 bp, Human
gcactttgggaggctgaggtgggcggatcaattgaggtcaggagttcgagactaacatggccaacatggtgaaaccccttctctactaaaaatgcaaaaattagccaggtgtggtggtagatgcctgtaatcccagctacttgggaggctgaggcaggagaatcacttgaacctgggaggtggaggttgcagtgagccaatatcgtgccactacattccagcctgggcgacaagagctagactctgtgtcaaatatatatatacacacacacacacacacacacacacacacacacaaacctatatatatatatattctcatatatatatacgagaataactgaaaaaactaatgactccaacagtgacttgcccagggagggctttaattgtccccaatatgcatgtgatgctcctttcctatttataatggatcttgtgacagacttggaagaattggcctcttccagttttttggctgcttttcaacaaaaaattttattttcagaatttttcttaattttttattttttttgcaaatatttccagctctgagggagcaggtaaaataatacagctcatatccggaggcatagccaga

SEQ ID NO: 199468 - DNA, 601 bp, Human
cttggggcaaagctctgagcctgcctccgtggaactgtcagaggaggcaggagacacaatcccacctctcaatgtgcaaatgtggcatttcgaatttgcaataggatgagtaaatttattttctctgagactttaatgagaccatgtgctacaagtacgaagtgttatcagagttgctattatagctgcagcttcaataatgcagaaaaatcagctatgtgccatgagaatttatttcccaagaatacgacaatgatctctgttgttgggaaaggggggattggtccatgtttcctgccawggtaaataactagaagcttggcctgaatggacgccgaaaccgcaggtgtgtactatcaccaaataaaatccctgtcaaactggctttaatttcataggatcagtccccatattttctttaacttctctgccatagcatatatagatgccatttttgttcagttttgtggcttgagcaaataactatcacttttctcgacagtattgagcagaagggggagacagggaagtatgaagtgtgtctgtgaacaggctgtctcatacacacatccagtgagctggaagacacaagggagaagga

SEQ ID NO: 199469 - DNA, 601 bp, Human
ctacaagtacgaagtgttatcagagttgctattatagctgcagcttcaataatgcagaaaaatcagctatgtgccatgagaatttatttcccaagaatacgacaatgatctctgttgttgggaaaggggggattggtccatgtttcctgccatggtaaataactagaagcttggcctgaatggacgccgaaaccgcaggtgtgtactatcaccaaataaaatccctgtcaaactggctttaatttcataggatcagtccccatattttctttaacttctctgccatagcatatatagatgycatttttgttcagttttgtggcttgagcaaataactatcacttttctcgacagtattgagcagaagggggagacagggaagtatgaagtgtgtctgtgaacaggctgtctcatacacacatccagtgagctggaagacacaagggagaaggacgaatccttttcataggaggtgtgtgtcttccaggttgctggcatcatctctgctgcgattgtgatgatcgccattcttgccctggggaagcttctggaacccttgcagaaggtataaccctgcttctctgcataccgattgcataat

SEQ ID NO: 199470 - DNA, 601 bp, Human
gagggagctctaagctgagttagggaattctgacttctaggctccatcttggtgagactttgcccaagtcattcagcctctcaggacctcagttttctcatctgaagcagctagactaaaattgctgattcctgaagactagaaaagtctatgattctgtgattcctgggttctattttgggtgtggccattgtatgtcagggtgagaacagatgatatcataggcctcagttctgcaaatcccattgattttgctttttttctttgctacttttaaagaatgttagcaaaatcaggaggrtcagtggtatgaacttcaggcaaatcatggcactgttctaagcctcagtttcttttctggaaatcagagggttgaataaattgctttctaaggccctttctaactttgaccttctatgagactgtagaggtccaagagtttttgtaacctgttgtctccctattcaagaaaagttgtagaggccgggcacggtggttcacacctgtaatcccagcactttgggaggctgaggcgggtgaatcacttgaggtcaggagtttgagaccaacctggccaatgtggcaaaactctgtctctact

SEQ ID NO: 199471 - DNA, 601 bp, Human
agttctcttagcagattttgttattagctcatttgaaaacactcttgttctttgttgtacatttcactctaagcattggctgagatccattgtagactatattggccagagagttcaatgaattacttttggggacagtcttaacatatttaatgccagaatatttcccacacaacgaatatttactttcaaatattataatgacagttatgatagctaaagaagactccaaactttatacttgaacagaggtcttgatttgttttcctccataattctcaaattctcttttattattgaycatgggtcttgtgtcttgactttttaaaattaaatgtttattttgacataattgtaaattcacatgtagttgtaaggaataatatttagatcctatataccccttacccagtttctcccaatgagtaacatcttgtaaaactgtagcataaaatcacagtaggacactgacattcaaaatagaggccttgacttttaggtcaatagtaacattttgaacccgataagcatagccacacccatatctcttctccaatcagcagggcctatattaagaagcctcctgtactctcttctttcc

SEQ ID NO: 199472 - DNA, 601 bp, Human
gttctcttagcagattttgttattagctcatttgaaaacactcttgttctttgttgtacatttcactctaagcattggctgagatccattgtagactatattggccagagagttcaatgaattacttttggggacagtcttaacatatttaatgccagaatatttcccacacaacgaatatttactttcaaatattataatgacagttatgatagctaaagaagactccaaactttatacttgaacagaggtcttgatttgttttcctccataattctcaaattctcttttattattgacyatgggtcttgtgtcttgactttttaaaattaaatgtttattttgacataattgtaaattcacatgtagttgtaaggaataatatttagatcctatataccccttacccagtttctcccaatgagtaacatcttgtaaaactgtagcataaaatcacagtaggacactgacattcaaaatagaggccttgacttttaggtcaatagtaacattttgaacccgataagcatagccacacccatatctcttctccaatcagcagggcctatattaagaagcctcctgtactctcttctttcca

SEQ ID NO: 199473 - DNA, 601 bp, Human
aattgtaaattcacatgtagttgtaaggaataatatttagatcctatataccccttacccagtttctcccaatgagtaacatcttgtaaaactgtagcataaaatcacagtaggacactgacattcaaaatagaggccttgacttttaggtcaatagtaacattttgaacccgataagcatagccacacccatatctcttctccaatcagcagggcctatattaagaagcctcctgtactctcttctttccacaaatgcttatttagcacctccacgctatcaagtgctgtgctattgagygctggatgttgccatctcttgagatataatcctaattataccattactgtagtttgaaaacctccatggttttgcaataataacctttccttaaagtcctgattaaccatgaaagtaataatgtttctcctgagcaagtaactgaatgctactgaattatgggcagataaggttgttaattgttacaaactctccttttttatttttagattgtcaaagaattccaaagaattgatgtgaatgtgtattttgcatcacttcaaggtaaatacatatatctacatatctacctgtaagact

SEQ ID NO: 199474 - DNA, 601 bp, Human
gtctgacaggtggctttttggaaacatttaaaactttgagagggtataatgtaccaggaagactgctattatgactatcagggagataataccaagggtttatagtatgctccttagccaggattctcatgaatcaaaccaactaaaattgaatagcctgacaaggagactacctgttttaaccaagaagtcttctctgtagtacctgatgtatttatatatgtggaacaagaagtgtcacccaactgcacagatgcttccttgttgagttagcaggtaatctagcattccatgactggttaaattaaagcagaaagtgtaagttacccaaagaagctactcattgtgaagttttaactacagcactatcctgccaagtgaaagaggtaggcacaagtaagggaaaattaaaagggataagcatcttatgatagggagtcttgttctgacagtcttggagctgtctacagcatgaagttgacaacttcttgttttggtttgtagttttattgtctctagttgtggcatccagcattctggcgaactctctatgtggcccacagtttaagcatgagattcatctcttgaaatttacactgag

SEQ ID NO: 199475 - DNA, 601 bp, Human
accatataaggttatctcctatacaaaagaaaaaattactctcttttcaattttctttatctcttcatacttgtaaatttcttctcacatctttcctacctagtggttccttcctgccttgttttgatttccttcataagtccatatttagaaacaacctttaaataacctctgattgccaagctagagttaagttttaaataaataaataggccggtcatggcggctcacatctgtaatcccagcactttgggaggcaaaggtcagaggatcacttcaggccaggagtttgagaccagcytgagcaacatggtgagaccccgtctctattattttttttttaaaaaacaaaaagcataaaaactctgagaacattttgaacccagaaagatattacttccaatttgtgccacagagctggtaatgtatggaaatgtgtatcttgacagtgggtgggggtggggtgaatattgacaatgtggggatgttgttatgaggagagcaaagctggagattacttagattccttagaacaggaggactctcaagggtgtgagtctctgtgtgtttctttatgaatgtatgtgtgtaggaaagtgct

SEQ ID NO: 199476 - DNA, 601 bp, Human
caagctagagttaagttttaaataaataaataggccggtcatggcggctcacatctgtaatcccagcactttgggaggcaaaggtcagaggatcacttcaggccaggagtttgagaccagcctgagcaacatggtgagaccccgtctctattattttttttttaaaaaacaaaaagcataaaaactctgagaacattttgaacccagaaagatattacttccaatttgtgccacagagctggtaatgtatggaaatgtgtatcttgacagtgggtgggggtggggtgaatattgacaatgkggggatgttgttatgaggagagcaaagctggagattacttagattccttagaacaggaggactctcaagggtgtgagtctctgtgtgtttctttatgaatgtatgtgtgtaggaaagtgctaaggcttaggttgaattctttagcagcagagcccaagatggggattcttgcacaagcgatttattgagaatacatctgaggaaatttatgaagcagtgaggggagcaggatagggaaggggaagaagctgatcaaagacatggtttctgaagtccagcgtagatccctgatttcacagg

SEQ ID NO: 199477 - DNA, 601 bp, Human
tacccattcttactaagattttaggctatgaatgtcataaaaaccactaaccaagagtgtatctactaggttagactcactcttgtttgcaatcagagaggtattgtgagtggctgggatggatttttttggaccttaaacaaatagactaagcataacggaatgcttgtattacatacttactggtccactaaaagtgggttggacattcctggtggcctgtgagatcaagaggcttatatttctgtgtcttctcagagtctagcacaaagctttatatgtgataagtaggtgaatgatrataaactccttcaagagggagtccctctgtatcaaagatattgtgactgcaatgacacaaccttcttcctatccctttattttaccatcacaggactatctcaggacacaacttgtagttagacttatcctctacctttcccattatgtcataccatttgcacagggacttaaccctctaattcattctcatactagctaagagaattgggctatttgtgagttgaaaagtagctaagtagcatttcaaaatgttattttagcctggatatatatttggagttgctttgaaaatgtcctt

SEQ ID NO: 199478 - DNA, 601 bp, Human
tccccaactcccaggccgtggactggtaccgttctgtggcctgttaggaactgggccacacagcaggaggtgagtggctgcgagcattaccgcctgagctccgcctcctgtcaaatcagcagcagcattagattctcataggagcccaaactctattgagaactgcacatgtgagggatctaggttgcagcactccttatatccttatgagaatctaactaatgcctgatgatttgaggtagaacagttttatccccaaaccgtccctccactgccccccaccaacctcccatctgtggawgttgtcttccaccaaagcaagtccctggtgccaaaatggttgggaaccactgccctagaccatctgatcgtatactcagagggcaagatgcaggcatcaggcatcaggttttttgtttgtttgtttgttttttagacagggcctcgctctgtcacccaagctgaagtgcactggtacagtcatggctcactgcggccttgaactcctgggctcaaacaatcctgccttagcttcccgagtagctgggactacaggctcacgccaccatgcctggccaatttttttttttttttttttggt

SEQ ID NO: 199479 - DNA, 601 bp, Human
ggaagttgtcttccaccaaagcaagtccctggtgccaaaatggttgggaaccactgccctagaccatctgatcgtatactcagagggcaagatgcaggcatcaggcatcaggttttttgtttgtttgtttgttttttagacagggcctcgctctgtcacccaagctgaagtgcactggtacagtcatggctcactgcggccttgaactcctgggctcaaacaatcctgccttagcttcccgagtagctgggactacaggctcacgccaccatgcctggccaatttttttttttttttttttggtagagacagggactcacatggtgcccaggctggtcttgaacccctggcctcaagcaatcctcctgcctcagcctcccaaagcactgggattataggtgtgagccactgcccccagccaagtattttttaaagttatctagatgatcccagtgtatagccaaaattgagaatcactagcataggatattggctttgacacttacctgattgtaaaatcacttgggatgtatatccatttgagttctccaggaagtaagtatcaagatggaactaaaagtgcaagagatttattggggaa

SEQ ID NO: 199480 - DNA, 601 bp, Human
atcctactgcacctttttgcaggagaaagggtttggagtacagtacttcctctaaaaaaattcttttttttttttttttttttttgagacagagtctcactctgtcacccaagctggagtgcgatggcatggtctcagctcattgcaacctcctcctccagggttcaagtgattctcctgcctcagcctcccaagtagctgggactacaggtgcccaccaccacacccagctaatttttgtatttttagtagagacaaggtttcactatgttggccaggcttgttttgaactcctgacctygtgatccgcccacctcagcctcccaaagtgctgggattacaggcatgagccaccgcacccggccaagacattctttacagatccttttcctttccaacccccatctcatattaaaaaaaaaaaaaaaaattcttgaagtgcttgagggagttcagagttgtgcagcaggatcagccatttgctttctaaattctgcaaataatgatctgtctcataaatcttggaatcttgtatttgttacatgctttattggtacctcagtcaaagtttttttttaaaaaagggtggagggtaaggggt

SEQ ID NO: 199481 - DNA, 601 bp, Human
taagaaaagcatccctagattttgtaatacccagaataagtaactatcctatgttgatgaattttaattaagggttcagattcatattgttttgtatattcagaactcttatgctcaaatttgtgaacagataatttctgttcataaatatttacttattgtattattatttttgccagttttgaaaatatttgcttggtttttacctgttttttaagtcttcttatgttagttatctgttgctatgtaacaaattagcccaaaacttagtgtcttaaaacaacaaacatctattatatcmcagtttctgtagatcaggagtttgagaatggcttagctggtggtttttcatgaagctgcagttgagatgttggctaggcctgttctcacggaaaggctacactggtgctggaccatccatttctatgatggcttattcacttggcaggaagccttagttccttgtcagatgggcctctcctattctcacaacacggcagctatttctcccagagtgggtgatccaagaaagagcaagacagaagccacagtgtttcttatgacccagtcttatactgtcccttgtattgcatattagtgg

SEQ ID NO: 199482 - DNA, 601 bp, Human
ctttttctttcctctagaggctagacttattgtgcaaggctgctgaaacttaagccaaaggattcttgcttgcataggcccctattaatgccttgtccccaattttataattttatgttaattttcttaaagttagtcaccctaaatttgtaagatcaggtcctgtgaattctggatctgtcctaagtctgtaccttaacttcaactgtggggttggttgattgacttggtaactgattgttggtcgcttactcctaagcagtacctgagccctggatcttctagtcctgcttgagggacrtgtcagtcattttcaattattcgtgattgcaaacagcagcaggggtaaacaacctttaacgaaacccttgaggacaatcttaattatttcctttgaataaattcctgggcttagaattgctgggtcagagaggatggaagcttcaaggcattctttatgtattaccaaagtgccagtgaagtgtgtgtactttagaaaaatacattaatttattcagacactggaggcttgggagtagttttgcaaagggctgctctagtgcactgaaagagtatagaacctacatgggggtgacttaaa

SEQ ID NO: 199483 - DNA, 601 bp, Human
cgtcaaaatgagtgaggaaggtaaaatatagacatgaaagggaaaagcagtatagcaaaactttgaaaggaaaagaagacatgttaattaagccttgtatcttacgtctctcttctcgaagaaattattctttgttacttaattcaatattttgcagtctaagatatttgcttcatgctaattaactacctgttttacaggtgaaaagatgtgttgtctctagggaaagggagggagaagaatgtgctggaagtggtagggggagagcacagaccccaaagtcagcacggactctgcaggyggcagagtagagcgttcccatgttgagggacctgcgggtgtacatctcaaagcatgtgaatgtgctctgttggtggaactagcacttctctaatcccataactgagcatttctctcaattattttgtagaccaaaattgtcactaatcggaggatcctagatccctgtgtaagtgtgggggtgatcttgcttttcccagccctggtgactgaacccagctctgtagccatatcacactgagcacagagccccagacccagcttctctcagagtacttgcttgagtggtcccgctgtcact

SEQ ID NO: 199484 - DNA, 601 bp, Human
atggaccggttactcagctgcagggctgacaactgtaacaccctgtgatataaataaatgctgcctggctggcgtgcagcctccagagcggacgtctttcacaccccaccccgtcccctcctccttctctgccccagacgccctggagtccaaagtggttgggtgcactggcttcctttctggagacgtgcttcctgctccctctcctgggacacatcaagacggctgtgcttaggcacagagcgagtgctcggaaatggaagatgtgctgggctttttgctttgttaaagttgtcagagygttgttcagtgaggaataggaggcaattccaagccaaggagaacatatccttgatttgcatgaaggttgagaattaaaagaacaagctagatagttctggtgagctgtctgatgtagtcaccactagccagatatattggtatgtaaattaactaaaaataaaatttaaaatgcagcttctcagttgcacttgccacatttcaagtactcagtagccacatggggctagtagctactgcattggacacaacacagagagaacattttcatcatcacggaaagttctactgggcagtgtgg

SEQ ID NO: 199485 - DNA, 601 bp, Human
atggatttcagaagaaaggagctctgctttacgctgagccaccgagttctctgaactgcaaatccttttagccaagtggatttggcgatcaaccaaagcagaataaaatgttttatcccaaccttcctttttgccagaaggagtcctaggaagccgatgtaagtccaagattgggaaaaatctacagtctttgaaaccacgggctcacttggtccaccaatgtctgttctgaccaaaaaggacttctgtgttgagtttaaattagcaacagtagcaacaataacaccaaaagcagcaacartgtatctgaatattcagtagatgtcaagtgctatctacattggtactcataccagctcatttaatgttcccaacagtcctttcagctggtagccatttgggctgccataacaaactgttataggttgggttgcttataaatgacagaatttatttctcacagatctagagccttggaagtccaagatcagggccccagcagatttgctgtctggtaagcacctgtttcttggttcatagatagtggtgttctcactctaagctcacacagtgaaagggatgagggagctctctggggcca

SEQ ID NO: 199486 - DNA, 601 bp, Human
ctctacataaatctgcatttttgtgcattcatttacaccctgtctgcttccaaaaaggatctgagatggctactttaaatggagatctttgggattgtaaatcctagaattttgcctgcctgtttcttctctgtgctcttggaaagccaaggagcagatgggaggccacccttgttatggggagctccagctcccaccccaggctccagataagtctgggaggtagatctacagttccaggatgggatacttttttaaaaagtaaatgtaaatgtattgccatatttctcttgaaaaaaaattatcacaagaaaccaacaagaagatatcaaggctttttcttagatctgccagaagtctgtaatttgctctatcccttggattttagtgttcacttgctgctttcagatgtggaaggaaaacctcagtccttttgccttgcctccttctccagttgcctcccctcagtgtgtctgccaagacctgagccccaggccagggcagcagcctctgacctttcactccctaacacacaagctggggaccaatgtcactccaaggttggaccctgcccccgtgcctctgcttttcccagttgggc

SEQ ID NO: 199487 - DNA, 601 bp, Human
gctccagctcccaccccaggctccagataagtctgggaggtagatctacagttccaggatgggatacttttttaaaaagtaaatgtaaatgtattgccatatttctcttgaaaaaaaattatcacaagaaaccaacaagaagatatcaaggctttttcttagatctgccagaagtctgtaatttgctctatcccttggattttagtgttcacttgctgctttcagatgtggaaggaaaacctcagtccttttgccttgcctccttctccagttgcctcccctcagtgtgtctgccaagacctgagccccaggccagggcagcagcctctgacctttcactccctaacacacaagctggggaccaatgtcactccaaggttggaccctgcccccgtgcctctgcttttcccagttgggcatggactccaccaatttcattctctgacttagcgttatgtggtgtggattgtactgctctccctccatttactgtaacctaggctctccaggataaaaattattattgccaaccttttatgaatactttctatatgccagaaccactgtgttcatagttccctttatgcagagcaggctacca

SEQ ID NO: 199488 - DNA, 601 bp, Human
attgccatatttctcttgaaaaaaaattatcacaagaaaccaacaagaagatatcaaggctttttcttagatctgccagaagtctgtaatttgctctatcccttggattttagtgttcacttgctgctttcagatgtggaaggaaaacctcagtccttttgccttgcctccttctccagttgcctcccctcagtgtgtctgccaagacctgagccccaggccagggcagcagcctctgacctttcactccctaacacacaagctggggaccaatgtcactccaaggttggaccctgccccygtgcctctgcttttcccagttgggcatggactccaccaatttcattctctgacttagcgttatgtggtgtggattgtactgctctccctccatttactgtaacctaggctctccaggataaaaattattattgccaaccttttatgaatactttctatatgccagaaccactgtgttcatagttccctttatgcagagcaggctaccactcccgaagcacagagaagccaagtcacttgtccaaggttacccagcaagtaagtaaattacagagttgtgctttgaaccaaggtgggactg

SEQ ID NO: 199489 - DNA, 601 bp, Human
agctggcacactcctgggtgtgacttcggatacactctttagggcctattctactactccaccatgcctgtcccatctcagggccttcagtaaaagtctgtggtcctggttggtgatgagattcctttgagggagggaaaggagaccaggtagctagaggagccatagcaatagttgtcagctgcatagttggataattggtttggacttagcgggaattagtgggcgatggaattaccacggtccagattccgtcagaagtggcatgccttagcttgatgacgtatctgttttctatcascacaatattgctgcatccctaacaaaccaccccaaaacttagtggcttaaatcaaccaccacctgtagcttattctctggttggcagcttaggttgggttcagctgggtggttcttctgttctctccaggactcactcatgcatctgtggtcaacttctgggttagctggttggctggctggcaaaggatggcttcagctgggagggcttatttttgctccatatgtatttcatcctcttgcaggctagcctgggcttgtacacatggtggttgggtagggtaccaacagaacaatcaga

SEQ ID NO: 199490 - DNA, 601 bp, Human
ttgagggagggaaaggagaccaggtagctagaggagccatagcaatagttgtcagctgcatagttggataattggtttggacttagcgggaattagtgggcgatggaattaccacggtccagattccgtcagaagtggcatgccttagcttgatgacgtatctgttttctatcaccacaatattgctgcatccctaacaaaccaccccaaaacttagtggcttaaatcaaccaccacctgtagcttattctctggttggcagcttaggttgggttcagctgggtggttcttctgttctctscaggactcactcatgcatctgtggtcaacttctgggttagctggttggctggctggcaaaggatggcttcagctgggagggcttatttttgctccatatgtatttcatcctcttgcaggctagcctgggcttgtacacatggtggttgggtagggtaccaacagaacaatcagaggcttgcatgatttcttgaagcctaagctcagaagtcaaaccatgcccctctgccacattcttttggccaatgtaagtcacaggtccagactacatcaagaggaggcagaaacacatttcatctct

SEQ ID NO: 199491 - DNA, 601 bp, Human
atttttgctccatatgtatttcatcctcttgcaggctagcctgggcttgtacacatggtggttgggtagggtaccaacagaacaatcagaggcttgcatgatttcttgaagcctaagctcagaagtcaaaccatgcccctctgccacattcttttggccaatgtaagtcacaggtccagactacatcaagaggaggcagaaacacatttcatctcttgacaagagaagctgcaaagtcacactgaaaagagcagggatacaggaaggatggggaattgtggccactttgtaatatattacyggtggtgaaagcatcctggctgtccctgaattactgtgacagtctgaataaattcctgcccagcgcaccagaaaagggaacaaggttctattaacctaaatagcaaacacagagagaggctctctaaaagaaaatgtttactcaggaatagggcattgcagtgggaatacatgtgtcacagtaatctgcatgaatattcagggaggtaaaggaaaacaaaggcttttaaaggaaaaatgaggattacttaattgttttgagataattatctttggatacaaggatcagtgacaagggtgg

SEQ ID NO: 199492 - DNA, 601 bp, Human
aacctaaatagcaaacacagagagaggctctctaaaagaaaatgtttactcaggaatagggcattgcagtgggaatacatgtgtcacagtaatctgcatgaatattcagggaggtaaaggaaaacaaaggcttttaaaggaaaaatgaggattacttaattgttttgagataattatctttggatacaaggatcagtgacaagggtggcaccagtttgaggttggatagagagttgctaggtagatttcctcacagaaggtgtgagtgtgtgtgtgtgtgtgtgtgtgtgtgtgtgtgtggaaggttgtgatggcctttgtgcaagattgtgtttttgcagatttttttgtgctagttcttgttatcagttgtttatgcatgaaaacctttccttcatggcgtcccacagctctatttgtcagggttttttttttttttttaaacataagtgactccattttgattctgacaacttttgcaattctaaggatctatgagctcttgggtgctgccaggagttagaactgggatgagttgagtgtcaaggtgtttgacctactactgcccagcagtctaacatttctttgaacacctactttg

SEQ ID NO: 199493 - DNA, 601 bp, Human
aaaaatgaggattacttaattgttttgagataattatctttggatacaaggatcagtgacaagggtggcaccagtttgaggttggatagagagttgctaggtagatttcctcacagaaggtgtgagtgtgtgtgtgtgtgtgtgtgtgtgtgtgtgtgtgtaaggttgtgatggcctttgtgcaagattgtgtttttgcagatttttttgtgctagttcttgttatcagttgtttatgcatgaaaacctttccttcatggcgtcccacagctctatttgtcagggttttttttttttttttaaacataagtgactccattttgattctgacaacttttgcaattctaaggatctatgagctcttgggtgctgccaggagttagaactgggatgagttgagtgtcaaggtgtttgacctactactgcccagcagtctaacatttctttgaacacctactttgtagcaggcactatgatgggtgttttataaacattcttttgcttaaaccttacaagaaaccttcttaggtacacttttattcctcctgttttacagaagaggaaaactgaggcttggagtgtttaagacacttgtctaaga

SEQ ID NO: 199494 - DNA, 601 bp, Human
ttgtgctagttcttgttatcagttgtttatgcatgaaaacctttccttcatggcgtcccacagctctatttgtcagggttttttttttttttttaaacataagtgactccattttgattctgacaacttttgcaattctaaggatctatgagctcttgggtgctgccaggagttagaactgggatgagttgagtgtcaaggtgtttgacctactactgcccagcagtctaacatttctttgaacacctactttgtagcaggcactatgatgggtgttttataaacattcttttgcttaaaycttacaagaaaccttcttaggtacacttttattcctcctgttttacagaagaggaaaactgaggcttggagtgtttaagacacttgtctaagagacacagcttgtcagcagtagaggcaggacttaaaccctatgttactgcctgtgcttcttacactttatcaccatgcataactttcccataaagcttagaagccaggtagaactactggcttaaaaccctagaaagcagtcagtatccactgcttaaataccaggagcctcagtttccccaaatataagaagagcttatgaggcctt

SEQ ID NO: 199495 - DNA, 601 bp, Human
tctgaggaccacacttgaagtagcaagcaaagcagagaagtagcttgatgctttgttgatggcagcctgttggtggggacactcaggcccttttatgtggtaaccatagcagaaaggaacatagtcttgttgagagtaccaggagagttggggcgatgtttgaagtggctaggatgtctttttataacttagcagatggcatcttttcagtggcttgttctgaactctgggccatggtaatctctgtatcccttgggatcagcctggtaaacagccagctgaattaacttcagaaaagacycactcatgggctggcctgcggtagtcttgctggatggtggcctaggtacagagcagtgctgggctgcggaggaagccacgatgttctgtaaacacatagatacaagcacattcccgcgtgccacctcgtgagtgtcatgcatgtgtgtgcatgcccccttatctctagcctgattttccattgcacaggatttgggaaaaacctttcatctgaccagctgatcagaagttttgaactgaaaggttgttatcagggtttgaatcagctattgttgttagaaccattgagtaccttgggctt

SEQ ID NO: 199496 - DNA, 601 bp, Human; identical to SEQ ID NO: 24351

SEQ ID NO: 199497 - DNA, 601 bp, Human; identical to SEQ ID NO: 24352

SEQ ID NO: 199498 - DNA, 601 bp, Human; identical to SEQ ID NO: 24353

SEQ ID NO: 199499 - DNA, 601 bp, Human; identical to SEQ ID NO: 24354

SEQ ID NO: 199500 - DNA, 601 bp, Human; identical to SEQ ID NO: 24355

SEQ ID NO: 199501 - DNA, 601 bp, Human; identical to SEQ ID NO: 24356

SEQ ID NO: 199502 - DNA, 601 bp, Human; identical to SEQ ID NO: 24357

SEQ ID NO: 199503 - DNA, 601 bp, Human; identical to SEQ ID NO: 24358

SEQ ID NO: 199504 - DNA, 601 bp, Human; identical to SEQ ID NO: 24359

SEQ ID NO: 199505 - DNA, 601 bp, Human; identical to SEQ ID NO: 24360

SEQ ID NO: 199506 - DNA, 601 bp, Human
gcccacggtgcttaccaagcattatgaagtctcagggaccgaaattcaccaagcctcagccaagtgacctaacagctgccttggttttctggtaatgccaggtgctgtgttgccttgggaaacttaccttctctctctggacctcagtttccttgtccgaatattcagtggttggcccagatgatctctacagccccaggcagctccaagtcagtcattaggctcccacacagcttctggctgcactgtggacagatgtcctgaggctggggggagaggagacccaggattcataaagcarcagctggacagaaacctgacactctgaactttcagcatttcatgacatttgaggtctgactttccttcccatgtggtcctgcagcccaggcagatgctggagaattgggcgcatcctgaatgtggttttaagagctcctcgccaaggggcacttggaaggaaaatgtatcctctcagacttagaaccttcaaatgcctgggcatcgaggacagtcactaatagtgattgagtcagtcactatttagcccagtcgaatctgagctttaagcgttcagaaaacacggttattttcttcagtt

SEQ ID NO: 199507 - DNA, 601 bp, Human
gggacccttctgggtactgaggtgacacaggtagggtgctctgggaaacgtcccccacagaagagccagcaagatctctgcaggaggcacaaaccctctcccctatagagtgagccttcctttggtttttctttctcctctgtatcagcatttgatcagctctggctgggccatgtagggaaatgaaactctggccctgtttatatctgtattgtcccaaacagaagaagaacaaacttcatcttaaaaatagaggatgatataatcaatcaagagtggagggatcgttggtttcagaaaygcaaagcatgtgtcaagcctgggtttccactgccccagtttactcctcctttttcctaaggaagaaaaaggaaaagcctctggaacaaccggtggggcagctcttcaggctgagaaggagcgatgggctcagcagggtgatggaggcagtgattgttgaaccatactagttatgcataggaccagtactttggttttcccagaagatgacatgttgtgacagggacacatgatggtccctgatgattcctctatatataccacaagcacaaggacagccctctgaagagggaggtggagt

SEQ ID NO: 199508 - DNA, 601 bp, Human
atcgttggtttcagaaacgcaaagcatgtgtcaagcctgggtttccactgccccagtttactcctcctttttcctaaggaagaaaaaggaaaagcctctggaacaaccggtggggcagctcttcaggctgagaaggagcgatgggctcagcagggtgatggaggcagtgattgttgaaccatactagttatgcataggaccagtactttggttttcccagaagatgacatgttgtgacagggacacatgatggtccctgatgattcctctatatataccacaagcacaaggacagccctcygaagagggaggtggagttcaatgtccatgtgtacgcaggtccacgaggctcataattctgcattactttctattaagtagctgtggatcatcagtaggccagtgttgatctgaggtctttacacattctctcatctaatcttcccagaagctgtgaaaaatgtttgtttcttttttttcttgggtctgattacaggtattttattttggaaattgttctagaagacaccagtgaggcagggggaagtaagaatgggaagggaaggcagcccatggaagatgtactcctcagcacgttacc

SEQ ID NO: 199509 - DNA, 601 bp, Human
gaggtgctggcaggtggcagtcaggccacatcataggaacggtggtaggagctggggggagacaggtgggatgcccaaaggccagcttctgtgttgtcattctcctgtgacaggagtaagtggagactcagagtgtatgtgaattgccccaggtcactcaaacaataaatggtggagcaggattttgaagctggcctctgtctgactcagcaaaccattttgtgtcctggtaattaatggtaatttctgttagtttgttttttagggtttctaatttaaatgagaagtaaaagccagtcarcaaccctcacaaagcaagaaagggtgactgaactatcccaaaaatacaatggacttaatgatggttaaatggaactggtgaagaaattagcaaaatgattatgcccctgcccaatcttccttcccatgggcgcacacacacttttatatgctaacccattcattggcccagggtgggaaataagggatggatggggctggcatgtggagtattggggtgtaagagcagccccttagaaaaatgggggactaaattgaaagtttctgtagttcttggccctgtaagaggagaggggtagaa

SEQ ID NO: 199510 - DNA, 601 bp, Human
tctgtctgactcagcaaaccattttgtgtcctggtaattaatggtaatttctgttagtttgttttttagggtttctaatttaaatgagaagtaaaagccagtcaacaaccctcacaaagcaagaaagggtgactgaactatcccaaaaatacaatggacttaatgatggttaaatggaactggtgaagaaattagcaaaatgattatgcccctgcccaatcttccttcccatgggcgcacacacacttttatatgctaacccattcattggcccagggtgggaaataagggatggatgggkctggcatgtggagtattggggtgtaagagcagccccttagaaaaatgggggactaaattgaaagtttctgtagttcttggccctgtaagaggagaggggtagaagatgctgagtatttttctagaagactggactggacgggtggggctgggaggatgccggccgtagtgagagggctcttgtctgtgctctgttggctttaggcatctccacctccctgttttgtggtttaaactagacctactatggcttttaaggccaccattatttcctcaatgtggagaaactcagtaatgcaag

SEQ ID NO: 199511 - DNA, 601 bp, Human
aaccattttgtgtcctggtaattaatggtaatttctgttagtttgttttttagggtttctaatttaaatgagaagtaaaagccagtcaacaaccctcacaaagcaagaaagggtgactgaactatcccaaaaatacaatggacttaatgatggttaaatggaactggtgaagaaattagcaaaatgattatgcccctgcccaatcttccttcccatgggcgcacacacacttttatatgctaacccattcattggcccagggtgggaaataagggatggatggggctggcatgtggagtaytggggtgtaagagcagccccttagaaaaatgggggactaaattgaaagtttctgtagttcttggccctgtaagaggagaggggtagaagatgctgagtatttttctagaagactggactggacgggtggggctgggaggatgccggccgtagtgagagggctcttgtctgtgctctgttggctttaggcatctccacctccctgttttgtggtttaaactagacctactatggcttttaaggccaccattatttcctcaatgtggagaaactcagtaatgcaagttctctgttccacgtt

SEQ ID NO: 199512 - DNA, 601 bp, Human
taatgatggttaaatggaactggtgaagaaattagcaaaatgattatgcccctgcccaatcttccttcccatgggcgcacacacacttttatatgctaacccattcattggcccagggtgggaaataagggatggatggggctggcatgtggagtattggggtgtaagagcagccccttagaaaaatgggggactaaattgaaagtttctgtagttcttggccctgtaagaggagaggggtagaagatgctgagtatttttctagaagactggactggacgggtggggctgggaggatgcyggccgtagtgagagggctcttgtctgtgctctgttggctttaggcatctccacctccctgttttgtggtttaaactagacctactatggcttttaaggccaccattatttcctcaatgtggagaaactcagtaatgcaagttctctgttccacgttaggggtcacattatggttaaagacaatgggaagattttagagtttgacaggacctttcagataccacctagaacagcctcctgtctttcatgaggtccagagaggtgatggcctgagtttttctttctaatctgttattcacat

SEQ ID NO: 199513 - DNA, 601 bp, Human
ttttatatgctaacccattcattggcccagggtgggaaataagggatggatggggctggcatgtggagtattggggtgtaagagcagccccttagaaaaatgggggactaaattgaaagtttctgtagttcttggccctgtaagaggagaggggtagaagatgctgagtatttttctagaagactggactggacgggtggggctgggaggatgccggccgtagtgagagggctcttgtctgtgctctgttggctttaggcatctccacctccctgttttgtggtttaaactagacctactwtggcttttaaggccaccattatttcctcaatgtggagaaactcagtaatgcaagttctctgttccacgttaggggtcacattatggttaaagacaatgggaagattttagagtttgacaggacctttcagataccacctagaacagcctcctgtctttcatgaggtccagagaggtgatggcctgagtttttctttctaatctgttattcacatgccacacaatggagaggcagagtagcttggtggccaatgcacagattctggacacagactgccggagttcaagtcccggctctgct

SEQ ID NO: 199514 - DNA, 601 bp, Human
tattggggtgtaagagcagccccttagaaaaatgggggactaaattgaaagtttctgtagttcttggccctgtaagaggagaggggtagaagatgctgagtatttttctagaagactggactggacgggtggggctgggaggatgccggccgtagtgagagggctcttgtctgtgctctgttggctttaggcatctccacctccctgttttgtggtttaaactagacctactatggcttttaaggccaccattatttcctcaatgtggagaaactcagtaatgcaagttctctgttccacrttaggggtcacattatggttaaagacaatgggaagattttagagtttgacaggacctttcagataccacctagaacagcctcctgtctttcatgaggtccagagaggtgatggcctgagtttttctttctaatctgttattcacatgccacacaatggagaggcagagtagcttggtggccaatgcacagattctggacacagactgccggagttcaagtcccggctctgctacttcctcttattaacagtgtaatctcagatgggttatttaagttctctgtgcctaaccaacctcaag

SEQ ID NO: 199515 - DNA, 601 bp, Human
taaatattctcagaaggtgtctaacatatcctgttttagtgactagataatgaagggtagaaagctggatattcctaaaatgattttaagagcccttggcaagttataatttctcaaatactgttgaagatcatattggcacaatttggttggtaagtgttccttccctctttttgtagatgacctaaaactttaactcatgccatgtttaaatgttcttaaatttgggattgttgaagtctgaattttactgtgctttaaaattgtgatggaaaaacttcctatggattccaaagatttstgtaccactctattatcagggaatgactggcttttatttctagtgtgtgtttgcatttcctaggacagtgatcatttccagggaaggaaatagattacccattcaaaggtgaagatttttttcccctttaatgttaaaagtggtctccacaagggataaaaatcaacgaaggtccatttacaaatgaaaaggaattggggttttgttgtatttttgttttgtttttgttttggagagaaccataaaaggctaagttgatccatttaaaaattcaagaacaagcctcataaatttttatta

SEQ ID NO: 199516 - DNA, 601 bp, Human
aaatcaacgaaggtccatttacaaatgaaaaggaattggggttttgttgtatttttgttttgtttttgttttggagagaaccataaaaggctaagttgatccatttaaaaattcaagaacaagcctcataaatttttattaaataaagacctctacatttacataggattttatggtttccaaggagctttaataaacatatcttatttaaataaatagagcaaattaaagagaagaggatgcagttgtacattatggccagttaaacagagagggattctgagggggaggaagggagggwggccccagaggacagccatggctgtaaggaggaggccagaggtctccagcagggcctctctggggctttccaggtttccttggagccaagaattttaatcttgggcaaacctgtctcctatacttcaaacgtgtttccatgtattacgtggaattatagactacctaaactgcatcttttgtttctctcagaaaaattcacagattcagattcacctaatatttattgagcacctacctggtgccaggggttgtgctaggtacttaacatttttgatcttactgagtaatcacatcattc

SEQ ID NO: 199517 - DNA, 601 bp, Human
tggtttccaaggagctttaataaacatatcttatttaaataaatagagcaaattaaagagaagaggatgcagttgtacattatggccagttaaacagagagggattctgagggggaggaagggagggtggccccagaggacagccatggctgtaaggaggaggccagaggtctccagcagggcctctctggggctttccaggtttccttggagccaagaattttaatcttgggcaaacctgtctcctatacttcaaacgtgtttccatgtattacgtggaattatagactacctaaactgmatcttttgtttctctcagaaaaattcacagattcagattcacctaatatttattgagcacctacctggtgccaggggttgtgctaggtacttaacatttttgatcttactgagtaatcacatcattctcagataagtattcttatccttgttatacagatgagaaaactgaggcccagggagcttgatgaaggtcacaggcttattagtcagaggaggggttgacggcttttaagtgtgtagtaggtttctttgtagctacctgttctgttgggatcctggttttcttggtgattactga

SEQ ID NO: 199518 - DNA, 601 bp, Human
tcaatggcataattttatgaatttttgggacactacactatagacttgttaagctatgtttcagttttgcaattatagatacactctgtagacaagtcccagtaggtacagagggcagacgtgggtcctcagactgataaaatgtagccaggagaccaatctgctctagtctggagtggctgcttactgggaacatttggtttcagtatctgcacagcagtttgtctgtccatgctttggtgccagttatttcatgagtctttttatttttattttttggttatatagatcagaggtttcygtgttgcccaggctggcctcgaacgtctagcctcgccttcttatgcgccaggacaacaggcctgagccactgcagctccctatttcatgagtcttttagctttggtcccaaaattgaattctgctcagttctgagctggggttctcactgaaatgtgactgtcccatgttcagggtcacttttttttttctgagagtagagcatgacataatgcatagtaagttgcatgtctatatatacattattatgtgcctgtattattacttgctgctgaagtagggagttggcaaaatgggttgc

SEQ ID NO: 199519 - DNA, 601 bp, Human
ctgcacagcagtttgtctgtccatgctttggtgccagttatttcatgagtctttttatttttattttttggttatatagatcagaggtttccgtgttgcccaggctggcctcgaacgtctagcctcgccttcttatgcgccaggacaacaggcctgagccactgcagctccctatttcatgagtcttttagctttggtcccaaaattgaattctgctcagttctgagctggggttctcactgaaatgtgactgtcccatgttcagggtcacttttttttttctgagagtagagcatgacayaatgcatagtaagttgcatgtctatatatacattattatgtgcctgtattattacttgctgctgaagtagggagttggcaaaatgggttgctaagttctaggtaaagggaacgctttaaagattacaaaactccttttttggtaatattaaaaaattattggccaggcgtggtggctcatacctgtaatcccagcactttgggaggctgagactggcagatcacctgaagtcaggagttcgagaccagcctgaccaacatggtgaaaccctgcctctactaaaaaatacaaaaattacct

SEQ ID NO: 199520 - DNA, 601 bp, Human
acagcagtttgtctgtccatgctttggtgccagttatttcatgagtctttttatttttattttttggttatatagatcagaggtttccgtgttgcccaggctggcctcgaacgtctagcctcgccttcttatgcgccaggacaacaggcctgagccactgcagctccctatttcatgagtcttttagctttggtcccaaaattgaattctgctcagttctgagctggggttctcactgaaatgtgactgtcccatgttcagggtcacttttttttttctgagagtagagcatgacataatrcatagtaagttgcatgtctatatatacattattatgtgcctgtattattacttgctgctgaagtagggagttggcaaaatgggttgctaagttctaggtaaagggaacgctttaaagattacaaaactccttttttggtaatattaaaaaattattggccaggcgtggtggctcatacctgtaatcccagcactttgggaggctgagactggcagatcacctgaagtcaggagttcgagaccagcctgaccaacatggtgaaaccctgcctctactaaaaaatacaaaaattacctgggc

SEQ ID NO: 199521 - DNA, 601 bp, Human
tccctatttcatgagtcttttagctttggtcccaaaattgaattctgctcagttctgagctggggttctcactgaaatgtgactgtcccatgttcagggtcacttttttttttctgagagtagagcatgacataatgcatagtaagttgcatgtctatatatacattattatgtgcctgtattattacttgctgctgaagtagggagttggcaaaatgggttgctaagttctaggtaaagggaacgctttaaagattacaaaactccttttttggtaatattaaaaaattattggccaggygtggtggctcatacctgtaatcccagcactttgggaggctgagactggcagatcacctgaagtcaggagttcgagaccagcctgaccaacatggtgaaaccctgcctctactaaaaaatacaaaaattacctgggcatggtggggtgcatctgtaatcccagctacttgggagggtgaggcacgagaatcactggaacctgggaggcggcggttgtggtgagccaggattgcatcactgcactccagtctgggtgacagaatgagactctgtctcaaaaaaaaaaaaaatattgtaaaaa

SEQ ID NO: 199522 - DNA, 601 bp, Human
tgccatgccattatcaccaccatccatccccagaacttttgcatcatcccaaactaaagctctgtacccattaaacatgaactcctcattccctgcttcccctagtccctggcaactgccattctactttgtctctgaatttggatactctagacacctcatgtaagttgaatcatacagtatgtgcccttttgtgactggcttgtttcacttagcataatgtcctcaaggtgtatccatattgtagcatctgtcagaattttcttcctttttaaaggaaggaatatttaataatattccrttgtatgtgtgtgccccacatttatctattcatctgtttataaaacattttctttggatgataagaatgttttcactggaaatgtgctttgtgaagcataagggagtggcagaagcagatcagaagttgggagccttgctcttgggtcctgatgctgaggctaatcagcagtgtagctttaaacaaaccacttgctctttctgagcaaaaatattccatttgtaaataaatggacagagttagagttattaggcattccctaaagatcttttccccttttaaaatctttctttcatttaa

SEQ ID NO: 199523 - DNA, 601 bp, Human
actaaagctctgtacccattaaacatgaactcctcattccctgcttcccctagtccctggcaactgccattctactttgtctctgaatttggatactctagacacctcatgtaagttgaatcatacagtatgtgcccttttgtgactggcttgtttcacttagcataatgtcctcaaggtgtatccatattgtagcatctgtcagaattttcttcctttttaaaggaaggaatatttaataatattccattgtatgtgtgtgccccacatttatctattcatctgtttataaaacattttstttggatgataagaatgttttcactggaaatgtgctttgtgaagcataagggagtggcagaagcagatcagaagttgggagccttgctcttgggtcctgatgctgaggctaatcagcagtgtagctttaaacaaaccacttgctctttctgagcaaaaatattccatttgtaaataaatggacagagttagagttattaggcattccctaaagatcttttccccttttaaaatctttctttcatttaattctaagtttctggctttatgcactttgtgtttcatgcacaccatagcttag

SEQ ID NO: 199524 - DNA, 601 bp, Human
gctctgtacccattaaacatgaactcctcattccctgcttcccctagtccctggcaactgccattctactttgtctctgaatttggatactctagacacctcatgtaagttgaatcatacagtatgtgcccttttgtgactggcttgtttcacttagcataatgtcctcaaggtgtatccatattgtagcatctgtcagaattttcttcctttttaaaggaaggaatatttaataatattccattgtatgtgtgtgccccacatttatctattcatctgtttataaaacattttctttggrtgataagaatgttttcactggaaatgtgctttgtgaagcataagggagtggcagaagcagatcagaagttgggagccttgctcttgggtcctgatgctgaggctaatcagcagtgtagctttaaacaaaccacttgctctttctgagcaaaaatattccatttgtaaataaatggacagagttagagttattaggcattccctaaagatcttttccccttttaaaatctttctttcatttaattctaagtttctggctttatgcactttgtgtttcatgcacaccatagcttagtcatca

SEQ ID NO: 199525 - DNA, 601 bp, Human
atctttctttcatttaattctaagtttctggctttatgcactttgtgtttcatgcacaccatagcttagtcatcagttattttcataaaatgttctcgcttcctctttaacctagctgtttaatttatttacattttttcccccatttatatggtggtcccttgtaaactgagggtagttttattctctcttcatttttctgtataattgcccttttttttttttttttttactagagctgtgtctgcccaaatgcattgtttcctgtattgtacaattatcagttatttagatttgccastctgttagaaacaaaatgcttgttcctcagtgccacaatgaaatagcacttgaacataaatttaattttctcagcaaggcaatttttacttctactgaagcgtgcgacttgtggatggagtaatggtgagagcacacctggacaggggaggggcaggggttcttattcctgttgcaggtagcccctactgctgtgtcgttcccctatttcctggggttcaactgcatagtctgagctaattccaactggctgttttaaagagagcaggagtacgatcctgagtggcggggtgagtagttt

SEQ ID NO: 199526 - DNA, 601 bp, Human
tcgcttcctctttaacctagctgtttaatttatttacattttttcccccatttatatggtggtcccttgtaaactgagggtagttttattctctcttcatttttctgtataattgcccttttttttttttttttttactagagctgtgtctgcccaaatgcattgtttcctgtattgtacaattatcagttatttagatttgccactctgttagaaacaaaatgcttgttcctcagtgccacaatgaaatagcacttgaacataaatttaattttctcagcaaggcaatttttacttctaytgaagcgtgcgacttgtggatggagtaatggtgagagcacacctggacaggggaggggcaggggttcttattcctgttgcaggtagcccctactgctgtgtcgttcccctatttcctggggttcaactgcatagtctgagctaattccaactggctgttttaaagagagcaggagtacgatcctgagtggcggggtgagtagtttggtgggaagggtggttacagaacaggtgactcaggatgatttgggtcagagcaagtgaccaggggtgactcaagatggagcaggtaaccagggtg

SEQ ID NO: 199527 - DNA, 601 bp, Human
tgtacaattatcagttatttagatttgccactctgttagaaacaaaatgcttgttcctcagtgccacaatgaaatagcacttgaacataaatttaattttctcagcaaggcaatttttacttctactgaagcgtgcgacttgtggatggagtaatggtgagagcacacctggacaggggaggggcaggggttcttattcctgttgcaggtagcccctactgctgtgtcgttcccctatttcctggggttcaactgcatagtctgagctaattccaactggctgttttaaagagagcaggastacgatcctgagtggcggggtgagtagtttggtgggaagggtggttacagaacaggtgactcaggatgatttgggtcagagcaagtgaccaggggtgactcaagatggagcaggtaaccagggtgacttaggttaaagcaggtgaccaggggaacagatctgaactactgattagaactggcgggaaagttgtttactgaaactagaggcaagggggccaaagagaaccaggaagttaaactttaaaatggaaaatcaaagaataagagagctgaacatattgacatactgattctttga

SEQ ID NO: 199528 - DNA, 601 bp, Human
aaacccacccatggcaggaagagttccacaacctggttccagctcctctaagtgacttctaagtccccttgttcaaccctatcttttgggtctcagatttggcttccccccccccctttttttttttttttttttgagaccgaatctggctctgttgcccaggctggagtgcagcggcatgatcgtggctcactgcaacctctgcctcccagactcaagccatcctcccacctcagcctcctgagtagctgggactacaggtgtgcaccaccgcatccagctaatttttgtatttttgtasagatgggggtctcactttgttccccaggctgattttcaactcctggactcaagtgatctgcctgcctcggcctcccaaagtgctgggattacaggtgtcagccaccgtgctggccagcttccccaaatgtaagggttaggtttgttacagtgcctgtgagctgctgtcaggcaaagcctgcttttcccctgcttctttgaggtggataaatgttttgttcagtagtggagagggcactagctattgtagtcctctctgcagggccatgtccctgggggcatttggagaccaagtagacat

SEQ ID NO: 199529 - DNA, 601 bp, Human
agccccagcctgagggtgcccaggagtggtctgtggaaggtctccagcaatgtcagcctcacatgtgattaatttgagtcactgtgaacatctctccacctccttgactttacccatgaaatgatttccaacatccagtcactttcctgggtatttttagtcactcactttgcagaacctttgatggtctacagaagtgaaggaatgggtttctaagtccaagctgaggtagaatcctggcattgccatttactagagctgtgtgaccttagacaattcacttaacctctctgagcctcartattcttacctgttaacaagtggggatatgggttcccagggatgagggaccggtgaaatgatatgcctggagacagctaacacaatgcctggaaaatgctaagcacttgtcaaaagtttcctacccctcttccttgccagcttaaaattataactgcagcagcagaacgcccccatttgttgggtagcagtgttgtgagctgagggggtggaggagaaaagcttatctgttagttttctttccacctggagagatcttccccctttccttccacacagcaatagtgtaaccgaatgccag

SEQ ID NO: 199530 - DNA, 601 bp, Human
tgcctggaaaatgctaagcacttgtcaaaagtttcctacccctcttccttgccagcttaaaattataactgcagcagcagaacgcccccatttgttgggtagcagtgttgtgagctgagggggtggaggagaaaagcttatctgttagttttctttccacctggagagatcttccccctttccttccacacagcaatagtgtaaccgaatgccagagcagtcccttcttcttgcggtcctctgtggacggcttgtttctttttggatggtaggaggcatccaaagcctcttttagggaagrttggtcttcttccaggagactccacactgggatggccacatcattccatttctgggtcacgttttcagctccttgggcctgcaagggatctctgtcccttctggagtaaatgaaataattgtcactagcctcccacttaatgactgtggctattgctcctctttctcgcacacgaggggaggaagtctgctggggcactgggcagcctcccttcccgatggcaccagagcctggatttttgaggtctggtggattcctgagactttccttcctcaccccagtctggacagcatccctggg

SEQ ID NO: 199531 - DNA, 601 bp, Human
taaatgaaataattgtcactagcctcccacttaatgactgtggctattgctcctctttctcgcacacgaggggaggaagtctgctggggcactgggcagcctcccttcccgatggcaccagagcctggatttttgaggtctggtggattcctgagactttccttcctcaccccagtctggacagcatccctgggcccagcctgccgcggcactcgtgggaagtggctggctggctctgctggctccacgcacagctggcatacactgacatggctgtggtttgcttctctctccttccttscccctagagtataagaagaagtacggagaggaacacggctcctgccaggctgggatagcgggcttcttcaccgaggtgggtgtctgctgtctgggcatttctgttctcttgtgggtgttcatttccttgcttatatgattttggcaacccttagaggtgggacttctggagtcccagatacttgagcctcgagggagcagattctggtcctcacaccagaggaggctatttctacctgccaggagggcaccagctggccagagaccactgggcagaggaggtggggtggctcatctcgag

SEQ ID NO: 199532 - DNA, 601 bp, Human; identical to SEQ ID NO: 24361

SEQ ID NO: 199533 - DNA, 601 bp, Human; identical to SEQ ID NO: 24362

SEQ ID NO: 199534 - DNA, 601 bp, Human; identical to SEQ ID NO: 24363

SEQ ID NO: 199535 - DNA, 601 bp, Human; identical to SEQ ID NO: 24364

SEQ ID NO: 199536 - DNA, 601 bp, Human; identical to SEQ ID NO: 24365

SEQ ID NO: 199537 - DNA, 601 bp, Human; identical to SEQ ID NO: 24366

SEQ ID NO: 199538 - DNA, 601 bp, Human; identical to SEQ ID NO: 24367

SEQ ID NO: 199539 - DNA, 601 bp, Human; identical to SEQ ID NO: 24368

SEQ ID NO: 199540 - DNA, 601 bp, Human; identical to SEQ ID NO: 24369

SEQ ID NO: 199541 - DNA, 601 bp, Human; identical to SEQ ID NO: 24370

SEQ ID NO: 199542 - DNA, 601 bp, Human; identical to SEQ ID NO: 24371

SEQ ID NO: 199543 - DNA, 601 bp, Human; identical to SEQ ID NO: 24372

SEQ ID NO: 199544 - DNA, 601 bp, Human; identical to SEQ ID NO: 24373

SEQ ID NO: 199545 - DNA, 601 bp, Human; identical to SEQ ID NO: 24374

SEQ ID NO: 199546 - DNA, 601 bp, Human; identical to SEQ ID NO: 24375

SEQ ID NO: 199547 - DNA, 601 bp, Human; identical to SEQ ID NO: 24376

SEQ ID NO: 199548 - DNA, 601 bp, Human; identical to SEQ ID NO: 24377

SEQ ID NO: 199549 - DNA, 601 bp, Human; identical to SEQ ID NO: 24378

SEQ ID NO: 199550 - DNA, 601 bp, Human; identical to SEQ ID NO: 24379

SEQ ID NO: 199551 - DNA, 601 bp, Human; identical to SEQ ID NO: 24380

SEQ ID NO: 199552 - DNA, 601 bp, Human; identical to SEQ ID NO: 24381

SEQ ID NO: 199553 - DNA, 601 bp, Human; identical to SEQ ID NO: 24382

SEQ ID NO: 199554 - DNA, 601 bp, Human; identical to SEQ ID NO: 24383

SEQ ID NO: 199555 - DNA, 601 bp, Human; identical to SEQ ID NO: 24384

SEQ ID NO: 199556 - DNA, 601 bp, Human; identical to SEQ ID NO: 24385

SEQ ID NO: 199557 - DNA, 601 bp, Human; identical to SEQ ID NO: 24386

SEQ ID NO: 199558 - DNA, 601 bp, Human; identical to SEQ ID NO: 24387

SEQ ID NO: 199559 - DNA, 601 bp, Human; identical to SEQ ID NO: 24388

SEQ ID NO: 199560 - DNA, 601 bp, Human; identical to SEQ ID NO: 24389

SEQ ID NO: 199561 - DNA, 601 bp, Human; identical to SEQ ID NO: 24390

SEQ ID NO: 199562 - DNA, 601 bp, Human; identical to SEQ ID NO: 24391

SEQ ID NO: 199563 - DNA, 601 bp, Human; identical to SEQ ID NO: 24392

SEQ ID NO: 199564 - DNA, 601 bp, Human; identical to SEQ ID NO: 24393

SEQ ID NO: 199565 - DNA, 601 bp, Human; identical to SEQ ID NO: 24394

SEQ ID NO: 199566 - DNA, 601 bp, Human; identical to SEQ ID NO: 24395

SEQ ID NO: 199567 - DNA, 601 bp, Human; identical to SEQ ID NO: 24396

SEQ ID NO: 199568 - DNA, 601 bp, Human; identical to SEQ ID NO: 24397

SEQ ID NO: 199569 - DNA, 601 bp, Human; identical to SEQ ID NO: 24398

SEQ ID NO: 199570 - DNA, 601 bp, Human; identical to SEQ ID NO: 24399

SEQ ID NO: 199571 - DNA, 601 bp, Human; identical to SEQ ID NO: 24400

SEQ ID NO: 199572 - DNA, 601 bp, Human; identical to SEQ ID NO: 24401

SEQ ID NO: 199573 - DNA, 601 bp, Human; identical to SEQ ID NO: 24402

SEQ ID NO: 199574 - DNA, 601 bp, Human; identical to SEQ ID NO: 24403

SEQ ID NO: 199575 - DNA, 601 bp, Human; identical to SEQ ID NO: 24404

SEQ ID NO: 199576 - DNA, 601 bp, Human; identical to SEQ ID NO: 24405

SEQ ID NO: 199577 - DNA, 601 bp, Human; identical to SEQ ID NO: 24406

SEQ ID NO: 199578 - DNA, 601 bp, Human; identical to SEQ ID NO: 24407

SEQ ID NO: 199579 - DNA, 601 bp, Human; identical to SEQ ID NO: 24408

SEQ ID NO: 199580 - DNA, 601 bp, Human; identical to SEQ ID NO: 24409

SEQ ID NO: 199581 - DNA, 601 bp, Human; identical to SEQ ID NO: 24410

SEQ ID NO: 199582 - DNA, 601 bp, Human; identical to SEQ ID NO: 24411

SEQ ID NO: 199583 - DNA, 601 bp, Human; identical to SEQ ID NO: 24412

SEQ ID NO: 199584 - DNA, 601 bp, Human; identical to SEQ ID NO: 24413

SEQ ID NO: 199585 - DNA, 601 bp, Human; identical to SEQ ID NO: 24414

SEQ ID NO: 199586 - DNA, 601 bp, Human; identical to SEQ ID NO: 24415

SEQ ID NO: 199587 - DNA, 601 bp, Human; identical to SEQ ID NO: 24416

SEQ ID NO: 199588 - DNA, 601 bp, Human; identical to SEQ ID NO: 24417

SEQ ID NO: 199589 - DNA, 601 bp, Human; identical to SEQ ID NO: 24418

SEQ ID NO: 199590 - DNA, 601 bp, Human; identical to SEQ ID NO: 24419

SEQ ID NO: 199591 - DNA, 601 bp, Human; identical to SEQ ID NO: 24420

SEQ ID NO: 199592 - DNA, 601 bp, Human; identical to SEQ ID NO: 24421

SEQ ID NO: 199593 - DNA, 601 bp, Human; identical to SEQ ID NO: 24422

SEQ ID NO: 199594 - DNA, 601 bp, Human; identical to SEQ ID NO: 24423

SEQ ID NO: 199595 - DNA, 601 bp, Human; identical to SEQ ID NO: 24424

SEQ ID NO: 199596 - DNA, 601 bp, Human
gtcagtcttagattacattggcttgttggtgcctttggtggggtgtgaggctgcgcagtacaggctcgtatgcaaacactgtcaggcctttgaatgcctgtgattggtgtttttatacctgctggggacagggcatcttctctcgggcctcttcttgctaggtctgttcacaaaacctttcctttaggtttctttgcagcttcttgctttggctgagaagttatcctttgttcctagttaccaagggtactggctatgagatgccacgtagagtggcaatagtgaagtgcaggccagaggmagggctgtttctatggtggccctgagggttactgggaaggatcagggttgcgcaaggggttggtcctgctactttctgatatctagggttgccagacttagcaaataaaactatagaactcctaattaaatctgaatttcagatcaccaatgaataattttttagtatgagtgtgtcccaaatattgcatgggatatacttatactaaaaacattttgctgtttatctgaaatttaaatttaacttggcatcctgttggcagattcaactctgctgatcttcctctacccaacaagtggc

SEQ ID NO: 199597 - DNA, 601 bp, Human
tcacacaccccggcttatcttccctcttccccgagaccagcccagttttggggatggggcccctcccactagccagtcaggctggaggcctctggtggatctcacagtcacaggcgaaagcccaacacctcccctcagcatcgggctctccatgccctgcctgaccttacctttctagacccatcttctgccaccacatcccctgggccccagctcttgtcatgacctgcccctttcctcctggaacctgctccttacacttctttgccttggttcttatgctcacagaagtcagaggccyggtttgtgtcatattcatgtagaaccatctaccacctgcatgatttttacatttttttggtcttaaactcatactgcctgtgatattttctttcatatttttctctttaaatcagccaacttttggtctcaaataaaataatttaaaacagaaactttgtacctttctataagcagaaaaccatctaacatgtccccaaaacagaaagtaactgtaaaaataaatatattgaagacacaacagtgtcctagaattctagctggatttcattgtttgtcaaagttgctgataaagcgccca

SEQ ID NO: 199598 - DNA, 601 bp, Human
agatgatggagaagagaatttgggatgcatggtgtgtgccaaagaataaatgcaggtgtcctgttgttactccatctgtttctggtttatgtgttcttacctggatgacagctgtgctcatcctctaatcctgtacaataccttgagagcacaggccttttgtgagatcaaatgcctatgcatgacaggcaaataagcaggctcttcaggaccagggaaacgatggcaacagttctgagtctgatgcagggatggcagagaagcccaggcagagtgcaggggcagtgatgtcattccctaytgtgaggatcagtgacaccctctagaggcatttagggaactttttttgaacagaaccatgtgtcagacactgtcaagaaggccaataacggtattattgttaaaaacaaaacaaaacaatctacactagacgagggaatatgcacatcagcttttctgagaagctgcagatgttcataagattgttcttctatgttcctgaaggatttttcaaggaactttgaaacctaagtggctgcagctccttccttgcttttgtgggcagatgctcatcctggcctggcgaagggtgggacatcac

SEQ ID NO: 199599 - DNA, 601 bp, Human
catttagggaactttttttgaacagaaccatgtgtcagacactgtcaagaaggccaataacggtattattgttaaaaacaaaacaaaacaatctacactagacgagggaatatgcacatcagcttttctgagaagctgcagatgttcataagattgttcttctatgttcctgaaggatttttcaaggaactttgaaacctaagtggctgcagctccttccttgcttttgtgggcagatgctcatcctggcctggcgaagggtgggacatcaccctggccaccaggtctcctgagagatcayaccctgggatctgcccaggtgttttggcctgtttccattttcatatccaacaaaatgcgttgggaccatggcttcaatcacattacatgctgtgagtttagagtgttggatgctggttttcagaggtgatcaaacctttttttttttcttgtttaagaaacagatagttaagaaagggagattaagttggagttaataagaactctgagaaagaggagaaagaaaaacagcaaaagtttcttctttatctggaaaataacatgctaaatctccgggtcatcttgagaaatcaaagaaata

SEQ ID NO: 199600 - DNA, 601 bp, Human
acggtattattgttaaaaacaaaacaaaacaatctacactagacgagggaatatgcacatcagcttttctgagaagctgcagatgttcataagattgttcttctatgttcctgaaggatttttcaaggaactttgaaacctaagtggctgcagctccttccttgcttttgtgggcagatgctcatcctggcctggcgaagggtgggacatcaccctggccaccaggtctcctgagagatcataccctgggatctgcccaggtgttttggcctgtttccattttcatatccaacaaaatgcsttgggaccatggcttcaatcacattacatgctgtgagtttagagtgttggatgctggttttcagaggtgatcaaacctttttttttttcttgtttaagaaacagatagttaagaaagggagattaagttggagttaataagaactctgagaaagaggagaaagaaaaacagcaaaagtttcttctttatctggaaaataacatgctaaatctccgggtcatcttgagaaatcaaagaaatagctaagaaaaaaacagttgcagggtttggcaaaaggggacaccaaccttagatatgagg

SEQ ID NO: 199601 - DNA, 601 bp, Human
cactagacgagggaatatgcacatcagcttttctgagaagctgcagatgttcataagattgttcttctatgttcctgaaggatttttcaaggaactttgaaacctaagtggctgcagctccttccttgcttttgtgggcagatgctcatcctggcctggcgaagggtgggacatcaccctggccaccaggtctcctgagagatcataccctgggatctgcccaggtgttttggcctgtttccattttcatatccaacaaaatgcgttgggaccatggcttcaatcacattacatgctgtgrgtttagagtgttggatgctggttttcagaggtgatcaaacctttttttttttcttgtttaagaaacagatagttaagaaagggagattaagttggagttaataagaactctgagaaagaggagaaagaaaaacagcaaaagtttcttctttatctggaaaataacatgctaaatctccgggtcatcttgagaaatcaaagaaatagctaagaaaaaaacagttgcagggtttggcaaaaggggacaccaaccttagatatgaggtcttctgaaaacttttaaaatttgtttattttttga

SEQ ID NO: 199602 - DNA, 601 bp, Human
ctgcagatgttcataagattgttcttctatgttcctgaaggatttttcaaggaactttgaaacctaagtggctgcagctccttccttgcttttgtgggcagatgctcatcctggcctggcgaagggtgggacatcaccctggccaccaggtctcctgagagatcataccctgggatctgcccaggtgttttggcctgtttccattttcatatccaacaaaatgcgttgggaccatggcttcaatcacattacatgctgtgagtttagagtgttggatgctggttttcagaggtgatcaaamctttttttttttcttgtttaagaaacagatagttaagaaagggagattaagttggagttaataagaactctgagaaagaggagaaagaaaaacagcaaaagtttcttctttatctggaaaataacatgctaaatctccgggtcatcttgagaaatcaaagaaatagctaagaaaaaaacagttgcagggtttggcaaaaggggacaccaaccttagatatgaggtcttctgaaaacttttaaaatttgtttattttttgaatcagtagtgtgtatagttaaaatttttaaatggttataa

SEQ ID NO: 199603 - DNA, 601 bp, Human
tcatatccaacaaaatgcgttgggaccatggcttcaatcacattacatgctgtgagtttagagtgttggatgctggttttcagaggtgatcaaacctttttttttttcttgtttaagaaacagatagttaagaaagggagattaagttggagttaataagaactctgagaaagaggagaaagaaaaacagcaaaagtttcttctttatctggaaaataacatgctaaatctccgggtcatcttgagaaatcaaagaaatagctaagaaaaaaacagttgcagggtttggcaaaaggggacrccaaccttagatatgaggtcttctgaaaacttttaaaatttgtttattttttgaatcagtagtgtgtatagttaaaatttttaaatggttataaaagttgtcaaagaaaggatgtctttcagctatcctatttttctcccaaaggcaaccacagttccattttcttaacgtgtctttcaaaagcttgtcaataaatatagaaatctgtgtgtgtacctccttttattttatgcaaatagtagtatactgtgtgcacactgtagtaaacttacttttcttttaaaacatccaacagcagaa

SEQ ID NO: 199604 - DNA, 601 bp, Human
caaaatctagctgtaccagatgaaatacaactcagcaataacaatattatgttattatgatacacacaataacatgaatgacttttgaaagcattaaactgagtaaatgaagccagacacaaaaggctacctactggatgattcatttatatgacgttctggaaaaggccaactaaggagaaagcagattggtggttttcagcggccagggtttgggggaagggctgatgatgattgacttcaaagagggatgagacaactttctggggcgatgaacatattctaagatcgtggttgtagyggttgtatggttgcatttattaaaacttaacagagtgcacacctaaaattagtgaatgttatgtatgtaaattatatctcagtcaaacttattttgttaaaaaaagtttcgtggagattattccatattggtgcatatagagctttcctgttctttttcagtagttctttttcactattccttgatttatttaacctgtccaggtggtcttctatatgtcagttccagactaacctgatctgatgcttgtagactagttatcttagtttgcttctccagaagaggctcctcttctctccc

SEQ ID NO: 199605 - DNA, 601 bp, Human
ttttgaaagcattaaactgagtaaatgaagccagacacaaaaggctacctactggatgattcatttatatgacgttctggaaaaggccaactaaggagaaagcagattggtggttttcagcggccagggtttgggggaagggctgatgatgattgacttcaaagagggatgagacaactttctggggcgatgaacatattctaagatcgtggttgtagcggttgtatggttgcatttattaaaacttaacagagtgcacacctaaaattagtgaatgttatgtatgtaaattatatctcartcaaacttattttgttaaaaaaagtttcgtggagattattccatattggtgcatatagagctttcctgttctttttcagtagttctttttcactattccttgatttatttaacctgtccaggtggtcttctatatgtcagttccagactaacctgatctgatgcttgtagactagttatcttagtttgcttctccagaagaggctcctcttctctcccctagatccatagtatcctggctgaggacccctgagagggcagcatggaggggccctggtgctctctaaggtgaccttggaca

SEQ ID NO: 199606 - DNA, 601 bp, Human
aaaaggctacctactggatgattcatttatatgacgttctggaaaaggccaactaaggagaaagcagattggtggttttcagcggccagggtttgggggaagggctgatgatgattgacttcaaagagggatgagacaactttctggggcgatgaacatattctaagatcgtggttgtagcggttgtatggttgcatttattaaaacttaacagagtgcacacctaaaattagtgaatgttatgtatgtaaattatatctcagtcaaacttattttgttaaaaaaagtttcgtggagattrttccatattggtgcatatagagctttcctgttctttttcagtagttctttttcactattccttgatttatttaacctgtccaggtggtcttctatatgtcagttccagactaacctgatctgatgcttgtagactagttatcttagtttgcttctccagaagaggctcctcttctctcccctagatccatagtatcctggctgaggacccctgagagggcagcatggaggggccctggtgctctctaaggtgaccttggacatatgtcctacagaggacaagcctctcagctatagggtg

SEQ ID NO: 199607 - DNA, 601 bp, Human
cttagtttgcttctccagaagaggctcctcttctctcccctagatccatagtatcctggctgaggacccctgagagggcagcatggaggggccctggtgctctctaaggtgaccttggacatatgtcctacagaggacaagcctctcagctatagggtgcccaaggaaaatgggagatttttcttgattcctgcagttggctttgtgcccttggcaggctctcctggtctgtaggtagcatagatggcctgaatgtttggtaaggggtgctggaaactagggcaagaaaagaggggaaggytgggatgcatagaactgatgtgtgggaaactaccttcatcatccagctcaggtgtgaagccgctgctcatgcgatatgctctgctcacacagatggcactaaggaaccgggaagctgggctttggagaccacgctggaagtcagctcactgagtgtgggttgccttgaccatctcctctgggaggccatgttgtgcatagctggagaacaaactggggatgaatcaagaagggaaagggtgtggtgaatgttcagcatgggagctgatatctccgatgagcactgtttggccattgattt

SEQ ID NO: 199608 - DNA, 601 bp, Human
tggagaacaaactggggatgaatcaagaagggaaagggtgtggtgaatgttcagcatgggagctgatatctccgatgagcactgtttggccattgatttatttcttgggtgcaatgaagggctcttaatcttctgcatttggacacttgccacagaggacattgtgattagcaaaggaaggcacaaaaattctaatccaaaggctttgcccgccttaagtccttttttgaaatggagctgatttaaatatgtaagtatggtcacagcattgacacttcagtggttatcgtaagcttatttstacagtatgtgagatgcagtttgtagcaattgctatgggtaaaatttttattttaagaggtgactttctatttacagttattcatttacactgggttcatctattaatatatactgttgatgcccttttaacactggtattctttgaagtcacacatgataatgtgttctgttttattggttttgtctttatatttgagatgtgattataaagatcccttctgcctcaaaccttgaacttagatattcattataagcatgattcccttcaaagtaatcaccttctagtcattcctgtttt

SEQ ID NO: 199609 - DNA, 601 bp, Human
tattcaatttaacttttaataatggctgtgtttaacaaccctggctcataaactttctgaaaatttaacagttggcttttggaaacccactgcagcaagctccagcacacaactgaatatgttgagggtttttttgttgttattgttgtttttaattttagattcacaaggtacaggtgcttgtttgttccatgggtatatcgcatactggtgagtattgggcttctagcatgtttgttaataagttggtcatatcactcaagtcatgcctgatacacagatgtttgattatcagagtctkttttctttcttgtttcctgtggctttttaagttgatgaataataggaaagtaaatttgtggggtcagttaaaccaccagacgacagcttttatgtttgtacattggttcagaggtactctgtattttgactggatttattggatagtgtaattgtttccatttaaaacaatggaaaagatttcatttaaatttattgagatcttatttttcaccctcattccgtgcacatttgggattctgttcgccagcccctctgcactctgaagatgcacagcagcctctctgtactctgaagacgc

SEQ ID NO: 199610 - DNA, 601 bp, Human
ttctagcatgtttgttaataagttggtcatatcactcaagtcatgcctgatacacagatgtttgattatcagagtcttttttctttcttgtttcctgtggctttttaagttgatgaataataggaaagtaaatttgtggggtcagttaaaccaccagacgacagcttttatgtttgtacattggttcagaggtactctgtattttgactggatttattggatagtgtaattgtttccatttaaaacaatggaaaagatttcatttaaatttattgagatcttatttttcaccctcattccrtgcacatttgggattctgttcgccagcccctctgcactctgaagatgcacagcagcctctctgtactctgaagacgcatgaattgctgactgttgggcttgcttggaggggactgggggttattacctcccacaggactgtttaagctctggaagttttcctacctcctgcaactgaatttagtcttaattagtacagagtgaactagctgtgaacaatctggttttcttgctttgtgccttgatcatgtgagacctaagggctggtcctgcccttttcttatccattgctttaatcaga

SEQ ID NO: 199611 - DNA, 601 bp, Human
gtaaatatttgattggcctgaagttaagtgggtaggcgtaaaaaattatggaagtattggacttgagcaaacttttgacaaatagcgctctctttctctcttgggcgtatgcgtgtgtgcatgcatgtactccagctctctgtgtatgttacacacacacacgtttttcgcataaaacatttttattttgggccaggtgtggtggctcacgcctgtaatcccagcactttgggatgctgaggcaggcagaccatctgaggtcgggagttcaagaccagcctggccaacatggtgaaacccygtttctactaaaattacaaaaattagctgggcatggtggtgggtgcctgtaatcccagctactctggaggctgagacaggagaattgtttgaatctggtaggcggaggttgcagtgagccaagattgtgccactgcactccagcctaggagaccgagcaagactccatctaaaaaaaaaaaaaaaaaatctttattttgaaataatagcagtcttacaaaaaagtcattaggatagcacaaagaaataccgtaaattcttcacccagattccctaaatgtcatttgctttgtaattttct

SEQ ID NO: 199612 - DNA, 601 bp, Human
tgggccaggtgtggtggctcacgcctgtaatcccagcactttgggatgctgaggcaggcagaccatctgaggtcgggagttcaagaccagcctggccaacatggtgaaaccccgtttctactaaaattacaaaaattagctgggcatggtggtgggtgcctgtaatcccagctactctggaggctgagacaggagaattgtttgaatctggtaggcggaggttgcagtgagccaagattgtgccactgcactccagcctaggagaccgagcaagactccatctaaaaaaaaaaaaaaaaaatctttattttgaaataatagcagtcttacaaaaaagtcattaggatagcacaaagaaataccgtaaattcttcacccagattccctaaatgtcatttgctttgtaattttctatctattcgtacttcttacctgtttgagagtaagtcggagacgcgatgcccccttatccctaacatcagggatatttcctgagaacaaggacattcttttacgtaaccatagcacaattattgaaataaggaaattaagtgatacattactgttagcttatctgcagaactcactcaaatatcaccag

SEQ ID NO: 199613 - DNA, 601 bp, Human
gcggaggttgcagtgagccaagattgtgccactgcactccagcctaggagaccgagcaagactccatctaaaaaaaaaaaaaaaaaatctttattttgaaataatagcagtcttacaaaaaagtcattaggatagcacaaagaaataccgtaaattcttcacccagattccctaaatgtcatttgctttgtaattttctatctattcgtacttcttacctgtttgagagtaagtcggagacgcgatgcccccttatccctaacatcagggatatttcctgagaacaaggacattcttttaygtaaccatagcacaattattgaaataaggaaattaagtgatacattactgttagcttatctgcagaactcactcaaatatcaccagttatcttcatgtccttggtagcaaaagaaaatcccgcactattgcatttggctgtcacatctctttagtctggaaaagtcactcagccttgctccttcatgtccttgacatttttgaagagtacaggtcagtttgtctgtttcatcatgattagattcaggatgtatattttctgcaggaataccacagaatacttgtgtcctatatatttaaa

SEQ ID NO: 199614 - DNA, 601 bp, Human
ctcagagggggatgggagtgtgtgagggatctgggcagggtggtgacctggcctgccttccatttttacaggcccctgctggcggctatgttgggaaggcctgtaggaggcggtagagcagcaggaacggggttaggagactgagcgttacccagggaagagggtggctccactggggccatagtggtaacattgtgagaagtggtcaaattctgcgtgcattttgaagggggatcctacagcatttcctgagggtttgattgtcagttgtgagggaataagatatcaagggtcactccargcttttcagcctgagtacctaaaaggatggagttgtcactggtggtgttttcaacggaaggtgcaggtgagcaggttgaaagggggaagatctggagtttgtttttagacacactggtagatgtttaagtgtgtatgcgtatgtatgagtcttcagtttgagtagtagtctgagtaagaagtatcaatttgggagtcgccagcagacagatggtatttaatgccaggagatttgatgagatcacccagggtgtgaggggagatagagaagagagggggaccaagggctgagctgtggaca

SEQ ID NO: 199615 - DNA, 601 bp, Human
aggggagatagagaagagagggggaccaagggctgagctgtggacactccaacactaagagcatcttttcctcctacccctaaaatggctctggggctccagccattgtatgtgtttttcatgcaggaagaagtgggacatgcaaaggggctctttataatctggtctgaggcccctgtaaagagcctccagtgacttctgcttataacgcattgaccatccatattttaaaagaggttggaagatgtctaagtaccagctagacatcttataaatcctatcactatagagttttgctctscagcagaactttctgtgatgaaggaaatgttccgtatcagcactgtccaatatggtggccagtgaccacatatgactgtgagcacttaaaatgtggctagtgccaataaggcattgactttttacttttctatacttttaattaatataaattcaaactgaaataacacatgtggctagtggctaccatgttggacagtgcagatattgaagtttgatttttaagaaggagagggacagacactggacagacaactcacagctcctgccacagtacagcatggagcctcccaaggcacta

SEQ ID NO: 199616 - DNA, 601 bp, Human
actaagagcatcttttcctcctacccctaaaatggctctggggctccagccattgtatgtgtttttcatgcaggaagaagtgggacatgcaaaggggctctttataatctggtctgaggcccctgtaaagagcctccagtgacttctgcttataacgcattgaccatccatattttaaaagaggttggaagatgtctaagtaccagctagacatcttataaatcctatcactatagagttttgctctccagcagaactttctgtgatgaaggaaatgttccgtatcagcactgtccaatatggtggccagtgaccacatatgactgtgagcacttaaaatgtggctagtgccaataaggcattgactttttacttttctatacttttaattaatataaattcaaactgaaataacacatgtggctagtggctaccatgttggacagtgcagatattgaagtttgatttttaagaaggagagggacagacactggacagacaactcacagctcctgccacagtacagcatggagcctcccaaggcactagtcacacagatcaagccacacagccaaatggaaatacaaataatagattgagg

SEQ ID NO: 199617 - DNA, 601 bp, Human
gtatcagcactgtccaatatggtggccagtgaccacatatgactgtgagcacttaaaatgtggctagtgccaataaggcattgactttttacttttctatacttttaattaatataaattcaaactgaaataacacatgtggctagtggctaccatgttggacagtgcagatattgaagtttgatttttaagaaggagagggacagacactggacagacaactcacagctcctgccacagtacagcatggagcctcccaaggcactagtcacacagatcaagccacacagccaaatggaawtacaaataatagattgaggtcacattgactgtttcacgttgtacttagacatgctgattaaaacctgagttgcaagtgtgccatggaacataatctctccctctagtgttttggaacaatcacacacaaatgtttatatccacatacaggccccatatacaatgggggaaacagaacagaagaaggttggatggttcaccaagttgagtgggtccttcaaaggatgtcaccatcttggatgtgatgttttctgttttcagtggcatagaactagataaaaggtggcagtgcagaggatgg

SEQ ID NO: 199618 - DNA, 601 bp, Human
agaaaactccattctggatggcccatttctgggtggattggtgctaggtttctcctggtcttggacgaggttgcacttttcagccgctcctgtgcacgtgtgtccgtgctctgaggtgggaggaaagctcaatgtgggtctgtgagtccagggcaggcaggagtcctggggactggaggttctctgcacttctgtttgatcttccctgcctgtctgtggcctctgcagtttaaacaatgactgtcacttaaacctcttctgaagagcttgaagtctggtccatgccttcagcccaccagcrtgtgttgagtacctgttgggtacacagctctgtgtctggtggaggggaaacaaagattaaaaagactgggccctgtcctccaacagctcaggttatttcatgcctgcattcggggcactgtcttacttggcctagtcccacacttgtccctcccaccccttgcttctctattttcaattcacttctgtttctacacacatcagtgatgcagtgtcctatgtacaggtgtgcctgggacagtcctggtttatgcctgttgtcccagcataatcattaatagttctctatttcactctcaag

SEQ ID NO: 199619 - DNA, 601 bp, Human
aggttgcacttttcagccgctcctgtgcacgtgtgtccgtgctctgaggtgggaggaaagctcaatgtgggtctgtgagtccagggcaggcaggagtcctggggactggaggttctctgcacttctgtttgatcttccctgcctgtctgtggcctctgcagtttaaacaatgactgtcacttaaacctcttctgaagagcttgaagtctggtccatgccttcagcccaccagcgtgtgttgagtacctgttgggtacacagctctgtgtctggtggaggggaaacaaagattaaaaagacygggccctgtcctccaacagctcaggttatttcatgcctgcattcggggcactgtcttacttggcctagtcccacacttgtccctcccaccccttgcttctctattttcaattcacttctgtttctacacacatcagtgatgcagtgtcctatgtacaggtgtgcctgggacagtcctggtttatgcctgttgtcccagcataatcattaatagttctctatttcactctcaagtgttccgatttggatggcaccctatttattgagtgctcattgtgtgccagacactgtgctgggcccg

SEQ ID NO: 199620 - DNA, 601 bp, Human
ctgtctgtggcctctgcagtttaaacaatgactgtcacttaaacctcttctgaagagcttgaagtctggtccatgccttcagcccaccagcgtgtgttgagtacctgttgggtacacagctctgtgtctggtggaggggaaacaaagattaaaaagactgggccctgtcctccaacagctcaggttatttcatgcctgcattcggggcactgtcttacttggcctagtcccacacttgtccctcccaccccttgcttctctattttcaattcacttctgtttctacacacatcagtgatgyagtgtcctatgtacaggtgtgcctgggacagtcctggtttatgcctgttgtcccagcataatcattaatagttctctatttcactctcaagtgttccgatttggatggcaccctatttattgagtgctcattgtgtgccagacactgtgctgggcccggggcagatggagactcgtaagccataaccgctgcctcccaggagctagtctgctggggcatccgttctgaataccatgacttggcaagtgaagcattcccatgccttccagactcctggctctgcctgtgtgaaacgtactc

SEQ ID NO: 199621 - DNA, 601 bp, Human
gagtacctgttgggtacacagctctgtgtctggtggaggggaaacaaagattaaaaagactgggccctgtcctccaacagctcaggttatttcatgcctgcattcggggcactgtcttacttggcctagtcccacacttgtccctcccaccccttgcttctctattttcaattcacttctgtttctacacacatcagtgatgcagtgtcctatgtacaggtgtgcctgggacagtcctggtttatgcctgttgtcccagcataatcattaatagttctctatttcactctcaagtgttccratttggatggcaccctatttattgagtgctcattgtgtgccagacactgtgctgggcccggggcagatggagactcgtaagccataaccgctgcctcccaggagctagtctgctggggcatccgttctgaataccatgacttggcaagtgaagcattcccatgccttccagactcctggctctgcctgtgtgaaacgtactccatttccagagccagctgccgagctttttcccctgggctgactttccaccaccctgacctgcgattcctctctgctaaccctcctctcaccgttctcc

SEQ ID NO: 199622 - DNA, 601 bp, Human
acagctcaggttatttcatgcctgcattcggggcactgtcttacttggcctagtcccacacttgtccctcccaccccttgcttctctattttcaattcacttctgtttctacacacatcagtgatgcagtgtcctatgtacaggtgtgcctgggacagtcctggtttatgcctgttgtcccagcataatcattaatagttctctatttcactctcaagtgttccgatttggatggcaccctatttattgagtgctcattgtgtgccagacactgtgctgggcccggggcagatggagactygtaagccataaccgctgcctcccaggagctagtctgctggggcatccgttctgaataccatgacttggcaagtgaagcattcccatgccttccagactcctggctctgcctgtgtgaaacgtactccatttccagagccagctgccgagctttttcccctgggctgactttccaccaccctgacctgcgattcctctctgctaaccctcctctcaccgttctccccagggtgggctgtgggccttctggtgctgagctccctcacatctgagctgtcttagcaccttctttccgcctgta

SEQ ID NO: 199623 - DNA, 601 bp, Human
gagactcgtaagccataaccgctgcctcccaggagctagtctgctggggcatccgttctgaataccatgacttggcaagtgaagcattcccatgccttccagactcctggctctgcctgtgtgaaacgtactccatttccagagccagctgccgagctttttcccctgggctgactttccaccaccctgacctgcgattcctctctgctaaccctcctctcaccgttctccccagggtgggctgtgggccttctggtgctgagctccctcacatctgagctgtcttagcaccttctttccrcctgtatttgtgttacttggatatttgtgttttatcttctgtaccagagcataggttattttaaagcagggagcttatggcattcaacactgtcaccctgggaataggacccccaaaacactttatttctcaaataaatgatggagtaggttccagcgttgtttcttccttgctgtccatttctaaggatgagtaaagagttaacgtattgaacttgaaaggagagatttttttccctcttgtaataaatcaaacttttctgaatctggaaaagtgatggatgaaactatgtgagcacac

SEQ ID NO: 199624 - DNA, 601 bp, Human
ttacttggatatttgtgttttatcttctgtaccagagcataggttattttaaagcagggagcttatggcattcaacactgtcaccctgggaataggacccccaaaacactttatttctcaaataaatgatggagtaggttccagcgttgtttcttccttgctgtccatttctaaggatgagtaaagagttaacgtattgaacttgaaaggagagatttttttccctcttgtaataaatcaaacttttctgaatctggaaaagtgatggatgaaactatgtgagcacacacacacacacacctatacaccccataaccattttgaggtcatttaataagggattgctttctggataatctcgctccttgggtataaatctaatgtgaaagggcaggggtcagatatttaccccaaagggttggtgtgaggataaaatgaggcattgcttttaaagtgctaagctcagcccactgaaaaatacgcaaatgcatcagaagagtcctctgtaaatccactgagctggaatttccaagcaggtgtccttgctgcctcttgttagccttttgtgagttaattctttgtttaataacaaagagctgcc

SEQ ID NO: 199625 - DNA, 601 bp, Human
gcatgagatggtatctcattgtggttttgatttgcatttctctgatgaccggtgatgatgagcatttttttttctagtagccacattgaaaaagttaaacaggtaaaactaatttcaataacatatatcagtttgctagagctgccataatgaagaccacagacttgtggtttatatgaacagaaatgtatttgcccacagttctggaggttggaagtccaggatcaggtgtccacaggtttggtttctcctgaggcctctcttcttggcttgtagatgactgccttttccctgtgtcccygcatggtctttcctctgtactcatatctctggggtttctgtgtgtccacatttcctcctattctaaggactccggtcagattggattagggcacaccctgagggcctcgttttaatttaatcaacccctttaaaggcccagtctccaaatacagccccattctgaggtactgggagttaggactttaacacaggaattttgggggaacacagttcagcgcataaaaatgtatattatttagtccaatatagccaaaatgttattatttcaacataaaatcaataaaatgttaatgaaata

SEQ ID NO: 199626 - DNA, 601 bp, Human
cttgtgctgatcaaactttccgcgtggctttttatgacactgtaacaattactggggtcatgcctggagaggtggcccacagttcatgcacaggctcgagtacaagccttccggggactcatctctcagccctgttattattctcagggatttggagggtgcagaggtagatgaagtaagcaagcactattgtgcttcctgtgttgaagtcagggaataagaatttcctctgtgccacaaataatgctccccacctgtatagaatgcctgggaaatgcaacactggccatccttcagctcytctgcttacagctgttgtgctggtgggtctcctcctattctcagagcagagagccacgaatggggcactcggggccgtgacaggcatcccttagctctggccttctggttgtgggcagactctgctgtgtccggcagcccatccagcgttggatggcatcagcaacctgaaagccctttcttaggctgaaccagagtctacctccatgtaatcacacactcccctcctatttctgccccggagcacctacagatatctgtctgtctgtccccatccccactgcctacttcctccagactc

SEQ ID NO: 199627 - DNA, 601 bp, Human
tgtgtccggcagcccatccagcgttggatggcatcagcaacctgaaagccctttcttaggctgaaccagagtctacctccatgtaatcacacactcccctcctatttctgccccggagcacctacagatatctgtctgtctgtccccatccccactgcctacttcctccagactcagcatcctgagttcctttgggttactagttcattttggaacttattccactattgaattatccgtattctttggttttatacctttattcctctttagttgaccttttagatacttttctaaccawgccccctccccgctgccccgaaagatcagggaaaataagaagaaattcaaacccttgttttgctcctcatcagcgacagtggtagggaagatgcccacggcacggaggttcagtggttgttttcattctttcctgttagccagtttcctcaaattggtcagtataatcctacctcttggagcgatagctggctggattcttctgccattttggcagttatatattggtctggatttaaaagtgatgtttattccatagctctcctgaatctgacatttgttcctctttcatcctatactt

SEQ ID NO: 199628 - DNA, 601 bp, Human
ctgaaccagagtctacctccatgtaatcacacactcccctcctatttctgccccggagcacctacagatatctgtctgtctgtccccatccccactgcctacttcctccagactcagcatcctgagttcctttgggttactagttcattttggaacttattccactattgaattatccgtattctttggttttatacctttattcctctttagttgaccttttagatacttttctaaccatgccccctccccgctgccccgaaagatcagggaaaataagaagaaattcaaacccttgttktgctcctcatcagcgacagtggtagggaagatgcccacggcacggaggttcagtggttgttttcattctttcctgttagccagtttcctcaaattggtcagtataatcctacctcttggagcgatagctggctggattcttctgccattttggcagttatatattggtctggatttaaaagtgatgtttattccatagctctcctgaatctgacatttgttcctctttcatcctatacttccctgggcatgatacccttctttccatcagctgtgttggagaaatgtggcatgtggcaga

SEQ ID NO: 199629 - DNA, 601 bp, Human
ccccatccccactgcctacttcctccagactcagcatcctgagttcctttgggttactagttcattttggaacttattccactattgaattatccgtattctttggttttatacctttattcctctttagttgaccttttagatacttttctaaccatgccccctccccgctgccccgaaagatcagggaaaataagaagaaattcaaacccttgttttgctcctcatcagcgacagtggtagggaagatgcccacggcacggaggttcagtggttgttttcattctttcctgttagccaktttcctcaaattggtcagtataatcctacctcttggagcgatagctggctggattcttctgccattttggcagttatatattggtctggatttaaaagtgatgtttattccatagctctcctgaatctgacatttgttcctctttcatcctatacttccctgggcatgatacccttctttccatcagctgtgttggagaaatgtggcatgtggcagatgtatccttgcttgtttaattaatgagccaaacagtccagaaacttaggttacaaccaaggtagtctggcaagaaatatacat

SEQ ID NO: 199630 - DNA, 601 bp, Human
aatgataaaaccataaagaactcagaaaatattttaagatgcttggcatcaggaactatttcatttgtctccatatccccagcaccacgcagagtaattgacattgactaattgcccaataaatgttcactgaatgttaggagaagctggagtatttccaaaatgaacatatgctcaagatattctactagaagtttacaatgttatcttttacatttagattagtgatccattttgagttaatttttgtgtgttgtccaggatagtttcaaacagttgtgcaaaacaattctgtttgttkgttatcatgggtagactaatacctgtcagatcatataacccgacagtcagctggaaacacttggtcacatgagattgcctatctacattttaaatttggcttcagagggagcagccagcaactcccttcaaccccctaaattttggattgtcctaatgaaatcttggactgaagcagtacatttttaaccaggctttctcaggagatttggttcggctggcactcagcccacactttgcttaactctgagcaaaggtgtccgtgggtggataatcccacctccccattctggatgtgcca

SEQ ID NO: 199631 - DNA, 601 bp, Human
ccatcacacccatctgaagtcctgcctggtaggcagcagacactgggtgtggcttggtttctcatacctttttatttcagtccctggtgtttttgtcatcttgtgtggcagtggcagtgctccagctgatcatttttatgggacagtccttccttgatgagacccagatccctgtcacttgacaacataaagaatattattcttcataccagcatttcccaaagcattttttcaaaggatagtaacgacttttatgtcaaaaaacaaaacaaaattttgaattcaaattaattttggaacrtaattgaatttaacgcaggctttttattgcaggacttcatggagctttagaagcccaggcacgcaaggaggatgcactgtttggcatttcctaaatgtacttgaccacggaacaccatttttctcctgaggtttaggaaatggtgctatgatatagattagttttctatgaataacttggctttatgccttcatataccttttctctctactcatgtagaaactcttcttcagcttcatgttttaataatggaagaacttagtgatgtttcatatgtagagatttttctctaggtccttc

SEQ ID NO: 199632 - DNA, 601 bp, Human
ggcctcctacactatggaagactttctgaaagcccatatctcatgctaaatttagctggatttttaacagccttgattgattgctggtcttaatggaagaaaatgtgatcctttctcttcctcccttgtcattaaattattactaatctatgaccagaggaagcagccactgcatacgtgggtgtatttttaaaaattgtgacacatcatcaagatggatatacttgcccctttaattcaacaggcacctgttgaatgcctgtgcatgcaaacatgatgctgggctgagccctggggcttmccctgaagagctttggagcccacagcagaactcccagccaggctcatccaccactacagccacaaccatccctacctggagaaaggggctaaaagaagcccatgggattaacagacattctgaaacaccaacccttaggaaaggagtagaaatgggagttgggattaaaagcagaggtgaggttaaagggtttgaacaaaatgggcctgatcttgggcttctgaagtcctgtatagtgtaagtgctgacctgagggcctgtggctctcctgtagtgagggaggatccaactggagtatga

SEQ ID NO: 199633 - DNA, 601 bp, Human
atttacctgaacgccccagagggtgcttagcaaatactttatgcttcttgtgggtccattactttcccttgcctgtttttttagggaccctggagtgttaccttggcttctgattaaaagctaggttggcagatgcaagcacacatgcctcctatagtgttgtcctagactggggtggtgttagtggtcaggcaaataattgatcactctgtgttctcaagacaagcaatgggtaagaagacaaggccacggaggtcaaagatacagaaagataattgccatatatgctatgcagccagtkcccctacctcatgtgattgtagagtggttcttacactagggtggcatagaatcacctgaagggcttgtttaaacagatcatgggtggtgggtacagcatttcaggtgcggaagatgaaaggttctggaggtggatggtggtgatggttgcagaataatgaaaatgtacttaatgccatagaactggacacttgaaaatggtgaaagtgatacatcttatattgctctccctgccccatcacaaatagattgctaggctcactccttatagattctgattctgtacctctgaggtggacct

SEQ ID NO: 199634 - DNA, 601 bp, Human
tatgatagttcttatagatgataaagacctcagaaaaatctcactatgtccatgcccaagagttccaccatgagcacatgccttgagggcagtgaccctggctcctattgtctctgtctctctatatctataacttttaatcttgaaatagtttaagattcataagaagttataactcataagaagttttaactcataaaaagtcaaaatagtacaatagtccccccttatccattgggaatacattctaagacccctagtagatgcctgaaactgtgggtagtcctgaaccctttatctrctgttttttcaatctgataactgagacagctagtaagggattaatgggtagtagtgtaatagcatggatgtgccggacaaaggtgtgattcccatcctgggcagtatggcatgagatttcatcacactactcagaatagcatgcagtttaaaacttgtgaggatgaggggaactactctatggaaagattcaggtaccctttacccggcttttcccaatgataacatcttacatatacatagtacattatcaaaagtaggaaactgttattggtttaatactatacattcttttaaaaga

SEQ ID NO: 199635 - DNA, 601 bp, Human
atggctgagcatgaagctgaattagacttggccactagcttactttgctgttgacagaatgttggtacagattgagcatccttaatctgaaaatctgaaatctgaaatgtcccaaaatctgaaactttttgagtgctgacatgacaccacaagtggaaattctacaccttacctcatgtgatgagtcacagttaaaacttttatttcatgccccaaattatttcaaatattgtataaagttacctttataggtcatgtgtagaaggtgtatataaacataaatgaatatgaagtttagccyttagtcccatcctcaaagtatctctttattatatggagatatttcaaaatctgaaaaaatccaaaatctgaaagacttctggtcccttatatttcaattaagggatatgcaacgtgtacttctgcagctgccttgagaatgcatatcattgaataatgttagtgggaggttttaaactatctgaagatcacacaactgtgagagcccagctcccctgaaatgcgtagggttggtcagtgattttgctatgcgccaaagcagctgccttgatccctcagagccccggcatttctgcccggg

SEQ ID NO: 199636 - DNA, 601 bp, Human
caaatattgtataaagttacctttataggtcatgtgtagaaggtgtatataaacataaatgaatatgaagtttagcctttagtcccatcctcaaagtatctctttattatatggagatatttcaaaatctgaaaaaatccaaaatctgaaagacttctggtcccttatatttcaattaagggatatgcaacgtgtacttctgcagctgccttgagaatgcatatcattgaataatgttagtgggaggttttaaactatctgaagatcacacaactgtgagagcccagctcccctgaaatgygtagggttggtcagtgattttgctatgcgccaaagcagctgccttgatccctcagagccccggcatttctgcccggggtttggccacccctggccttggctgacttctcatggatgcagcaaaaacccagtaggatgcacctctcaagtggttggcagcttttactggacagctttagagtcctgtgggttattctggttgttgctattcttaaatattgagtgtccaaaagattcgtgaactgcatctcagctgggtgggaccctttgggacaggagtaggggaataatgccgtcgtta

SEQ ID NO: 199637 - DNA, 601 bp, Human
tagggttggtcagtgattttgctatgcgccaaagcagctgccttgatccctcagagccccggcatttctgcccggggtttggccacccctggccttggctgacttctcatggatgcagcaaaaacccagtaggatgcacctctcaagtggttggcagcttttactggacagctttagagtcctgtgggttattctggttgttgctattcttaaatattgagtgtccaaaagattcgtgaactgcatctcagctgggtgggaccctttgggacaggagtaggggaataatgccgtcgttaaytgcaaagaggagttttgggaccaggttgtcttataggtttattttgaacaactgataggcttggtattgctggaagtggatagatttgggttgcctgtgtctagcaggtggcttccttttccagtatgttgcccactggtctcatctatcagactcacttgagagtatttcattattcatctaataaaggagtatgtgagattcccagaggaggaggatctacttctgtacttgacctgggtgaggaccactgggaacatttgcacctttcaccattgcaaactttgacatgtgagagtt

SEQ ID NO: 199638 - DNA, 601 bp, Human
ctcagatgaggctgtttgtattgcacggtaggaatatatccagaaacagtgggccttttataaattaagcctgccattctccaattgcttaagacactgaggcccatcaggccagaaacatatgacccactttttctgagaaggaactttccctttaggagtggtaatttagaagaaaagaacaagcccaatgaatagtcccttatgggaggcatctcagcagaggccctttttgggggcaggagggattgcatagcaatactgcctacccagagttgttgttcccaggctagggtccaamtcagggcagggagatctactggaggcagcgtatcacacactagttgtccaagagatggagagagagtgcaaaatctgagctgtgcttatgggaagctcggagtctcacaaaactacacccatgctgcccatggtttatgtttaatgaatgaaatgatgattaagataggacaattggacaaaaaggctgggccttcttaggtgggtattgagtgggaagtgattcaagaggccagacattctgtctggacattagctggaagtggggctggacaagatgaactagagccctcttgtggtc

SEQ ID NO: 199639 - DNA, 601 bp, Human
gcatagcaatactgcctacccagagttgttgttcccaggctagggtccaactcagggcagggagatctactggaggcagcgtatcacacactagttgtccaagagatggagagagagtgcaaaatctgagctgtgcttatgggaagctcggagtctcacaaaactacacccatgctgcccatggtttatgtttaatgaatgaaatgatgattaagataggacaattggacaaaaaggctgggccttcttaggtgggtattgagtgggaagtgattcaagaggccagacattctgtctggayattagctggaagtggggctggacaagatgaactagagccctcttgtggtcccatcattcaggcctgtagctttcatttgagaccagtggttcttaaacttttgcagggatcagaatcacctggaggacttgctaaagcacaaattgctgggccccaccccagcgtttctgattcagtgggtctggggttgggactaggagtgcatttcaaagcactttctggagatattgatgctgctggtcctgggaccacactctgagatacagtaatctagaccatgaaggaggtctggatcctggg

SEQ ID NO: 199640 - DNA, 601 bp, Human
tctgaggagctgtcatcctttattcatcctgcccttctgcttgccctcagtctcagaaattccaaaagacagcttatgaccctgcatttttggttaaagaaaggagggaactgaactgtctgctctatgaattctgggctagtggggatcatggggattttgtaaattattttggtagcccgttgagttttgtctcaggatttcagcggaatccaaaccatgtgacatggaccattatcattcagctgccacctcctggatcctgccctgtaaacatgcccaggggtctctgaggatggaygcgtgtcattcacacaccaagtgtgttagagacaacagaaaaccttgtttttttcctgtgttctggtgaaagtcttttctgtctttccctttgtttcttcgagggagcttgagtggcaggattattattaagagtactttttaagttcccaacaattagataggaaatgaactgaatgggagttcacattttatcttcaggaaaatgaccgcaagaaggccttactgtggggtggttaagagcatggcctggctttggaatgcctggattgggaatccttgttttgtcacatcatcgctg

SEQ ID NO: 199641 - DNA, 601 bp, Human
gttgagttttgtctcaggatttcagcggaatccaaaccatgtgacatggaccattatcattcagctgccacctcctggatcctgccctgtaaacatgcccaggggtctctgaggatggacgcgtgtcattcacacaccaagtgtgttagagacaacagaaaaccttgtttttttcctgtgttctggtgaaagtcttttctgtctttccctttgtttcttcgagggagcttgagtggcaggattattattaagagtactttttaagttcccaacaattagataggaaatgaactgaatgggrgttcacattttatcttcaggaaaatgaccgcaagaaggccttactgtggggtggttaagagcatggcctggctttggaatgcctggattgggaatccttgttttgtcacatcatcgctgtgtgatcctaagccagtgatgtgacctccctgcacttcaatttcctcacctctaaagttgggataatactacaacttatttagtaggattgctgtaaggaccaaataagataatatagctcatgcagttagaattggacctgtcacttacagatagaaggcaatacattttagttcttact

SEQ ID NO: 199642 - DNA, 601 bp, Human
ctcacctctaaagttgggataatactacaacttatttagtaggattgctgtaaggaccaaataagataatatagctcatgcagttagaattggacctgtcacttacagatagaaggcaatacattttagttcttactgtaagactgagacatccaaagacgtctcatactgtaatgtgtgatatttatgtatatgctttttaaggactacaatccttagtttcctacctactcaaggttatgttttgtagatgctaacagtgtacattctagagaaaatcagctggagggaggaaaatggyacagttctaaaattctttaagcctcgtttaattttttacctgttactgctttcatcatcacctctcactctcattttctaataagcctgaaaagcatgatggagtcataaatcatgtctgtaaaatgaagatgtgtagactttggtaagatctcacatgtgatgttaataacaataccttacatatctggcctcacacttcacttaaactgtcccatttaatccctgaagtggtctcattagcttctgttagtcccattttacagtttgtacagtggagacttcagagaagaacctggcc

SEQ ID NO: 199643 - DNA, 601 bp, Human
aagactgagacatccaaagacgtctcatactgtaatgtgtgatatttatgtatatgctttttaaggactacaatccttagtttcctacctactcaaggttatgttttgtagatgctaacagtgtacattctagagaaaatcagctggagggaggaaaatggtacagttctaaaattctttaagcctcgtttaattttttacctgttactgctttcatcatcacctctcactctcattttctaataagcctgaaaagcatgatggagtcataaatcatgtctgtaaaatgaagatgtgtagrctttggtaagatctcacatgtgatgttaataacaataccttacatatctggcctcacacttcacttaaactgtcccatttaatccctgaagtggtctcattagcttctgttagtcccattttacagtttgtacagtggagacttcagagaagaacctggcccaggctccacaggcagttaatgacagagctgggatttttttttgtggaggaataggggagacttttctggtaaagaccagaaaacctgctagacaaattctaaaagagccataacactcagagcggggattttaacttc

SEQ ID NO: 199644 - DNA, 601 bp, Human
tttgctgatttttttcctattattctttcctgttattccatattcatgcaggtcttgcagccaaggattgttacattaagatccaatctgaaattaaaacttatggttttaaccaataagctataaagctgttgaactcccactgggatgtagttaccttttcctaaacttcctgcattgtctccttttagccccacagttgatttcttattgagcctttggaaagttccttgccgtttcacagccatttcccgtcagagtggggaatattgactgtgcaaaccacttaaggtcacaggcrccacagctgtgtttcttctttgcagaaggggggtttctttgggtggggctgtgctcagcccttccgggtggtgaaggtctgaggtcacactgggagagcaggtccatatcgggattggggctccagcaggatcagaatgacttcacccagacttctggacctggaactcattctcagaaccttccagaagaccctgccctggaattgctttcaagggtctttttcatctgtgtacagagtatatttccttggaggcagctttgctgaaggccccttgagtcaagggtaatagggtgggag

SEQ ID NO: 199645 - DNA, 601 bp, Human
cagtgtttgatgataaaatggtgtccgttggtgagcatcttggtggtgaggaagtttatacgaccacagatgcttctcaccccaaggtacccgtgccctgtgctgctggtgccactcatcctagggcattcctgcttggcagtagcagattctagattgtcctgtttgctggtttgggggctgcaggggtctgcagagtgccgcaaggaggaggagtcccagatcactggttgaccttcagcgggcatttaacagcatattccatcaggcctcacctactagtgttttgttgaggctgctrtgtaactttgactttctctgctgtctcctatttaagagtaaataaaggtagtgacagtcacaaaaatagcatcaatgatgacaactagcgtttactgagtgctgactatacccaggcaccattctaacctctttacccaagttgtctctgctagtcctcaccacagccctgggaagtgtgtgctgtcatatacccatgaagaaactgaggccaagaaaggaaagcagctctgcccaaggtgttataagcagagagcaccgagacaggacccaagcccaatttgtgttgactggggaatca

SEQ ID NO: 199646 - DNA, 601 bp, Human
tccatcaggcctcacctactagtgttttgttgaggctgctgtgtaactttgactttctctgctgtctcctatttaagagtaaataaaggtagtgacagtcacaaaaatagcatcaatgatgacaactagcgtttactgagtgctgactatacccaggcaccattctaacctctttacccaagttgtctctgctagtcctcaccacagccctgggaagtgtgtgctgtcatatacccatgaagaaactgaggccaagaaaggaaagcagctctgcccaaggtgttataagcagagagcaccragacaggacccaagcccaatttgtgttgactggggaatcagtactcagttctcttagtctttggctgttttgttgagtgcccaggtcatcctggtagaagggagacagtgacccacgtgaaaaaggatggctacagatgcatggctgcatggctgtgcgtcatccaccctggagtatctgcttgccaaaaatagggctacctgcaaaatgctttgagcactgtggaaaccagccgttacaactccaaacgtttatttttctgataataggtcaaggttttcataattgagttttaggggg

SEQ ID NO: 199647 - DNA, 601 bp, Human
ccattctaacctctttacccaagttgtctctgctagtcctcaccacagccctgggaagtgtgtgctgtcatatacccatgaagaaactgaggccaagaaaggaaagcagctctgcccaaggtgttataagcagagagcaccgagacaggacccaagcccaatttgtgttgactggggaatcagtactcagttctcttagtctttggctgttttgttgagtgcccaggtcatcctggtagaagggagacagtgacccacgtgaaaaaggatggctacagatgcatggctgcatggctgtgcrtcatccaccctggagtatctgcttgccaaaaatagggctacctgcaaaatgctttgagcactgtggaaaccagccgttacaactccaaacgtttatttttctgataataggtcaaggttttcataattgagttttaggggggctaattttagactttctgaaaatcagtctcaagaaacaaaacccagagtcaagtaaaaggatgcttttggaactgatgattctcagaagaagccatgaagggctcggccataaccccgggaaagctcactggccagcagcctggagccagtggagctt

SEQ ID NO: 199648 - DNA, 601 bp, Human
taaaaggcataaaaaagtggcatagatgatggctggaaagattaagttctttctggtggcttctttaattttggaataaccagccttccttcaacccccttacatgcattagaaacttctgaactgtttttgttctgtttttaattaggttgtggtacaagaggagcaattaataaaaccttccatttccacatctactgtgaaactctgtgacttcttcccgtgtgatgatggctaagtgcgcagaacatgtgaaatttaagtagatttgtggaaacagaaacacatttttatttagtcrtgagcgtcacttggagtataaatagagccctttatgattcgtgtgctggtctttcttcctggagggcttcagtattatctcatgctgtcatctttatgttgtattggaaaaatctgggattctttttcccttggtcattatttgctttttaaaaaataatgtagttttaaagaattcttgctatttaatctcaagcccaaacatggtttttagtgaggaactgatacttaataaagtttgatatttttagttctagaaagaattgttttggggggtgggaggctgcagttgagaggtaca

SEQ ID NO: 199649 - DNA, 601 bp, Human
gcatagatgatggctggaaagattaagttctttctggtggcttctttaattttggaataaccagccttccttcaacccccttacatgcattagaaacttctgaactgtttttgttctgtttttaattaggttgtggtacaagaggagcaattaataaaaccttccatttccacatctactgtgaaactctgtgacttcttcccgtgtgatgatggctaagtgcgcagaacatgtgaaatttaagtagatttgtggaaacagaaacacatttttatttagtcgtgagcgtcacttggagtakaaatagagccctttatgattcgtgtgctggtctttcttcctggagggcttcagtattatctcatgctgtcatctttatgttgtattggaaaaatctgggattctttttcccttggtcattatttgctttttaaaaaataatgtagttttaaagaattcttgctatttaatctcaagcccaaacatggtttttagtgaggaactgatacttaataaagtttgatatttttagttctagaaagaattgttttggggggtgggaggctgcagttgagaggtacaagaaatgttcaatgagggg

SEQ ID NO: 199650 - DNA, 601 bp, Human
ggccttaaacaaaataatgatgagagaaatctgcctcccataagtcataatctcagcaggctcctgtgtctgagctatttctgtatccaggtccccaagagggctacagggaaaacttcatcatgatgggagggaagaaagaaggtaaagtcctaagatgtttgcttcctattccttgtaaggtttagccatgtatagtcatgtgccagtcacctagggctgagaaaggggagcaagcagagagggagaagaggaagaagccaaatgagatggttcgtaattgattagtggaagttaaatmatgttaaggataggaggcttgtcccctccatcatgatttagtatatcatccttcccaagagaagttttgagaacttgtcctctggtatccaggaaatggcctccccagcagtgtgcatagtcccagggaagccgtctcatgagcccctccttctcttgactcctctcctaatggtcacatggtgccaccactctttcaagccaagtcaaattgcatgcagcagaaaacccaaataagtttatgcagtagaggtttattctcacaccgaagtaattcagcattggtatggtggctccatgg

SEQ ID NO: 199651 - DNA, 601 bp, Human
ggaatccttctgaaaatctagttacataaatttatgttccaccacaagaaaaatcagtggatggctggaaggcggggctttcccttttgctctggaagggaaggaaactctgacagccagacttctcagtcggaaagtgtctttggtgagccttactatgtgactggctgattcactttgtccgctaagtcttgggagaggtgatgtaaccagggactgcaacttctagggaaaggggaaaaatcactgttggccccaccctctagcattggaagcttaacagggctttggcccacagcasatggaagtttgagctgtgttttgtaattcttttttaaatgttcgccagagcatccattattcttcctcattttctcttctcctcttccctccttttcttctttcttaccttttctcttttttatcctggatgtgctcctgtatggccattctaaatcaactcaggtctgacctttggaaatacgtacagtaataaggaatcctaggggcttcctgctgtatttctgtttttgaatttgattaacatgagctaagaggttgagtagaaagaacttggactttggtgtccaaaagacacggg

SEQ ID NO: 199652 - DNA, 601 bp, Human
tatcagttgtgctcatgctttcccttgaatctagataacctgtaacttctgttacagaatgagatggcttatttccctgggtagactgactgtattagtcagctattgccacataacaaactgccccacaactccatggcacacatcaagaagcatttatgttctcatggatctgtgggatggttggacagttctgctgcaggtctgcacgttggctggggaagctgttctccatgtctcttatctttctagaaccagttggctactggggcaggttcttctcatggtgatggcaaaaatkcaagaggggcatgcagaaacatgtgagacctcttaaggggtaggctcagaactggcactatcacttctgccctcattccattggccagagcaagtcatgaggcccaatccatcagtagagtggggaaatagagtagaaatagatcagcctctagtgagaggaaccttagagtcaatgacaaagggtaggagtaccaggtggtgggtagggggcagctgataagtaatgcagtctagcctgtaatcccagcactttgggaggccaaggcaggtggatcatgaggtcaagagattgagacca

SEQ ID NO: 199653 - DNA, 601 bp, Human
atgcagaaacatgtgagacctcttaaggggtaggctcagaactggcactatcacttctgccctcattccattggccagagcaagtcatgaggcccaatccatcagtagagtggggaaatagagtagaaatagatcagcctctagtgagaggaaccttagagtcaatgacaaagggtaggagtaccaggtggtgggtagggggcagctgataagtaatgcagtctagcctgtaatcccagcactttgggaggccaaggcaggtggatcatgaggtcaagagattgagaccatcctggccaaygcgatgaaaccccatctctactaaaaatacaaaatttatctgggcatggtggcatgtatctgtagtcccagctactcgggaggctgagtcaggagaattgcttgaactcgggagacggaggttgcagtgagccaagactgcgccactgcactccagcctgggcaacagagtgagactccatctcaaataataataatattattattaataataatacagtcgatcacaggcagtgtaattatttgaagaccataaggttgggcatacagcatagagtatctagcccttagtggctatgtt

SEQ ID NO: 199654 - DNA, 601 bp, Human
aataataatattattattaataataatacagtcgatcacaggcagtgtaattatttgaagaccataaggttgggcatacagcatagagtatctagcccttagtggctatgttggctattctctacttcccctctccagatccattctccaccattatccctcctgctttgtgcccttgggaggctgaccttcccctctgccttttagttgggttcagtcagaggggagcactggaaaaagagggtggaagagtggccagccatagtgaccatggctctctacggaaggccatagcttctgycaggtggttagttctaataacttaggggttccagtgaccactccccaccttgctccttccgacctagggcattaatggctccctgctttgccacaggggtctcttttaaactgaccccccttactgttgtaaatagtcccttcagtgaattctttttgtctccctggttgaaggaaacatctgcttctggccaggaccatcatggatacagtaggtgctcaataagtgcatggttgattagcaggcctccttgtttttcctctcctctggcctctacatcactaaatggtcacttctctt

SEQ ID NO: 199655 - DNA, 601 bp, Human
ctcctctggcctctacatcactaaatggtcacttctcttctagcctgaagagcccatggaatgtcagcttgggaatccctccctctttccccataacttgtccaaccaccatccctctcccaagaacctggcacagtaaattcattagagcgaattcaaataaataaggttttacttttcttctttgggatttcttagcatgcccgttgggacaattagggagggattctttcaagtacaacattttctctagcaattatgggggttttatctcccagatgtgatttatgccatattacaytccaagaagggaacatgaagaatgtttgtggctaaaaaagtctcaacacaaggaaactacaggtgaaacgtaacaatagtaattgccttactttatttgcgaaggggtggtgaacactaatatgcctgactccatagagcagtgtatttggttttcttaagcaggaagaagggggcccccccccaattttaatttactgaatgagtttaagaaccatggtgtatttcccaagcttcgctagtgaagatggtattttgttaaaaattgagattcccattgatccagatccagttgggcctg

SEQ ID NO: 199656 - DNA, 601 bp, Human
ttctagcctgaagagcccatggaatgtcagcttgggaatccctccctctttccccataacttgtccaaccaccatccctctcccaagaacctggcacagtaaattcattagagcgaattcaaataaataaggttttacttttcttctttgggatttcttagcatgcccgttgggacaattagggagggattctttcaagtacaacattttctctagcaattatgggggttttatctcccagatgtgatttatgccatattacactccaagaagggaacatgaagaatgtttgtggctaaaraagtctcaacacaaggaaactacaggtgaaacgtaacaatagtaattgccttactttatttgcgaaggggtggtgaacactaatatgcctgactccatagagcagtgtatttggttttcttaagcaggaagaagggggcccccccccaattttaatttactgaatgagtttaagaaccatggtgtatttcccaagcttcgctagtgaagatggtattttgttaaaaattgagattcccattgatccagatccagttgggcctgggaatctgttttcaacgtgtatcctgagtcatatttg

SEQ ID NO: 199657 - DNA, 601 bp, Human
ttttcttctttgggatttcttagcatgcccgttgggacaattagggagggattctttcaagtacaacattttctctagcaattatgggggttttatctcccagatgtgatttatgccatattacactccaagaagggaacatgaagaatgtttgtggctaaaaaagtctcaacacaaggaaactacaggtgaaacgtaacaatagtaattgccttactttatttgcgaaggggtggtgaacactaatatgcctgactccatagagcagtgtatttggttttcttaagcaggaagaaggggscccccccccaattttaatttactgaatgagtttaagaaccatggtgtatttcccaagcttcgctagtgaagatggtattttgttaaaaattgagattcccattgatccagatccagttgggcctgggaatctgttttcaacgtgtatcctgagtcatatttgggaagcactgggctctgcttatgattctcacgttctggtctgtgactgaggagatgtgccatgatgagagtgatgatggtgatggtggcagacaagagcatgtcacatttagaaatactgtaactggttgctgaggtt

SEQ ID NO: 199658 - DNA, 601 bp, Human
tttatttgcgaaggggtggtgaacactaatatgcctgactccatagagcagtgtatttggttttcttaagcaggaagaagggggcccccccccaattttaatttactgaatgagtttaagaaccatggtgtatttcccaagcttcgctagtgaagatggtattttgttaaaaattgagattcccattgatccagatccagttgggcctgggaatctgttttcaacgtgtatcctgagtcatatttgggaagcactgggctctgcttatgattctcacgttctggtctgtgactgaggagaygtgccatgatgagagtgatgatggtgatggtggcagacaagagcatgtcacatttagaaatactgtaactggttgctgaggttttacatatattccttctgagcttgttttgtctaatattgcctgtgccaacagtattttaccagaattgaatgaaaagaaaggtaccagcagatttttttagatgttctaattgataccagaagcaaagacgtagaaaccgtcatgttataaacatgaaagccccaagcaaacagcctttagcccaccctttgagaaccactacatgacttcttgata

SEQ ID NO: 199659 - DNA, 601 bp, Human
acttgcctgggtcaccaggcagtcaaggcggagcaggcctgaggcatccttgcaacattagaaccagaacaacatttcattcttttatgttaaacggactctcctgcctggacccaggcccacgttagcatccagagtggcatgcagtggcagaattggagctggaacagccctcatttgttgtcttctctccttgggaaatcttcctgctatcagtgaaaaagggagagggatcagctcttgtttcttggctttgctctttacagcctcttagaaacttgagttctatctggattcatcstgtcatttgatggtacaggagtacaaatggaggtccacttagcgaatatctaaatatttaaagattacaaatcaaggtaactgttcagtaaactgtgttccatcctaccttgacaaatatacctttataacaacttggaagccctaggttgaattttgatttctcaggcctctcagagtttagtgtagaaatggatggcttggggagagccagcccccagcccacccccccacttccctttccatctgactccatcccgcatggcaatgggccttctgtgcatgcgtgtgtggacaccca

SEQ ID NO: 199660 - DNA, 601 bp, Human
actccctcaagtcccagctgcattaccagccaaggatgtgatgcatagtattctggagctcctttttaaaaaggagttacattgctttgggagttcaggacacaggcagcctgggggtgcttgcttcatttctgaaaaagcaggttgtggccaccctttcatgagccttgactctactgggctctccctgctccccatggagcctcatgctgtcctcaggccaccctagccccctgttctcctggctggctttatcccgctgagcagtgggacagaggacaggaagatgagaggaagataktccagagctgggtggagagtcagggtggagtagagctgtgtgagggtgtgcatgagggagccaacaggaaggagggctgggttcttgttctctgaccaattcccagtcatggctctcccatggggtttcacagctcagtccgaagacacattgttcctgtgcatggtgtagccaagcccaaatatttagctacggccacaccagcccttgttctgcttataactgtggtgtagacctcagtccagacaccctccaagagatacccaccctgccccttggcactggcttgggcggccttgt

SEQ ID NO: 199661 - DNA, 601 bp, Human
gaggaaacttccatgccacccctcctgcccctgggctccagggctctcgatttttggggtaaacagaggtgctgggctctgctgaggataagctttgtgatctgggaaggatccctttctcctcattttttccccacctccttttcatcatgtctgtgtgaaaacgaaagctattgtttatgtaaaaggaccatttgcctaatgtccctggaatttatttgctggagcattttccattttcatattcagtttagaccttggctgaagtagggaggttatgtaactgggatggaacaaatcycattggcatctggggaccctagtgtaccccacccttagccattcctgcagtggactgagtgcccccctggctgtatattcaagtcgcctctgtggctgccagagttggggagctggggagctggagtgatagagaaggagttggcagcatttagaatggagtcaggaggaagatttctctggggggttggattcatagatctgctttggggctgtctcctcctcctcagctgtagacctcgggggtccagactttccttgcacacaaagcctaggcctttcctatcagcctgtctgtgga

SEQ ID NO: 199662 - DNA, 601 bp, Human
tgtactccatagcctgaaaccatagcacctgatgaaattggaccaatctgttttcaaatacaaagctagtagttagaataaccagggggaaaaaagcataatcagtagccccatgtctttgcacaggctgccataaaaaaaggtacagttgtttctcagtatgcatgggagattggttccaggattcccaatggataccaaaattcatagatgctcaagtccctgatataaggtggcatcgtatttgtatataacctacatatatcctcctgtatactttaaattatctctagattacttrtaatacctacaacaatgtcaatgctatgtaaatagttgttatactgtattttgggttttttgttgtattgttatttttattgtttttttcctgaatatttttgatctgtggttggttgaatccatggatgtggaacccatagatacagagggctgactatcccataaattgggtgggttacacaacagaaattaatttgctcacagttttggaggctgaaagcccacaatcaaggtgccagcatagttggtgtgtggtgtgggctctcttcctggcttagagacggccaccttcgtgcta

SEQ ID NO: 199663 - DNA, 601 bp, Human
cctgaaaccatagcacctgatgaaattggaccaatctgttttcaaatacaaagctagtagttagaataaccagggggaaaaaagcataatcagtagccccatgtctttgcacaggctgccataaaaaaaggtacagttgtttctcagtatgcatgggagattggttccaggattcccaatggataccaaaattcatagatgctcaagtccctgatataaggtggcatcgtatttgtatataacctacatatatcctcctgtatactttaaattatctctagattacttataatacctacarcaatgtcaatgctatgtaaatagttgttatactgtattttgggttttttgttgtattgttatttttattgtttttttcctgaatatttttgatctgtggttggttgaatccatggatgtggaacccatagatacagagggctgactatcccataaattgggtgggttacacaacagaaattaatttgctcacagttttggaggctgaaagcccacaatcaaggtgccagcatagttggtgtgtggtgtgggctctcttcctggcttagagacggccaccttcgtgctatgtcctcacatg

SEQ ID NO: 199664 - DNA, 601 bp, Human
ggaaggcagcagattggtgtcctggcccatccacttcaggtgagaaggatgcctgctgtcctcgtgtggacacaacttcctctgctctccttggccttgccttggcctctttgctttaggatatgatgcccagaagggctcgaaactggagtctgaccaggggcaagcaggctgcctcttgctcctccccagaaagggagagccagctgagggtgacaccttgggctgcagccacaggccactttgccactgggctcacccacgctgctgctgccacacgtggggccaagggtgacaaggytgccagggagcctgggatcggagttccagggccatctgagctctgggtcagcagcagtcattggagcagggatctggggaggcttttcacgtgggggttgttgagataggggtctggccccattcctgcctgactggcagtcttcattaatgtacgtttataccaggagcaagtggagctggggaggggactcacatctctgtctgtgggaagcagggcagagtgagggagagtatggcctgctttctagctgatatctccccttgctctcagcaagctcctctgcctcttcctttcctt

SEQ ID NO: 199665 - DNA, 601 bp, Human
tagctgatatctccccttgctctcagcaagctcctctgcctcttcctttccttctggtaaagcataaggagaggactcaacagtaaggactaatatttgacagtgaggagcagatagagttttttaggcaggggtcactgttaaggaagtttgtattttttttttaacttccaaataaagcttgaagtgtctgagaggctgcataacagaggtgaagggcacagacttgggagccccatggccaggatttgaatctgaactcttaggcaggtccctgaactgctcagccctcagtttcccrtctgtaaatggtgataacagtaccttcctaaggtcattatgaggactaaatgagtaaacattgatacagtgctaacaacgcttaatagagtacttacaacacttcacttaataagtgccatatggtgggtgttaaatatatattttggggaacggggtctcgctatgttgcccaggctagagcgcagtaactattcacaggcacagtcagagcccactacagcctccaactcctgggctcaagcagtcctccttcctcagcttcccaagtagctgggactacaggcatgtaccattgcac

SEQ ID NO: 199666 - DNA, 601 bp, Human
agcagtcctccttcctcagcttcccaagtagctgggactacaggcatgtaccattgcacccagctaaatttttaaaaattaagtcttgttgaagagtgagtagaaaccagagtggtgataatttctggttctccctagtcatctccctcaagaatttcccagttacttctcctggaagatccgcttccttgttttgttgtttttgtttttgtttttgtttttttttgactttgagacaggatctcactctgacacccaggcgggagtgcagtggtacagtctccgctcactgcagcctcarcagcccaggcccaagtgatcctcccacctcagctttccaggtagctgggcagtgtcagcagctctcctatggccagctccaccaccaggtcagacagtacccttggcaacctgtggaccaggctggggaagaagaaaatctaggaagaaaaggccacacaaggaagaagtgcagatggcaggggattccggtggccagggaccagatgggagtccgaaagctacacagagcaaacaaccaaaattgaaagcaaacagactctgagttgagaaacctgttctccctatccagagcatacaa

SEQ ID NO: 199667 - DNA, 601 bp, Human
gtaagaagtctgcggtggtctaatggtggaggtgaagagaagagggcaggctgcagaaaaggcaggatacgaggtagaactcccacagtttcctcatctctattgtacatagtaatcagggtctaacatagcttccctttcccacctacgacctatgaggtgcacctgtccgtagtaagtactcagtaaatgactggtgaatgaatgtgttttaaataaggtatatagtgagaaaagtgagcattggagtctatttcagttatgtgttacaataataatgctgcagaacaaactcaaaacytcagtggcatataatacaaagcatatagtttgtgcagctgggattagcagtggcttggctagctggctctgctgatttgggcagggcttgttcatatagctaggggtcagctagctgttggttatctagactggcattggctggggtgactggggcaactcagcaccgctccatgcatatctcactgtccaacaggccagcctgggcatattcacgtggagactgagaagcacgagaaggcagaattgggcccttgataagatcatcctaacacagaggcagatgtagatttgaacccta

SEQ ID NO: 199668 - DNA, 601 bp, Human
cggtggtctaatggtggaggtgaagagaagagggcaggctgcagaaaaggcaggatacgaggtagaactcccacagtttcctcatctctattgtacatagtaatcagggtctaacatagcttccctttcccacctacgacctatgaggtgcacctgtccgtagtaagtactcagtaaatgactggtgaatgaatgtgttttaaataaggtatatagtgagaaaagtgagcattggagtctatttcagttatgtgttacaataataatgctgcagaacaaactcaaaacctcagtggcatayaatacaaagcatatagtttgtgcagctgggattagcagtggcttggctagctggctctgctgatttgggcagggcttgttcatatagctaggggtcagctagctgttggttatctagactggcattggctggggtgactggggcaactcagcaccgctccatgcatatctcactgtccaacaggccagcctgggcatattcacgtggagactgagaagcacgagaaggcagaattgggcccttgataagatcatcctaacacagaggcagatgtagatttgaaccctatttgcaacagtc

SEQ ID NO: 199669 - DNA, 601 bp, Human
gttttaaataaggtatatagtgagaaaagtgagcattggagtctatttcagttatgtgttacaataataatgctgcagaacaaactcaaaacctcagtggcatataatacaaagcatatagtttgtgcagctgggattagcagtggcttggctagctggctctgctgatttgggcagggcttgttcatatagctaggggtcagctagctgttggttatctagactggcattggctggggtgactggggcaactcagcaccgctccatgcatatctcactgtccaacaggccagcctgggcrtattcacgtggagactgagaagcacgagaaggcagaattgggcccttgataagatcatcctaacacagaggcagatgtagatttgaaccctatttgcaacagtcactaatcatgtgatcttcggtgatttattttacactttgtggcttaatgtctttatctgtaaaatggggctaggaaaatttatctcactgggtagtcaggattacataagagtaataacatctcattcccactataccatcctgagagggtaaataattctgcctatgacgcaggtatagaaataaaaaagactat

SEQ ID NO: 199670 - DNA, 601 bp, Human
cagtgtggctgggccaatgcctatcatcatccagcaggctggcctgggcttgtttacatggttaggaggttctacaagtgagagtggaagtaggcaaggccttttgaggcatgggcttcagaagtggcatgatgtcatttcttacacattctcttggccaaagtaagttcaagggatgggaaaatagcctcttcctgatgatgggaggagctactgtatcatcttttcatgacacatatgtagggacaggtagaacattgtggtcatatgcagtggactgagcccatgggctttggagtcmcatggggctctcaagccatgattctttacttaaccttcatctataaaatgaaaacactgatagaatctatctcacaagatcattttgaggtaaatgcacatgtacctaatgcatagtaaattctcagtagaaaataacattttatgtattttgcatgtttctcataaactgattgtgcattctaattatttagtttggaaaatgtagtctctgtaggtttacccttccctgaggcagtaggggagatcatcacctctgtaatggtataatatgaactcaggagttgagattcgtaaagca

SEQ ID NO: 199671 - DNA, 601 bp, Human
tggcctgggcttgtttacatggttaggaggttctacaagtgagagtggaagtaggcaaggccttttgaggcatgggcttcagaagtggcatgatgtcatttcttacacattctcttggccaaagtaagttcaagggatgggaaaatagcctcttcctgatgatgggaggagctactgtatcatcttttcatgacacatatgtagggacaggtagaacattgtggtcatatgcagtggactgagcccatgggctttggagtcacatggggctctcaagccatgattctttacttaaccttcrtctataaaatgaaaacactgatagaatctatctcacaagatcattttgaggtaaatgcacatgtacctaatgcatagtaaattctcagtagaaaataacattttatgtattttgcatgtttctcataaactgattgtgcattctaattatttagtttggaaaatgtagtctctgtaggtttacccttccctgaggcagtaggggagatcatcacctctgtaatggtataatatgaactcaggagttgagattcgtaaagcagtaaggaatgcatagtcagctatactggaaatttgggaa

SEQ ID NO: 199672 - DNA, 601 bp, Human
tttgaggcatgggcttcagaagtggcatgatgtcatttcttacacattctcttggccaaagtaagttcaagggatgggaaaatagcctcttcctgatgatgggaggagctactgtatcatcttttcatgacacatatgtagggacaggtagaacattgtggtcatatgcagtggactgagcccatgggctttggagtcacatggggctctcaagccatgattctttacttaaccttcatctataaaatgaaaacactgatagaatctatctcacaagatcattttgaggtaaatgcacatrtacctaatgcatagtaaattctcagtagaaaataacattttatgtattttgcatgtttctcataaactgattgtgcattctaattatttagtttggaaaatgtagtctctgtaggtttacccttccctgaggcagtaggggagatcatcacctctgtaatggtataatatgaactcaggagttgagattcgtaaagcagtaaggaatgcatagtcagctatactggaaatttgggaaagggaaatggactatgtgggaaagcgggactcttatccttgcagaagtcactatgaaatgagg

SEQ ID NO: 199673 - DNA, 601 bp, Human
ggccaaagtaagttcaagggatgggaaaatagcctcttcctgatgatgggaggagctactgtatcatcttttcatgacacatatgtagggacaggtagaacattgtggtcatatgcagtggactgagcccatgggctttggagtcacatggggctctcaagccatgattctttacttaaccttcatctataaaatgaaaacactgatagaatctatctcacaagatcattttgaggtaaatgcacatgtacctaatgcatagtaaattctcagtagaaaataacattttatgtattttgcrtgtttctcataaactgattgtgcattctaattatttagtttggaaaatgtagtctctgtaggtttacccttccctgaggcagtaggggagatcatcacctctgtaatggtataatatgaactcaggagttgagattcgtaaagcagtaaggaatgcatagtcagctatactggaaatttgggaaagggaaatggactatgtgggaaagcgggactcttatccttgcagaagtcactatgaaatgaggctttcagtaaacagaagatgggcatttcatcctttctcattactgagccttcc

SEQ ID NO: 199674 - DNA, 601 bp, Human
ggaaaatagcctcttcctgatgatgggaggagctactgtatcatcttttcatgacacatatgtagggacaggtagaacattgtggtcatatgcagtggactgagcccatgggctttggagtcacatggggctctcaagccatgattctttacttaaccttcatctataaaatgaaaacactgatagaatctatctcacaagatcattttgaggtaaatgcacatgtacctaatgcatagtaaattctcagtagaaaataacattttatgtattttgcatgtttctcataaactgattgtgyattctaattatttagtttggaaaatgtagtctctgtaggtttacccttccctgaggcagtaggggagatcatcacctctgtaatggtataatatgaactcaggagttgagattcgtaaagcagtaaggaatgcatagtcagctatactggaaatttgggaaagggaaatggactatgtgggaaagcgggactcttatccttgcagaagtcactatgaaatgaggctttcagtaaacagaagatgggcatttcatcctttctcattactgagccttcctcaagacctccttaacatcctaa

SEQ ID NO: 199675 - DNA, 601 bp, Human
aatgcacatgtacctaatgcatagtaaattctcagtagaaaataacattttatgtattttgcatgtttctcataaactgattgtgcattctaattatttagtttggaaaatgtagtctctgtaggtttacccttccctgaggcagtaggggagatcatcacctctgtaatggtataatatgaactcaggagttgagattcgtaaagcagtaaggaatgcatagtcagctatactggaaatttgggaaagggaaatggactatgtgggaaagcgggactcttatccttgcagaagtcactaygaaatgaggctttcagtaaacagaagatgggcatttcatcctttctcattactgagccttcctcaagacctccttaacatcctaacattataaatacaataattttagaaattacttagtcaataaaaaataagcacttattgtatacgagactctgttctaggagccagagatacagaggaataaggaattaaggtatttctcccatattcaaggacttcagtttcattacctgtccagaaaactatgagaaccacccatcacctctggttatagattcttaagtgggatgtcaagccc

SEQ ID NO: 199676 - DNA, 601 bp, Human
ggacttcagtttcattacctgtccagaaaactatgagaaccacccatcacctctggttatagattcttaagtgggatgtcaagccccttccctaatgatctcagtttaacctgctgtcctattcctctgtggcctattcctgtgctacactcgagccaaggtggcctcttccctagccccacacatactctttgtttttccattcttccaagcaggcccggagaaggaatgggctccacgatgcagggcccgcggtagagaacagccaggcagagcagggggcctggctggatgtggccascatctgcaggggttcagcattgagatatgacactgtcacctccatctcaagaagcccttacggatgcctcccttcccttcatgactcactgtgatctacaactcctcagagccagccttaaagtggtctgtggatcagtctcatctccccactggagctccatgggcagaaagcactctttctcttctgcctacaacatcctcctcccatcggtatgcaccccttcctaggagccccacaggcaatgacaggaacccccaaccccatgtgtgcacatatacacattcccacatgtgtggg

SEQ ID NO: 199677 - DNA, 601 bp, Human
tccttcagctgcaaagaacacagaggtcaggaggaataaagctaatgagagagcagagagtcctttgtctccccaggtgttattcccagagggcaactagggaaaatggagatggggtataaacatctgaattcactgttaaacactccatgaactgttgataattccctagaagcagcatattcctgaggtagcttcatatgatctccagaagcaacttacatgtagacatttttctgagaattccagaaagaatattgataattttcagacaccatggcttccacgcctcatcaacatragcagtattagtctttatctctgacatcaatcaaacttgaacaccatcagcatgggctttaatgaaattctcacatatgtatcagaacttgtattttttcctttagtcagtgtcttgatccatttgtgttgctgtaaaggagtacctgaggctgggtaatttataaagaaaagatgtgtattcggctcatggttctgcagggtgtacaagaagcatgatgccaggcatccgctttgggtgagggcgtcaggctgattctactcatggtggaaggagaaggggagccatcgtgtggagatc

SEQ ID NO: 199678 - DNA, 601 bp, Human
aaagaacacagaggtcaggaggaataaagctaatgagagagcagagagtcctttgtctccccaggtgttattcccagagggcaactagggaaaatggagatggggtataaacatctgaattcactgttaaacactccatgaactgttgataattccctagaagcagcatattcctgaggtagcttcatatgatctccagaagcaacttacatgtagacatttttctgagaattccagaaagaatattgataattttcagacaccatggcttccacgcctcatcaacatgagcagtattagkctttatctctgacatcaatcaaacttgaacaccatcagcatgggctttaatgaaattctcacatatgtatcagaacttgtattttttcctttagtcagtgtcttgatccatttgtgttgctgtaaaggagtacctgaggctgggtaatttataaagaaaagatgtgtattcggctcatggttctgcagggtgtacaagaagcatgatgccaggcatccgctttgggtgagggcgtcaggctgattctactcatggtggaaggagaaggggagccatcgtgtggagatcacatggtgagag

SEQ ID NO: 199679 - DNA, 601 bp, Human
agtggaggtgccaggctctttttaacaaccagctgttgtaggagcacagtgagaactgactcactacctagagaatggcaccaagccattcacaatggatccgtccccatgacccaagcacctcccatcagacccacctccaacactggagatcagatttcagagtgagacttggtggggccaaacaaatcatattcaaaccatagcaattagaatcttaaaatcaaaattgatggctttatttttctaaaaatgggaaaatatctccaaaacattgttcaaaaacaaaacaaaacaaaamaaaaatgtttgttcttatatcccatcagtttattcaactaacattcactgtggactttttataaggcagtaactgttttatgaataggagatataaaactgggtgaaacagtgaggttcctggccactgtattgtaataatagaggcacatataccaaagagctaaaatacaggcagcaaactctagggactgaagtaaatttccttaatttaatgaaatgtatcaagcagaaacccacaataagcatcatacttaaaggattcatttgaatttttttatttatttttattaaatcagat

SEQ ID NO: 199680 - DNA, 601 bp, Human
gtgaggttcctggccactgtattgtaataatagaggcacatataccaaagagctaaaatacaggcagcaaactctagggactgaagtaaatttccttaatttaatgaaatgtatcaagcagaaacccacaataagcatcatacttaaaggattcatttgaatttttttatttatttttattaaatcagatatacttttctagtttttttaatttttattttttgcatttcttgatcatttcaaagtgaggtcagttacagagtgaatgggttcatcctgtcattgtaaataacagtttttygtttaataatggcattttgtattaccaagaccttgcttcacattaggtgttttgtatacattatctcatttaatcaaaaccagcactctatatcatgggtgccaccattcctctgatttttgctaaggaggaaactgaggttcaaaaagggtaaataagttgtccaagaccacacagccattgtttggcagagctggggcaaaggtctatactgctgcaaagcttgtgatttttggctactaccctctaatgttctgtgagggtggaacacctaacctagaatttccctgtggatcactc

SEQ ID NO: 199681 - DNA, 601 bp, Human
taaaatacaggcagcaaactctagggactgaagtaaatttccttaatttaatgaaatgtatcaagcagaaacccacaataagcatcatacttaaaggattcatttgaatttttttatttatttttattaaatcagatatacttttctagtttttttaatttttattttttgcatttcttgatcatttcaaagtgaggtcagttacagagtgaatgggttcatcctgtcattgtaaataacagtttttcgtttaataatggcattttgtattaccaagaccttgcttcacattaggtgtttygtatacattatctcatttaatcaaaaccagcactctatatcatgggtgccaccattcctctgatttttgctaaggaggaaactgaggttcaaaaagggtaaataagttgtccaagaccacacagccattgtttggcagagctggggcaaaggtctatactgctgcaaagcttgtgatttttggctactaccctctaatgttctgtgagggtggaacacctaacctagaatttccctgtggatcactcacccccaatgatggcatgtcttgctctggacccatgatataatgatctggata

SEQ ID NO: 199682 - DNA, 601 bp, Human
cccatgatataatgatctggatacagccaaagtcactaagcacgctacaccctagcctttcaattcctttattacttcatggagaatcatgtatttcagccactcaagtatctttaaggtctaggccttatcgaatggggtttagtcactcagtacagtctgccctttgtactcatgagttcagcattcatggatttgaagaactgtggggtgaaaatattccaaaaaaatggatggttgcatctgtactgaacatatacagacttttttcaatatttcctaaacaataaagtatagcaaygatttacatattatttacattgtattgggtattataagtaatctagagattaaagtatataggaggatgtgtgtatgttatatgcaaattctacaccattttacatcaaggacttgtgtgttcttggggtttggtgtcagggtggtcctggaaccagttccccatggacattgaggaatgactgtgcttcccctacccaacagaagtggttctcccgtcaggttataatagggaagggatgtgtgatctttcctgagaactgaggcatgctattaagctttaaatggagcatctctaagt

SEQ ID NO: 199683 - DNA, 601 bp, Human
ccctttgtactcatgagttcagcattcatggatttgaagaactgtggggtgaaaatattccaaaaaaatggatggttgcatctgtactgaacatatacagacttttttcaatatttcctaaacaataaagtatagcaatgatttacatattatttacattgtattgggtattataagtaatctagagattaaagtatataggaggatgtgtgtatgttatatgcaaattctacaccattttacatcaaggacttgtgtgttcttggggtttggtgtcagggtggtcctggaaccagttccycatggacattgaggaatgactgtgcttcccctacccaacagaagtggttctcccgtcaggttataatagggaagggatgtgtgatctttcctgagaactgaggcatgctattaagctttaaatggagcatctctaagtttccttaccaaaaagtaatcagacaaagggccatgtggcaagagctcttgcttcaccaaacacgtagtgatggacccccctatacccagtgtgccagacatcatcatgagatgtaactcctttcacatatctcttcccttgccagaggaaggaactgaggct

SEQ ID NO: 199684 - DNA, 601 bp, Human
aactgtggggtgaaaatattccaaaaaaatggatggttgcatctgtactgaacatatacagacttttttcaatatttcctaaacaataaagtatagcaatgatttacatattatttacattgtattgggtattataagtaatctagagattaaagtatataggaggatgtgtgtatgttatatgcaaattctacaccattttacatcaaggacttgtgtgttcttggggtttggtgtcagggtggtcctggaaccagttccccatggacattgaggaatgactgtgcttcccctacccaayagaagtggttctcccgtcaggttataatagggaagggatgtgtgatctttcctgagaactgaggcatgctattaagctttaaatggagcatctctaagtttccttaccaaaaagtaatcagacaaagggccatgtggcaagagctcttgcttcaccaaacacgtagtgatggacccccctatacccagtgtgccagacatcatcatgagatgtaactcctttcacatatctcttcccttgccagaggaaggaactgaggctcagaaaggttcaattcctcacccaaaggtttccaaccca

SEQ ID NO: 199685 - DNA, 601 bp, Human
gtgtgttcttggggtttggtgtcagggtggtcctggaaccagttccccatggacattgaggaatgactgtgcttcccctacccaacagaagtggttctcccgtcaggttataatagggaagggatgtgtgatctttcctgagaactgaggcatgctattaagctttaaatggagcatctctaagtttccttaccaaaaagtaatcagacaaagggccatgtggcaagagctcttgcttcaccaaacacgtagtgatggacccccctatacccagtgtgccagacatcatcatgagatgtamctcctttcacatatctcttcccttgccagaggaaggaactgaggctcagaaaggttcaattcctcacccaaaggtttccaacccaaggtttctgacctggagccctgctctttcctccacaccctgctgccattattttgtcttgttgggctggggaagggcaaagagggtgcccactgctggatgaaagaagcagctacattcccattcaaggtgtgctgagcccagtcctaactgctcaagtctttcttaggtcttatgatggaactgaaaagcaggctacctattttatccaggaag

SEQ ID NO: 199686 - DNA, 601 bp, Human
gggtcttaaaagcagttcatgggaatctataggctattgtgtataactggagggtagcagaaaacaagttccttgtgagatcagacacatgagctaaacatttaggaaaaccttacagaagcaaatctttaacggaagggtttccacactgagggccttgtgttgcttttgggaatggtgtagaaatcacgtgcttagtcttgaattatgattcacctttactgaatgtcccttctcttttctttactcactgtcgaacaggaacccaaaggatgtagtttttggcagatgtcctttgtarggttcagtatttctcactcacccctttaagaccctaaagggagagttattaatagtttcagaaagttgagggaaatcatgcagaggttctcagatgttcagagaggcttcctctccccttccatgaaagttctaaggctcatgggtgaggcctaagaaaggcatgtcagttgtctatcaagttcattagtttattcagcttatttctgaagcttttgatgggccggctattcagaggtcaatgaaatagacatgagtactcttcacagaccttaccgtctaataggaatgatagcaagtg

SEQ ID NO: 199687 - DNA, 601 bp, Human
gaggtcaatgaaatagacatgagtactcttcacagaccttaccgtctaataggaatgatagcaagtgaatgtataataaataaataattaggggttgattgttacgagtgctatgaggggaatagccagggtgacatgtttgagaaggggtcagtactgctaagtgttggtcagggaagcattgcaggcagagggaacagcaaatgcccatggtttggaggcaggaatggtgttccaagagtagtagggagcctcgggactagagtttggaggatgagcggggagagtgggaggagatagygggaaagtctgtggagccagttccctgaggggcctggtgggccatgctcagtgggggtttcatttgacgagccatgggaaggcttccagcaatgggggatgtggttttacttgtaccttaagaagatcacactgggtcttgtttggagaatggacaggaaaggagcaggagagcaagcagagagtctgaggggcaagaaatgccctgtcctcccagcagactggagcgaattctaattctgcctctgctacttcattcctatgcaactttgggcaggtttcctaatctctctgcctctca

SEQ ID NO: 199688 - DNA, 601 bp, Human
gggaacagcaaatgcccatggtttggaggcaggaatggtgttccaagagtagtagggagcctcgggactagagtttggaggatgagcggggagagtgggaggagatagtgggaaagtctgtggagccagttccctgaggggcctggtgggccatgctcagtgggggtttcatttgacgagccatgggaaggcttccagcaatgggggatgtggttttacttgtaccttaagaagatcacactgggtcttgtttggagaatggacaggaaaggagcaggagagcaagcagagagtctgaggkgcaagaaatgccctgtcctcccagcagactggagcgaattctaattctgcctctgctacttcattcctatgcaactttgggcaggtttcctaatctctctgcctctcaactgttcacccctcataaaatgaggacaagtattttctcatgtggtttctaggacaaataagtattcgtaaagtcctctataaacttgggccatatgcttatctgagctataatatgattcatattgaaaggagggggactcctgcaatgttgggaaaacgactcagctgcccctatataaggaatatgtta

SEQ ID NO: 199689 - DNA, 601 bp, Human
attgttaggataaagtttcataagtcttatatggctttgaacaaagcaagtctatttttcatcatagtatgggttatttagaattcatatgttatgaggaaatacactgtttcaaatgcagttttctttgtggtgtctcagcagatactgagttttgctgccctgtcatccaagagggcctcaaggtgcccagagagaccaactgaaaaatgttcactggaacggagctgcaatggtggaaacgttctgtgtgtgccctgttcagtacagcagccactgcgcggctgctgagcccttgaawtgtggctatcagggtagaagaactgatttttaatatattgaattatgagtcatttaaatttaaagagcacagctgtattggacagcacagctgtagaaggatgttttctctcatggaaaaccccaactctgagccccaggggtcctatggatccatgagctcacagactcccctaacgtccatgaagatcatcaccaggatttgagggaatgctgtggtgcatactttgtgttggacagttatgggggattgcttttgccgtctcagcatttcaccgctgtcctcggtatgagattatgg

SEQ ID NO: 199690 - DNA, 601 bp, Human
cctcagtgagagtatttgtcacttcctactcttggtgtttaatatcatccctctggcacagatgcttgaaaatcaatggtttcttgacacatcttggcttgtgtgaggggccataacaatagcagggctcatggctcctttttttttttttttttttttttaaagagatagggttttactctgtcacccaggcaggcaggggtgcaatagagtgatcatagttcactgtaacctcgaactccaggtctcaagggatcctcctgcctcagtctcctgagtaactggatctatacacatgtgyccccgtacctggctaatgtggcttcctttatgttcagcaaggaactctcagtgtttgtccatttccttaggaacatgagtgtttttggaaggcctttgatgagtggcagttgggtggatggatgagctaatacatccatcatcctatctcaggaggatgcttggatttgtgtttagaaattgggtaactcagttgttcatggaggaaaaagttgaacattactcaagtgcagatagggaaacagtgtaagaacaaaaaactttttttctatctacaagtgaggaaaaaaatattgacagt

SEQ ID NO: 199691 - DNA, 601 bp, Human
agcattcagcataagagggtcctgcctctcagattaaggcaccagcattcagcataagagggagtaattgacattctacatggcaaaagacccttgaaagataacagatgaatgtctcatggccagtagcttggtttttttgcatggtgtagatttagaatataacttttacagggaagaaaggggttaaaatgtctggtgccatctgtcacagtaatgagttgtgcaaagcccaatgaaccttgtagaaacaacatcgtgcccagaaatagcctagacctcagagtgacatcagggggcrgggacctgatagatgtggtcctgcaaaaggaccgaaggttcttctttaacaattcaaattgaataggaaccatttttaatttgggggtaactccgtcttcaccattaatggccattcttcaaagctactttcattcctgtgagggatggccagacacgagaaagccaagcagggattttcagttacaggtgagcatccgatctgcagccagggctttttctaccgggcacatctttgtgcgcagcctggtttgagctgatctgcacataaacaggcactctgggtgtggatgggggcatc

SEQ ID NO: 199692 - DNA, 601 bp, Human
ttatggctatatttccagaatatgcttttaaagactgtggtcacatttaccttggttagggaagatagtgacttataaaaacctcaaacatttatgtttccctttccaatataaaaagtgttaataatttacccacttaaaaggttaagatcaaagagatcataaacacacatgaatactatttcaggaacataaaattcagctatttctactaacagaaagtgagtttatgggataccaatgcaaacaaacatagatttagtggaaaatgactcaaccaagtaagatttacaaaacaaacaaaactgttttcatcatctttggttgtagttttataaagaatgctggttcatggactccagacacttcattgaaactgtgtgaatcattttaaacaggtttgtccttgggccccagatagtacattggcatttgtgaatcattttagatgagtttgtcctcagtacaaatcgtgctgtgtttaaagttcttggagacacttctctcttccaataaaaggcttttactagatgtttcagtgacataaagttgaagacataaatactgttttatattgtaagcaggaccaactcttttatgg

SEQ ID NO: 199693 - DNA, 601 bp, Human
acttataaaaacctcaaacatttatgtttccctttccaatataaaaagtgttaataatttacccacttaaaaggttaagatcaaagagatcataaacacacatgaatactatttcaggaacataaaattcagctatttctactaacagaaagtgagtttatgggataccaatgcaaacaaacatagatttagtggaaaatgactcaaccaagtaagatttacaaaacaaacaaaactgttttcatcatctttggttgtagttttataaagaatgctggttcatggactccagacacttcaytgaaactgtgtgaatcattttaaacaggtttgtccttgggccccagatagtacattggcatttgtgaatcattttagatgagtttgtcctcagtacaaatcgtgctgtgtttaaagttcttggagacacttctctcttccaataaaaggcttttactagatgtttcagtgacataaagttgaagacataaatactgttttatattgtaagcaggaccaactcttttatggtgtgttttatacgtctagaggatttttgttgttgttgtttctttgaggttttctctgaaacttcagatta

SEQ ID NO: 199694 - DNA, 601 bp, Human
gatagtacattggcatttgtgaatcattttagatgagtttgtcctcagtacaaatcgtgctgtgtttaaagttcttggagacacttctctcttccaataaaaggcttttactagatgtttcagtgacataaagttgaagacataaatactgttttatattgtaagcaggaccaactcttttatggtgtgttttatacgtctagaggatttttgttgttgttgtttctttgaggttttctctgaaacttcagattaaggtagtccttgaagtggaggctattaagacctagtgttatctgtytcagggaggtgggggactaggtggactgatggaccccagaactccagattccttgcactggaagctggtgttttgtgtttggaagagcctctgccctctgtgtcatgctgcagtaaagtatgggtcaacatccccaaaatgtgtgactcgcccaaattaagtggtgtcatactctgatccttcttccactgaacatcacattcttcatgagaatcacaccattgtcctctgtctgccctgcctgtgagacgggccatgctctatgcttgcccgcctcttccatcaggaacactcacacag

SEQ ID NO: 199695 - DNA, 601 bp, Human
gtagtccttgaagtggaggctattaagacctagtgttatctgtttcagggaggtgggggactaggtggactgatggaccccagaactccagattccttgcactggaagctggtgttttgtgtttggaagagcctctgccctctgtgtcatgctgcagtaaagtatgggtcaacatccccaaaatgtgtgactcgcccaaattaagtggtgtcatactctgatccttcttccactgaacatcacattcttcatgagaatcacaccattgtcctctgtctgccctgcctgtgagacgggccaygctctatgcttgcccgcctcttccatcaggaacactcacacagtcattctcctcacataccccactctcatctgctgcccctcacacctgcccttctatagaatgttctaccctttaatagggaagggtttcttcttcctatgaatttttacctcactttgtgtctttttaggtttgtattggaactatttgcaaacaggtcttggcttatctaaagaaaaattgtaagctccccatgacgcaagacagtatcttatttacctttgaaaacctcatcacactctgccctgctcagagtac

SEQ ID NO: 199696 - DNA, 601 bp, Human
ggtgggggactaggtggactgatggaccccagaactccagattccttgcactggaagctggtgttttgtgtttggaagagcctctgccctctgtgtcatgctgcagtaaagtatgggtcaacatccccaaaatgtgtgactcgcccaaattaagtggtgtcatactctgatccttcttccactgaacatcacattcttcatgagaatcacaccattgtcctctgtctgccctgcctgtgagacgggccatgctctatgcttgcccgcctcttccatcaggaacactcacacagtcattctyctcacataccccactctcatctgctgcccctcacacctgcccttctatagaatgttctaccctttaatagggaagggtttcttcttcctatgaatttttacctcactttgtgtctttttaggtttgtattggaactatttgcaaacaggtcttggcttatctaaagaaaaattgtaagctccccatgacgcaagacagtatcttatttacctttgaaaacctcatcacactctgccctgctcagagtacaatctaaataaaagtctattgaatgactgaagtagagtttcttttttaaca

SEQ ID NO: 199697 - DNA, 601 bp, Human
ctatgcactgtgctaaagggtggacatgctgagatgagtgtgagtggcctctgcaccaaagagttcagtctaattctgggggttggggataaatatgttagccagtaaatgccatttattgctttagatgtcatctcagaaggataaggagcagtggggacaggaggagcaagccatctcctgggggagtcaagaaagatgaggacagagagagaatgtcccttggatccaatatggtggccattagtgaccttgttaaaaccagtaggaatggggtggcaagaaggagagtagaacagaytataagaaagaatgagttttgatgaaagtattggaattttgatgaccttttttattacaggtttgggagcaactactttcttcactctctaaactgcaaatcattcagggtaattgtgctggttcagttagcccccaagctgagaagacaggcccactgtggtttgagtaacttggaaatcttgtggggtcagtgttttgactctcttcattttggtcatggttcaggattttcacacaccactaaggtctaggggaagcttctcagctttctggataccctctcagggctcatgaagtg

SEQ ID NO: 199698 - DNA, 601 bp, Human
aaaatttttaaagaccactttatgatataataatataccagctttttcttgatgcatgaaataagaagatctacagacattttgagtactgttaagcataaacaatatttcaaggtgtctacaactataatatagtgtgtaatatctcagatttctatcgacggtagagtcacaggtctttctaatacttttgtggtttgatgcctacattttataatggaaggaaatgctaaatttcagttagaggttaataaaaataaagaaggaaaattcttttcctctatctaaatccacagatgcyctgaattctcttcgaggttaagaacttctggtttaagatatgcttttggttgacagtagtaaaacaagccaaaagaagttgaccatttatgtgatgtgcagtaataaattagcaattcagagttgaggagctcattactaatctgtggatagtcctaatcccagcccttttctttctgagctttgccttttgtaaatctcagtgcttcacacacatcagacaaagatattttgtgagtggctctaaaaatgggggcaaaacatgaccctgaggaggcctggggctgatctgagccttaag

SEQ ID NO: 199699 - DNA, 601 bp, Human
ggtgcttgacatccatttctctaatcttcacaacaagcatgcaaggttgattctgtcatcccattttacatctgagaaaacaagctcagagagagtaagtaaagtggccaaggttgcagtttgcaagaaatggagcttggaccccctctgaccttgaactggctgacatcaaagttgtcgctttgcctggtcctgtcacctctcttcctcagatgtctagtgtttattagacctccatagtatcttcaccaactgagaaggtgccccatcagcctgaggaactcccagggtcacccctctmcaaggattcttgacacttgcacttctacccactctgggtcagaagctattcttccctcattggattgccaccattcttgtaagggcaccttctctgcaccacagttttttgctcacactcctcctatttttctcttctcagcttccctatgcctcatgatgccaggcataaggcacacagcaaccaagtgttggcagaaggcaaattatatggtttggctgtgtccccacccaaatctcatcttgaattttagctcttataattcccacatgctgtgggagggacctggtgggagataat

SEQ ID NO: 199700 - DNA, 601 bp, Human
ttggattgccaccattcttgtaagggcaccttctctgcaccacagttttttgctcacactcctcctatttttctcttctcagcttccctatgcctcatgatgccaggcataaggcacacagcaaccaagtgttggcagaaggcaaattatatggtttggctgtgtccccacccaaatctcatcttgaattttagctcttataattcccacatgctgtgggagggacctggtgggagataattgaatcatgggggtgattttccccatactgttcttatggtagtgaataagtctcatgagktctgatgcttttataaggggaaactcctttcacttggctctcattctctcttgtctgctgccatgtaagatgtgccttttgccttccaccatggttgtgaggcctccccagccatatggaactgtgagtccattaaacctcttttactttataaattacccagttttgggtatgtctttatcagcagcatgagaacagactaatacaccaattgaggttcctccagagaattaacaaaatgtccatgcactctttcgttgttcccccatacccacagacctgccatccctggccctgcct

SEQ ID NO: 199701 - DNA, 601 bp, Human
catgggggtgattttccccatactgttcttatggtagtgaataagtctcatgaggtctgatgcttttataaggggaaactcctttcacttggctctcattctctcttgtctgctgccatgtaagatgtgccttttgccttccaccatggttgtgaggcctccccagccatatggaactgtgagtccattaaacctcttttactttataaattacccagttttgggtatgtctttatcagcagcatgagaacagactaatacaccaattgaggttcctccagagaattaacaaaatgtccakgcactctttcgttgttcccccatacccacagacctgccatccctggccctgcctggatgccggtacctggccactgctgctatattccatgcttttggacaagagcatgttcagtattgtccaggagacccagggagctcaagacagagctgagatccagttcctacagccacagttaacaccccagcccccgacacacacacagacttttcaatgcaaaatcaaaccattcccaaatatccagctacatattgttttacctttgaagagaaaaaagcatcagtggggttatgtgatttt

SEQ ID NO: 199702 - DNA, 601 bp, Human
ctggatgccggtacctggccactgctgctatattccatgcttttggacaagagcatgttcagtattgtccaggagacccagggagctcaagacagagctgagatccagttcctacagccacagttaacaccccagcccccgacacacacacagacttttcaatgcaaaatcaaaccattcccaaatatccagctacatattgttttacctttgaagagaaaaaagcatcagtggggttatgtgattttcatagatgaacaatttttgcaaatatgttaattgaagagtaattggtgctttyttgaccctcctgagcactgatgcttgccaaagggttatacatttcagactaatgatgatatccattactatatgtgcaattgcttataaactaatatatagtcatattaaaatctctaatctgattgagaaattttcagaaacaaggtacactgattttctcaccacttatttcctgctctcatgacagaatttctggagttctttgaattcacctggtttttggagctctgtcaagtcaatatttataactgaactagttcaaacagttcaagcattgtctcttcctttctggttgaag

SEQ ID NO: 199703 - DNA, 601 bp, Human
tgcaaaatcaaaccattcccaaatatccagctacatattgttttacctttgaagagaaaaaagcatcagtggggttatgtgattttcatagatgaacaatttttgcaaatatgttaattgaagagtaattggtgctttcttgaccctcctgagcactgatgcttgccaaagggttatacatttcagactaatgatgatatccattactatatgtgcaattgcttataaactaatatatagtcatattaaaatctctaatctgattgagaaattttcagaaacaaggtacactgattttctyaccacttatttcctgctctcatgacagaatttctggagttctttgaattcacctggtttttggagctctgtcaagtcaatatttataactgaactagttcaaacagttcaagcattgtctcttcctttctggttgaagttctgtcttagaagactgttgtagtcagctgtgcttgtcataaagttttgtttaaaattattttagaattttcttctttggctttaatttaaatttttgtttgtttacttttttttttttttttccccggctcactgcaagctccacctcccaggttcacac

SEQ ID NO: 199704 - DNA, 601 bp, Human
aaaatctctaatctgattgagaaattttcagaaacaaggtacactgattttctcaccacttatttcctgctctcatgacagaatttctggagttctttgaattcacctggtttttggagctctgtcaagtcaatatttataactgaactagttcaaacagttcaagcattgtctcttcctttctggttgaagttctgtcttagaagactgttgtagtcagctgtgcttgtcataaagttttgtttaaaattattttagaattttcttctttggctttaatttaaatttttgtttgtttacttttttttttttttttccccggctcactgcaagctccacctcccaggttcacaccattctcctgcctcagcctcccaagcagctgggactacaggcgcccgccaccaggcctggctaatttttttgtattttttagtagagacagggtttcaccgtgttagccaggatggtctcgatcttctgacctcatgatccacctgcctcggcctcccaaagtgctgggattagaggtgtgagccaccgtgcccagccttgtttactttttaatttataggattgtaaatgaaactatacttggcct

SEQ ID NO: 199705 - DNA, 601 bp, Human
gtttgagccactttcctttgacacgtctcagacttgccctgctccacttggaagtccttggagcagcccacacgcacccccgccgagctcactgtctcagaatgtgggaccacctaccagctttactcctgcgtctaactctaacttgtgagattgtgggggccagagtccccaggaggcagtgacgctgtgtgcagaaaagccaagagctccagggctgaacagatgtgactgaaaatctttaccagccatgtgccctggggaactgagcctttcatttcccctttccttttctgtatawtggaggataacaagccttcactcacagggcgtgggtgtgtttctcatctccttgcagcacctagcacagtacctggcatctcatatgttcagggcatgtttgctctcctcccttcctttcccatcgtgactgtcaatcgactgttcccttggggcttgagattcttggattccaaaggaaagaacacagggccaggagtcagaatttcatccttgcctccgctgatgtctaattctgggataacgctgggccactcagtctttggattccctgccctaacacaaaatccatatttatctc

SEQ ID NO: 199706 - DNA, 601 bp, Human
atcaccacagattcagaaccctgtggaagatcaggaaaaactgtgggctaacccagcctcctaggcagggttggggcaaagctgtggaaccacctttcacagtgcttcagaccactgtaagtgtaggggaaaactagcagattgtgacccatgccttgtagattagagttgtagactgaaccacagagaagggtttgggatttgagatatccatccaggtgttcacgtaagtgctgagatttttaccaaggcatcgcattatctcccaaagcctctttcccatcatcctaagtggggttcyctagaagcagagcctgagaaagggaattgggaacacatggtctaatgatgctgtgctcttagggaaaacctgtaaaggaaaggcatgggggctcaaaatggttgtggtctcagataaagtctggctgagggactctggaacaaaaattacaccaaagagttgtcctcaccttgaggcaagaggggcttcccttttgtgccccatatcattcagccattgactggctgtgggggggaagggaagtgtaaccctccttgaaaggagatcccctcagctgaggatggttctctagagaagaat

SEQ ID NO: 199707 - DNA, 601 bp, Human
ggtatgagtgaagtaaatggaagagtgttagtgggtgaacttgaactgtacatggaagagctggcttcctgcctacccagggaacagagaagctgcagccacagccaggccaacagttacagagggggccagagtaagaagtgggactgcaagtggtggtggtattgagggaggtcagtgaaatgtgaaggttggtatgaagaagggttagagttgacttttcaccattgtccccacccctacaggcttcaggcatgcagaatagcaagcagccaggcatcgccttctctaaagtgttaartaaactgtttaagatagtgtgggcgacctcgttctcagagaaaagaaagccttacttctggcatttgaagtcaccaacgtaagagctagctttctctcccacaatccacccaaacactttcacagattttctactcagtccttttaccttagtttgaaatatgaatggacaaccaaggaaacccaagattgaggaatatttggtgcatgaaaggaaaggctaaaataaaccaggagaataactaacttaaaaggaaacaaatgatttagggaatataagagattattttaaaaaatttta

SEQ ID NO: 199708 - DNA, 601 bp, Human
gggaagtgttcttaaaaattaaaaatatatttgcagcaccaaaaactcagtggaagtattagaagacaatggtaaataatttcccaatggaagtgctaaaagacaagtagaaaagaaagctaaagaataaatttacggggtcctatatctccaagtaataagaatactagaaagtaagaataccagtaataagaaaagagaaagaagggggagaaaattatgtaataatagaatagcatgtttcagagttaaagagggagactattttttaaaattggtgtaaacaacaatttacaatcamaataaaccaaaattatcatagacacatcattttgaaatgtcagtgcttcaaagacaaagggaaaattctaaatgtttcgagggcaaagaatgcaggaatgttgatcatggaggataagtcagcttacaacagaatgagagtcagactgagtagtccattagactttttataagcaagattagaaactaaactatgatgaaataaaggcttcaatgttctgagggaaaatgattttgaaattagaattttgttttcagccacacaatcaaagtatgtggtaaaaataaagtcacttttcag

SEQ ID NO: 199709 - DNA, 601 bp, Human
gaggaagcaggtgctctgctgcctttccacatcctttcctctgaggggggtcccgtctctgcaggcccgtgggtgggctccccggtgggacgcaatggcaccatcttaggcaggagtccccaactcctggatcagtaccagtccggccacacagcatgaggtgggcagcgggccagcgagtgttaccgcctgagcgcccctcctgtcagatgagcagaggcattagattctcacaggaacatgaaccctacacatgtgagggatctagattgtgccgaaaccatcccgccccctccaccgyccgttcatggaaaaattatctttcacaaaactggtccctggtgccataaaggttggagaacactggtctaagggttctggcaggctctcagatgaacctctctggatctttagggtgtctggccctcacgtgtcaggcccaaagatgcctgttagtctgtcgcagagggagaagatctggggaggacccatataaccagaactcgggagccagccgcaccaccatgagcccagatagcatgagtcccttctcttttctccatctctgctgccattccctaggccaggccaccatcatttg

SEQ ID NO: 199710 - DNA, 601 bp, Human
tgcctttctttgttttgacacagggtctcattctgtcacttaggctggagtgcagtggtgtgatcatggctcactgcagcctcgactttccaggctcaagtgatcctcccacctcagcctcccaagtagctgggaccactggtgtgtgccaccacgcctggctatttaaaaaaaaaaatttttttttctggacacagggtttccccatgttgcccaggctggtcttgaactcctaggctcaaggaatcctcctgcctcagcctccctaagtgctgggattacaggcatgagccaccgtgcrtggccttagctgcctatttgattccttcgtgacatctaacagaacgtgttatttcgtctacttgttattgtatttacctctctagaatggaagcccagtgagggaagggatctattttatcttatttgctattgatccgcaacacctggcagagaacctggcctatagtggatgcttagtaaatagtaaatagttgaaagagcccttctggaagaacacaaggctagttcctttggcaaaaattgggcatcatatcagagcttcttcactagcagattcagcagagctataaaattaaaa

SEQ ID NO: 199711 - DNA, 601 bp, Human
aaagacaaataccacatgttctcgtttataagtgggagctaaataatgtgtccacatagaagcagattgtgggatgatggacaatggaggggtggggaagttggagctgggtggatgatgggaggttgcttgttgggtgcaatgtgcattggcccagtgatggatgcaccaaaggccctgactttgccatgacagaatatatcaatgtggcaaaactgcacttgtatcccatgaatatataccatgtttttaaaaatgttgcctttgggcagaggggataattctgcaaactgcagagccrtggagtaaaaaaaacacccaagatagcagaacttgtcatttctagtttttccacaggaccataaagcaaaattggtgccgggtttgtatttaaagggaaaccaagagggtttttttatccttccatggtttcaaaatctggaaggacaatttgtacagaccctgagatagaaggattcctcagctttaatttcatgaacgatttgcctttcattgattcttgaggatatgaatgttttagaaagcaacagtgtatgccttgattttaagaggcaatgagccttttccttccttcgtttag

SEQ ID NO: 199712 - DNA, 601 bp, Human
atatcaatgtggcaaaactgcacttgtatcccatgaatatataccatgtttttaaaaatgttgcctttgggcagaggggataattctgcaaactgcagagccatggagtaaaaaaaacacccaagatagcagaacttgtcatttctagtttttccacaggaccataaagcaaaattggtgccgggtttgtatttaaagggaaaccaagagggtttttttatccttccatggtttcaaaatctggaaggacaatttgtacagaccctgagatagaaggattcctcagctttaatttcatgawcgatttgcctttcattgattcttgaggatatgaatgttttagaaagcaacagtgtatgccttgattttaagaggcaatgagccttttccttccttcgtttaggcatggggctgaatggagctgaaattcctgcactcttataacgtgccacatgaagggcagttttggattctgggaaaacagcccattgaaacagaattgggagggagaaacctcttacactcaggtcatggtatttatatgaatacaaaaaaaaatttaaatactgtgctaggtgctgggggttataaacatgaatta

SEQ ID NO: 199713 - DNA, 601 bp, Human
tgaacatgatagctggactaggctaagaatcctatttcctgttagatcagaagtgaagattttctggtacagatttgggtgggagaaatgagctacccttcccaaggccttagcacctagatgacatcctctctgaagtcaccctcagccaggagcggacactgagctgctatttctgaatcacatgtccccaaagctgccctggccttggtgaccatggcactgtaagagaagcacagccagccccagcgtccttactctgactcagaggaaaatgcaacttgagctggattcattgaawtcttttttttcctggcctgaaggaaatgaagaaacatagccaaatattctaaaacaggattcaacaaacagcccataggccaaatccaccactgcctgtttttgtaaataaagttttattggaacacatctatgcccattcccttatgtattatctatggctgcttttgctctacaacagcagagttgagtagtgtgactgagaccgtatagcctacaagcccaaaacatatactgtctcacccttttcagaaaaagttgccagccttgttctaaaagaagtagagtaaggatttagtga

SEQ ID NO: 199714 - DNA, 601 bp, Human
ataggccaaatccaccactgcctgtttttgtaaataaagttttattggaacacatctatgcccattcccttatgtattatctatggctgcttttgctctacaacagcagagttgagtagtgtgactgagaccgtatagcctacaagcccaaaacatatactgtctcacccttttcagaaaaagttgccagccttgttctaaaagaagtagagtaaggatttagtgagaagctggagaaaatattttcaaagacaactgtattctccagggaaacctgagatgaagaccaaggtgaggaagragccagcagagaaatcgagtccatgaggctgaggaggccactggatgtccagtcttcagctctctgaagcctgagacaggaaacagttgtctcccgagagaaaggtttgaacctcctttaactagggaggaataagagatgatggcttcttagatctgtttacatttgctggaaaaacttcttccagggaaataactagacagggctttggccaactagcaggtgaagtctggagggaggtggaagagactgcttccaagctgggttccgatttgtctgattgaagcagccaagcttgtg

SEQ ID NO: 199715 - DNA, 601 bp, Human
actgcctgtttttgtaaataaagttttattggaacacatctatgcccattcccttatgtattatctatggctgcttttgctctacaacagcagagttgagtagtgtgactgagaccgtatagcctacaagcccaaaacatatactgtctcacccttttcagaaaaagttgccagccttgttctaaaagaagtagagtaaggatttagtgagaagctggagaaaatattttcaaagacaactgtattctccagggaaacctgagatgaagaccaaggtgaggaaggagccagcagagaaatygagtccatgaggctgaggaggccactggatgtccagtcttcagctctctgaagcctgagacaggaaacagttgtctcccgagagaaaggtttgaacctcctttaactagggaggaataagagatgatggcttcttagatctgtttacatttgctggaaaaacttcttccagggaaataactagacagggctttggccaactagcaggtgaagtctggagggaggtggaagagactgcttccaagctgggttccgatttgtctgattgaagcagccaagcttgtgtttgccagaggactta

SEQ ID NO: 199716 - DNA, 601 bp, Human
gtaaggatttagtgagaagctggagaaaatattttcaaagacaactgtattctccagggaaacctgagatgaagaccaaggtgaggaaggagccagcagagaaatcgagtccatgaggctgaggaggccactggatgtccagtcttcagctctctgaagcctgagacaggaaacagttgtctcccgagagaaaggtttgaacctcctttaactagggaggaataagagatgatggcttcttagatctgtttacatttgctggaaaaacttcttccagggaaataactagacagggctttgrccaactagcaggtgaagtctggagggaggtggaagagactgcttccaagctgggttccgatttgtctgattgaagcagccaagcttgtgtttgccagaggacttaggaggatgtggataaaatcaggctgaggcctttttttaaaggcccaagctggagctattgggattgttccctcagaggaaaatcaggagtttgggccattggcttcatggagaacctgtactttgtaccaaggagaagtcatttctacttggtttttgaaactgcattgtcatctagtattccaaggctttagtc

SEQ ID NO: 199717 - DNA, 601 bp, Human
ggagcagagggaaaatcagagtttttatgcaagtaaagttacattgtgaacttataacagactgttacaaattatttcgtgtaagctcctggtaaccaccaagaaaatacctatggaagttatatatataaaaaaagaaaggaatcaaaacctatcgatacaaaaaaaaaaaagaaacaaaacaaaagaaaaccgcaagggagaaaaagagggacaaaagaacaagacacatagaaaatagtcaccaaaatggcaatagtaaatctgtctctatatttactttaaatgtaaaaagactaamcttcccaataaaaagatacagcatgactgaatagattattaaaaaaaacaacaacaaccaggatcaaactgtatgctgtctacaagaagctcacttttagattcaaggacacacagagagatggaaaaaggtagtccatgcaaataccaaccaaaagagagcaggagtggttaatacttatatcaacaaaatagactttaattcaaaaactgtctctagagacaaaggtcatttcttaatgacaaagggtcaattcaacaggaagacataacaattataaatgcacccagcatcagagca

SEQ ID NO: 199718 - DNA, 601 bp, Human
tctcctgggttcaagcaattctcctgcctcagcctcccaagtagctgggattacaggcacccaccaccacacccggctaatttttgcatttttagtagagacagggtttcaccaagttggccaggctggtctcaaactcctgacttcaggtgatcacccgcctcagcctcccaaagtgctgggattacaggtgtgagccaccatgcctggccccaccatccacacccagccccaccatccattaattaagcttcatggtgttcactcagtcacactgttgtcgctctcatttgccaatgttaaatagtgatgcacagtgcctaagacaaaatcgctatcactgcaagctcctacccctggctaaatgctaatctggatttatgggacagtgacgagtgctattattttcattttataaatgaggaaactgagtcctggagggaagaaaagtcaattttcttaatgtaatacaattaaaataggattacactttgaatttccttatttcttaactagtattttatctttccatgattgtgcttaattttatcttatcagtacaagcactcatataacctgtagggatatttgtgtacatgtg

SEQ ID NO: 199719 - DNA, 601 bp, Human
gattgagatgagcagtaggaggaaaaagtgtgtggaactgtgagagctcacgatgggcctgaacttgcccagggactcagagaagtggtctggatttgcttgttgaagggtgagaggacatgtactaggtgaaccagctggaggaatctggggatccacttgtggggaggccctgggtgggaagttgtaaggacaaccagagtgatagctggcatgagaaagccagggtgacagaggtgaggagggcacatgccagatctggcagcctgcatgtcaccagatggatttaggtcacatcctkttcttccgttctcacctctttcacctccatctccacctccacctctaccccttcacctctccatgcctcacaaagttggactgtcttgcctgtgagacaggaaaggcatgtgtgatgaggggactgtacactaggggccagtccaggttttgtgagacctgaggcttatatagtagagggtggggtcttgaaggaaaaaaaaaaaaggtgaaattatgaagacaaagtttgtgcaaggcttccctaggggccatgtcagctggggacctctaagctgaagtttcactagtgtggtgggga

SEQ ID NO: 199720 - DNA, 601 bp, Human
tatgaagacaaagtttgtgcaaggcttccctaggggccatgtcagctggggacctctaagctgaagtttcactagtgtggtggggaagctccctttggcaccttccctctgtcctcaaagctcataaagcccacctttcatcttgcctgagacgttcatgccatccttacacccacttcctcctgttttcttcttagttaagatggcaaagaaagagcaaatatattgaaatctcctggaaatttggctctctccttgaccccagtagtgtccaaaagaacacaggaatttcctctttttkcccaagacttccatgatattttccctgataatcaaggaagggagtgttggctgggacacttttttcttttggaaatgtggcaggggaatatgaattttcataggcgaaattactctgtctggtcgagtctagactgttcgttggccagcacgtttgctggcgcccacactgacactctgaggtgctgcctggacttattctctgggcagggaagaaataacctggaactacattttggggaaaaaactcacgaacatgagcagtgacaaggaagaagtttaataatgagtaaattacaac

SEQ ID NO: 199721 - DNA, 601 bp, Human
ggaaaaaactcacgaacatgagcagtgacaaggaagaagtttaataatgagtaaattacaactaaaagttgtcaacaggctcttctctccaaattccactgaaatgagcaaagccatctaacagtagtgaagagtctctgtcatctggaacttggggaagctactgtccatagatctgaaatgtcagagaggttgagacagattgaggggaagactaacaagccctccatggaccgtagaagaaagccctaacccctctccaaatgctgctgctgatctcctggcaagcctccacagatargcccaggcccaggcacagccagcaagctctctggaaatatttgggttttgacatgccaagacttggccccagtaagggctgggtggggctttggctgttgaggcccagtcttggttagagaaaaggcactgtgtccctgttaactgctggctgccccaccaacaaactggaaagaatctcccccagtctgttgtgattccctcagcctgatggcctaattgcctttgccttttcctgttaatactgacaattcaatacagtcccattgctcaggcagaacctatttcatatataaatttc

SEQ ID NO: 199722 - DNA, 601 bp, Human
gtgttgattgcaattccacatatctcacaatgtagcttgtatttctaatttctatgagtatttgaggggtggctattttatgcttgctgattgtattaagttgaatcatatgaaattgccaatatttgaacttttggacaatttcatatgtatgattcatcctattattaaataaaggtttatgccctcctgcctccacacacacacacacacacacacacacacacacacacacacactagtgtatgttttaacaagtaacatttctgtggcaggagagggctgaaggagaggggcaggytgccctgatccaagtgagcagatagtctccttattgtttcagggtttcctcccgcactacatgaatcccccaaggctaaaggtgaaccgtacagcggccttctgtttcctctttgccaaccttttattttagacttcatttaggatgaaggtgctggtcctgatcatttagcctcatttcacagaatggcttccttttgaaacagttccttctgaaagactgttttagccttggggccagaaacccctctattagttttattaccatttctgaaaaacagtcactagttttggtagttat

SEQ ID NO: 199723 - DNA, 601 bp, Human
tagtgtaagtgcttttaacctaacaagaatacagccagggggccaggcgcagtggctgtgcctgtaatcccagcactttgggcggctgaggcagatggattgcttgagctcaggagtttgagactagcctgggcaacatgtcaaaactccgtctctaaaaaaacatacaaaaattagccaggcgtggcagcaagcgcctctagtcccagctactcgggaggctgaggtgggaggatcacttgagcctgggaagcagaggttgcaatgagctgagatggcaccactgcactccagcctgggygaccgggggcaaaaaaataataataataatgcagctgggcacactccaggagccagggtggggaagggagaggagaacattgagatggtataggtcattttaccctctattcctctcagtgaaagtacgttccagcttgagttttgagtttgctcctctctccaaccataacagttcctgcttccctgccttgggtaggtctgtggggcagctgcccttcatctcagtgcaggagcagccttttcagggttggacttatgagagatgttgtgctgatttccaccatggtgcccccctccc

SEQ ID NO: 199724 - DNA, 601 bp, Human
aatggcacaatctcagctcaccataacctccacctcccgggctcaagcgattctcctgcctcagcctcccgagtagctggtgttacaggcatgcaccaccatgcctggctaattttctatttttagtaaagacagggtttctccatgttggtcaggctggtctcgagcttcccatcttggcctcccaaaatgttgggattacaggcatgaaccaccgcgcctggccgagtcagcacattctttatctatgtaggttgcattttctctccttggagagcctcagattcaatggtgagcttayggctggcatgccagcagtttcctaaaatgtaatatcatcactattattgttattatatgagggaaggtgaataggaactcatcagaaacctggaaaatgttgtcagaacattagccgtgtaatttttttccccttcattgtctgcaccagctctgaagaaaaaatgcagaagtttgttgatttggagtagctggcttttttttttttttttttagatggagttttgctcttgtcacccaggctggagtagagtggtgtgatctcagctcgctgcaaccttctccgcctgggttcaagcga

SEQ ID NO: 199725 - DNA, 601 bp, Human
gacagacagggattagagtcacttatctgaggtcaaaaaaattaaatagcagaggcaggagaaacacctggtgggaggctccaaagcctgatattctagcaatttgacccatgggccctcactttaaataaccattgcagcttggggaacctggcctgtctttaggtggaaacaagttttggaaattcctcctattgcagaaagcatttgatttgcagtttcctgaatgcgaggctccaagtgtagggaccgccacccaaggacgtttttctctgttgggcagactcaaagcactgagggragcttttcagggcccaccatacatgagcaacagatagctctccctacagataccatatttcagggacagccccttccctcctgagcagacactggctgagattttccagcttcgactttctagatggtgagaggatggggatgctcagagggacagtgaaggcactgaggcagtaactgtggcaaccatagaagaggctggccacgtgctcatagcggccttcctcctgagacacccgggaaggctgagtctacctcacaggtgtgcctgataaaatttttttgggcagtgttttccttg

SEQ ID NO: 199726 - DNA, 601 bp, Human
ttgatttgcagtttcctgaatgcgaggctccaagtgtagggaccgccacccaaggacgtttttctctgttgggcagactcaaagcactgaggggagcttttcagggcccaccatacatgagcaacagatagctctccctacagataccatatttcagggacagccccttccctcctgagcagacactggctgagattttccagcttcgactttctagatggtgagaggatggggatgctcagagggacagtgaaggcactgaggcagtaactgtggcaaccatagaagaggctggccacgwgctcatagcggccttcctcctgagacacccgggaaggctgagtctacctcacaggtgtgcctgataaaatttttttgggcagtgttttccttggcttccaaacatagccatccattggaggttttatgtggaagcatctttccagcaggcacaatgacatggctatttcccttgtgactggacgcaaggaaaggatctatgaagagaatgtagccccgaatccctcccttctctcaacttggagcagacagggagccatgtgtggtttccttgctaagatttttgcagtttattctgtgt

SEQ ID NO: 199727 - DNA, 601 bp, Human
gtgagagggaaggtaccttgtagaaaacctctagattttatgagcttgtttccctgactgcattccagagccacgtgtgagacttgggtttaacgtgacctgtccgtaaatcattttgctgaaattgcagtgagagggaaggtaccaggtagagaacctctagattttatgagcttgcttccctgactccattccaggtgatcttgatccaaaaatgacgaggctgggtggttgccattggtgtcacacccacatcccttgctgtgcaggtgcactgctcccagctgctgtgctggctgcwagctgctcacagtggcccgtcctttggtctggaaagtcacccttgccctgcctgggagggtgacttgttagccaatggctggctgatttggggtgtggattaactccctggtgcagtttatgctgcacagctccccttggtgtctggttgaggctagattccccctgtgcccacagccttggtccactcctgccctgtccctgccccagcctggttccctggctcgccaacagatccctggatctctgccacaagctctggcttccagggaagggagcctatcctgagatgcggtagaac

SEQ ID NO: 199728 - DNA, 601 bp, Human
tcacacccacatcccttgctgtgcaggtgcactgctcccagctgctgtgctggctgctagctgctcacagtggcccgtcctttggtctggaaagtcacccttgccctgcctgggagggtgacttgttagccaatggctggctgatttggggtgtggattaactccctggtgcagtttatgctgcacagctccccttggtgtctggttgaggctagattccccctgtgcccacagccttggtccactcctgccctgtccctgccccagcctggttccctggctcgccaacagatccctggawctctgccacaagctctggcttccagggaagggagcctatcctgagatgcggtagaacctcatgttttatttatctgctcttagatctcctgtccgggcaggctgattgctttttaggattccaagtttcaaaaggaaatcaaatccaatgtatttatcagacattagtgggagagaaaaaaaaacagttgctcattggctttttatttgccctcttggaattgcagaggattttgttatttttatatttaaaaaccagacttgtggagtaatgtgtgggagaccccttcaggctggtcca

SEQ ID NO: 199729 - DNA, 601 bp, Human
ctgatctgtgaacccggataaggaaatgattgcattttgttttcactaacttcacactgaaatttaacatcatattcaattatgaatgtaggaaacagactacagtaatattaccaggacctgtgactctgtcccaaatagaaatcacaggtattgtcaaatcaagttagagttattgcagatatttcaaactaccatttacattcatccctccttcagagttatagcattagatttacctccagatctttttatttaatatgttttttttaaagcatattgctaaactacacatttgtgytctcccctttcccatagggctacctcacctcccaggagaaaagattcaaaatctaggagattcataatttcaatatattccattgcttgtgactatttatggccgtatttggttcctgagctagaaacagaaaagttatggccatgacagaattacttgtcaagggactatgatggccctgctaacctgggctttcttgagctgtctgccccgctagctttgatgaaatgcacatacactgcttgcattttctgtgcaatggccaagtgtaacaggcagcacacatgtggcagatcgtag

SEQ ID NO: 199730 - DNA, 601 bp, Human
atacactgcttgcattttctgtgcaatggccaagtgtaacaggcagcacacatgtggcagatcgtagcagcgggcccttgccgggtcaagtcatacatcgctgcacaccggggctgtcttaggacattggacctccgagcagcctgcagatcttgggaattcctctgccccctaaagtattctttgtctttaatccagttgttacagtgagtgaacctgatttgttccagatgtcctaagatttagtgattccggaaactactcctaaagtcaaggctgatgaggatttgaattcctctgytagctgggaaccagcagttcttttcacagttaaacagatgaggcaggaggagggagactgagctgccttgagggacagggaggggcccactgactggcttatttgccttgttagaaagaggatggcctttgaagcaaatatcgattctaccactacatggctggggccaaagtcagctgggcagggacatggacgtgctattttttttaaagtaatacatatttaccttaattatctgaatgttgttgctagggaaaccactattttggctcagatcatcttagtaaatgcttttttctc

SEQ ID NO: 199731 - DNA, 601 bp, Human
agtgtatttttctagctccattacagagatagtttttattatttgctttctaggacatggccttagccttcataatactgtttgtttacagatttcatgaaggcatttaccctggcattgtaccactaaaggctgatgttggcggcattattcttaggagacatagaaatgttgtggttttgagaatgggcttttatattatttggcgtagattattaaagaacagttacctgtgtcatgaaggagaggcccccagactggcactttgaatgcaaattcttctgtgacaaatccaggggaytttggaataactctcagatatggcagtagacttaactgtaaaagctcccagcccacagaggtgagcagaggctgaggagtaaacaccataccaacattctgggacaaaatagcctgaatgctgttgtaccttggaaatgcaatagcagctgccttcctaggtggggaagctgagagcagcctcttacaggagtgcatgccctatagacagaggctcatgaacttgtgcttgctgacatgtatatcttcttcagttggtccctagtgagtctacccaaagtgaattgcactggggaaattc

SEQ ID NO: 199732 - DNA, 601 bp, Human
ttttgagaatgggcttttatattatttggcgtagattattaaagaacagttacctgtgtcatgaaggagaggcccccagactggcactttgaatgcaaattcttctgtgacaaatccaggggactttggaataactctcagatatggcagtagacttaactgtaaaagctcccagcccacagaggtgagcagaggctgaggagtaaacaccataccaacattctgggacaaaatagcctgaatgctgttgtaccttggaaatgcaatagcagctgccttcctaggtggggaagctgagagyagcctcttacaggagtgcatgccctatagacagaggctcatgaacttgtgcttgctgacatgtatatcttcttcagttggtccctagtgagtctacccaaagtgaattgcactggggaaattcagaaatatacacccctcagattcaacaagggtggtatcttgtgtgtttcctttaagttataccagtttatggcaggggcaatgttcaaaatagttaagaacctgcacagcatgagcacacctacctttaagaacagttgccagtcatagagaactggtacagctcccctggtgcaac

SEQ ID NO: 199733 - DNA, 601 bp, Human
tatgtgctatgctggtatgcagctactagtaactatatctctttgccttttctgcctaccaagtatcttgccagaggtactgggagtagatgtgcagccccccgcctttgcagtagccctcaaccaatgactgactagagtggacacgtaaatattccctcatcccacaaatgggataactctgttctgctcatgtgttgcacagtttcccagagctccccagcaagattaagttccaggtgctcagggagctgactggcttgatgttgctgcctttgctggttgcctgtccttctgtgtytcactctaccccttccctactggtgttttatggaaccacctctggaataaacaacttgctttcaaacctgtctccagctctgcatctgggggcgcctgcactgacattctttattccctagatctgtgtggcttgctacttttttctcccaccacatcacaggtaatgaatgaggctcatttgcacaacatacaactttggacatcagattttggtgaaactcaaaattacttggtgagaaagaaaagcacacatatgttacgctttttttttcagcatttcacaatattcactaaagca

SEQ ID NO: 199734 - DNA, 601 bp, Human
atcatgtttatttttctctctggctggaatgtactccctgtttttctgcccatcaataggcagagcattttacaagcaagtgagttttaggatcattctttcagatgtggctcaattgctacctgtctctggaagcttcatgtaataacttcagtcaacagtgatatcttttccctgagtttctcttgccccttgatcttcacctgttcctttggcaggtcttatcaacttcatggtttatttcctgggtaattcatttaccagcatgcattcaggaggtgcctgacagtcctcacttatgccctgtagcttaattaacaccgtctcttaattcttcatgttataatcaatttatttggtattttttgctcatatctctcatagaaagacaacagatgagcaattttggttttatggtttactcatgtttgtaattttaaactctgaaaattgaaaagctttgatagttgtcaacaaagtacccagaaagaaggttgcccatgagagtggctaaagacatctagagtcatctcaaatgcctccacaaatttcaaagaaaattgtcaagagaaaagttaagcacctcagtagcatttgtaaa

SEQ ID NO: 199735 - DNA, 601 bp, Human
ttgattttatgatacattgttgagagtatctgtgatttttttggaagctgaatccttactgagggcatgctgcccctagttatgatattgctcctaggaagaataaaatctgcttcacaatgtcctttttggtatgatttccatgattgagaaaactggggattgtatgtgtagtacatctggtttatccacttgtctgtccatggacactttgggttgtgtctacccttggctactgtgaatagtgctgctatgaacatgggggaacaaatgtctctttgagttcctgctttcagttcaytgggtaataaacccaaaagtataatttttgggttatatgacaattctatgtttaattattttgagaaatgttcatattgttttccaagcagccactcgattttacgttcctaccaacagtgcacaagggtttcaatttctccacattcttgacaattcttgtcttctgtttttttgatagttgccatcctaatagtcatgaagtgggaaaaaatagtttttaaaaagtaacagatggataaacaactaagagaaagaaggaaggagtgaaggatggacggatggacagacttggctgccc

SEQ ID NO: 199736 - DNA, 601 bp, Human
tgtacagtgatgaatgaggacagaaaacaagttctacagagattttctggcttgacacagctgccaagatgtcatcagtaacatcttccattgagtatagtgaatgaattggtgctaaacttaagtacaaacccaataacgcagtcaaaaaaaagccagctgctataagatatacttgggtaggatttttaataacaaatgagcaatatattttcagcaggctatatatatgctgtaagataagctttatagaagcagtacactttgtatcttatgttgactactaataatgattttcatwtaaaagcacagcaaagagatccatgtacaaagtaatataacccacttaaaagactgcacaagcaaattaaaataaatggggaaatttctcagggaataaaatttcttgaagattagaaacactgttcctcaataaataagcacccctggaatgtttagcacaaaaactctatgcttgatcgttttactatttcagcaggactgtcagagaggttggtctttgtggagtcctgttcctttcaggtgtttgtaaactttcttgccaaagcccttcccgactgagatggagttgatattagag

SEQ ID NO: 199737 - DNA, 601 bp, Human
agtcctgctgaaagatgaaaacaatcaggcacggggtttttatgctgaacattccacggtgcttagttatttattgaagaagaatctttctgatattcaaggaattttattccctgagaaattatgtgccaggcactactctgtcactaggagttcaacgataagcaaagccagagaagggtcctacccctgatgtttagattctagtaggggatagacagtcctcaaccaaaaagccccacaaacaaatgcataaccacaacttcgataagtgccatgaagggttgatggggcacatggkgggtggggggctcataatgggaggatttatttcacctaggcagggagatcaggaaggatcccctggggacatgatagtcagggggctggagaatgtgggttatgttggagaggaatgagttttgaagggataggagttgctgggttctcataccagcacagcgtcttctctctcttcatctcaatttcctcatctctctaatatgggcctaatatcaagaccctttctcagtgttgtgaggtttcagaaggatgacatatttgacaacacccaatatcatgctggcacatcacattttca

SEQ ID NO: 199738 - DNA, 601 bp, Human
cctaggcagggagatcaggaaggatcccctggggacatgatagtcagggggctggagaatgtgggttatgttggagaggaatgagttttgaagggataggagttgctgggttctcataccagcacagcgtcttctctctcttcatctcaatttcctcatctctctaatatgggcctaatatcaagaccctttctcagtgttgtgaggtttcagaaggatgacatatttgacaacacccaatatcatgctggcacatcacattttcatttcatttctaaaaataactttggaagcagagatrtgctgttttagtcaaagacttttttagctttggagaaagaatgaaaccccagctttgagactcctctaaaaaaaatctgagttcacattctgccctggaagttgcctggctgcttcccttaatcacagagccttgtttgaatcacttgactttgaaatcccaggaatgactttgctgtgtgattaagtgacagaggcccaaggtttggggattggcagaagtttagatgtccctggcctgatcccttaccctttacatataaggaaaggaagctgatcacatgaacaactaaactggaat

SEQ ID NO: 199739 - DNA, 601 bp, Human
ttagtccagggttccacctctgggccctttactcctctgtagctacttcagatgatccctggtgtctctgtgcaaccctcaaaatttgtagccctgggtgggagcatctgttctcacatcgctgccacttgatcacccttagatcacatgatttcacttaggcaagtgcccacaccctagtgatcaagaagaggggaaagagagggtctgccccctttctgctgatgtgccgccccacctatcttgagattcccccaaaacacgaggatgtcaggatgctgagtggccaaaaataacaacygttcattatacaaacccttatatccttaattacgtcttccattaactggttatccgattaaaactggccactcacatggatttattttgttcaaaggtcgcatcacacaataatcatcagtctctcatgcatcttcatccttgtcatcttcagcctcagccttatcaccgttctcatcctagccccgttcactcacccctgtcctgggcccccatttccctccatctcctcacctctcaaacgttcacctctttctcctccaactcccagtctttcaccctacttctatttcactacaaa

SEQ ID NO: 199740 - DNA, 601 bp, Human
cctgtcctgggcccccatttccctccatctcctcacctctcaaacgttcacctctttctcctccaactcccagtctttcaccctacttctatttcactacaaaatagaagcaatcacagaggaattcccgcatgttcctaccacccatctactaatgcatcttcagctcacctccagccaggcgagaacagtcattcatcagaccccagcaattgttgcctgtcgtgttttcattaattgttgcctctctaatggatcattcccattagcttgcaaatatgctatgataattcccatcttrataaaaaagagcaaaaaaactccctggagcccacttcccccaccagctaccatccaatttctctgttctcctttagagaaaaactcctccaaatagttgtctgtcctcattgcttccatttgttctcctcctacatctctgaaactctctccagttaggctttcctcccatcgtgccacttcagcagttcttatcaaggtcaccagtgacctccagaaggctgattccaatggccagttctaattattcccattgttctggcctgtctgccatattggacaaaattgatccttcctttct

SEQ ID NO: 199741 - DNA, 601 bp, Human
caccagctaccatccaatttctctgttctcctttagagaaaaactcctccaaatagttgtctgtcctcattgcttccatttgttctcctcctacatctctgaaactctctccagttaggctttcctcccatcgtgccacttcagcagttcttatcaaggtcaccagtgacctccagaaggctgattccaatggccagttctaattattcccattgttctggcctgtctgccatattggacaaaattgatccttcctttcttgagactgtcctctgtgaccatgtggatgactcctctctcrattttcctcttccttctctagccatgcttttccagtcttgttggctgacacctcctcatcttcaactcctaaatgtgagtcctcatttctatctatactcatttcctagtgatcgtttctagtctgtcccaaatgtatcctagcccagacccctccttcaactccagactcatgcatccacctgcctcaaaatctcctttaaaacccaataggcatttggattttctctgctgaaccttctcaacccagtctttcccatctcaataaatgacaacttttctcttctagttattgaatcca

SEQ ID NO: 199742 - DNA, 601 bp, Human
tttgagtgaattgaggtagttaaattatttccacaaattgagtgagtttttttagagtaaattaatttgaatgaagtgaagtttatatagcatgactcaaaggtacagtgctggtattctcccctacccataatcatcccgagtgtaccacctctcagaggaagtgaacaggcttccctgcagacaacaagggggaacaagtggacaaaagtcgactctgctctacccagtgttgctctaactgctgatagctgttcagctgggactgcttgcagctttttaatatttacagcattgaacrgggttgccttgttctttatgttaaaatggaaccaaaatcactttctgtggaaaaccttcactctgcccaccgatgagcactgggcatacattgagcaggtcaacggcgtttgttcaggcacatattctgtggcctcaatagtgttgacaggtttgtgccaagcctgcccagcttaggggacagctgaaatgctcagagccaccaacagtagaggcactccaaaactttccaagaagtcatctcagattccctgctgcttcatagcttttaggagctccagggttgagggaggccacaaaa

SEQ ID NO: 199743 - DNA, 601 bp, Human
ctaggcttcattctctttattggctgctagaaagctcagagctgaccccactctgtcagtatataggacttagtcttactattttataaactcactagcctcctgtatcttgctttgctccccctttaccatgcttttctttttagcttggagattgcataatattctaccatatggatatactgtggatttaccttaaaaattcctcttattctgtatttaggttattcccagtttctatattaagtaaaattgtgagaaatgtcttttatggagattagtaccagtaaatgatcatatycttagctctataacttttcagagggtgtgaagtcacatttttgaccacctactatacaccagggactttttgcatctcgtccgcatcccctcttcactgcatgaggcacaatgtgtgtgaattattggaggagcactctcaggagaagaggggcgagggagcagggaggggcaggggatgggctgggagggatgtgctgtcgggtcaaagctagccttggtctgatttatgggctgggaagaggtggggaagccctggagcataaatcactctgcagaattgtccccccttgaagctgct

SEQ ID NO: 199744 - DNA, 601 bp, Human
atttttaattttaaggatatgaaaatgatactattaacacttagcagaaaacaaagaaaccagtttctacagacttttctgtaacattaatgtccaaaattagaacagtatattccattgtgaattttaaattcaacacacagccaacttgccctccattgtgacgtcaaaataaagatatactcagatatatgagaattcataggctattacctcttccagtttggatttccccaaaagcataccctgatacaatgatacaggtacaggtagtttatttgggggtgggcgatctcagtgktgagtttagacaggaaagagaggaaagacaggaaggcgtgcatttataagcaggttactgccgtaggcaccttgggcttgtcttcctcagaccctccaagagactgtgtgtaacaaacctcacatccacttcactccaggatgaggaagctgctggaggaccgatcccccagctcctgtcattcatcatggagaaccattccctgggcatgaactctctggcacttccagccttctctaagtaggtccacactgcctggggccaggaagcaactcaggcagaaagatgtgggaagccttt

SEQ ID NO: 199745 - DNA, 601 bp, Human
accttgggcttgtcttcctcagaccctccaagagactgtgtgtaacaaacctcacatccacttcactccaggatgaggaagctgctggaggaccgatcccccagctcctgtcattcatcatggagaaccattccctgggcatgaactctctggcacttccagccttctctaagtaggtccacactgcctggggccaggaagcaactcaggcagaaagatgtgggaagcctttgacctggaggggcatggcttcaggtgaccagaactgtggctggttctggggaatgtgagcgaggtgctrgccacatctgctatagtaaccatgagagcttcctgaaaagtagttatttactgataaactactcaagaatacaaaagtagttgaataaaaagtgtgccacagccaaataagcatagaatgaagcaaaacaatttttataaatatttacaatagtaagcaaatgtaaaaaaaagtattgccatggtaaatgcataatttaaaagattaataaaaataatcccataatctcagttataccaataacaatttgagaagaaagttgacattgtgactcctctgcttcactttcttcaggaagga

SEQ ID NO: 199746 - DNA, 601 bp, Human
gacattgtgactcctctgcttcactttcttcaggaaggagttcagactcctcagctcctcatgagaggccgtcctgagcctggtcctgcctgcctgcctttctccccagacccctggctcaccatgcccccacatactcacttgaatcagtcgccacttaataccaaagctgcctttacccaggaatcacccccaccccccatttttgtttaatgaactactatgtccttaaatctcagcttagggagcccgtgtgcaggctcctcacctggctgcacaggatctgtccacagaatagatrgatggatggatggatgggtgggtgggtggctgaatggttagataggtaggtaggtagatgactggctgggtgactgggtggatgagtgggtggatagttatgtggataggtgagtggggatggctggctgggtggatgagtgggtatgtgggtggatgggcaggtgagtggatgactggctgggtggatgggtgtgtgagtggatggctggctgggtggatgagtggatgggtgagtggatggctggctgggtggatgggtgggcgggtaggtggatggatgattattcattttgtgcaa

SEQ ID NO: 199747 - DNA, 601 bp, Human
ccccacatactcacttgaatcagtcgccacttaataccaaagctgcctttacccaggaatcacccccaccccccatttttgtttaatgaactactatgtccttaaatctcagcttagggagcccgtgtgcaggctcctcacctggctgcacaggatctgtccacagaatagatggatggatggatggatgggtgggtgggtggctgaatggttagataggtaggtaggtagatgactggctgggtgactgggtggatgagtgggtggatagttatgtggataggtgagtggggatggctgrctgggtggatgagtgggtatgtgggtggatgggcaggtgagtggatgactggctgggtggatgggtgtgtgagtggatggctggctgggtggatgagtggatgggtgagtggatggctggctgggtggatgggtgggcgggtaggtggatggatgattattcattttgtgcaaagttacagagactcaaggcccaggcctccaaggttacctatcttctctgtcatcacacagtccattagttatgtattagcttctaagactgaatacaaaatatcccctgcaatggatttttctgtct

SEQ ID NO: 199748 - DNA, 601 bp, Human
aattaaagcacaaggtgccagctgctctacagaggtgctgaaacgttgtttgaagcacagatatgacaaggtgaagcaagtcattaccacagtggctagtgccatgttggacagaatccttggataagtgcttaaggtacatggatgagcctccaaaggatctgatgtcagctgattcctacattgcagagctagggtgggtggaatgagtcagtttatttggctggtgaaggaggaacctaggttggagcagggatgagagggtagaagagagcaaaggaggaggggcaggagagaaccyggtaggatggaaagaggctgcccatgttgaacaaagggccagtaacatttctggtggcagggagatgtcaggacattttagaaatctgatgcctgctgttacaggcctgtcaggactttaccactcataggttctaagaaatctcccctccccacctcattctgttttgtttttagcccattctggatttctgcactcatgcatgcctcatgtgaccagggataggcagggagaaaaactcaaggggctggggttatgtgtacatcttcatggtattgactgttatggcatgcatggaaa

SEQ ID NO: 199749 - DNA, 601 bp, Human
tccgcttatcagatggaaactcggcattcctcagagacccttcagtgtttctcagttgcttctgcaggcccttcccttcctccttgagaggacaagagaaggtggcggggagcaggcacccccagcctgtgtttgtatttcctcacctggattacctgtggcccttgcatcagggagagcccagccttgagtgaaactgcctgggagacaggctgggcgcttcctgcggcagtcggcagtgaggaagtggtggagaaacgcagatgtccatttcaaatcacaaggcggcttcagtattccrccgcggggctcagctttcacgtatatgaaaagcttcatttgtgtattcactgcgtttggaaggaaggctatgttttgctttagaaatgtcaacagagctgtagttacgacaaggatcaattaagaaggacgtttcccagagccgcaagacttgagtgaatctgtggggggaatttagaaaacatgtgttaaacctctagatttctttttttctaactaactgcaaaacagcaatttaataatttcctcttttaaggggaaaggggggagtcttggattttaaatcttcctaaagcagcac

SEQ ID NO: 199750 - DNA, 601 bp, Human
agactactaagctaaggcgaataaaataaaattttcaaaaatcgagaacttcagtgtcctagtctgggtttccctgagcagatcctgagatgagggctcacatgcaagtggttcataaaggatgtgtttccgggggaagacaggtagggagtggagagacgcaggacagggcaggactgaaactcaggcagggtccctcagagcgtggcctcagcctgatgctgcaagggggatcagaggtgtgagttacgccaaggtactgttccatctccagcttaggaagctgagttttgttctcccrtaaacaccagtcattggttaagggccacttagggaggaataagtggtagaaagtggtcctaggcactttccacccaggggtgaagtgtagacagtggggcttcaatagcttaagggcagaagaagacccacggttctggctcttggagccaaacgaagactgaagccacagtgtgcatgtaaagggagtccaaggagcattgggtggggcattgaaattgtttgctacagtcggtttaccttcaactggtttccttcttgttctgaaggatatattacaagcatattgacaaaagtcttt

SEQ ID NO: 199751 - DNA, 601 bp, Human
gagttacgccaaggtactgttccatctccagcttaggaagctgagttttgttctcccgtaaacaccagtcattggttaagggccacttagggaggaataagtggtagaaagtggtcctaggcactttccacccaggggtgaagtgtagacagtggggcttcaatagcttaagggcagaagaagacccacggttctggctcttggagccaaacgaagactgaagccacagtgtgcatgtaaagggagtccaaggagcattgggtggggcattgaaattgtttgctacagtcggtttaccttyaactggtttccttcttgttctgaaggatatattacaagcatattgacaaaagtctttgaactcttgaggtgtttgtatgatattctgtgtcagttgcacatgggatgtttctaccagcatctgaattggggaattgacatatacagatgcccgtggaatttaacagagaatgtgaatgtacggctacagtccgtcaccatccagcttgccagggctgtcatttcatccttttgaggccaggcttacagacagtctgggcttccactgcccccatgctctgcctgtgatgtgtggtggcct

SEQ ID NO: 199752 - DNA, 601 bp, Human
ccttttaaagagctttcctaaagctccacttgacattttccacatatatctcattggccagcaccatgccacaaggtggggtggcaaatgaattttctcagctgggcacattgctactctagacagagtcagagttgtgtttattgggaggaagggaagagtggccattgggaagcaccagcagagtcagcagggcagagacctgagagaggtagtttgtgagtgtgtatccctgagatacgtagcagaactggggaaggactgcccagtgagtctactcccttcagtatttgtcagatcytgctcaattataagatgatctttatctgtccgccttatctatcttcactgacgtgtatttcttattttcacaaaatgaagccatttcaacgatgttgtcaatgtgtttggatttctgtccttcaacagaggtgccacagctccatactaggtcaatccatgcaataaagaccaagttccagaacccctgtccttcagaccatttggtatatataatttccaggcccttcttcactgttctgtttatcactccctgtgctgtctctagtttggcatcttcctttttaaaatagaacccagg

SEQ ID NO: 199753 - DNA, 601 bp, Human
ttgagaagtgtctgttcatatcctttgcccacttttggatggcattgtttgttttttttcttgtacatttgtttaagttctttgtagattctggatattagccctttgtcagatgggtagattgcaaaaattttctcccattttgtaggttgcctgttcactctgatggtagtttcctttgctgtgcagaagctctttagtttaattagatcccatttgtcaattttggcttttgttgccattgcttttggtgttttagacatgaagtccttgcctatgcctatgtcctgaatgatattgyctaggttttcttctagggtttttatggttttaggtctaacatctaagtttttaatctatcttgaattaatttttgtataaggtgtaaggaagagatcccgttttccatcatatgaatatgccacaatatgttttctccattatcctgatgatggacattgaagttgtttctggttttatcttttgtgaataaggatactaagaacatttttataccagttttcgtgtgcatgttttttttcatttattgagtaaatgctagtgagtgtaggtgctggctcaaagggtcactgtttagctt

SEQ ID NO: 199754 - DNA, 601 bp, Human
tctgttcatatcctttgcccacttttggatggcattgtttgttttttttcttgtacatttgtttaagttctttgtagattctggatattagccctttgtcagatgggtagattgcaaaaattttctcccattttgtaggttgcctgttcactctgatggtagtttcctttgctgtgcagaagctctttagtttaattagatcccatttgtcaattttggcttttgttgccattgcttttggtgttttagacatgaagtccttgcctatgcctatgtcctgaatgatattgcctaggttttmttctagggtttttatggttttaggtctaacatctaagtttttaatctatcttgaattaatttttgtataaggtgtaaggaagagatcccgttttccatcatatgaatatgccacaatatgttttctccattatcctgatgatggacattgaagttgtttctggttttatcttttgtgaataaggatactaagaacatttttataccagttttcgtgtgcatgttttttttcatttattgagtaaatgctagtgagtgtaggtgctggctcaaagggtcactgtttagctttattagaaac

SEQ ID NO: 199755 - DNA, 601 bp, Human
tgtagattctggatattagccctttgtcagatgggtagattgcaaaaattttctcccattttgtaggttgcctgttcactctgatggtagtttcctttgctgtgcagaagctctttagtttaattagatcccatttgtcaattttggcttttgttgccattgcttttggtgttttagacatgaagtccttgcctatgcctatgtcctgaatgatattgcctaggttttcttctagggtttttatggttttaggtctaacatctaagtttttaatctatcttgaattaatttttgtataagrtgtaaggaagagatcccgttttccatcatatgaatatgccacaatatgttttctccattatcctgatgatggacattgaagttgtttctggttttatcttttgtgaataaggatactaagaacatttttataccagttttcgtgtgcatgttttttttcatttattgagtaaatgctagtgagtgtaggtgctggctcaaagggtcactgtttagctttattagaaactgccaaatagcttttcaaagtggttctgccttttacaccctcaccagcaatgtataagagtttgagttggtc

SEQ ID NO: 199756 - DNA, 601 bp, Human
cattatcctgatgatggacattgaagttgtttctggttttatcttttgtgaataaggatactaagaacatttttataccagttttcgtgtgcatgttttttttcatttattgagtaaatgctagtgagtgtaggtgctggctcaaagggtcactgtttagctttattagaaactgccaaatagcttttcaaagtggttctgccttttacaccctcaccagcaatgtataagagtttgagttggtccccatccttgtatattcagtattgtcagtcatttttattttagccattctggtgtrtaattgtgtttctttgtgatttagagctgcatctcccatatgactaataaacacgttttcacgtgcccctcagccattgggacacttattttagcctgttcaagtcttctgcactcccttcttctggggatacttttcttctcctgtgctgtggtacactcctcaccccaattcttctcactcgccactccttttctgcttcctttgttggggtctccttatcttgccaacctttcaacattggagagcctcagggtgcggtcctgagaatgcttttcttctgtgtatacgcattccctg

SEQ ID NO: 199757 - DNA, 601 bp, Human
ttttcgtgtgcatgttttttttcatttattgagtaaatgctagtgagtgtaggtgctggctcaaagggtcactgtttagctttattagaaactgccaaatagcttttcaaagtggttctgccttttacaccctcaccagcaatgtataagagtttgagttggtccccatccttgtatattcagtattgtcagtcatttttattttagccattctggtgtgtaattgtgtttctttgtgatttagagctgcatctcccatatgactaataaacacgttttcacgtgcccctcagccattggracacttattttagcctgttcaagtcttctgcactcccttcttctggggatacttttcttctcctgtgctgtggtacactcctcaccccaattcttctcactcgccactccttttctgcttcctttgttggggtctccttatcttgccaacctttcaacattggagagcctcagggtgcggtcctgagaatgcttttcttctgtgtatacgcattccctggatgaactggtcaagtctcataacttcatatcatggacatgctgacaactcccaaattttcccctccagcccagagctcac

SEQ ID NO: 199758 - DNA, 601 bp, Human
agactggagtgcagtggcatgatcttggctcactgcaacctccgcctccctggttcaagcaattctcctcctcaacctcccaagtagctgggattataggtgcatgctaccatgctcagctaattttttgtctttttagtagagatggggtttcaccatgttggctaggctggtctcgaattcctggcctcaagtgatcctccctccttggcctcccaaagtgctgggatgacaggtgtgagccactgcacctagccggacatactatttgtttgttgctggttgtcttagtcctcctacyggaattaggttaggtttctacatataatatgcaatgacttttttgagacaaggtctcactctgttgcccaggatagagtgcagtgacatgatcttggctcactgcaacctccacctcccaggctcaagcgatcctcccagcctccggagtagttgggaatacaggcatgcaccaccacacctgggtaatttttgtattttctgtagagatgggggttttgccatgttgcccaggctggtcttgaactcctgagctcaagtgatccacccacctcagcctcccaaagtgctggagattaca

SEQ ID NO: 199759 - DNA, 601 bp, Human
ggcctcaagtgatcctccctccttggcctcccaaagtgctgggatgacaggtgtgagccactgcacctagccggacatactatttgtttgttgctggttgtcttagtcctcctaccggaattaggttaggtttctacatataatatgcaatgacttttttgagacaaggtctcactctgttgcccaggatagagtgcagtgacatgatcttggctcactgcaacctccacctcccaggctcaagcgatcctcccagcctccggagtagttgggaatacaggcatgcaccaccacacctggstaatttttgtattttctgtagagatgggggttttgccatgttgcccaggctggtcttgaactcctgagctcaagtgatccacccacctcagcctcccaaagtgctggagattacagagtgagccaccacacccggcctggaatgactttttattcattgattcatacctagtaactgcagcagtgcctggatgtgtggtaggatctcaatctttgttgaataaactaatggatggtgggcaaataaatggatagaagatgggtatatctatctttctctgtactttatgagcactctttc

SEQ ID NO: 199760 - DNA, 601 bp, Human
acaatcacagttgggaaatgtgtaatctcagggtgcctccttgcccgggcatcttcattataaaagcttagtctttctaaatgcagccaagctctcctctgacaagagatgtgagaattccgttgacactcactgaccacctagaaaccagagacccagaaacccaaaggtgggtcacatggtcgccctgtccctggggaatgcacaggaaaagagctctgcctcccggaaggttccaggtgttggggtaaatagagatcctgctgctgcctctactcccttactggtctccctggggacrtatttgaacatattttactcataaattctcatctcagggtctgtttctaaccagacctaaaacagacaggtcccccccttttttaatcagtaactttggtttattacagcagaaacttcccaaattactgatctgaccaattagatatgttttaatttttttatgaccggaatcttttccttcaaatgaacctgtttggattctcttatctgtgcaatacaacctaatgtaagtctactttgtaagtatttgttctgagattatttgttctgaaggaggcccaatccagttcagttaaat

SEQ ID NO: 199761 - DNA, 601 bp, Human
ttacaaatgggaaagtggatgcttagaatggcatgaatgttggctggcttgatcatgagtgggatcacgatggcattcactctttcattcagcaaagttatgtgttaacaggtattaagtataccgttatcatttttccttactttagaagataagccaaaaaatttgaccttaatgaaaatagaggatttttaatggagatcagaattttcacttataaaagtaccatttacacatttcgtcactgctgacagtcattagctagtggatagatccaagctttaaatctgaatcttgtcayaggaggatggaagctcaagttgttaaaggcctaaaaggttgcatgttacatatagaacaaggccctgggaaaggaaatggtctgttgaaagtcacaaggccaaatggcataccaggtttttggtccttgtttaagaaaaccaaatgtaggttcagaatagtttcttctttcttccacgtctctgaaagtccagcttcgtgtgggagagctctgaggccctctcccagccctcgtttttcagctcggggttaccacgtgtattccgtgaaatgctctacctgctttctgtatcggctttct

SEQ ID NO: 199762 - DNA, 601 bp, Human
tgttgaccttataaatttgttgcaaagattaaattagacattcatgtaaagcacttaggaccatacctgagacatagtagcctttagttatttttgtctaattcttctttccctgatacagtgcccaccataaatccccagtcatggtgctgacctggcatgtgaagctggctgggaggaaagagatttttctctcccagcaaagtagtaaacaggctctctcaagcattcatccatctggggagcttggcacacaggacagatcctttctcttaagtgtcccaaggccaaccctgaaccwtggaagccttcatttaccatcagtttttctttcaaaacttctgcaagggcataaaaatgggggactaaatagggaccaaataagtgagtccatgctttggaaatgatgacctgagagtgtgaggaaggggagagccaggagctgagtggcagcattgcgggagggctcttcctcccttggttggcagatgggcgggtgtgactgaggctcaccatgggtggactgagcagacgcctgccctcacacacaaccccatgctttcagaagaaggcgtcagacctccttgtatgggaacatcat

SEQ ID NO: 199763 - DNA, 601 bp, Human
tggtattgttatcctcatttaccaatgaagtgttggcactcagagcaggcaagtagcttggccagagtctcacagataatagcaggtgcagaccgtcatcctcctgccccactagtgttgatgaaggacgagggtctcacctttccagtccttggtcctgagtgctctgtggccatcttccacttaaagctctaggacagaccagcagctctggaagtgactggattaaaaccccaccaactgaagacagtggcgtgggatgatggctcgctgatgggagacagaatttctgtctctcctstcagaagccctttgaagaactcagctgtctggacaacaaaagtgggagcttttgttgtctagaagttcatgtgacctttcctttcaccttttagtgctgcctaagtgtaagatttaagcacagcattcttttcccatgtgtcatttttcagcagttaaaaatccatcagctgaggccacacaaagttggcactccctcctccaccaaccctcagctaaaaggttcagtggaagggactgatgctgtctccagatgcagactggggccatggattgagccacagagggaggagggaggagg

SEQ ID NO: 199764 - DNA, 601 bp, Human
agattccctccaatctttttatttctggttgggaaaccctacacagaccagtgtctgtctcacggtttaaaaggctgcatgcaaaacatttcctcccctggtagaaatgctgcattgagccacagccctccctctgcagcctgtgcagtgtcaaggggacagtggctgcatgatgatgtgcctagcagggtgtcccccatcaggacagtcacaggggtggaacaaatgcaggagccatggagccaaactgaactgggttggaatcccagtttcagccacttaatagttacatggatattgscaagtagcctgagttctcagaggcttgatatcctcatctgtaaggtgggaagtataagacctacctcacggtgtcagtgttaaataagacagggcaaaatgatgaaggtactctgtaaatgtatgtccattccttcctcctcctctgggttccttttcagcacttcctcaccacagcaccattcttaagttttctagccccatttattttagaaggggaactggaggcagcttggagggaggtaacatctggatgtcgcagtgacagctggtggctggtgaggagtccacaggtcagggg

SEQ ID NO: 199765 - DNA, 601 bp, Human
caggacagtcacaggggtggaacaaatgcaggagccatggagccaaactgaactgggttggaatcccagtttcagccacttaatagttacatggatattgccaagtagcctgagttctcagaggcttgatatcctcatctgtaaggtgggaagtataagacctacctcacggtgtcagtgttaaataagacagggcaaaatgatgaaggtactctgtaaatgtatgtccattccttcctcctcctctgggttccttttcagcacttcctcaccacagcaccattcttaagttttctagccycatttattttagaaggggaactggaggcagcttggagggaggtaacatctggatgtcgcagtgacagctggtggctggtgaggagtccacaggtcaggggcaacgggccctgcagacttctcagcatcccctgctcagaaggggctctcagagtccatgggctcagcaggctgattcttcccctctcctatgagaccatcctccatgtgggtcccatccaggaagctgcttccctcccaagggaaggaagccaccagtgtttctagaatctacatcagtgccactcaaagcgtggtctcc

SEQ ID NO: 199766 - DNA, 601 bp, Human
tgaaactggctgccccattgaagcatgagataggacgagagattcccaggacctggaagaccacttgctcagagtctgaaatgtttacactgcctctgactggcatctctataccagaaaggagaagagggggactagatgtttttgtgtgatagtctctttcctgctatcttaggctgagttccctaaaacaaaatcctgagatgagacatcatgtaaaaataatttgttaggaagtgttctcaggggaatgggaagtagagcttcaaagggaaggaggccaaacaaggatgtgatatcmagcaaagtccccaggagacagaaagaaggtgggtgactttggcaccgtctaaagtataggtcacatctcactgtcccaatcagggacaaaagagcatggctgaggattcccccaaggggatgtgaattctcaagcacttccatctctccatgttcatgcaaagaaggtgccaggagccccgtggccatcctcccacaaaagacacacaggtggtggcatctggggggtcaatgtgcatggttgtgcatggtagagacccctggatggagctccatgatgtgggatttacatcccgcccat

SEQ ID NO: 199767 - DNA, 601 bp, Human
cttttttacaaagcttttcataggattgtcatcgtcacctttccagcactgttatgcaaattggagagactcatgccaaggtgaagggcttggtgagagcagccaggtcttctatgcagtgatcagcctgcacagctgggtgtggcatctctggctcccaggtggttccagtgcacacccccagttaagaaccaatgaagaatgttgcttgttaacaacctttgaaggctttttagcaaaaacaaagtgtcatattgggattcatctgtggcagtttgcagaacatatcaggggagagagstgtgtgcaaggcatccaccaggaggccgttttgtgctggtctaggtaagaggagattggagctgacctgttgaagcaacaaagagaaagggaggaaggatcatcctagaagtggataccagttctttaagaagagtcctgagatgtacccaggagtagcaaagtggatgtgccaacccgagggaagagattagtaagctgctgccccctgagacagggctccatgagctgacaggttgatctgtggagatacactctgaaggtgctagactaggaagaggtcctctcaggccccatccct

SEQ ID NO: 199768 - DNA, 601 bp, Human
ttcagcagtagctgcccctggcctctgttctcagtccacagctccaccagcccagttgcttgtgcagagggagaggatgtgggagagatgctgtcaacaccctccatgtcccctccacccaccctggaggccgcctatgacagttcgccataggcgaactgtttctctggttaggaactttctctggctacaggagtgtgctgcacccgagtcaggagggctggaagtgcaggatagttaacgtccccagtacagttttctaccaaggagagaccggtgagatggatagatgccccagctktctcacccgttgatgacacacttcactaccctctcctggagctccctgagatcactgcccatacaaactaattgcaccccaatgcttgtcccaaagtctgctcagataagggccgtgtgaatagacaggtcttcagttccagaaaagtgtatactcacacaggaaatatctctcaaataacatgggcagtgtatatgttatttttctggagggcagagggcatcatgaggaaggtggtcttcgtggggtgaatatcatgtttcctccagggagggctcagtgacatggagcagtgcttct

SEQ ID NO: 199769 - DNA, 601 bp, Human
acacacttcactaccctctcctggagctccctgagatcactgcccatacaaactaattgcaccccaatgcttgtcccaaagtctgctcagataagggccgtgtgaatagacaggtcttcagttccagaaaagtgtatactcacacaggaaatatctctcaaataacatgggcagtgtatatgttatttttctggagggcagagggcatcatgaggaaggtggtcttcgtggggtgaatatcatgtttcctccagggagggctcagtgacatggagcagtgcttctcaaatgtccatgttcrcagaggttagcttctaactcatcaggtctagggtggggcctgagaatctgcatttctaacagtgagcatgtccagggaccacactttgagtagcaagaccttcacagcttcaagttgcaaaccagttttgaatgagcagagtagaagggggtttgtaggtgagaaggaactcttcaccatgagtacatttctatgaagatttctggccaggattttagtaagtacctgagccccttcaaacatttgactcccgcataaccttttcatccaaacaccattcatgagttgtttttatgccat

SEQ ID NO: 199770 - DNA, 601 bp, Human
ctcaaataacatgggcagtgtatatgttatttttctggagggcagagggcatcatgaggaaggtggtcttcgtggggtgaatatcatgtttcctccagggagggctcagtgacatggagcagtgcttctcaaatgtccatgttcacagaggttagcttctaactcatcaggtctagggtggggcctgagaatctgcatttctaacagtgagcatgtccagggaccacactttgagtagcaagaccttcacagcttcaagttgcaaaccagttttgaatgagcagagtagaagggggtttgyaggtgagaaggaactcttcaccatgagtacatttctatgaagatttctggccaggattttagtaagtacctgagccccttcaaacatttgactcccgcataaccttttcatccaaacaccattcatgagttgtttttatgccatgaggttaaattctttcctatcatttcaggggaggtccccacttgttgagttttccgtcagcctataaggcaaaggaaaagagtgatagaaaataaaaataacttgattcattagatggaattcaacttgaattcttagtttgttgactaagaattt

SEQ ID NO: 199771 - DNA, 601 bp, Human
agggagggctcagtgacatggagcagtgcttctcaaatgtccatgttcacagaggttagcttctaactcatcaggtctagggtggggcctgagaatctgcatttctaacagtgagcatgtccagggaccacactttgagtagcaagaccttcacagcttcaagttgcaaaccagttttgaatgagcagagtagaagggggtttgtaggtgagaaggaactcttcaccatgagtacatttctatgaagatttctggccaggattttagtaagtacctgagccccttcaaacatttgactccygcataaccttttcatccaaacaccattcatgagttgtttttatgccatgaggttaaattctttcctatcatttcaggggaggtccccacttgttgagttttccgtcagcctataaggcaaaggaaaagagtgatagaaaataaaaataacttgattcattagatggaattcaacttgaattcttagtttgttgactaagaatttgcagcctccgaggaaattttttttaattgaagaaaaactaatttttaaaaatctgaaaataattcgtttgtgactatttaacagaaggaaaaactt

SEQ ID NO: 199772 - DNA, 601 bp, Human
gattgtttccagtttttggctattacaaattatgctgctatcaatatttgtgtacacatttttgtgtgggctcatgtttttatttctcttgggtacatacctaagagtgggattgctgggttacatggtaacttatatttcactgttaagaaactgccaggctgcttttcaaagccactatactattttacattcccatcagtagtatgtaatggttccagtttgtccacatctagtccagcatttgttattgtttgtctttttgattgtagccattctaatgagtaggaagtagcatctytttgtggttttgatttagatttccctgaaggttaatgatgttgagcatcttttcatgtgattattggccatctgtatgtattttttggaaaaactattcagatcctttacccatttgatagttaggttacttatctttttattattgagctgcaagactttttaaaaatgtatcctaaagttcctattagacatatgatttaaaatattctcatcctgtggattttttcactttcttaatggtgtcctttgaaacacatgagttttaaattttgatgatatccagattatccagtttttt

SEQ ID NO: 199773 - DNA, 601 bp, Human
cctccaagacaggaattctctggccctgctgacaggagccccatgttgcacagggcaactatgtcactcattggaaattaacatgtctgccctctgacttcagtatttctcccaggagcagaggatggaagttcttcacagctggatctgctgtatcattcagaagctggcttcagagcctgtgtagctggaagcctcgggctcacatcaaggaagggaatgccactcagcctctgggcacacagctgcaacttcccctggtgctgtctctcttggtgctaccctatactagccttgtccygaaacatctaccccattcatttcaccctctctgctactatgtcactgcctctcccatcacagtattccacccaaatgaggcaaattcttatcctttcaagacctaccctagagtcaccttttttgatatatttgcttttttatttactccaccaggcaaagagggtggcaccctgctatgagctcttggaacaatttatttataagttccttatagcctggatcgtattcaaccaatagtttttccccctctattaaaatgcgttaatttggagtctttgcttactaaatgctgtctcct

SEQ ID NO: 199774 - DNA, 601 bp, Human
ctggatcgtattcaaccaatagtttttccccctctattaaaatgcgttaatttggagtctttgcttactaaatgctgtctcctttttttttgagacagagtttcgctcttgttgcccagcctagagtgcaatggtgcaaactcggcttactgcaacctctgcctcctgggtccaagcgattctcctgcctcagcctcccaagtagctgggattacaggcatctgcccaccacgcccagctaattttttgtatttttattagagacggagtttcaccatgttggccaggctggtctcaaacrcctgacctcaggtgatccacccacctcagcctcccaaattgctgggattacagtcgtgagccactgagcccggtcaaaatcccttcttacctgtcatttgtattctccccattctgtgtctgacatcttgtaggtgtttgttagatgattggtgagtgaattaatgaatgtacagatggatgatgtataagtcctttcagagggaaactttgagtatgttaagaccccaggaaggcttatacttgatctttgtatccagaatgttgccaacattctggatacaaagaaaagcaccctctc

SEQ ID NO: 199775 - DNA, 601 bp, Human
tcgctcttgttgcccagcctagagtgcaatggtgcaaactcggcttactgcaacctctgcctcctgggtccaagcgattctcctgcctcagcctcccaagtagctgggattacaggcatctgcccaccacgcccagctaattttttgtatttttattagagacggagtttcaccatgttggccaggctggtctcaaacgcctgacctcaggtgatccacccacctcagcctcccaaattgctgggattacagtcgtgagccactgagcccggtcaaaatcccttcttacctgtcatttgtrttctccccattctgtgtctgacatcttgtaggtgtttgttagatgattggtgagtgaattaatgaatgtacagatggatgatgtataagtcctttcagagggaaactttgagtatgttaagaccccaggaaggcttatacttgatctttgtatccagaatgttgccaacattctggatacaaagaaaagcaccctctctgtgacttctcagatcccatctgcctctgatctttcatgacccctgctggattgactacatgagcctctttcagaagtttgactagcaaatcaacaaaacag

SEQ ID NO: 199776 - DNA, 601 bp, Human
aattctaaattaactaagtgagttaacgtggaagccgcttttaccagcccacaagggtcacgcttgttgtgtctggaagaaggaaagggtcttagaggaacacaaattgccagactgacagtcagatatggagacaccagggtcatcttcagtttaacaaacacatgtcagaactagaaagttggaagtgagacttcaaactctacctagcattgagcataagcaggtcactgaccacaaagatattctgttcccaaagagcaccatattcgtggtcaagtaaggccagagtctagactgrcatcaaatgcttgtatgattgggaggaaggagcccgaaggccaaagaggctcactaatttcattattcgattcttccaaccactgcacgttacaaacagggctgtagcctgggtctactggccaagcttccggggctgggacaggcaaggtatgtctggatgagagaaggtctttgccaagacaagcatctcttgtgccaggcagaccagcaaatgagctgcttcttgcagccccttctttggcatctcccataagccaaggcctattcatttaataaatgcagactcaggagctactaa

SEQ ID NO: 199777 - DNA, 601 bp, Human
gaaacatcatagcttagcctagcctacttaaacatgcttagaacagttccattaacctacagttgggcagaatcatctggcaacacagccctccatagagtatcgattgtttaccctggtgatgatgtggctgacgaggtgctacagctcgctgcgctggccagcatcttgagagtattgtacagctttctaccactttccactgaatacctattgtttttacaccatcagaaagttgaaaaatcttaagtagaaccatcataagtcagggactatctgtatggtagtagaaatttttaaytgaatcttctgtaatcttcagcaagaaaccctgagaatattgaacgtctttgccagacaaggaaaagtgggactggggaaaaggccagttatgtgaatcctcttaaaatagggtctaaaattttataataaaaatgtattttaaaagttttgattgagactttgcctgaaatgtgaaactgaaaattacgaaattaggtttattttatcctgcatttattcagtggcactcaaaacattgtaattataattgtcaaagatatcttagaccaaaggcaaaagattatttgctttattagag

SEQ ID NO: 199778 - DNA, 601 bp, Human
gtattgatgtttaacaaacaaacaaaaatatacaagttattaagttcccagctcaatgaactttcacaaaatgatcaaacctgtgtaacctgcactcagaactgccttccacttattccataattactgtcttgatttctagccccatagattatttaccttttatcacctttatttttggtgcatttgataatgttcataatatattagaataataagatatgtataattggataatttaagtagatatattatggtaaatgctcacatgtttttaccagttggacacaaaataaaaatrtttttcatccacctgtctagatgccttgaaatgttagtctgagctgagatgtgagtcctggaaattggaggacctctgtaccttctcttccaaaatctgtaaacatactgtttccgcttggcagtcttgatttgctttcagtgactctgagaagccctgtggtttgtgaagagcctcttggctttcctttgaccttggttggaagccatgtgcccaggtggaaagacagcagttccctacagcctttctcttctgtttctctcaagtcgctgtgtgcagagtccagcctaagctggctac

SEQ ID NO: 199779 - DNA, 601 bp, Human
aactttcacaaaatgatcaaacctgtgtaacctgcactcagaactgccttccacttattccataattactgtcttgatttctagccccatagattatttaccttttatcacctttatttttggtgcatttgataatgttcataatatattagaataataagatatgtataattggataatttaagtagatatattatggtaaatgctcacatgtttttaccagttggacacaaaataaaaatgtttttcatccacctgtctagatgccttgaaatgttagtctgagctgagatgtgagtcytggaaattggaggacctctgtaccttctcttccaaaatctgtaaacatactgtttccgcttggcagtcttgatttgctttcagtgactctgagaagccctgtggtttgtgaagagcctcttggctttcctttgaccttggttggaagccatgtgcccaggtggaaagacagcagttccctacagcctttctcttctgtttctctcaagtcgctgtgtgcagagtccagcctaagctggctacacttggaaacctctcctcacccttgtaccctccccacaccctggggagacttgctggt

SEQ ID NO: 199780 - DNA, 601 bp, Human
ccttccacttattccataattactgtcttgatttctagccccatagattatttaccttttatcacctttatttttggtgcatttgataatgttcataatatattagaataataagatatgtataattggataatttaagtagatatattatggtaaatgctcacatgtttttaccagttggacacaaaataaaaatgtttttcatccacctgtctagatgccttgaaatgttagtctgagctgagatgtgagtcctggaaattggaggacctctgtaccttctcttccaaaatctgtaaayatactgtttccgcttggcagtcttgatttgctttcagtgactctgagaagccctgtggtttgtgaagagcctcttggctttcctttgaccttggttggaagccatgtgcccaggtggaaagacagcagttccctacagcctttctcttctgtttctctcaagtcgctgtgtgcagagtccagcctaagctggctacacttggaaacctctcctcacccttgtaccctccccacaccctggggagacttgctggtggacagcccagccctcactgcttcaggctttaggaagaaaccctct

SEQ ID NO: 199781 - DNA, 601 bp, Human; identical to SEQ ID NO: 24425

SEQ ID NO: 199782 - DNA, 601 bp, Human; identical to SEQ ID NO: 24426

SEQ ID NO: 199783 - DNA, 601 bp, Human; identical to SEQ ID NO: 24427

SEQ ID NO: 199784 - DNA, 601 bp, Human; identical to SEQ ID NO: 24428

SEQ ID NO: 199785 - DNA, 601 bp, Human; identical to SEQ ID NO: 24429

SEQ ID NO: 199786 - DNA, 601 bp, Human; identical to SEQ ID NO: 24430

SEQ ID NO: 199787 - DNA, 601 bp, Human; identical to SEQ ID NO: 24431

SEQ ID NO: 199788 - DNA, 601 bp, Human; identical to SEQ ID NO: 24432

SEQ ID NO: 199789 - DNA, 601 bp, Human; identical to SEQ ID NO: 24433

SEQ ID NO: 199790 - DNA, 601 bp, Human; identical to SEQ ID NO: 24434

SEQ ID NO: 199791 - DNA, 601 bp, Human; identical to SEQ ID NO: 24435

SEQ ID NO: 199792 - DNA, 601 bp, Human; identical to SEQ ID NO: 24436

SEQ ID NO: 199793 - DNA, 601 bp, Human; identical to SEQ ID NO: 24437

SEQ ID NO: 199794 - DNA, 601 bp, Human; identical to SEQ ID NO: 24438

SEQ ID NO: 199795 - DNA, 601 bp, Human; identical to SEQ ID NO: 24439

SEQ ID NO: 199796 - DNA, 601 bp, Human; identical to SEQ ID NO: 24440

SEQ ID NO: 199797 - DNA, 601 bp, Human; identical to SEQ ID NO: 24441

SEQ ID NO: 199798 - DNA, 601 bp, Human; identical to SEQ ID NO: 24442

SEQ ID NO: 199799 - DNA, 601 bp, Human; identical to SEQ ID NO: 24443

SEQ ID NO: 199800 - DNA, 601 bp, Human; identical to SEQ ID NO: 24444

SEQ ID NO: 199801 - DNA, 601 bp, Human
ccttggctcgtgatcttctttccttgtagctaatgtctctgagcccctctgctgtgcttgtatttaccttaaaaacagagccacggtggtggcctgaggaaagactatcaattttcactgcttcccacccacgggggttgtgtggaccctactctgacttcccacagcacagaaaaaaaaggaaacaggtcactgtggacctagtgtctgtccatcaggaagccaggttgtaatgatcatgaaaataatagaggggaagaatgacagacctttctagtctatctgaaatagcaaaattacyagtaacaaatcattcttgatttgttcacaaacactggctcagcaagtacctattacgtgccaggctccaaggagaggaataagtcccacatctgccccagaactcactgtcttgcaggaaacagatacataaaatgccattgtaataccgtataacaaatgcaataatggaggcatgcccagaccccaggatgctacaaaggttcagtgcttcacaaaggaacctcttcaagtcagggcttagaggatgtctagttcaccaagagaacaggtgaagaagagaacattccagatagaggaa

SEQ ID NO: 199802 - DNA, 601 bp, Human
cttacttttttccttctattggacagtcattctaaaaaactcacctgatttccaggaataaaatgagtgagccagacagcttatgggaggcaggctgtgtccacttgctccttagagatttctttttgaagtgaagatagatcatcttctcaatttttcagaacagacctgaaaaattgaaccacttcactttattgccattcttctgcagaggcgagccgtgtagcatagcccctgagcacaggtctaagattgcaccaagataacacatctgtcacaagcttcatggcttatgaagggragagggtagtggtctttccaaagttaagttttactcacaatttctgaaggttcaatggaagagatgggagctttatctcagactgcaagcttcacttgatggagttaaaaacctgtatctgtgagcagctttctcacactggaggagaaggctttgggatttggctcttgttaatatgcaagaaggggaaaagtcagaaatgatagctaacagggagtgaagggctagaacttttattccaggtgaaagtactggatttttgaaagaactctagtgttagtccagaagagatataaaata

SEQ ID NO: 199803 - DNA, 601 bp, Human
tagtggtctttccaaagttaagttttactcacaatttctgaaggttcaatggaagagatgggagctttatctcagactgcaagcttcacttgatggagttaaaaacctgtatctgtgagcagctttctcacactggaggagaaggctttgggatttggctcttgttaatatgcaagaaggggaaaagtcagaaatgatagctaacagggagtgaagggctagaacttttattccaggtgaaagtactggatttttgaaagaactctagtgttagtccagaagagatataaaataaatatcrtaccattcattcctcctcctgcaaaaccaattgaaaatattggcctctctggcttgttgttttcttgctatggggcagtgattctaaagaactgacctgatttccaggaggtaaaattgtagggatgaatgataattttctaaggagatatatcaatgtctttgccatagggtaccattaggacattgacttcaatatggcatgaataccaacatctgttagaatattccaagttggtgccaggactcatattttagtaaactgtaaaatcttccctccccatgcttgtacagtagacag

SEQ ID NO: 199804 - DNA, 601 bp, Human
gatttggctcttgttaatatgcaagaaggggaaaagtcagaaatgatagctaacagggagtgaagggctagaacttttattccaggtgaaagtactggatttttgaaagaactctagtgttagtccagaagagatataaaataaatatcgtaccattcattcctcctcctgcaaaaccaattgaaaatattggcctctctggcttgttgttttcttgctatggggcagtgattctaaagaactgacctgatttccaggaggtaaaattgtagggatgaatgataattttctaaggagatayatcaatgtctttgccatagggtaccattaggacattgacttcaatatggcatgaataccaacatctgttagaatattccaagttggtgccaggactcatattttagtaaactgtaaaatcttccctccccatgcttgtacagtagacagggctacccatgatgtacgatgggtatcccacaatgagtcagttgatgtgggaacttcaattaatttatagtgggactgctcacatccctatgaagaaaatatgcacctgatacatcactgaccataacaggagcttaaaattagacataaa

SEQ ID NO: 199805 - DNA, 601 bp, Human
atctgtaaaatgaactagtagtagtacctatctcacactgtaaggactgaagaaactaatttatatggagtaattaacagagatcctaacataaataagggaatgcacattcttttcaaatgtgaacatttacaaattattcaacatacaacaacacaaaaataagcatcaatggaatttttaaagtcaaagcagtagaagccacagtctctgaccacaatgcaataaacttggaagctaaaaacaaaaggttaggcaaacaaccaaccaaaaacaaatccacttgggaaattttaaacamcattcaaattaactttttagaaaaaaaagaaatcaaagttgaagggatgaacaaattagaagtgaaagacagtgagcggttgttcatatcaaaaccaatgggatttagacaaaaccaacacagaggaaaatgccactacttacatgtggaaaatagggaagactgaaaataagtgaactaaattgacaacataaaaactagacaagggacaatgaaataaacccaactcaaagaaagtaaaatgaaggtattattaaagacaaagcatatcctgaaatagaaaaaataataacaacaaaa

SEQ ID NO: 199806 - DNA, 601 bp, Human
attcttttcaaatgtgaacatttacaaattattcaacatacaacaacacaaaaataagcatcaatggaatttttaaagtcaaagcagtagaagccacagtctctgaccacaatgcaataaacttggaagctaaaaacaaaaggttaggcaaacaaccaaccaaaaacaaatccacttgggaaattttaaacaccattcaaattaactttttagaaaaaaaagaaatcaaagttgaagggatgaacaaattagaagtgaaagacagtgagcggttgttcatatcaaaaccaatgggatttaracaaaaccaacacagaggaaaatgccactacttacatgtggaaaatagggaagactgaaaataagtgaactaaattgacaacataaaaactagacaagggacaatgaaataaacccaactcaaagaaagtaaaatgaaggtattattaaagacaaagcatatcctgaaatagaaaaaataataacaacaaaagtattccacattagcaaaatcaaaagctgtttttttgtccaaaaaaatagacaaacctgcagcaagcttcaacaagaaataaagaagagcgatgatgccaaaaaacaa

SEQ ID NO: 199807 - DNA, 601 bp, Human
taaattgacaacataaaaactagacaagggacaatgaaataaacccaactcaaagaaagtaaaatgaaggtattattaaagacaaagcatatcctgaaatagaaaaaataataacaacaaaagtattccacattagcaaaatcaaaagctgtttttttgtccaaaaaaatagacaaacctgcagcaagcttcaacaagaaataaagaagagcgatgatgccaaaaaacaacactagaaatactttttaaagaagtaccatacttatatgaagatttaaaatttataacatcttttgagctgggcatggttggctcatgcctgtaatcccaggactttaggaggctaaggcaagaagatccttgagcctaggagttcaagaccagcccagacaaggaagtaagaccttgtctccacaaaaaataaaaaacaaattagccaggcatgtggcataaactacttgggaggctgaggtgggaggatcccttgagtccagaaggtcaaggctgcagtgagccatgttcacaccactgtactcaagccaggatgacagatcctgtctcaaaaaaacaaaaacaaaacaaaaaaatcttttcaattgta

SEQ ID NO: 199808 - DNA, 601 bp, Human
ctgggcatggttggctcatgcctgtaatcccaggactttaggaggctaaggcaagaagatccttgagcctaggagttcaagaccagcccagacaaggaagtaagaccttgtctccacaaaaaataaaaaacaaattagccaggcatgtggcataaactacttgggaggctgaggtgggaggatcccttgagtccagaaggtcaaggctgcagtgagccatgttcacaccactgtactcaagccaggatgacagatcctgtctcaaaaaaacaaaaacaaaacaaaaaaatcttttcaattktattcacacaaagataaaatctgaataaaatatgcatgaggttaaaaaaaaagtccaactagactatcttagaaaaaaatgtaaaagtagacaaagacctatatcttaaaaaaaatcaccgacccagatagctatataggcagattctagtaggctttcaaggaatggataattcttatgttaatataagctgttccagagagtagaaaaagataaagcaactcattccagaaaactaacatagccctggtacagaaaccagaaatggagagcgggcacactcacgcaaaaataggaagc

SEQ ID NO: 199809 - DNA, 601 bp, Human
tgttcacaccactgtactcaagccaggatgacagatcctgtctcaaaaaaacaaaaacaaaacaaaaaaatcttttcaattgtattcacacaaagataaaatctgaataaaatatgcatgaggttaaaaaaaaagtccaactagactatcttagaaaaaaatgtaaaagtagacaaagacctatatcttaaaaaaaatcaccgacccagatagctatataggcagattctagtaggctttcaaggaatggataattcttatgttaatataagctgttccagagagtagaaaaagataaagmaactcattccagaaaactaacatagccctggtacagaaaccagaaatggagagcgggcacactcacgcaaaaataggaagcagtgagccaaactcactttgaaaacagatacaaaagttctaaataaattgcaaattgagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgt

SEQ ID NO: 199810 - DNA, 601 bp, Human
gacactgtatatatcatatatatttctcatgtgctatacaggaagaaaaaaacagttaataaaaactgaggaacccagatgttggatttaacaaagacttcaaagcagctattacaaatgtttaaagaactaaaatcagtttaaataaagtatgacagcaatgattcatcaaataaagaatatcagtaataatattgatgaataaattaaaataagtggaaattaaataaatgaataataaaatagatggaaattataagaaccaaggggaaattctggaattgaaagtaaaacatgggcygagcatggtggctcatgcctgtaatcccagcactttgggaggctgagttgggcatatcacctgaggtcaggagttggagaccagccaggccaacatggtgaaaccctgtctgtactaaaaatacacaaaacttagccaggtgtcgtgggcaggtgcctgtaatcccagctactcgggaggctgaggcaggagaatcgcttgaacccgggaagcagagattgcagtaagccgagatgtgccactgcactccagcctgaatgacagagcaagactccatctcaaaaaaaaaacaacaaataa

SEQ ID NO: 199811 - DNA, 601 bp, Human
aaaatcagtttaaataaagtatgacagcaatgattcatcaaataaagaatatcagtaataatattgatgaataaattaaaataagtggaaattaaataaatgaataataaaatagatggaaattataagaaccaaggggaaattctggaattgaaagtaaaacatgggctgagcatggtggctcatgcctgtaatcccagcactttgggaggctgagttgggcatatcacctgaggtcaggagttggagaccagccaggccaacatggtgaaaccctgtctgtactaaaaatacacaaaamttagccaggtgtcgtgggcaggtgcctgtaatcccagctactcgggaggctgaggcaggagaatcgcttgaacccgggaagcagagattgcagtaagccgagatgtgccactgcactccagcctgaatgacagagcaagactccatctcaaaaaaaaaacaacaaataaataaaagaaagttaaacacctgactgggcacggtggctcatgcctgtaatcccagcactttgggaggctgaggcgggtgtgaggttaggagttcaagaccagcctggccaacatggtgaaaccccatctct

SEQ ID NO: 199812 - DNA, 601 bp, Human
atcccagcactttgggaggctgaggcgggtgtgaggttaggagttcaagaccagcctggccaacatggtgaaaccccatctctaccaaaaatacaaaaaattagctgggagtggtggcagatgcctgtaatcccagctactcaggaggccgaggcaggagagtcgtctgtaatctcagctactcaggaggctgaggcaggagaattgcttgaacccaggaggcggaggttgcggtgagccgagatcacaccactgcacttcagcctgggcaaaagagtgagactctgtctcaatttaattaaaaaaaaaaaaaagcaaaacacctgaaatgaacaattcattagaggggctcaatagcatatttgagctgacacagaatcagtgaacttgaagctggattacagtacagattttccaatctgaagaacagaaggaaaaaagaataaaacacaagcaaaatggttgaagccccagaggcctttggtgtgctttgtgggacaccacaaagtttatcaagatatacacaattggagttgcagagaaagacgatagagaaaagagggcagaaaaaaaaatttgatgaaatatcgttccaaaacag

SEQ ID NO: 199813 - DNA, 601 bp, Human
caccagcaccatgacaatttacagatgccatggcaactcctagaagttactctgtatgctctaaaaacagaaggaaccctgggttctgagaattcgcagcccctctcctgtaaaactcatgaataatccactccttttttagcatttaatcaagaaataaccattaaaataggcaagcagcagcccttggggctgtgttacctatggggtaaccaccttttatttctttactttcttaataaacttgctttcactttactctctgggcttcctcttgaattctttcctttaggaagccaamacccaccggccctcccaggccaaaccccaatttgggggttcatcctgccacaactgtacagtgtggggtcaaggggaacccttggtctttttcactgaaaaatcaactcagaaaaggcagattaataggagaaaaggcacacagatttatttaacttgtatacaggggaggcttcagaatgaagacccaatcccctggtaaggtacagaagcttatataccatcttgaggttatagaaagaatgcaggctcagagcatgaccacaaccaggttttaatggcaagacatgtcatgggggag

SEQ ID NO: 199814 - DNA, 601 bp, Human
atactttgcgcccagcatatgctaagcacctagtgcagagaggaaaacagacaaaaagtaatttccagccatcatgtagcttacattctggtggggaaagagtaataagtaaagcatatagtttattacatgatggtaaatgctctggagaaaaatttaaaaagcaagaggatagggattgggaaaggctgtaattttaaacggagtggtcagggacagtttcacggagacctttattcagaagttgcagggaccaaagctatcttacgggagtttgcaatgagaatttctttgcccatgragtccttgccaagtctatgtcttttctgagaattctctcccccttgatttcagccctgtttgatttctgacctttgaaatgccagcccccatgctgccgttgtgtggggttccgactggacatccagaagtctccgtgtgtgttctcattagctttcactctgggggagttttctgccacaatgtgaatcacttattttgctggcagcagcagttgacagtgacactgatttttaaagcctgcacatttcacatcagaaaagtcctggattttatgacttagctatgcttagaggataat

SEQ ID NO: 199815 - DNA, 601 bp, Human
aaatcccttgttatgactatccacaattctccatgccccatgaccctttcttagctaaaatgaaaaataattgcctagttccctcatgtagagaagttgagctattaccttgacttcccccttctcttccaaaaaagattacaattcctttaattttctttcccatcctagggtgtcctctttgctctctccatattctccaaataaaaattcaaaactgagcagcaaatcctgtgcctcttcatccaacccctcctcatcatgaatcattatcactcaggaagtaaggacctggtttacyatctgagaactttagtcctaataatttctctacaccaacttctagtcctaataatttatccgtataatgctcagaaacactccgagattctcagtaaaaaaaaaaaaaaaaaaaaaaaaaatcaaggaaatcttaatggccaaagccataggtccaaaacccggcgttccctcccacccaactttccaggccattttctccaatagcccctcatccctgaccttgtcttccagcctccctggaccatgaatgctgctgaaggctctcactttgtacttccctgggccccctgcccttgct

SEQ ID NO: 199816 - DNA, 601 bp, Human
cttccaaaaaagattacaattcctttaattttctttcccatcctagggtgtcctctttgctctctccatattctccaaataaaaattcaaaactgagcagcaaatcctgtgcctcttcatccaacccctcctcatcatgaatcattatcactcaggaagtaaggacctggtttaccatctgagaactttagtcctaataatttctctacaccaacttctagtcctaataatttatccgtataatgctcagaaacactccgagattctcagtaaaaaaaaaaaaaaaaaaaaaaaaaatcarggaaatcttaatggccaaagccataggtccaaaacccggcgttccctcccacccaactttccaggccattttctccaatagcccctcatccctgaccttgtcttccagcctccctggaccatgaatgctgctgaaggctctcactttgtacttccctgggccccctgcccttgctagtgacttctcctcccctctggctgtggaaagctactcattcttcaagacccagttcatatgtcctctctgtcaaggcttcccagatgccttcacagatggccctgcctcagggcctttgcacct

SEQ ID NO: 199817 - DNA, 601 bp, Human
agtggcatcctcagacacacagtcaccccttgtatctcctggggattggctccaggacatccccccatctctacttgagatcgcccagtaggaatattttgaacaaattcctttaacccatggcagaggttgccttaatttcaatgtgagaataagaaggtgaaattttgaaataagagattgaattacttatcagaaacgaaagcttcttagagcaaatttaaactctacaaactttggtcagggatttgaacacatatttccttccccctcagtttctctcacacagacactgctgatytcagtaatggccctaaactttcttttctttttcttttgcattttcttctttctgcacatgtatgaatgcaagctgaatagtcaagttcctgaaatgggtcaggattaggtttgccttaaatctttttctcaacagaagccaaacacttaaaagaagggagatggctgattgaattctggaacaaaagttacattcctaggctcttggttaatttgagcttggctagagggagaaagcgtgtgtgtttctgtgcacaagttacactcaacacacaccctctggaaggtgggggtaagcttc

SEQ ID NO: 199818 - DNA, 601 bp, Human
tcctttaacccatggcagaggttgccttaatttcaatgtgagaataagaaggtgaaattttgaaataagagattgaattacttatcagaaacgaaagcttcttagagcaaatttaaactctacaaactttggtcagggatttgaacacatatttccttccccctcagtttctctcacacagacactgctgatctcagtaatggccctaaactttcttttctttttcttttgcattttcttctttctgcacatgtatgaatgcaagctgaatagtcaagttcctgaaatgggtcaggattakgtttgccttaaatctttttctcaacagaagccaaacacttaaaagaagggagatggctgattgaattctggaacaaaagttacattcctaggctcttggttaatttgagcttggctagagggagaaagcgtgtgtgtttctgtgcacaagttacactcaacacacaccctctggaaggtgggggtaagcttcagtcccgactgtccgtacagagtgtggttcagaggctgccctttaacctgtgtggccagagagaataaatcaagccagcagtgctgtctccctgctgactgaaggcgc

SEQ ID NO: 199819 - DNA, 601 bp, Human
tggccctaaactttcttttctttttcttttgcattttcttctttctgcacatgtatgaatgcaagctgaatagtcaagttcctgaaatgggtcaggattaggtttgccttaaatctttttctcaacagaagccaaacacttaaaagaagggagatggctgattgaattctggaacaaaagttacattcctaggctcttggttaatttgagcttggctagagggagaaagcgtgtgtgtttctgtgcacaagttacactcaacacacaccctctggaaggtgggggtaagcttcagtcccgrctgtccgtacagagtgtggttcagaggctgccctttaacctgtgtggccagagagaataaatcaagccagcagtgctgtctccctgctgactgaaggcgcccggccttatcaaggagcccaaatgtcttgtgctcacagctgctgtgacatctggaagcattaacactttgttgccagcatgtaggctagttgaatgccgatgcgtaggtgcctggtgttttctggtctgctacatgaataggcgtcaaaagttggtggtgaggagtttgcttacgttcattccttaaaagcaacatgac

SEQ ID NO: 199820 - DNA, 601 bp, Human
taggtttgccttaaatctttttctcaacagaagccaaacacttaaaagaagggagatggctgattgaattctggaacaaaagttacattcctaggctcttggttaatttgagcttggctagagggagaaagcgtgtgtgtttctgtgcacaagttacactcaacacacaccctctggaaggtgggggtaagcttcagtcccgactgtccgtacagagtgtggttcagaggctgccctttaacctgtgtggccagagagaataaatcaagccagcagtgctgtctccctgctgactgaaggygcccggccttatcaaggagcccaaatgtcttgtgctcacagctgctgtgacatctggaagcattaacactttgttgccagcatgtaggctagttgaatgccgatgcgtaggtgcctggtgttttctggtctgctacatgaataggcgtcaaaagttggtggtgaggagtttgcttacgttcattccttaaaagcaacatgacacagagccttgccatggcaggggtgatgggttgttaccaaagtcgataacaggaaatctcactgaggataaacagggctcatcggccattgccgagaa

SEQ ID NO: 199821 - DNA, 601 bp, Human
gtttctgttttttggatttttgtccttaaataaacaccttggaaccactagctacacagaggggtaaatatcagaaaatccaaatttggtgcactaatgaacacggggtctcttttcacaaagcaaaagaccatcattcttcagaaggatctcccaaagaatgccattgaaaactcctcattaccttcaaatggggtgatgcacacacgagtagcatgaaattagccatgttcatattaaggagcaatctaagatcattattgctgtttctctggccttatattaaatagtgtcattgcarttgaaaaattagagtaaatgaacagagcctgtgagcatccaccctttgtaggttatcctgagtctgcattattacagggtcttgaaatgaatggtgatacgtgaaagtatttgtcctaggattcattaatattattatattttagtctttggtcaatatgaagaaatactcaatagtaaatcatagcaacatgatttaacatgagatataatttgaagggctctttaaggctgctaagcaaccatgaatcatggtttgcatttttctagatggataatatgaagctatcttatttatctt

SEQ ID NO: 199822 - DNA, 601 bp, Human
agatcattattgctgtttctctggccttatattaaatagtgtcattgcaattgaaaaattagagtaaatgaacagagcctgtgagcatccaccctttgtaggttatcctgagtctgcattattacagggtcttgaaatgaatggtgatacgtgaaagtatttgtcctaggattcattaatattattatattttagtctttggtcaatatgaagaaatactcaatagtaaatcatagcaacatgatttaacatgagatataatttgaagggctctttaaggctgctaagcaaccatgaatcrtggtttgcatttttctagatggataatatgaagctatcttatttatctttctagaactagacaccttaggtcaggctaatcaaccagctggtatcatttctcagttattgtatgactactatctttatttcaaaccctgaagtcctaaaattaatgtcaccacagccattgtagtatgtgttcagccgcctgtgccggaataggggcttactgtcttttgatgccttggttctcagagtaggcaatgggtaattgaattagcaaagtagacattcaaaacattctctgagttttcaaact

SEQ ID NO: 199823 - DNA, 601 bp, Human
gtcaacagacaactcttagaagtgcctgattgagcctacaacatggaaatgccatttcctccaagccgtttatctgaccacctcagcctggaaagtaacagctcttgacttcccttctccacctgggatcagatgacgacaacatttgaaacaaagggtctgctctctttctcagtatcacacctatggaatcagccctgattcacacttcaaacccactacttcatgaagcaaggtcttgccagatcccctagagtgaacaggggattctttatcctctcacaggcctggcaccgtggtrgcttctgaccatgacagctcctttcactgaggctgacccagactctgccaccaagtgatggccactccttgggctcccacagccagggttcctgacagcttccccagtcaccaccatttcatggtttcagtttgcacaatgtcctctttggggtaaaggggaggacagatgccaacagaaaaccctcagtacctgccttggtagaatacagccttgtcactgtgtcctgcatcctcctgtccttgtttgggtgcctggtgaagtccttttgttcaaattctaatagccatggacctctgc

SEQ ID NO: 199824 - DNA, 601 bp, Human
tgggtggccaggcctcgtaatctcagcagaggaatgtgcatgccacagggctgcagaaaacagtttccagcggtctgtcagcagatgtccactccagaagacagacagggaatttggagacctacaggctttggagtgaaaaagtgatggatattaagagcacaactacacacattcggattctcaaacgcccaataaacataaatattttccatccacaatgtactatatatgcctaaatatagggcaagccccaaatagcacatcctccatttccctaattagataaatttaactctctttttttttttgccaacttaataggaatcagaactatgattgcctttgaggtggggggagtgggcagtgggaattgactggcaagggactggtgggaactttctggagtgagagacaagttctgtactttcatgggggtggtagttactgggtgacataattcatcaaactgcaccctttagatctgtggattttaatgcctgtaaatttacctcaataaaaagaagtttggagaaatgaagaaataatcaactatctgtgtataatgtttaacttaatcatgtggttgaatgcttaaaat

SEQ ID NO: 199825 - DNA, 601 bp, Human
acaattgaacccaaggaataattaccaaatcttcattaaagctcattgcctccttcccattgtttccctctcgtgacctctaaaatcgtccaaacctgatgttgattgagatcatttcaggctagtgtgttttccccaaatgttgtcgttcaaataaagtaattgaggctgggtgcagtggctcatgcctataatcccagtgctttggaaggccaagacaggcagattgcttgagctaaggagttcgagaccagcctgggtaatgtggcaaaactctatctctaccaaaaaaaaaaaaaaaaaaccagcaaaaaacaaaacaaaacaaaaactagccatgtgtggtggcatgtgcctatagtcccagctactcaggaggctgaggaaggaggatcacctgagcccaggaggttgaagctgcagtgagctggactactgtacttcagcctgggagacagagaccctgtctccaaaaaaaaaacaaaaaacaaaaaacaaaatttccaaattattagacacttaaattttaaaggacagtaagtcccaaactgtgagaaacttttataggcaacatcctcttttctaatagtttaacttgagg

SEQ ID NO: 199826 - DNA, 601 bp, Human
gccaagacaggcagattgcttgagctaaggagttcgagaccagcctgggtaatgtggcaaaactctatctctaccaaaaaaaaaaaaaagaaaccagcaaaaaacaaaacaaaacaaaaactagccatgtgtggtggcatgtgcctatagtcccagctactcaggaggctgaggaaggaggatcacctgagcccaggaggttgaagctgcagtgagctggactactgtacttcagcctgggagacagagaccctgtctccaaaaaaaaaacaaaaaacaaaaaacaaaatttccaaattaytagacacttaaattttaaaggacagtaagtcccaaactgtgagaaacttttataggcaacatcctcttttctaatagtttaacttgaggatataaaccttcaccttatttattttcagacatatatagtaaatcctggaatgtattcagatcaaagataaaatagagataaatttagcaaattttggtggtcttgttttataattcactattaatagattagcattgttagctttagtttatttgtgtagcaaaaactgaccaatagaatctaattaaactgaagagcttctacacagca

SEQ ID NO: 199827 - DNA, 601 bp, Human
ttcatttttctaacagttcctcaatttaaacatcagaaagagtgctgttcttaaggaaatcatcaagaaagactaagcaccattgttttgtttctgatgttgctgtcactcagcaccgttgccattgctgtcagaagcaaaatcaaatcactcaccaagagctcggcaagcatgcaggtccccgtctggctcagggcagagactggtcagttatttttttggtagcaaaactctggctttagagttggaccatgagcagtcctgcttgctgctcattccctttctctagaaggacccctawggagttttacagcaccgtgggggctttctagaatggttgaaaacctctggcagcagatcatccatcaggcttggtcccaagttccagacctgggttcttgactccatgactgttggccagtgacctaagttcagtctcattttcctcattcagacaagaattgcttgtaaggatgttcttaagtgtgctttcaaaaccatggagtataaggcttattttactccttaagtcttcctatttcctagtcacatctcatttgcatgttatatgccatctcatcaattattgggggacctaaga

SEQ ID NO: 199828 - DNA, 601 bp, Human; identical to SEQ ID NO: 24445

SEQ ID NO: 199829 - DNA, 601 bp, Human; identical to SEQ ID NO: 24446

SEQ ID NO: 199830 - DNA, 601 bp, Human; identical to SEQ ID NO: 24447

SEQ ID NO: 199831 - DNA, 601 bp, Human; identical to SEQ ID NO: 24448

SEQ ID NO: 199832 - DNA, 601 bp, Human; identical to SEQ ID NO: 24449

SEQ ID NO: 199833 - DNA, 601 bp, Human; identical to SEQ ID NO: 24450

SEQ ID NO: 199834 - DNA, 601 bp, Human; identical to SEQ ID NO: 24451

SEQ ID NO: 199835 - DNA, 601 bp, Human
gaatacctggcctcaagggatcctctcaccttagcctccagagtagctaggactacaggcacactaccatgcctaatttttaaattttttaaaatttttttgtcgggatagggttccacgatgttgctcaggctggtctcaaactcctggcttcaagcgatcctcctgcctcagcctcccaaaacactgagattacaggcaaacactgggtgttttaaaaacaagttgtttgaatgacttaaagagattacatccaaattgccaagacctagtaactgctctttaactatttaccaccccmttctcctccataaagtgcagttggcaccaaggcctcagagacacgggagggtgtggcaaaccacgaggctgagagtggaggtgtgggagaggctggagggaagctatggccttggaattttattgccttttattgttgttcttgcaggagcaggggggttgaggggggttcatcctgtatttgacgcccacactcagatcccaggggagtagaggaggagacagcagccgatgcacttcttttgccagtgagctgtgcaatgatgctacctgtctgcttcccttctgtggaatttaccct

SEQ ID NO: 199836 - DNA, 601 bp, Human
caccttagcctccagagtagctaggactacaggcacactaccatgcctaatttttaaattttttaaaatttttttgtcgggatagggttccacgatgttgctcaggctggtctcaaactcctggcttcaagcgatcctcctgcctcagcctcccaaaacactgagattacaggcaaacactgggtgttttaaaaacaagttgtttgaatgacttaaagagattacatccaaattgccaagacctagtaactgctctttaactatttaccacccccttctcctccataaagtgcagttggcrccaaggcctcagagacacgggagggtgtggcaaaccacgaggctgagagtggaggtgtgggagaggctggagggaagctatggccttggaattttattgccttttattgttgttcttgcaggagcaggggggttgaggggggttcatcctgtatttgacgcccacactcagatcccaggggagtagaggaggagacagcagccgatgcacttcttttgccagtgagctgtgcaatgatgctacctgtctgcttcccttctgtggaatttaccctctcttagaacagtcagtgttgctgtg

SEQ ID NO: 199837 - DNA, 601 bp, Human
actgagattacaggcaaacactgggtgttttaaaaacaagttgtttgaatgacttaaagagattacatccaaattgccaagacctagtaactgctctttaactatttaccacccccttctcctccataaagtgcagttggcaccaaggcctcagagacacgggagggtgtggcaaaccacgaggctgagagtggaggtgtgggagaggctggagggaagctatggccttggaattttattgccttttattgttgttcttgcaggagcaggggggttgaggggggttcatcctgtatttgaygcccacactcagatcccaggggagtagaggaggagacagcagccgatgcacttcttttgccagtgagctgtgcaatgatgctacctgtctgcttcccttctgtggaatttaccctctcttagaacagtcagtgttgctgtgacacatttacaaaagtgataagtttataatgattttgtgcttagaaactgttgttaatttactctctgacaacagtggagacaccacatgtcaaaatgtcagaatggggttcaaaccaaagactactcttacaagaccctggttgggaaagtttcatat

SEQ ID NO: 199838 - DNA, 601 bp, Human
tcttagaacagtcagtgttgctgtgacacatttacaaaagtgataagtttataatgattttgtgcttagaaactgttgttaatttactctctgacaacagtggagacaccacatgtcaaaatgtcagaatggggttcaaaccaaagactactcttacaagaccctggttgggaaagtttcatatagaaaataaatgctgggcaggcggatcatctgagatcaggagttcaagaccaacatggcgaaacgctgtctctactaaaaaatataaaaattagccagtcgtggtggtaggctcttrtaatcccagctacttgggaactgaggcaggagaatcacttgaaacccggaggcggaggttgcagtgagccaagatcatgccactctgctccagcctgggcaacggagtaagactccgtctcaaaaaaacaaaaaacaaacaaacaaacaaaaaaaaaaccaatagtaataatgcttaggacctcaataaaacttcagtcctgtccgtttttggtgagcaagagatgagaacatcagggagtctgggatgaaaatgaattcctgaatgagtgaggggttgggcattccctactcagtgagg

SEQ ID NO: 199839 - DNA, 601 bp, Human
aagactactcttacaagaccctggttgggaaagtttcatatagaaaataaatgctgggcaggcggatcatctgagatcaggagttcaagaccaacatggcgaaacgctgtctctactaaaaaatataaaaattagccagtcgtggtggtaggctcttgtaatcccagctacttgggaactgaggcaggagaatcacttgaaacccggaggcggaggttgcagtgagccaagatcatgccactctgctccagcctgggcaacggagtaagactccgtctcaaaaaaacaaaaaacaaacaaacaaacaaaaaaaaaaccaatagtaataatgcttaggacctcaataaaacttcagtcctgtccgtttttggtgagcaagagatgagaacatcagggagtctgggatgaaaatgaattcctgaatgagtgaggggttgggcattccctactcagtgaggagaatgagtgttccatgcagacttttatgctctacccacaagataagttgtccaagcactatttttgtttgtttgtttgtttctttgtttgtttgagacagggtcttgctttgtcacccaggctggagtgcactggtgcaatc

SEQ ID NO: 199840 - DNA, 601 bp, Human
tactcttacaagaccctggttgggaaagtttcatatagaaaataaatgctgggcaggcggatcatctgagatcaggagttcaagaccaacatggcgaaacgctgtctctactaaaaaatataaaaattagccagtcgtggtggtaggctcttgtaatcccagctacttgggaactgaggcaggagaatcacttgaaacccggaggcggaggttgcagtgagccaagatcatgccactctgctccagcctgggcaacggagtaagactccgtctcaaaaaaacaaaaaacaaacaaacaaamaaaaaaaaaaccaatagtaataatgcttaggacctcaataaaacttcagtcctgtccgtttttggtgagcaagagatgagaacatcagggagtctgggatgaaaatgaattcctgaatgagtgaggggttgggcattccctactcagtgaggagaatgagtgttccatgcagacttttatgctctacccacaagataagttgtccaagcactatttttgtttgtttgtttgtttctttgtttgtttgagacagggtcttgctttgtcacccaggctggagtgcactggtgcaatcatggc

SEQ ID NO: 199841 - DNA, 601 bp, Human
ttcatgttttcttaaaacaattattgtattgaactaaaaataaactaggtagtttgttcacataacaaatctacattcaaagacatgcaaacaaattttccacttagtccatttttctgttctcagcattactacaaatgcctcattctgttatcacgttgaattcttcagcatcttctatatcatttccagggcatctctgggaagtagtgatgcctgtcttccctcagaagcacactgataaccccaatatacccacaattcacacttttttccttctctgaggtatgctgttttttgkcaaaacagaaaaaacacactactaggatatgaaaaacttcattctgggcctggttaggtcataaactacagaaccttaggtcatatattctcaccgggcgcttgtttctccactgcaaaaaataattcgtatttgcttggtcctttgtagtactttactgtttataaatgtagtacatttatcttcatgatgacccttaaatttaagtaaggtagtattatgctcattttatagaagaaattcaatctcaaagaggatacagtctcccaaagatcccacaagcagtaatatattaggcag

SEQ ID NO: 199842 - DNA, 601 bp, Human
cagcatcttctatatcatttccagggcatctctgggaagtagtgatgcctgtcttccctcagaagcacactgataaccccaatatacccacaattcacacttttttccttctctgaggtatgctgttttttgtcaaaacagaaaaaacacactactaggatatgaaaaacttcattctgggcctggttaggtcataaactacagaaccttaggtcatatattctcaccgggcgcttgtttctccactgcaaaaaataattcgtatttgcttggtcctttgtagtactttactgtttataartgtagtacatttatcttcatgatgacccttaaatttaagtaaggtagtattatgctcattttatagaagaaattcaatctcaaagaggatacagtctcccaaagatcccacaagcagtaatatattaggcagagctaaactcacacactgtcactcaatatcctaatattggtacatgccatgctaataagtgtgctaaaatggatgaagcggcaatttctcaggtcccttccaatgatcctgtcctctgcttctacttgatattttttctctctttcaactagcattaacatccgaaac

SEQ ID NO: 199843 - DNA, 601 bp, Human
tatgaaaaacttcattctgggcctggttaggtcataaactacagaaccttaggtcatatattctcaccgggcgcttgtttctccactgcaaaaaataattcgtatttgcttggtcctttgtagtactttactgtttataaatgtagtacatttatcttcatgatgacccttaaatttaagtaaggtagtattatgctcattttatagaagaaattcaatctcaaagaggatacagtctcccaaagatcccacaagcagtaatatattaggcagagctaaactcacacactgtcactcaatwtcctaatattggtacatgccatgctaataagtgtgctaaaatggatgaagcggcaatttctcaggtcccttccaatgatcctgtcctctgcttctacttgatattttttctctctttcaactagcattaacatccgaaactgtatatcatcaccacatttcatttaccatggttttttaatttaattattctttaaatttttctatttccatgttaaatccagagaaattgttactttttggaaagtttctactgctgcctgcctctgaaggccacgggacttacctgtttgtttgtcaa

SEQ ID NO: 199844 - DNA, 601 bp, Human
atgagggattcaggacatttcccaaggggtcatctgaccaatttaagagttggtatgatgtgcctaaaatagcaaattaactcttctacttataataaaggtgcagatgtactgattagacatgctgacatgtacatataaaatatgcctaaaccaaattaaaagaaaacaaaatatattccatggcaatcttgaaaagtcagggagctcaatatatattaagagtatgcgctcagccaggcgcggtggctcacacctgtaatcctagcactttgggaggccaaggcgggtggaccacaargtcaggagatcgagaccatcctggctaacgtggtgtaaccctgtctctactaaaaaatacaaaaaaaaaaaaaaatgagctgggtgtggtggcgggcgcctgtagtcccagctactcgggaggctgagacaggagaatggcgtgaacccagaaggcggagcttgcagtgagctgagatcacgccactgcactccagcctgggtgacagagtgagactccgtctcaaaaaaaaaaaaaaaaaaaaaaaaaaagactatgctctcacaatgagagcattaaacatttggtaattaacataat

SEQ ID NO: 199845 - DNA, 601 bp, Human
tctgctctcacaggaggctgttggtagaggggtgcctgggagcaggagagggcttcatcttgctgatttcccattctgctcggttctctcggttggaatgcctgatcctgcgagtcactgcagcccccatctcataacatgatgccctcaggtttacgccacttgtgggaacactggcacaggaagcctccagggcgtctggagcatgcacacatgtcctgtgattctttatatcttttatttttatgccatggtacaagttgtgctttacagagcatttgggtgaataactagaaatatrccatagattcttgaggctttgcctggttcactaatgacaggctccagggcgtttctcagggagcgtgttagcatgtttctaggaccagccacatcagccagacctggctctgtacagacccaaacctgagaatgccatgtgagacctgtgtgactgcagaatcaaagtgctggttgcgaggtgccaattacatgttgaatttcatcttcaacccaactctacttacctttcagggagtgatgagtagggggcgagaggggaaaatgcagaaagtgttgtttgaggcccacagaaactata

SEQ ID NO: 199846 - DNA, 601 bp, Human
atttcccattctgctcggttctctcggttggaatgcctgatcctgcgagtcactgcagcccccatctcataacatgatgccctcaggtttacgccacttgtgggaacactggcacaggaagcctccagggcgtctggagcatgcacacatgtcctgtgattctttatatcttttatttttatgccatggtacaagttgtgctttacagagcatttgggtgaataactagaaatatgccatagattcttgaggctttgcctggttcactaatgacaggctccagggcgtttctcagggagcrtgttagcatgtttctaggaccagccacatcagccagacctggctctgtacagacccaaacctgagaatgccatgtgagacctgtgtgactgcagaatcaaagtgctggttgcgaggtgccaattacatgttgaatttcatcttcaacccaactctacttacctttcagggagtgatgagtagggggcgagaggggaaaatgcagaaagtgttgtttgaggcccacagaaactataaagatgaagaacaggagaaacgtagttaatcatgccctggaaagctggcctgcagaaagaaaagg

SEQ ID NO: 199847 - DNA, 601 bp, Human
tgggtgaataactagaaatatgccatagattcttgaggctttgcctggttcactaatgacaggctccagggcgtttctcagggagcgtgttagcatgtttctaggaccagccacatcagccagacctggctctgtacagacccaaacctgagaatgccatgtgagacctgtgtgactgcagaatcaaagtgctggttgcgaggtgccaattacatgttgaatttcatcttcaacccaactctacttacctttcagggagtgatgagtagggggcgagaggggaaaatgcagaaagtgttgyttgaggcccacagaaactataaagatgaagaacaggagaaacgtagttaatcatgccctggaaagctggcctgcagaaagaaaaggaatttatctctgagaaggccttcagaaagaaaatgagtaggctccggagacgttcatctgtcttcgtgcagccataaaaagttatcaggtgaggctgaggggtgaaggcgctttctctgatccctgaattggttactgaggcccacagaagaggaaaggacccctgaagccagaaactcccccaaggcaaatcaagactttatggaatcagctc

SEQ ID NO: 199848 - DNA, 601 bp, Human
cctggttcactaatgacaggctccagggcgtttctcagggagcgtgttagcatgtttctaggaccagccacatcagccagacctggctctgtacagacccaaacctgagaatgccatgtgagacctgtgtgactgcagaatcaaagtgctggttgcgaggtgccaattacatgttgaatttcatcttcaacccaactctacttacctttcagggagtgatgagtagggggcgagaggggaaaatgcagaaagtgttgtttgaggcccacagaaactataaagatgaagaacaggagaaacstagttaatcatgccctggaaagctggcctgcagaaagaaaaggaatttatctctgagaaggccttcagaaagaaaatgagtaggctccggagacgttcatctgtcttcgtgcagccataaaaagttatcaggtgaggctgaggggtgaaggcgctttctctgatccctgaattggttactgaggcccacagaagaggaaaggacccctgaagccagaaactcccccaaggcaaatcaagactttatggaatcagctctgttactgcaagacatcccctcaaactcccgtctcagtctgtg

SEQ ID NO: 199849 - DNA, 601 bp, Human
tctggagtcaggcagaaacctttctactttctggagttgctgagaaggttcagtgataccagcatgaagctcctagaagaagggctggtgcatagctgctgctcagggtggcacagcccctccacagtcctgcccacatgtgagttgccccttcacaccactccctaacactgccctcaccaaagatgcaagcctggtatctcaaccagagaggcatctttcaacatggcaagcaagattactccaaaaaaatgccacttaccattcctttggtgtactgcttctagaggcaaagtttacygcttttactgtcatgaaatagactgtgacttgttatttatcatttatgtgaccaattatagttacaatcatgttccatgtgacaatagaatctttccccccttgaacctcacattatgctgagatgtaggatgaagaggagggttgttgaagggtcatcaccgcccccatcctatgccatcagcagtgggtggtgagtagttctttctcttcacccacctccccacatgtgagaattaagctctgaccatcaagaattgagaaaactctcggtatagttttccaaacacacgagtcatat

SEQ ID NO: 199850 - DNA, 601 bp, Human
accgcccccatcctatgccatcagcagtgggtggtgagtagttctttctcttcacccacctccccacatgtgagaattaagctctgaccatcaagaattgagaaaactctcggtatagttttccaaacacacgagtcatattttctaatggtcatcatttgcttatttgtttgatgaatatttattgagggcttgctaagagccaggcactgtgctaggcactggggactcgatggggaacaaaagagacatgatccgtgccctcccagagctggccgagggggcagcagtcagcaaggasgcaaacaagaattctatttccagttgaggttagtccccagggagtagcctgctttagattgggggtcgaggaatgtttctacaaggaagctgagactggcagatgagaaggaattcgcttgccaagcatgaggaagagtgtctcagttggggaggagagctgtatggagccccaaaaggcttggcctcttcaaggcactgaaagaccaggtagcaggaagctggttagcagtgaagagaaccatggtagacctaggcagggtccatgccaggtaacaccactgggcacttacaaaggaaa

SEQ ID NO: 199851 - DNA, 601 bp, Human
ctctttccacttcttattttatataaattccttccttctattgagacaagtgtgtgatgttgactgcagagagcatcttgcccttgtcattgaccttcagctggcctaggtctggagttgaacctcctcttggatggtattgaccgagctgtccctccgtctctggaagccctccatccagcagaagcctgggtgagatgtactgccattgtgatcatattctcaggccttgtggagacatgggcattgccagctgttacagtaggcatatttgcattgatcagaacataaaagtttccakaaacacagaagtgaatcaaatagtgtggtttaggttcacccactgcctcagactggaagctggcttctggccactccatgacaccagcttggcaacctcaggtacgttaaattctacagaagcaggcagggtgccagtgtctggacctgtctcaaaggcctgtttgccctcctcaaaggcccccttgagacagatcctcatactccccattttcgtctgttttgttagtcagcgtccagtgtgtgagccctccagccagggtccgcaccaggccatcagccatcccttcactggccagag

SEQ ID NO: 199852 - DNA, 601 bp, Human
cccactgcctcagactggaagctggcttctggccactccatgacaccagcttggcaacctcaggtacgttaaattctacagaagcaggcagggtgccagtgtctggacctgtctcaaaggcctgtttgccctcctcaaaggcccccttgagacagatcctcatactccccattttcgtctgttttgttagtcagcgtccagtgtgtgagccctccagccagggtccgcaccaggccatcagccatcccttcactggccagagctcctgccttccccagctcagcctgctacgaccctcacrgccactcccccaaaaccagcagacttctcctcctcctcagtcaatcttctcctttcacaccacctcctttcttactgaaagcgtggatctaacctggggaaaccatttcccccgcagccctctcacgggggctttttccttgtactcccacattcagttatctcttctgacctagattcattttgcagtgtactttgcaaaatgcaaatcacatcactgccctgctcaaaatcctccagtggcttctcattcctcttaaggtaaagcatggagatcttactgcagcctccagctcctgtc

SEQ ID NO: 199853 - DNA, 601 bp, Human
ctctccttggaatgatcttccctcccttgtttagctggtaaacttctgcttgtcctttcaccttcagctcaaatggctcctcagggaactctgttcactcccatgcctctatcatgaggatcttttatcatcatgaacttctcctttgtagcacttccacagttataatgatgcatttatttttctaattgactagtagtctctagaagctggaagttctgtgaaagcaaagactgcctgttttattcatcaatgaatttccacaatgtctagcacataggagatactgcagacacattttttggttggttggatggatggatggatggatgaatggatggatggaacgacggacagacggatggacagagcagatggacaggttgattgacagatggataggtggtggatgggcggatggacagatggatggatggccaggactcccccaaaagatataacatttgcaaatatatttttgaaggagagagaaaataatcacactcagagactccacttcaaatcccacatctcttttgttgcaaactgagtcgtgttcatacttcatctgattttatagcagaaatgatgttgaatgtat

SEQ ID NO: 199854 - DNA, 601 bp, Human
tggaatgatcttccctcccttgtttagctggtaaacttctgcttgtcctttcaccttcagctcaaatggctcctcagggaactctgttcactcccatgcctctatcatgaggatcttttatcatcatgaacttctcctttgtagcacttccacagttataatgatgcatttatttttctaattgactagtagtctctagaagctggaagttctgtgaaagcaaagactgcctgttttattcatcaatgaatttccacaatgtctagcacataggagatactgcagacacatttgttggtttgttggatggatggatggatggatgaatggatggatggaacgacggacagacggatggacagagcagatggacaggttgattgacagatggataggtggtggatgggcggatggacagatggatggatggccaggactcccccaaaagatataacatttgcaaatatatttttgaaggagagagaaaataatcacactcagagactccacttcaaatcccacatctcttttgttgcaaactgagtcgtgttcatacttcatctgattttatagcagaaatgatgttgaatgtattaatttg

SEQ ID NO: 199855 - DNA, 601 bp, Human
gaatgatcttccctcccttgtttagctggtaaacttctgcttgtcctttcaccttcagctcaaatggctcctcagggaactctgttcactcccatgcctctatcatgaggatcttttatcatcatgaacttctcctttgtagcacttccacagttataatgatgcatttatttttctaattgactagtagtctctagaagctggaagttctgtgaaagcaaagactgcctgttttattcatcaatgaatttccacaatgtctagcacataggagatactgcagacacatttgttggttggatggatggatggatggatggatgaatggatggatggaacgacggacagacggatggacagagcagatggacaggttgattgacagatggataggtggtggatgggcggatggacagatggatggatggccaggactcccccaaaagatataacatttgcaaatatatttttgaaggagagagaaaataatcacactcagagactccacttcaaatcccacatctcttttgttgcaaactgagtcgtgttcatacttcatctgattttatagcagaaatgatgttgaatgtattaatttgta

SEQ ID NO: 199856 - DNA, 601 bp, Human
aatgatcttccctcccttgtttagctggtaaacttctgcttgtcctttcaccttcagctcaaatggctcctcagggaactctgttcactcccatgcctctatcatgaggatcttttatcatcatgaacttctcctttgtagcacttccacagttataatgatgcatttatttttctaattgactagtagtctctagaagctggaagttctgtgaaagcaaagactgcctgttttattcatcaatgaatttccacaatgtctagcacataggagatactgcagacacatttgttggttggtaggatggatggatggatggatgaatggatggatggaacgacggacagacggatggacagagcagatggacaggttgattgacagatggataggtggtggatgggcggatggacagatggatggatggccaggactcccccaaaagatataacatttgcaaatatatttttgaaggagagagaaaataatcacactcagagactccacttcaaatcccacatctcttttgttgcaaactgagtcgtgttcatacttcatctgattttatagcagaaatgatgttgaatgtattaatttgtat

SEQ ID NO: 199857 - DNA, 601 bp, Human
ttaacttagcataataaacatcattttcccacattattactatgttttcaaaagtatctaaaatttggaaatcaggcaaaaagatgattacatatcctttcagtgtcatactggagcatcccctcgcccctttctactcaaagtgtggtccacagaccagcagcatcagcatcatgggggagattatttgaaatctaggctctcaggccccattctagactctaattcagaatctgcattttaatagagttcctcatgtgattcttatacacagtaaaatttgagaagcactggtggaggkcccaaattctgtaaagttacctattaacttacggaaggctgataagttataaatgactcttgccagtaaagataaaaatgatttctgtttgactgaaaatatcccaaaggttagaatttattgccttgtagggtattagccagttttgtatttgatttagtaatctgatttcagtaatttttttcctgtgactacacatttttttctggtctttttaaaactagctttgccaccctgctgacttcctcaataataaattaaataaatctttgccacgtattcactatatatttgtatgag

SEQ ID NO: 199858 - DNA, 601 bp, Human
aagttataaatgactcttgccagtaaagataaaaatgatttctgtttgactgaaaatatcccaaaggttagaatttattgccttgtagggtattagccagttttgtatttgatttagtaatctgatttcagtaatttttttcctgtgactacacatttttttctggtctttttaaaactagctttgccaccctgctgacttcctcaataataaattaaataaatctttgccacgtattcactatatatttgtatgagaatcatgtttttaactttttgaaaattatgctttgacaaccagstttctgtcatcatttttaatagttctgtggtattctattttgtgattgaccatagtttacttatctattgccctaatgttagacacttaggatattgctaatttagtaccaatataaataattctgcagtgaacatctttgagcataaaactttttccgtattttatatttatttcctttgagtaagttttcaagtactgaattaatggatcaaagggtatgaacatttttattttattttttaattttttatttttttaagacagagtcttgctctttcacccaggctggaatgcagtg

SEQ ID NO: 199859 - DNA, 601 bp, Human
aaccaggcactgcagtgtggtgatgacaagctcagatttgggggtttggggttggctaagagctgggttcaaatcgtgactgtgcatttgaactacacaatccagagcaaatatcctctctggacctccatgttcccctctgtaaaatgggtgtggaagacctcatagggctgttgtatgacttagacaagagattgcaaaaaaaagcataaactgacacagacaatattcaataagtgttagagagggatggaagccaggccctaaaaaggttaaataagcagtgctaggcattataacrtcagtattgtgcccagtcactgcttgggcttgagcaaggggctggaccagtgggcttcagcgatcagtgaggcttcttgacagaggattgaactaggtttagaaaagactttcccaaaggggaatggacattccaaagagatggcaaagcttggagaaagacctgtggttggccagcctgtctggagccaaaggagagaatgactgcccagagctgtgatttttttgtcttttgcagtgaggagcttaaatgggacagtggtgtattggggagagttatttggtagcagaagacgcaata

SEQ ID NO: 199860 - DNA, 601 bp, Human
gaactacacaatccagagcaaatatcctctctggacctccatgttcccctctgtaaaatgggtgtggaagacctcatagggctgttgtatgacttagacaagagattgcaaaaaaaagcataaactgacacagacaatattcaataagtgttagagagggatggaagccaggccctaaaaaggttaaataagcagtgctaggcattataacatcagtattgtgcccagtcactgcttgggcttgagcaaggggctggaccagtgggcttcagcgatcagtgaggcttcttgacagaggatygaactaggtttagaaaagactttcccaaaggggaatggacattccaaagagatggcaaagcttggagaaagacctgtggttggccagcctgtctggagccaaaggagagaatgactgcccagagctgtgatttttttgtcttttgcagtgaggagcttaaatgggacagtggtgtattggggagagttatttggtagcagaagacgcaatagatgctttgaattctgcaaaaccaaactcccctgtgaccagtggggataaagcagagccgaaggggacaatcagaagtgagcactgata

SEQ ID NO: 199861 - DNA, 601 bp, Human
gaaagctttgaggaggctgttgaatgaggccacctgggtcacaacagctttgctagtcaacccagagcagtatctcatttcggctcacatttctcgaacgcttactttgccccagtccttgctttgcctggactaggcactgggatgcagcaataactgtgcccttccctgcacttgaccgcctcaccacctagcaatagacctgcaggcataatggagggtggtgagtgctgcgcagtaactgctctggaaactgagaagaaggtgccatgagtccccctcccttgcccccaaggaggasggaggattaaaaggtcacagagaacagtgtggtagatgagagcagctttcaggctgacagctgtgggcagcaatcctgactctcacacttgcctgacatgaggccttaagggggctgcttaccttctgtgaccctcagtttcttcctctgtaaaaaggagaccatcacctccagtttggtatgtagaggttatgcaaggaaaatgtttagcactgcgcttagcacacagaagccaggggatatttcataaatgaggtgtcattcgagtctgacctttagtgtggtttgagttttccaggc

SEQ ID NO: 199862 - DNA, 601 bp, Human
gccacctgggtcacaacagctttgctagtcaacccagagcagtatctcatttcggctcacatttctcgaacgcttactttgccccagtccttgctttgcctggactaggcactgggatgcagcaataactgtgcccttccctgcacttgaccgcctcaccacctagcaatagacctgcaggcataatggagggtggtgagtgctgcgcagtaactgctctggaaactgagaagaaggtgccatgagtccccctcccttgcccccaaggaggagggaggattaaaaggtcacagagaacagygtggtagatgagagcagctttcaggctgacagctgtgggcagcaatcctgactctcacacttgcctgacatgaggccttaagggggctgcttaccttctgtgaccctcagtttcttcctctgtaaaaaggagaccatcacctccagtttggtatgtagaggttatgcaaggaaaatgtttagcactgcgcttagcacacagaagccaggggatatttcataaatgaggtgtcattcgagtctgacctttagtgtggtttgagttttccaggcagggaagggtagatgaagattccatcca

SEQ ID NO: 199863 - DNA, 601 bp, Human
cccacggaggctagtgggggagaaagatgcaggatggtggtttaggggatactggggaggagactctcagaaaagaaaacaattaggcaggcaccccaaaggagttcgctcctgcaggatttcatcgttgttagtgctgctgctgcctgaattgcaggctgttgtatcataccagctagctatgctgcatacaaactgcccccaaattgaatggcttttcacaaccattacatctgacaaatttctgggtcagggatccaggaagggtttggcggggtgattcttccgtcccacatgacawtgagtgaggtcacttagtggcatttacctggtggctaagctggtcttcagagttcaagacagcttcattctcatgcctggcaccttggtagggacagctggaaggctggattcagtcaagtccttcttcctctccatgttgactcagggcctctccatgtggttcttccagcagatggtctgactttttatgtggtggcttaggctgaaagagagcgctgccagttgtcttaaatgctagcccacagctggcatagcatcatttattctgttggtaaaagcagtcatatgccagctcagg

SEQ ID NO: 199864 - DNA, 601 bp, Human
taactgaagagaactataaacatgaagtcttgagttagtccaaaaaaggaatttgtcccaggtcctcagaatcactgtctaggaagcaacccaaaggccgcggagtgggtaggatcccccaagagaccagatgtcatggtgttgtccagctggtccctctcaccctgcagggggctggggaggaagaggctgctgctgcagggtggataccccagaactcagtcaggcctcatgcctcacgcagcacccatctaagtaaggctgtttggggcaatctgttgtttccctaggagttttctgkttgcttttggatacatggttatatgagaaaattgtgtatgtctgttacgagggttcagggagctgctctttggagctgcaggaccagcagacacaaaaaccagaaagcacactgttccttcggcttccagccaagcaaagcttggcttgagtcacctcctctagggtttctatgtttcttctgctacagatagaacagttaacagagccgcttgcccctcaaatggtgaagcaagcactggaaggttccagaaaaaatgcagaaaaacattgactccattggcttggaagtgagtgtggg

SEQ ID NO: 199865 - DNA, 601 bp, Human
tcttgagttagtccaaaaaaggaatttgtcccaggtcctcagaatcactgtctaggaagcaacccaaaggccgcggagtgggtaggatcccccaagagaccagatgtcatggtgttgtccagctggtccctctcaccctgcagggggctggggaggaagaggctgctgctgcagggtggataccccagaactcagtcaggcctcatgcctcacgcagcacccatctaagtaaggctgtttggggcaatctgttgtttccctaggagttttctggttgcttttggatacatggttatatgaraaaattgtgtatgtctgttacgagggttcagggagctgctctttggagctgcaggaccagcagacacaaaaaccagaaagcacactgttccttcggcttccagccaagcaaagcttggcttgagtcacctcctctagggtttctatgtttcttctgctacagatagaacagttaacagagccgcttgcccctcaaatggtgaagcaagcactggaaggttccagaaaaaatgcagaaaaacattgactccattggcttggaagtgagtgtggggctgctgggcatccagcttagcccatc

SEQ ID NO: 199866 - DNA, 601 bp, Human
atttgtacttgttagatcatcaaattcagagtcactatctttagtttagtgtttatctttagtctttagtttttatattttatctttagccattatctttagttgaagtcattatctttacttaaggggatgacaaaaaccttgctaaatttagtttttcacttcctcattcctgattgacattctattagaaaatgttagctaggaagacctgttctttatttattgacttgcatttattgagaactgttgggaataatattgtgcctctagggcatttagaagataacatgcttttttytggttcttgcaaattactttcggtgacttgttctcatgggttgcttattttgagtttttatttttagagaactgatattttttctgttcttgatgaggtaatcaggcagtctctatgttacatgagttaagagtcctagacttacttagcaagtcctcaattctgacacttattataagacatctgatccagagctgcatgttcaactccatcaagccttgcctactttcctcatcggtaaaattgaccttaaaatcccacagttcaaaagactataaaagttaaataagtgaacataac

SEQ ID NO: 199867 - DNA, 601 bp, Human
cgtgccactgcactccagcctggcaacagagcgagactccatcccccacccccccaaaaaagaaacaatattagtttgacagagccaccactagactatagggtacctttgtgcaaactataatagtaaatagcaccgcttcctaaagactctttacttccatctgtcagaaaaaattcagaaaactctgattttatgagaacaagacactctactgccatctgttggaaaacagttataataaacttatacacatacatgatatctgtgatgtgagtggtatcccccagccccttaaatrcagtgtagcacctgcactactgtacctacaactccctagccatgagagtgcattatgttttaagaaatggtcttcagactctaaaaaaaggaagacatacatcagtggtagctctgatctcccatccaagagattacgcataggctgtgttaggaacaggactggagaccctgcagtgttagagtggggcatagagcttgcaaggctgtttcagccaggggtgggtgggggtgattttcaggcctaatgctgacaccactccactgagagaaagaagcttgcttccgggtgcctgcaaga

SEQ ID NO: 199868 - DNA, 601 bp, Human
ttttcttaattatccagaaaattctggccaagcaccttttcttgcagaggggagaaggtgaagaggtttcaggagagaaaagtatatgtgtgggggcgtcagaacatggcattctgatgaatgtggtcttatgctgggaagaaacctccagggctgaaatcaccaggaactcaatatctgtttacaaaactggccttgaggattgaagctcagaacacaagactcttgccagttgttctaagaaagcttctgctctttcccagtcattcaaactgcaccaccttatcgacttcccctcacrgtgaatgctcaggatctccttggcaacgtgggtgaagatacctgctggctctcttgacagttctcgtctttggcttggccaataaaccccctttagggaagtagaaagatggtggcaacagacagctcctcagctccacctgccttcccttcttcaggggagcttatgaccatcagggtggctgtgatgcttccctggatgtttggctcacagtgaagaagcatgaggacaaatacacagacaacaaaaacatttgatgtgcccatgacagctgggtttgcttcacgatttgtgtaggac

SEQ ID NO: 199869 - DNA, 601 bp, Human
tgtgtgggggcgtcagaacatggcattctgatgaatgtggtcttatgctgggaagaaacctccagggctgaaatcaccaggaactcaatatctgtttacaaaactggccttgaggattgaagctcagaacacaagactcttgccagttgttctaagaaagcttctgctctttcccagtcattcaaactgcaccaccttatcgacttcccctcacggtgaatgctcaggatctccttggcaacgtgggtgaagatacctgctggctctcttgacagttctcgtctttggcttggccaataawccccctttagggaagtagaaagatggtggcaacagacagctcctcagctccacctgccttcccttcttcaggggagcttatgaccatcagggtggctgtgatgcttccctggatgtttggctcacagtgaagaagcatgaggacaaatacacagacaacaaaaacatttgatgtgcccatgacagctgggtttgcttcacgatttgtgtaggacacgtcttatatgtgcatgcactgttggcagcagactgcagagagtcttaagggttttccaatatgacttgggaattgcaagctgat

SEQ ID NO: 199870 - DNA, 601 bp, Human
tataaccaattctctgcaattgatgtagaattttgtgccttcatctgtgttcgtagaacagtatcaacaggagccattatttcctgaatacagggtgatgtctttaatctggtttttaatctgcttttttatttgcctttcccacaccatgcatgcagaggccactgtggactcccagcagaagccagaactagcagctgagatgacacagctgagacatcaggccatctctattgataaggcccatctgaccaagccacactatgaaagtcagaggcatcatgtgagagaaataaggaarttggagcttcccagaaaaaaacccttcgctttctctcagtagcccaggtgttagacaccggctcttgctacaacaagataaaatacaacgggtttctctttttggtgaacatgacagaaagagaataaccagcagaaatcaagttgaccagtagtctctctttcttatttatttgttttgagacagggtctcgcccagtcacccagactggagtgcagtggcgtgatcacagctcactgcagtttcaacctccctggctcaagtgatcctctcacctcagcttctcaagtagctgggact

SEQ ID NO: 199871 - DNA, 601 bp, Human
gggagaactgaacttcaaaaaagtgtaaggggctgagagcagtggctcacgtctgtaatcccaacactttgggaggctgaggagggtggatcatttgagcccaggagttcaagatcaccctcggcaacatagggagaccctcggctgtacaaaaaatacaaaaatttgcaaggtgtggtggctcacatctgtaatcccaacactttgggaggccaaggagggtgggtggcttgatccttggagtttgagacctccctgggtaacatggcaaaaccccatctcaacaaaaaaatacaaaaawttatttgggcatggtggtacatgcctgtagtcccagctacttgggaggctgaggtgggaggatggcctgagcctgggagtttgaggctgcagtgagctgtgatcataccactgcactccagcttgagacagagcaagatcctgtctcaaaaaaaaaaaaaaaaaaagtataagcgtcgtgctgtacggtgacacatcttgtgagagttggcatcaggactcaagcccaggagacacagttctcttaccccaaatctaacactctttccactactcctcactgtctatgtgacacccaatt

SEQ ID NO: 199872 - DNA, 601 bp, Human
ctacatttatctttggtcaaggagattcttaggttattgttgcttagcaaaaggtctctctgaaaacctgagcaagagaaagtcagtcttcaagagtaccaataccctaaaatgactcatggatttaaaacaacacactctccactgccacccccgccacaaccaccatagcccagatgaatgccaacaattaagaaaagaaacggccaggattccttggaccagcaaaggcacgtttctagagcaggacgagagctgaagtgagatgctgggagaggaactagccttggaaagggtggcstgctcccacgaaagcaaccctttgttcgggacaggagctttgagcctggtagctctcatcccacttctccaggccctgcatagtacagaggccatgatctcagaataaaaaccactttcaaaaactaccatcacataagtaattcttaacttttcgaaaaggtgattttctataggctaaatggttattttccctctcttaacagaactgtttataactaggggagaagagaggaagagtctgtttcttatctaatttcaccaattccaatgaagtgaagagtatagcatcctctcagag

SEQ ID NO: 199873 - DNA, 601 bp, Human
tgtaatcccagcactttgggaggccaaggctggcagatctcttgaggtcaggagttcaaaacaagcctggccaacatagtgaaaccccatctctactaaaaatacaaaaaaattagctgggcatggtggcgggcgcctataatcccagctactcaggaggctgaggcaggagaatcgcttgaacccgggaggcggaagttgcagtgagccaagattgcgctactgcagcctgggcgacagagcaggacttcgtctcaaaaaagattatacagaaaagtgacttgcaataaaggaactgtasacatgtagtcaatcaatgaaattgcaaacagtgcagtcgctccagatgttagtgaactggagaattatagtctgtactcttgccagcaagaagaaggcagaaacgtgagcaagctagaggaggagggaaattgcaagggaaagacaaacgtaaattgatactattatcaaatgttgcaccatgtgcaaagtttgctacatttatctttggtcaaggagattcttaggttattgttgcttagcaaaaggtctctctgaaaacctgagcaagagaaagtcagtcttcaagagtaccaatacc

SEQ ID NO: 199874 - DNA, 601 bp, Human
gtttattttcatataaaaacattttaaaaatagattatatggccaggcacagtggctcacacctgtaatcccagcactttgggaggccaaggctggcagatctcttgaggtcaggagttcaaaacaagcctggccaacatagtgaaaccccatctctactaaaaatacaaaaaaattagctgggcatggtggcgggcgcctataatcccagctactcaggaggctgaggcaggagaatcgcttgaacccgggaggcggaagttgcagtgagccaagattgcgctactgcagcctgggcgayagagcaggacttcgtctcaaaaaagattatacagaaaagtgacttgcaataaaggaactgtacacatgtagtcaatcaatgaaattgcaaacagtgcagtcgctccagatgttagtgaactggagaattatagtctgtactcttgccagcaagaagaaggcagaaacgtgagcaagctagaggaggagggaaattgcaagggaaagacaaacgtaaattgatactattatcaaatgttgcaccatgtgcaaagtttgctacatttatctttggtcaaggagattcttaggttattgttgc

SEQ ID NO: 199875 - DNA, 601 bp, Human
agagccaaggatgcatgccgttttggctgagaaattgatgatcatgccaaccagaaaggtggtgttcatttctttggtggccacatggggaaatgatggtcgatgggcaccagtgagtaactgattctggattgggcacagcccctggaaaggaggaggccagctggaggagggacaggggaaagtcagtggggtgctgtctcagtgcctgtgtattacatccccctctatctgcctctaccggccccatcttccctccataaaaaccagctcctaggaaaggaactaatcagcttgttcrcataaggtaaaaatgactgaaaaataattaatgtgctgtccttccaaaaagcatctatattttgaggcataaaatctcctgccagcaatgcaaaaccaagtgggctggatgctccaaggttgcctccggtgctgacatcctgcggtttctgttctgttgtgagaacatacgacatggggagtgtcacatgcagtataaactgggaaactcttacaaatggcactatagttctattgtttaaattatataggaaagcgaggccacatgaggtggttcacgcctgtaaccccagcactttgg

SEQ ID NO: 199876 - DNA, 601 bp, Human
tttggtctgttggctgtagcaaccagagtgactctgttcctgggccctgccaaacaacctgtgaatgatgactgttcttggggaaaacgggaacaatagtctggtaaccaggaagtggggtaccgtgctgtaagctcactttcctgggagatgtactgtttcccagagccaaggatgcatgccgttttggctgagaaattgatgatcatgccaaccagaaaggtggtgttcatttctttggtggccacatggggaaatgatggtcgatgggcaccagtgagtaactgattctggattgggyacagcccctggaaaggaggaggccagctggaggagggacaggggaaagtcagtggggtgctgtctcagtgcctgtgtattacatccccctctatctgcctctaccggccccatcttccctccataaaaaccagctcctaggaaaggaactaatcagcttgttcgcataaggtaaaaatgactgaaaaataattaatgtgctgtccttccaaaaagcatctatattttgaggcataaaatctcctgccagcaatgcaaaaccaagtgggctggatgctccaaggttgcctccggtgctgac

SEQ ID NO: 199877 - DNA, 601 bp, Human
taggtctcgctctgtcatccagactggagtgcagtggcatgaacatggttcactgcagccttgacccaccaggctcaagagatcctcctgcctcagcttcccagagctgggacttcaggcatgtgccactgtgcctggctgagagagagagagagagagagagagagagtgtgtgtgtgtgtgtgtgtgtgtgtgtgtgtgtgtgtagagacaaggtttctctatgttgtccaggctagtctcgaactcctgggcacaaatgatcctccttcctcagcctcccaaagtgctgggatcaggygtgagccaccgcgcccagcatttttccttcctttttaaagctgaataatactccactgtgggatagaacacattttgtttatccattcgtctgtcaatgctgggagataattttgcccagagatttctgtgggctgaagggctagaccatttctgagacatcttggcagcccagagaccacagcgctctggcttggtttcctggaagggaattcctgccctgggcttgactagatggagccgcagtcatgtcctcttggacttctgcagcggaagccattgggattttattgccagcaca

SEQ ID NO: 199878 - DNA, 601 bp, Human
ctgtcgcccaggctggagtgcagtggtgtgatctcggctcactacaagctccgcctcccgggttcatgccattctcatgtctcagcctcctgagtagctgggactacaggcgcctgccaccacgcccggctaatttttgtatttttagtagagacggggtttcaccgtgttagccaggatggtctcgatctcctgacctcgtgatccgctcgccttggcctcccaaagtggtgggattacaggcgtgagccaccgcgccccgctgcctttttttctttttcctttcttctttcttctttcttttttttttttttttttttttttgagactaggtctcgctctgtcatccagactggagtgcagtggcatgaacatggttcactgcagccttgacccaccaggctcaagagatcctcctgcctcagcttcccagagctgggacttcaggcatgtgccactgtgcctggctgagagagagagagagagagagagagagagtgtgtgtgtgtgtgtgtgtgtgtgtgtgtgtgtgtgtagagacaaggtttctctatgttgtccaggctagtctcgaactcctgggcacaaatgatcctccttc

SEQ ID NO: 199879 - DNA, 601 bp, Human
agtctcgctctgtcgcccaggctggagtgcagtggtgtgatctcggctcactacaagctccgcctcccgggttcatgccattctcatgtctcagcctcctgagtagctgggactacaggcgcctgccaccacgcccggctaatttttgtatttttagtagagacggggtttcaccgtgttagccaggatggtctcgatctcctgacctcgtgatccgctcgccttggcctcccaaagtggtgggattacaggcgtgagccaccgcgccccgctgcctttttttctttttcctttcttcttwcttctttcttttttttttttttttttttttttgagactaggtctcgctctgtcatccagactggagtgcagtggcatgaacatggttcactgcagccttgacccaccaggctcaagagatcctcctgcctcagcttcccagagctgggacttcaggcatgtgccactgtgcctggctgagagagagagagagagagagagagagagtgtgtgtgtgtgtgtgtgtgtgtgtgtgtgtgtgtgtagagacaaggtttctctatgttgtccaggctagtctcgaactcctgggcacaaatga

SEQ ID NO: 199880 - DNA, 601 bp, Human
tgtagcatgtcctttttttttttttcttttaagatggagtctcgctctgtcgcccaggctggagtgcagtggtgtgatctcggctcactacaagctccgcctcccgggttcatgccattctcatgtctcagcctcctgagtagctgggactacaggcgcctgccaccacgcccggctaatttttgtatttttagtagagacggggtttcaccgtgttagccaggatggtctcgatctcctgacctcgtgatccgctcgccttggcctcccaaagtggtgggattacaggcgtgagccaccrcgccccgctgcctttttttctttttcctttcttctttcttctttcttttttttttttttttttttttttgagactaggtctcgctctgtcatccagactggagtgcagtggcatgaacatggttcactgcagccttgacccaccaggctcaagagatcctcctgcctcagcttcccagagctgggacttcaggcatgtgccactgtgcctggctgagagagagagagagagagagagagagagtgtgtgtgtgtgtgtgtgtgtgtgtgtgtgtgtgtgtagagacaaggtttctctatg

SEQ ID NO: 199881 - DNA, 601 bp, Human
cttaacgatgttcagtgcacagttcagtggcattaagcacgtcatattgctgtgcggccggccgtcaccaccgcccatctccagaacttctccatcacccctaactgaaactctgtagccattaaagaataactccccattccccttttccccagcagccacgctgctactttctgtctgtatgaacctgactgctctacatacatcctagaagtggaatgagacagtgtttcttcttttgcgactggtttgtttcactttgcaaatgtcttcaaggtgcatccatgctgtagcatgtcctttttttttttttcttttaagatggagtctcgctctgtcgcccaggctggagtgcagtggtgtgatctcggctcactacaagctccgcctcccgggttcatgccattctcatgtctcagcctcctgagtagctgggactacaggcgcctgccaccacgcccggctaatttttgtatttttagtagagacggggtttcaccgtgttagccaggatggtctcgatctcctgacctcgtgatccgctcgccttggcctcccaaagtggtgggattacaggcgtgagccaccgcgccccgctgcc

SEQ ID NO: 199882 - DNA, 601 bp, Human
cagacatgcatctagaagaggattctagaaactacatattttttattgttgcaaaatatacataacacaaaatttaccaccttaacgatgttcagtgcacagttcagtggcattaagcacgtcatattgctgtgcggccggccgtcaccaccgcccatctccagaacttctccatcacccctaactgaaactctgtagccattaaagaataactccccattccccttttccccagcagccacgctgctactttctgtctgtatgaacctgactgctctacatacatcctagaagtggaatsagacagtgtttcttcttttgcgactggtttgtttcactttgcaaatgtcttcaaggtgcatccatgctgtagcatgtcctttttttttttttcttttaagatggagtctcgctctgtcgcccaggctggagtgcagtggtgtgatctcggctcactacaagctccgcctcccgggttcatgccattctcatgtctcagcctcctgagtagctgggactacaggcgcctgccaccacgcccggctaatttttgtatttttagtagagacggggtttcaccgtgttagccaggatggtctcg

SEQ ID NO: 199883 - DNA, 601 bp, Human
gggatcctgcacaccaacctggctgggcgaaacgaagactgctccacacagcagcagcacacagcagagccctctcttcattgcatccatgattgcttcacagcgtcccttaaattctggaaggagagaaaaaacagcttgatcacggggtgcgagaggtccatgatggcaacagaggaggataagccgcaatgttgtcctgtctggcttcctccagtgccagccccgcggcagaaacgccagacatgcatctagaagaggattctagaaactacatattttttattgttgcaaaatatayataacacaaaatttaccaccttaacgatgttcagtgcacagttcagtggcattaagcacgtcatattgctgtgcggccggccgtcaccaccgcccatctccagaacttctccatcacccctaactgaaactctgtagccattaaagaataactccccattccccttttccccagcagccacgctgctactttctgtctgtatgaacctgactgctctacatacatcctagaagtggaatgagacagtgtttcttcttttgcgactggtttgtttcactttgcaaatgtcttcaaggtgca

SEQ ID NO: 199884 - DNA, 601 bp, Human
aagtgaaagtccatctcctgccttctagtccaattcttcctctccttcctgactggctctgtccagaagagctttctgcttggtggaaatgttttctgtctgtgctgtccacgacagaagccacacagggccaccgagtgctttgaatgtggccagtgggactgagaaacaatttttaactttaattattttaaatttaaacagttgcacaaggtaagtggccaccatattgggcaatggagttgcagctggctgtctactccacgcagtcacctggctctccccgctgtagggtcctgtkggagaggtgtggttagtttggacttccgtgaggccctttattgctaggcattttcagagagtgtgtgtagcgcttccatctcagctagagagtaggcaccatgagggcagtttgcctctgctgtggctcatggcacttgcattgcctttttctttttttttttttttttttgagacaggatctcagtttgtcacccaggctggagtgcattggcgtaatcatatctcactgaagtcccaacctcctgaacttaagcgatcctcccgcctcagcctcctgagtagctgggaccacaggtgc

SEQ ID NO: 199885 - DNA, 601 bp, Human
cctgccggccagatacctctgctcagagaccccctcgggtaactggcccaagtgaaagtccatctcctgccttctagtccaattcttcctctccttcctgactggctctgtccagaagagctttctgcttggtggaaatgttttctgtctgtgctgtccacgacagaagccacacagggccaccgagtgctttgaatgtggccagtgggactgagaaacaatttttaactttaattattttaaatttaaacagttgcacaaggtaagtggccaccatattgggcaatggagttgcagctgrctgtctactccacgcagtcacctggctctccccgctgtagggtcctgttggagaggtgtggttagtttggacttccgtgaggccctttattgctaggcattttcagagagtgtgtgtagcgcttccatctcagctagagagtaggcaccatgagggcagtttgcctctgctgtggctcatggcacttgcattgcctttttctttttttttttttttttttgagacaggatctcagtttgtcacccaggctggagtgcattggcgtaatcatatctcactgaagtcccaacctcctgaact

SEQ ID NO: 199886 - DNA, 601 bp, Human
ctgtttctgctcccctcagaatcagaacccgcccagtggccgcagctgatgggagaatggtgccgacacaggcatctctgtagaatcatgctgcaatggcactgtcacaccgtaggcaggtggtgggtggaagaaggcaggtggtgggtgggtgatgcaccctgcaccccgccctgcctccctccctgatgaccccatgcacccctcagcttcacccgaccttggtaagatctggctcctcttctgaatcgggcatggatttcctgcgaagaaaccagaggtggaggaaggatcagcacawgccaggtgtactaagagtaaaggcggccaacccagaagcccatgtgaacctgccggccagatacctctgctcagagaccccctcgggtaactggcccaagtgaaagtccatctcctgccttctagtccaattcttcctctccttcctgactggctctgtccagaagagctttctgcttggtggaaatgttttctgtctgtgctgtccacgacagaagccacacagggccaccgagtgctttgaatgtggccagtgggactgagaaacaatttttaactttaattattttaaatttaaaca

SEQ ID NO: 199887 - DNA, 601 bp, Human
ctgccggtgcactgtggtgggatcacagcctaggatgagacccagagcatgggcctggcctcggctgtgactgccctggccgtgctgctggcggctgtgtgaccctgggcaagccacttgctctctcctgggctctgccttttgatctgtataaccaggaccttgggccagtggccgccccccccagcccccgctaggttgtgatccctgacagcctggctccttgggggggaacacctgtttctgctcccctcagaatcagaacccgcccagtggccgcagctgatgggagaatggtgcygacacaggcatctctgtagaatcatgctgcaatggcactgtcacaccgtaggcaggtggtgggtggaagaaggcaggtggtgggtgggtgatgcaccctgcaccccgccctgcctccctccctgatgaccccatgcacccctcagcttcacccgaccttggtaagatctggctcctcttctgaatcgggcatggatttcctgcgaagaaaccagaggtggaggaaggatcagcacatgccaggtgtactaagagtaaaggcggccaacccagaagcccatgtgaacctgccggccagata

SEQ ID NO: 199888 - DNA, 601 bp, Human
agtgaagtggcacaatctcggctcactgcaacctccacctcctgggttcaagtgattctcctgcctcagcctcccgagtagctgggattacaggtgcccgataccatgcccggctaatttttgtatttttggtagagacggggtttcaccatattggacaggctggtctcgaactcctgatctcaagtgatccacccacctcggtctcccaaagtgctggggttacaggcatgagccaccgtgcccagcctaattttttcttttcttttctttttctttttttttttcgagggtctctgtyacccaggctggagtccaatggtgctgtcttggctcactgcaacctctgcctcccaggctcaagcagtcctcctgcgtcaacctcccaagtagctgggactacaggtgcacaccaccacacccagctaatttttaaatttttttgtagaggcggggtggggtgggggaggcagaggtgtctcactatgttgcccatgctggtcttgaactcctgggctaaagccatcctcctggatccgcctcctaaagtgctggagttacagatgtgagccattgcacctggactttttctcattgtaat

SEQ ID NO: 199889 - DNA, 601 bp, Human
tttacagatgaggaaactgaggcaagcgggcatttgcccaaggtcacttggtcttgctcccttttctgcttgtaccttcacctccgcctaaggccgaacaggcctggaggctccttttgaagatttgaactttccggggaccatgaaagacagggttcatgactggacccctgaactcgaagtctcagtttgaagtcgatttgtactgggcttttctgtgtttttgtttttgtttgtgttgttttgttttgttttagaggtgagggcttgccctgtcactgaggttgaaatgcagtggcayaatcgtagattactgcagcctccaactcctgggctcaagtgatccttctgcctcaacctcccaagtagttgggactacataccaggtctggctaatttttttattttttgtagagacaggggacttgctatgtttgcccagattggtcttgaactcccgggctccagcgaccctcccaccttggcctcctaaagtgctgggatcacaggcatgcaccacctcccagcctcagtacatacttttgacaggcactgagtggcactgtgccctgccactgttgcaccagcaatattccacccg

SEQ ID NO: 199890 - DNA, 601 bp, Human
acaatccacacacactcaagtcctgcagcgtggaacacgcgtataccagttctgcatcctacaaatactgttttcatcctgcctttggttgaaaaaaatccatacataagtggaccctgcaggtcagacaagtgttgttcaagggtcccctgtattttcaaagcagctccaaggatgatgtgagttaaaatattaagaatgtgctctatgtgccaggcgctgttgtacagtctacaaaaattagctaatttaatcctcacagcaaaccatgaagtgtgtactgttattcccacctctttayagatgaggaaactgaggcaagcgggcatttgcccaaggtcacttggtcttgctcccttttctgcttgtaccttcacctccgcctaaggccgaacaggcctggaggctccttttgaagatttgaactttccggggaccatgaaagacagggttcatgactggacccctgaactcgaagtctcagtttgaagtcgatttgtactgggcttttctgtgtttttgtttttgtttgtgttgttttgttttgttttagaggtgagggcttgccctgtcactgaggttgaaatgcagtggcataatc

SEQ ID NO: 199891 - DNA, 601 bp, Human
tccttccgggggcgggggagactggagaggtgggatttcagctcgtttcacgtgctctcacctactcacctatttcacagcacttcccagcaaatccttcggggcactggcacacgaaatctgagaagtacagggcctgctggcaggtgcccccgttgaaacaccttggctcgctgcaacctgtcaagtataaaaaaggaagcccctaatgacagcctccttctgtgtgctcaggccatggttccaggagccctgtctaccacaatccacacacactcaagtcctgcagcgtggaacacgygtataccagttctgcatcctacaaatactgttttcatcctgcctttggttgaaaaaaatccatacataagtggaccctgcaggtcagacaagtgttgttcaagggtcccctgtattttcaaagcagctccaaggatgatgtgagttaaaatattaagaatgtgctctatgtgccaggcgctgttgtacagtctacaaaaattagctaatttaatcctcacagcaaaccatgaagtgtgtactgttattcccacctctttacagatgaggaaactgaggcaagcgggcatttgcccaaggt

SEQ ID NO: 199892 - DNA, 601 bp, Human
tctatctgtcatccatctaccgtctatttatcatctatctatcatgtatgtatcatctatttatctaatctatcacctatcatctatcatctatcaatctatcatctatcacctatcatctattatctgtctatcatctatccatctatccatcctgtattggttatgtttcttgggagaaccctgacggatctgacagaatctttccccagctgtagcagcttctcacagggggaatccctccttggggatgtgccctcacctgcagtagttgtggttccccaggcccagcctgatggcrtctggcctccgcccgctgtagggcttctgggccaacgcgctgctgttccagttggtgcactcggcgccactctccgctgtgctccacgtgcccctgtagctgatgccctggtcctcgtagcacgtggccctggtatctgacagagagcagggcatggatgcctcacatgggagtcccctttcattcagccctcaggaggctcccctctctgccccgtcctcccccaggcctgatgcaggctggctcggaagccacaggctgggtggcaagggtgccagcctggattcagggtcacaccta

SEQ ID NO: 199893 - DNA, 601 bp, Human
taccatctatcatctatgtatctatcatctatttatctatcaatcatctatcaatctatcatctatctatcacctatcatctgtctatctgtcatccatctaccgtctatttatcatctatctatcatgtatgtatcatctatttatctaatctatcacctatcatctatcatctatcaatctatcatctatcacctatcatctattatctgtctatcatctatccatctatccatcctgtattggttatgtttcttgggagaaccctgacggatctgacagaatctttccccagctgtarcagcttctcacagggggaatccctccttggggatgtgccctcacctgcagtagttgtggttccccaggcccagcctgatggcatctggcctccgcccgctgtagggcttctgggccaacgcgctgctgttccagttggtgcactcggcgccactctccgctgtgctccacgtgcccctgtagctgatgccctggtcctcgtagcacgtggccctggtatctgacagagagcagggcatggatgcctcacatgggagtcccctttcattcagccctcaggaggctcccctctctgccccgt

SEQ ID NO: 199894 - DNA, 601 bp, Human
tgccaaattgacaaggtgtggactggaatagtcttatatgtcaacttggccaggctgtggcacccagtcagttaaccaaacattcatctaggagttgtgaaagtgttttatagatgtggttaatatctacagccagttgactttagaaaaggaaattgtcctagataatgtagttgggcctcgtccaatcacttaaaggccttaagagcaaatatgaggtttcctgaataagaaattctgccttaagagagcagcctcagcttctgcctgcacttccagcctggcttaccaagatgtttcrgacttgccagcccccacgatcctgtcagccagttccttaacataaatgtctatctatctagtgtgaaaggaaaataaatctcaggaccccaacgtcatgagccaagggaaatgtcaagccgggaactacgtcaggcaaacctgcctctcatttattcctcaataagatagctgcaaagttttttttttttttttttaattctctacaaggacattccttgcaggcctaaagatctttaccctaaaacagttctgttgactttcaccttggcattgtaaatggatagcttatcttcccagg

SEQ ID NO: 199895 - DNA, 601 bp, Human
gcgtccccgggaggggaggaacacgcaggaggggcaggggctggaggaggaggcccgtgtgtgtaaacataggtgagtgcatgtgggtgtgttgtgtgatctgtatgaactggagccgggaatgacgagctcttaccaatgtcattgtcgtaagtgtcatcatcgaattccttatggacaatgtatttttcgacttcaaatttctgctcctcctcgccagggaccacccggtatgttctgcccaagatcaccgtcaggtggtggggcggaaacctggtggagaaacagccttagaatgctwtttttgctgtgggatttcccctaaagggcttggtttctaggcgttagagggtggaaaaaccaactgggtttccgagcccctacctctcctggaagcagtgggcggcagagagaatccagcaggagctgatgagtatgcccccgcacaggaaccgctctccgggcgacctcctgtgcttggcaaagatggcagcctgccaggggtgggaggcgatgtcggcgaagagccctcctttgatgcgaaactgaggctggctgtactgtctcaggccgcaggtggctggggaggaaaggacgagga

SEQ ID NO: 199896 - DNA, 601 bp, Human
atctagaatccccaggggtatcactaagaggaaatcactccactctggtgataacttttttctttggtgaagaacctgttgtcccaggggcattctcccctgggttgtgcccagcatgggcgcgccactcctggttacctggcaggcgtcgtgcaagtttgcctggggcccgccgctccgagtgtctccagcacacagcatgttgtcggtgactgttctgttaagtaaatgttgtgatgtgcagcggctggatgggtacagtctgacatgagcctccttcagccgctccgaatagaaaggrgacactgaaaggggagaaccatcatatggttttagggaaagttatttataaacgtttttgaaagagaaagccaaattttccaataatagctaacattgatcaagattcaacatgtattaggtcgaatcctatgacactgctggtattttatcgttttgacccacaaaaacagcaggattccgggattgaacccacagcctctccgtagtggcactgctgatgcttcggaccagggaggtccctgttgtgggggatggggacagtcccgagccctgcagtgtgcagcatccctggctgcac

SEQ ID NO: 199897 - DNA, 601 bp, Human
ctgaggaagatcaattccttggctctgtgcaggtcttaataccagcaggctggcctgtcctcccataccccagtatctggctaatcatgaaatataagtactaattctgataaggatgcccacacaaaggacctcaaatagtgtgctttcccagggtattagggctgaatgtgagttttgaaaacttctttctcacatcatctagatcctgcttcccagtaagttgcctttcttccttctccttctacaaagcagactccaattctctagtgccaacagaggcaaacatttctttcttttytttttttttttttttttgagatcgagtttcgctcttgttgcccaggctgaagcgcaatggcgcgatctcggctcactgcaacctctgcctcccgggttcaagcgattctcctgcctcagcctcctgagtagctgggattacaggcatgtgccaccatgccaggctaattttgtatttttagtagagatggggtttctccatgttggtcaggctggtctcgaactcctgacctcaggtgagcctcccacctcagcctcccaaagtgctgggattacaggcgtgaaccaccacaccaggctg

SEQ ID NO: 199898 - DNA, 601 bp, Human
atgtctgaggaagatcaattccttggctctgtgcaggtcttaataccagcaggctggcctgtcctcccataccccagtatctggctaatcatgaaatataagtactaattctgataaggatgcccacacaaaggacctcaaatagtgtgctttcccagggtattagggctgaatgtgagttttgaaaacttctttctcacatcatctagatcctgcttcccagtaagttgcctttcttccttctccttctacaaagcagactccaattctctagtgccaacagaggcaaacatttctttcttttttttttttttttttttttgagatcgagtttcgctcttgttgcccaggctgaagcgcaatggcgcgatctcggctcactgcaacctctgcctcccgggttcaagcgattctcctgcctcagcctcctgagtagctgggattacaggcatgtgccaccatgccaggctaattttgtatttttagtagagatggggtttctccatgttggtcaggctggtctcgaactcctgacctcaggtgagcctcccacctcagcctcccaaagtgctgggattacaggcgtgaaccaccacaccag

SEQ ID NO: 199899 - DNA, 601 bp, Human
ggaactcctgggcacacggagtagctaggactacaggtttttgccaccacgtctggctagttttttatttttatttttttaatgtttagtatagacaggggtctccgtatgttgcccaggctggtctgaaactcctgacctcaagccatcctcctgcctatgtctctgtctctcaaagtgttaggattacaggtgtgagccacagcgcccagcttctctcttcgattaaaaataaaaacaaatttctgtctgttagttgaaggctcaatatttgcacgtcagtcgtttcttcccattcagkctacccgggaatattaaaaggaaaaataactataatttctgataaatttaaaagataaaatattttatgtataatagctatcgttcaaaatctctccaagatctgtgtgcatacttttcttattgttgtaactatattgaatttaactttttctttaactaccaaggactccagattcaccgtcaactttcttcctgcattcactcttactgttcagttctgggttaaaagacagcggggcctgaacgaagtgtctacaaagcacagtatttggagaagctttgttgttgttttttaaaa

SEQ ID NO: 199900 - DNA, 601 bp, Human
tgggtgatactccagcaaggtctatagtttagtgagtagcactataccagtgttaatttcctggtctgaacattgtacaatggttacataagatgttttaattgggagaaaccaggtgagagggatatgggaattctttgtgctatttctgaaacttctctgcaagtcccaaattagttcaaaattaaaagttaaaaaaagaaaataattctgcaagtttaattagttcactagaatcatttatgtccctgtgtatgtgtgtgtgtgagtgaagtatgtcctggaataacttctcagtgamataaaatacggaatgctgccatgtttgtatcaaagaagagacattttgactaatactctcactccattaagtcattctaataagcatagttgttgtttggtatttagactgcaatctaaagctccaaaactcaagtttatttgttaatagacatcataagctatacttttttcctctttggggatttagggaagaccctgttatttttttttaaatatatatatatatatatactgtaagttctggaatacatgtgcagaacatgcaggtttcttacataggtatacatgtgccatggtg

SEQ ID NO: 199901 - DNA, 601 bp, Human
gtggcaccattacaaactcacggtcttaaatatatatacacacccacagatacatacagaaatatagatgtgtgtgtataactacgttagtctatacacacatatttcccagctccgtccaccgagagcacctagaaacaacattccagtagcaataagcatgcctcacacccagattttggtttctaaacacctttctccaatagaaggaaccagagcttcctgaggaagtcattaattccaggcctggggcagggaaaacactagatgagtctggaatgttgttggcactagaaagttratgaagtgctcaaaaaagatggggttccttagagggacacaggagccaaactgaaggaactcttagtggccaaagctggaacagcatgagcaataaaactgataatgatagtattggattataaatgaaagaagaagacacatccatgagtccatactgatatacttaaccaattgaataaatacctaaaaaggcaaaaatgatgacccttccttgtaatagaattccaatgaataaatgtggaaaaaaagagtgaaataaaaaatcactactaggtatagtagtttttgcagtcaaaat

SEQ ID NO: 199902 - DNA, 601 bp, Human
atcctgaaaatatttatattagaatcaggcaaataagtctattgtagataatgacatctgggtttctcactgttagacaaagaggctgtaaatgaaagaggaaggctagaatgaaacttgattgttaggttgaaattagtggcaccattacaaactcacggtcttaaatatatatacacacccacagatacatacagaaatatagatgtgtgtgtataactacgttagtctatacacacatatttcccagctccgtccaccgagagcacctagaaacaacattccagtagcaataagcatrcctcacacccagattttggtttctaaacacctttctccaatagaaggaaccagagcttcctgaggaagtcattaattccaggcctggggcagggaaaacactagatgagtctggaatgttgttggcactagaaagttaatgaagtgctcaaaaaagatggggttccttagagggacacaggagccaaactgaaggaactcttagtggccaaagctggaacagcatgagcaataaaactgataatgatagtattggattataaatgaaagaagaagacacatccatgagtccatactgata

SEQ ID NO: 199903 - DNA, 601 bp, Human
tattataaagcttaagaccagaaaactgtacataaaggctataatttagtaagtacacgtttttctcataagagcatgagttagcaatcctgaaaatatttatattagaatcaggcaaataagtctattgtagataatgacatctgggtttctcactgttagacaaagaggctgtaaatgaaagaggaaggctagaatgaaacttgattgttaggttgaaattagtggcaccattacaaactcacggtcttaaatatatatacacacccacagatacatacagaaatatagatgtgtgtggataactacgttagtctatacacacatatttcccagctccgtccaccgagagcacctagaaacaacattccagtagcaataagcatgcctcacacccagattttggtttctaaacacctttctccaatagaaggaaccagagcttcctgaggaagtcattaattccaggcctggggcagggaaaacactagatgagtctggaatgttgttggcactagaaagttaatgaagtgctcaaaaaagatggggttccttagagggacacaggagccaaactgaaggaactcttagtggccaaagc

SEQ ID NO: 199904 - DNA, 601 bp, Human
tgcctgcctgggtgcagggtagtgagtatcctgtgatgagaggtgctcacacagcagacaggtcattacttggaagtgatgctgcagaggacaatcaagagagtggcagctgggtggggtgacttttaaggtcctgtcaactctgagtttctacatcaaaaggaattctgaaagataaagcagtatttaattttaatgtctctgactagcatactttctttctatagttcttttgttctcctttttttttttttttttttttttttttttttttttgagacagagtcttgctctgttgccygggctggagttgcagtggtgcgatcatagctcactgcagccccaaactcctgggctcaagtgatcctcctgcctcagcttcccaagcagctaggcattaccaagcctggctattttttgaaatttttttgtagagatggggtctctcctggctgctctcaaattcctggcctcaagtgacccttctgcctcaacctcccaaagctctgggattacaggcatgacccattgcccttggccttgttctccaattttatatgtaattgatagaccttggaattgattaaagtgatttaattca

SEQ ID NO: 199905 - DNA, 601 bp, Human
aagtataaacaaagcttccccacaagtctgtacaggactaagtatgccttttctctgtgttgtgggtagagctggcatttgcttgaacagtggatagtgattgaagtatccattttggtggtgcaaagtgtaatgcagcgattgctaccctcaaaaaacagacccaatttcgtatagataatatttatagtcaataaaaattgtcctttcagcaaagagtagccttagttgcatttaagaccatcatcacaagttctagataaaacactatgccatactttcattccctatgctgtaagargcaaacagaaacaaaatcacctccagagcaaaatgaaattgtactaatatgaaattctgagtttgaatgagggtctgtgtctcatagatgacaacaaagataagaaaggagggctccttttagacatcagaggcctgtgttcatcaggaacctgatgctgaatcattggagggtaaatgaaccttccaaggttcagtgtttagaatgttgtagaccagcagtctcatcatgatctataggaagtcagcccgagatattgcaaacaaactggaacatatactggaaatactgggagagaga

SEQ ID NO: 199906 - DNA, 601 bp, Human
tccctagagcagccaagatgggaggcagaggtctcagaagagtgagctcctctgctggataaatttaaatgtctttagtctttattaagtacccattgacagctctgccttatggtcaagttacggaaagcacaagagaagacctcgtccgggctctcaacattctcagtagaggctttcagctctcacccttctgcaaaagttttccttcattggacacagactcctaaacatgttggagaggaggaaccactgcatgtggctgagaaaacattcttttccaccatagatgccaagcccrtggatcctgcttggtattctataagtctttgagggtatggtagatgtgatgagttgaattgtgttgcccaaaagaaatatgttgacatcctaacttctagtacctcagaatgggatctcattcagaaataaggtctttaaagagatgagcaagttacaatgaggtcatcagggtgggccgaaatgcagtatgactggtgtcctcataaaaagggaaatctgaacacagacagacatgcagagtcttctggaagactatgtgaaggcaaacaggaagaatgccatgtgaagatcagggaga

SEQ ID NO: 199907 - DNA, 601 bp, Human
aaggtcaggagatggagaccaccctggctaacacggtgaaaccctgtctctactaaaaatataaaaaaaaaaatgagccgggcgtggtggcgggcgcctgtagtcctagctacttgggaggctgaggcaggagaatggtgagaacccggaaggcggaggttgcagtgagccgagattgtgccactgcactccagcctgggtgaaagagcgagactccatctcagaaaaaaaaaaaaaaaaagagtgggaacatgtggtatttggttttctgttcttgtgttagtttgctgaggataatggyctccagcttcatccatgtccctgcaaaaggacatgatcccattcctttttatggctgcatagtactccatggtgtatattaccacatttttaaaaagatctaaatttatattgaattataaatattttatataacatagatggcaacctacttatgactactgattgaattaatatggtttttactaaaagtatttaaggtatttattcatagaaaggcatttacttggatatcaaatttcttttctgattcaccttttatccttgagtaaggagaatgtgatgtgatatatacatatgc

SEQ ID NO: 199908 - DNA, 601 bp, Human
aggtgcggtggctcacgcctgtaatcccagcactttgggaggccaaggcgggcagatcacaaggtcaggagatggagaccaccctggctaacacggtgaaaccctgtctctactaaaaatataaaaaaaaaaatgagccgggcgtggtggcgggcgcctgtagtcctagctacttgggaggctgaggcaggagaatggtgagaacccggaaggcggaggttgcagtgagccgagattgtgccactgcactccagcctgggtgaaagagcgagactccatctcagaaaaaaaaaaaaaaaaagagtgggaacatgtggtatttggttttctgttcttgtgttagtttgctgaggataatggcctccagcttcatccatgtccctgcaaaaggacatgatcccattcctttttatggctgcatagtactccatggtgtatattaccacatttttaaaaagatctaaatttatattgaattataaatattttatataacatagatggcaacctacttatgactactgattgaattaatatggtttttactaaaagtatttaaggtatttattcatagaaaggcatttacttggatatcaaattt

SEQ ID NO: 199909 - DNA, 601 bp, Human
acacctccagaaacaacttggatactggaccaggcaagacagttcctttgatgttgttcatgaaagttaacagagtccttaaaggactgggttgactcaggaagtggtaaatagtacctatgtcagaagccacagcataatgtgtgccttttgattactgtggtttgagtgagtgttgcaaagagccgcagaccacagtggcttgttgaggctgccgatgatcttgaggtcagtgtcctacagtcacaaaacccctgactcctacccactagatgactaccactcagaaaaatcatccttkccatgggattttgctattattggatttttgtttgtttgttcatttttagtgttttaagaaagaaatgtatgtgaaaaggaatattaactacttggtaatttatatatggaatatgctgatagcaggacttagctttatttgtttgctaatatttaaatttaaaagacctgaatttattttattttttatattttattttattttattttaagtttcaggatacacgtgcagaatgtgcaggtttgttacataggtaaaccgtatgccacggtggtttgctgcacctatcaacccatcacc

SEQ ID NO: 199910 - DNA, 601 bp, Human
atggacattcattatctcacagctctaaggctggatgtctgatatcaaggagtcagcagggccacactccctcagatggttctagaaaactatgtttcattgcctctttcagctcctggtggccccaggtgttccttggctcatggcaacatcactccagtctctgctcaccttggccttcatgtggtttttctgagtcccatcctcttcttacaaggacaccagtccaccctaattctgggatgatttcatcatgaaatcttatatagtttggatatgtgtccttgcccaaatctcatgytgaagtactaaaaattcccaatgtaagaggtaggacctggtgggaggtgattggaccatgggggtggatttctcatgaatggaatgcccacaaagtgggcattagtggtttagcaccacccgcttggtgctgttctcctgatagtgagtgagttctcacaagatctggttgtttaaagtgtgtagcacctccccaccattgctctctcttgtttctgcccaggccatgtgacatgcttgctccccttccgccttctgccatgattgtaagtttcctgaggcctccccaaaagccaagcag

SEQ ID NO: 199911 - DNA, 601 bp, Human
gtcagcggtttgcgggttttttttttttttttttttttttttttttttgagacagggtctgactctatcacccaggctggagtgcagtggcatgatcatagctcactgcagcctcaaaatcctgggctcaagtggtcctccctcctcagtctcctgagtagctgggaacacagatgcatgccaccatgactggctaagttttaaaacattgttttgtagagacggggtctcattaatgttgcccaagctggtctcaaacttttgggctcaagtgatcctcctacctcaaccacccaaagtrttgggatgacaggcatgagccaccatgctcggccaccagttttcaatgcatatatcagtaagtacttcagtaagctgaaaagcaacagcaaggctatttggcaaagaataaataagattaatgggatgtaaaacagtgtaactctttcccctcatgacacacacttctgggtgcctcctttactcataaagaccacatgtccccatcatcagctttcccaaagttttatatttatgtatttaatttacacttgcacatgtgacattgtccttaggaaggttagaaggaataaagaaaaag

SEQ ID NO: 199912 - DNA, 601 bp, Human
cagtgcccggcacaaagaaagagctcaggaattattcgctcagtattgtcctccaaagttaccatcctcattttacagcttagtggatagaggcccagggaggttgaatgacttgcccatggtttttcagccatttggtggatgctcaggcccaagtgtgctggccaagacagggctctcgcctgggatacttacatttaggtaagtgggaaatgctcccaagtacagtgttgtgggaagaaaagattatatgaccaagatcaattttgcatattaaagattgtggcttctaaggaaagayataaaaaagtcaatgaggtaaactcaagtattattcttttaagcttttcctggtggaactgttcatagttatattcgtgtgacaaatagttactggtacctactatgggctagaagtagaatatatgataggcacgggggtacagttgaggacagaaatagacagaagggctgggcacagtggctcacgcctataatcctagcactctgggaggccgaggtggttggatcacctgaggtcaggagttcaagaccagcctggccaacatggtgaaaccccatctctattaaaattacaaaa

SEQ ID NO: 199913 - DNA, 601 bp, Human
catttggaaaatggaacagtactatctgcctcttaggcttgttgcaatgattaagattcttcacatagagctcctggaacagtgcccggcacaaagaaagagctcaggaattattcgctcagtattgtcctccaaagttaccatcctcattttacagcttagtggatagaggcccagggaggttgaatgacttgcccatggtttttcagccatttggtggatgctcaggcccaagtgtgctggccaagacagggctctcgcctgggatacttacatttaggtaagtgggaaatgctcccargtacagtgttgtgggaagaaaagattatatgaccaagatcaattttgcatattaaagattgtggcttctaaggaaagatataaaaaagtcaatgaggtaaactcaagtattattcttttaagcttttcctggtggaactgttcatagttatattcgtgtgacaaatagttactggtacctactatgggctagaagtagaatatatgataggcacgggggtacagttgaggacagaaatagacagaagggctgggcacagtggctcacgcctataatcctagcactctgggaggccgaggt

SEQ ID NO: 199914 - DNA, 601 bp, Human
ggagagggagatgcatgggaagcttggaactcaagtttcaaactagaagtgggacctgccgatgaagcagaactgcacaggtcccatcaggaagagagtggctgtgctgtgaaagtaaaattaacagatgaagatctagcaaggaatactcatgcttttatctattttgatgatgcaaaggagtgataaaaaatagaattagcccaggtgtgtgggctcacacctgtaatcccagcacttaagaaagccaaggcaggcagatcacttgaggtcaggagtttgagaccagcctggccaacakggtgaaacactgtctctactaaaaatacaaaaattagccagatacggtggcaggcacctgtaatcccagctacttgggaggctgaggcagaagaattgcttgaacccaggaggtggaggttgcagtgagccaagatcgcaccactgcattccagcctgggtggcagagtgagactctatctaaaaacaaaacaaaacaaaacaaaacaagagttagcacttttatttaaaggaaaagaaatagtacatttaaaaaagaaatacgatttgataactagtattctctttagtttaaaaaaaa

SEQ ID NO: 199915 - DNA, 601 bp, Human
aggaaacaaagcaatttttctcttctgaaataaactatactctggaatgttctgtcaataattaatgttcattgattcagtagacagtttgattaatgctttgtaattgtctaaatggtccttcacaaatgctatgccaattgttgaaatgttagcaaactctggtaatgatattaaaccaacagaatgaataatgtgacaataataacattaaaaaataatgttcttatgccattctattctttgagaagagaatatatttcattataaatgctgtgaactatgtatgcctcccctgcaygtctacattatgggtaaatcttatctatcaccatgactgtggtagctggcctccaataatcccttcctcttggcattcacaggttgtatcattctctcccacattgtgcctgggttggtctgtgtgtccaataaaatatgacaaaagccatgacaaaagacacttctgagattaggtgataaaaggcactgtggcttctgtcttgttttctttgtcttggatcatttgcatgggcaacaccagctgctttgttgtgagtggccctgtggaggcccatgtggcaaagtaactgaggcttcc

SEQ ID NO: 199916 - DNA, 601 bp, Human
tattttaatttagtttttttggttgctgtcataaggaaacaaagcaatttttctcttctgaaataaactatactctggaatgttctgtcaataattaatgttcattgattcagtagacagtttgattaatgctttgtaattgtctaaatggtccttcacaaatgctatgccaattgttgaaatgttagcaaactctggtaatgatattaaaccaacagaatgaataatgtgacaataataacattaaaaaataatgttcttatgccattctattctttgagaagagaatatatttcattawaaatgctgtgaactatgtatgcctcccctgcacgtctacattatgggtaaatcttatctatcaccatgactgtggtagctggcctccaataatcccttcctcttggcattcacaggttgtatcattctctcccacattgtgcctgggttggtctgtgtgtccaataaaatatgacaaaagccatgacaaaagacacttctgagattaggtgataaaaggcactgtggcttctgtcttgttttctttgtcttggatcatttgcatgggcaacaccagctgctttgttgtgagtggccctgt

SEQ ID NO: 199917 - DNA, 601 bp, Human
cccatgctggagtgcagtggcatgacctcagctcactgcaacctccacttcccaggttcaaatgattctcttgcctcagcctcccaaatagttgggattacaggcactcaccaccatgcctggctaatttttttgtatttatagtagagatggggttttgccatgttggccaggctggtctccaactcctgacctcaggtgatcctgccatcttggcctcccaaagtgctgggattacaggtatgagccaccgcgcccagccctatttgtttttttaatgtgagtaaagaaatgacagagytctcaagatgcctaaaacatacccaaaaaagttttgagaaataacttggagtaaaagaaatagacaggcaattttattttaatttagtttttttggttgctgtcataaggaaacaaagcaatttttctcttctgaaataaactatactctggaatgttctgtcaataattaatgttcattgattcagtagacagtttgattaatgctttgtaattgtctaaatggtccttcacaaatgctatgccaattgttgaaatgttagcaaactctggtaatgatattaaaccaacagaatgaata

SEQ ID NO: 199918 - DNA, 601 bp, Human
cagagctaaaatgctgtggcctacatttttagatggccttaacatatgaagagtggttagcatcttatacaaaataaaatagactgtgcattataatatcactggtggaagacattgtcaaaacatggctttatagaaatgaaaaggaaattgaacattttggtttgtggcaacatgagtttggagatagaaaacagaagttatcttagatagtatagtccaggcatatcgtctcaaggttcaatctgtacaaatctttatcttctacaacactgtattctatttatctttttttttttttgagacagagtctcactctgttgcccatgctggagtgcagtggcatgacctcagctcactgcaacctccacttcccaggttcaaatgattctcttgcctcagcctcccaaatagttgggattacaggcactcaccaccatgcctggctaatttttttgtatttatagtagagatggggttttgccatgttggccaggctggtctccaactcctgacctcaggtgatcctgccatcttggcctcccaaagtgctgggattacaggtatgagccaccgcgcccagccctatttgtttttttaa

SEQ ID NO: 199919 - DNA, 601 bp, Human
ccttggttaagattagttctatacaatgtattgttattttgcaagccaagtgaaaagaaaaattatttactttagaattaaactttgtaatatcaccctgattctaagcaaaattagctctttagtgtaaagatggctgagtgtaggtatgcttgtgttataattgtcatgactcctacttttaaccttgctcatttaaaaaattttgttttatttttttaaaaaatgttacagagaagcacaatcaattgaccactgccgtgtgcgtgtgtgtgtgtgtgtgtgtgtgtgtgtgtgtgttttaggggtaggggaatctcaaaaggacatagcctgcccaacatcagtctttgatttcttcttgtaattctttggaaccattgggtagcaagtggtgttggtattttctggagattacatagagtgaatatttatcaatgatttaatactgctttgtggtactactaggttctcaattttaatcagatttttgaagacaaaacagaacatgaggaggcagcacattgagtataacacttctcagctcttctaaaatgtggaacccatttaacataaaaattgccaaggatctttccagagc

SEQ ID NO: 199920 - DNA, 601 bp, Human
taatgtcagagaaaggaattatgtgtgaggtaatccttggttaagattagttctatacaatgtattgttattttgcaagccaagtgaaaagaaaaattatttactttagaattaaactttgtaatatcaccctgattctaagcaaaattagctctttagtgtaaagatggctgagtgtaggtatgcttgtgttataattgtcatgactcctacttttaaccttgctcatttaaaaaattttgttttatttttttaaaaaatgttacagagaagcacaatcaattgaccactgccgtgtgcrtgtgtgtgtgtgtgtgtgtgtgtgtgtgtgtgtgttaggggtaggggaatctcaaaaggacatagcctgcccaacatcagtctttgatttcttcttgtaattctttggaaccattgggtagcaagtggtgttggtattttctggagattacatagagtgaatatttatcaatgatttaatactgctttgtggtactactaggttctcaattttaatcagatttttgaagacaaaacagaacatgaggaggcagcacattgagtataacacttctcagctcttctaaaatgtggaacccat

SEQ ID NO: 199921 - DNA, 601 bp, Human
tgataaccaatcaggttttatgaacaacttatcctgtcacaaatatgcacattctagtcaatcaatgaacttgaaaaatataaaatattaatactgccaatcaaacttaggaaataaaatttagttcagtcactgatggcaggtccaatcttggctaagtatcataattcttgagtaaagtagctgggactaatgtcagagaaaggaattatgtgtgaggtaatccttggttaagattagttctatacaatgtattgttattttgcaagccaagtgaaaagaaaaattatttactttagarttaaactttgtaatatcaccctgattctaagcaaaattagctctttagtgtaaagatggctgagtgtaggtatgcttgtgttataattgtcatgactcctacttttaaccttgctcatttaaaaaattttgttttatttttttaaaaaatgttacagagaagcacaatcaattgaccactgccgtgtgcgtgtgtgtgtgtgtgtgtgtgtgtgtgtgtgtgtgttaggggtaggggaatctcaaaaggacatagcctgcccaacatcagtctttgatttcttcttgtaattctttggaa

SEQ ID NO: 199922 - DNA, 601 bp, Human
aattaaggggccacaatgaagttactgtggccattctagccccttctgtcacaggctgaagctgcatgagagacctcgtgtgagatcagcagaagaatcatctggcagagccccagttaatccccagaaatttaagaaataataaaatgattgttttaaaccactaagttttgggggtagtttgttatgcacagcagagaactaaaacaatctctttattaaatataaaaacaaaatttagagtaggtgaccccgagaggccagagtttcaaaggttagaattgggactgcctttactaawgaatatagtaaagcaataattagaaaaggaaccaatgaaataagacaatttatttaaataaacactgatatgttcacataggtgcactctaagaaaaactgtatcctagaggattaatttacagaaatccttgtagagaaatggtaaagaattgagaaactactaaaaacttggaaaaggaaaggagaggctactttcttataaaataaagcaaagataatccttggattaaagtaaatgaaaaaattcagtggtaatatgtaggaatcaaaatattaatttaaaatattggaaagatca

SEQ ID NO: 199923 - DNA, 601 bp, Human; identical to SEQ ID NO: 37545

SEQ ID NO: 199924 - DNA, 601 bp, Human; identical to SEQ ID NO: 37546

SEQ ID NO: 199925 - DNA, 601 bp, Human; identical to SEQ ID NO: 37547

SEQ ID NO: 199926 - DNA, 601 bp, Human; identical to SEQ ID NO: 37548

SEQ ID NO: 199927 - DNA, 601 bp, Human; identical to SEQ ID NO: 37549

SEQ ID NO: 199928 - DNA, 601 bp, Human; identical to SEQ ID NO: 37550

SEQ ID NO: 199929 - DNA, 601 bp, Human; identical to SEQ ID NO: 37551

SEQ ID NO: 199930 - DNA, 601 bp, Human; identical to SEQ ID NO: 37552

SEQ ID NO: 199931 - DNA, 601 bp, Human; identical to SEQ ID NO: 37553

SEQ ID NO: 199932 - DNA, 601 bp, Human; identical to SEQ ID NO: 37554

SEQ ID NO: 199933 - DNA, 601 bp, Human; identical to SEQ ID NO: 37555

SEQ ID NO: 199934 - DNA, 601 bp, Human; identical to SEQ ID NO: 37556

SEQ ID NO: 199935 - DNA, 601 bp, Human; identical to SEQ ID NO: 37557

SEQ ID NO: 199936 - DNA, 601 bp, Human; identical to SEQ ID NO: 22027

SEQ ID NO: 199937 - DNA, 601 bp, Human; identical to SEQ ID NO: 22028

SEQ ID NO: 199938 - DNA, 601 bp, Human; identical to SEQ ID NO: 22029

SEQ ID NO: 199939 - DNA, 601 bp, Human; identical to SEQ ID NO: 22030

SEQ ID NO: 199940 - DNA, 601 bp, Human; identical to SEQ ID NO: 22031

SEQ ID NO: 199941 - DNA, 601 bp, Human; identical to SEQ ID NO: 22032

SEQ ID NO: 199942 - DNA, 601 bp, Human; identical to SEQ ID NO: 22033

SEQ ID NO: 199943 - DNA, 601 bp, Human; identical to SEQ ID NO: 22034

SEQ ID NO: 199944 - DNA, 601 bp, Human; identical to SEQ ID NO: 22035

SEQ ID NO: 199945 - DNA, 601 bp, Human; identical to SEQ ID NO: 22036

SEQ ID NO: 199946 - DNA, 601 bp, Human; identical to SEQ ID NO: 22037

SEQ ID NO: 199947 - DNA, 601 bp, Human; identical to SEQ ID NO: 22038

SEQ ID NO: 199948 - DNA, 601 bp, Human; identical to SEQ ID NO: 22039

SEQ ID NO: 199949 - DNA, 601 bp, Human; identical to SEQ ID NO: 22040

SEQ ID NO: 199950 - DNA, 601 bp, Human; identical to SEQ ID NO: 22041

SEQ ID NO: 199951 - DNA, 601 bp, Human
taagttctcccattgaactagagaatatggttctaaggagtttggtaagatgaatgacttcttgctttctctccatgtggacttttgtcttccttgaccctagaatgtgatttggttttgaaaacacggcatttgaagtcatcttcaatgccaccaactttaagccattgagcataagtatttgattgagattttcagaaaaattcctaagagtgcttctttttagaatgaggatgggctgcaacaaatgaaatgctgaagcaggaactcctgttcctctgatatgaaaatcaaatggagrcgatactctctaggctgagtttaacataaaaggaattgggcagccctgtctggagggggacccacaggtaattgtcttttagatatgaaaattgctgacacccacagctgggtgccccttacgtattgctccaagggctttgtgctttttttttttttttttttttttgagacagagtttctctcttgttgcccaggctggagtgcaatggtgcaatctgggctcactgcaacctctgcctccccggttcaagtgattctcctggctcagccacccgagtagccgggactacaggcatgc

SEQ ID NO: 199952 - DNA, 601 bp, Human
gcataagtatttgattgagattttcagaaaaattcctaagagtgcttctttttagaatgaggatgggctgcaacaaatgaaatgctgaagcaggaactcctgttcctctgatatgaaaatcaaatggaggcgatactctctaggctgagtttaacataaaaggaattgggcagccctgtctggagggggacccacaggtaattgtcttttagatatgaaaattgctgacacccacagctgggtgccccttacgtattgctccaagggctttgtgctttttttttttttttttttttttgaracagagtttctctcttgttgcccaggctggagtgcaatggtgcaatctgggctcactgcaacctctgcctccccggttcaagtgattctcctggctcagccacccgagtagccgggactacaggcatgcacccccacgcttggctaattttgtatttttagtagagacgggggtcttccatgttagtcaggctggtctcgaactccccacctcaggtgatctgcctgcctcggcctcccaaagtgctgggattacaggcatgagccaccgtgcctggccgctttgtgctttttgtttaac

SEQ ID NO: 199953 - DNA, 601 bp, Human
gctagattccagcatgcccactgattgtccttttgaaaaatgtcattttgtttttgaggaggtgggcaagctgcatagtggcccgtcagatacatattttaaaaaacagattgcatccaagagtgacagtcaacgtggagtctgtcatatatgaaaagatagcagttcagttcagaagagggtctaagtagaaagaacttagctgtttctgctatagaaaaacctttcttactggttatttttccgagtggtggtctttttgcttgtggctttggggtctatctggaagcttcttttctaycttgcctgagctagaggaatgttgccctgccatcccctcctagtctgagttcccccgcattttaaatcacaactcatcctctggcgttctctctgtcctggtcctcagggtctgaagcatcaggaacagctctctcctgtttcagctttcttggcaccactgagaaaagcctccaagtgtaagccttgcgacttgtgtcttgctgtacatgttgccctttaacctagtgggtgccattttccagggatgtcggggggagatttcatgcacacctagggagagcagagcctgcaccttgtc

SEQ ID NO: 199954 - DNA, 601 bp, Human
tttgaggaggtgggcaagctgcatagtggcccgtcagatacatattttaaaaaacagattgcatccaagagtgacagtcaacgtggagtctgtcatatatgaaaagatagcagttcagttcagaagagggtctaagtagaaagaacttagctgtttctgctatagaaaaacctttcttactggttatttttccgagtggtggtctttttgcttgtggctttggggtctatctggaagcttcttttctatcttgcctgagctagaggaatgttgccctgccatcccctcctagtctgagttsccccgcattttaaatcacaactcatcctctggcgttctctctgtcctggtcctcagggtctgaagcatcaggaacagctctctcctgtttcagctttcttggcaccactgagaaaagcctccaagtgtaagccttgcgacttgtgtcttgctgtacatgttgccctttaacctagtgggtgccattttccagggatgtcggggggagatttcatgcacacctagggagagcagagcctgcaccttgtcatttgctggggaatcactggcacctgtgggcgtttctgcctctcctccaggg

SEQ ID NO: 199955 - DNA, 601 bp, Human
acatattttaaaaaacagattgcatccaagagtgacagtcaacgtggagtctgtcatatatgaaaagatagcagttcagttcagaagagggtctaagtagaaagaacttagctgtttctgctatagaaaaacctttcttactggttatttttccgagtggtggtctttttgcttgtggctttggggtctatctggaagcttcttttctatcttgcctgagctagaggaatgttgccctgccatcccctcctagtctgagttcccccgcattttaaatcacaactcatcctctggcgttctstctgtcctggtcctcagggtctgaagcatcaggaacagctctctcctgtttcagctttcttggcaccactgagaaaagcctccaagtgtaagccttgcgacttgtgtcttgctgtacatgttgccctttaacctagtgggtgccattttccagggatgtcggggggagatttcatgcacacctagggagagcagagcctgcaccttgtcatttgctggggaatcactggcacctgtgggcgtttctgcctctcctccagggcggactgtggagaaacacttgaacttggagaagcttaga

SEQ ID NO: 199956 - DNA, 601 bp, Human
aaaacagattgcatccaagagtgacagtcaacgtggagtctgtcatatatgaaaagatagcagttcagttcagaagagggtctaagtagaaagaacttagctgtttctgctatagaaaaacctttcttactggttatttttccgagtggtggtctttttgcttgtggctttggggtctatctggaagcttcttttctatcttgcctgagctagaggaatgttgccctgccatcccctcctagtctgagttcccccgcattttaaatcacaactcatcctctggcgttctctctgtcctggycctcagggtctgaagcatcaggaacagctctctcctgtttcagctttcttggcaccactgagaaaagcctccaagtgtaagccttgcgacttgtgtcttgctgtacatgttgccctttaacctagtgggtgccattttccagggatgtcggggggagatttcatgcacacctagggagagcagagcctgcaccttgtcatttgctggggaatcactggcacctgtgggcgtttctgcctctcctccagggcggactgtggagaaacacttgaacttggagaagcttagactattcgggtg

SEQ ID NO: 199957 - DNA, 601 bp, Human
tgcttgtggctttggggtctatctggaagcttcttttctatcttgcctgagctagaggaatgttgccctgccatcccctcctagtctgagttcccccgcattttaaatcacaactcatcctctggcgttctctctgtcctggtcctcagggtctgaagcatcaggaacagctctctcctgtttcagctttcttggcaccactgagaaaagcctccaagtgtaagccttgcgacttgtgtcttgctgtacatgttgccctttaacctagtgggtgccattttccagggatgtcggggggagwtttcatgcacacctagggagagcagagcctgcaccttgtcatttgctggggaatcactggcacctgtgggcgtttctgcctctcctccagggcggactgtggagaaacacttgaacttggagaagcttagactattcgggtgtcagccgggaaggccaagtcagggtgatcatctgcctcagtttggagttcacagggagaccctgcaggcccctggattggtcacagacagtcaataagccattaaaaacaatatttctctggctgggcaccatggttcatgcctgtaattccagcact

SEQ ID NO: 199958 - DNA, 601 bp, Human
ttaaaaacaatatttctctggctgggcaccatggttcatgcctgtaattccagcactttgggagcctgaggtgggtggatcacttgaggtcaggaatttgagactagcctggccaatatggcgaatctactacaaatacaaaaattagctaggcatggtggcatgctcctggagtcccagctacttgggaggctgaggcaggagaatctttgaacctgggaggcggaggttgcagggagctgagattgcaccactgcactctatcctgagcaatagagtgagactccgtctcaaaaaaaaacaaacaaaaaaattctcgagtgaatggtcagtgtcatctatcattggagagggaaatgcccccagccaggagttaggagtctggagtgctggcccccttctgacactgacttgccgtgtgaccttgagtcactaccctactctgtgttctagctgtgtgtctccagtgagggatttgtgctacatgaccctggaagtcctttccagccccctacatttggccattcactgaaactcattcactgaaactcagagagattttgcctctcatcaagtacatgttgctcagcagatacagaaa

SEQ ID NO: 199959 - DNA, 601 bp, Human
gagattttgcctctcatcaagtacatgttgctcagcagatacagaaagtccctgttttctctcacacttgctggaaagaatccctcagcccaccatctcctgtcctgcattcctgggtctgcctcttccctccacacgctcgccccgtgcttaggcccccactcttgttcttgtttttgactctttcctgccttcccttccccaccacaggagcatcaccttcttgccaccaccccgaatttctctttcgtcttccccctcagaggctgtggccttttttccattcatccagatgggttcyttctgtttagggacgagggacatccccctctgagtgcagcacctggcccagggagctcagaagagtcagcagatggccttatgggcaggtggtccggaaaggggagtgaggagtctgaccgcctgctctgcttccttggccagaatgctatggcatttgcacggaggctgtgtgatgcgatctggctatagagtggggcatccaatgagcgaacctcaaggaataaaagtcatcagagggggcagtgtatggttagcattgtgacccccaaatgccattgcttttatagcctgagaaaag

SEQ ID NO: 199960 - DNA, 601 bp, Human
atagagtggggcatccaatgagcgaacctcaaggaataaaagtcatcagagggggcagtgtatggttagcattgtgacccccaaatgccattgcttttatagcctgagaaaagtactaactacttttgcaaataaccacctatgtttactgacctctgtagaatttctactagcctgcctttccccgggggagggaatggtaataatacaggtgaggaactgaggaatttttatcctttttctgtttgctgaccagacgttctgcattgctttaagtgagtgagtggctgggatttgcttyacagagaaggaggccttgcaaagagaaatagcttaatgccacttcattggcacctaagacctgctactttctttgacttaatatattgagtccagaaagaaatgcctggggcactttgaaaacttcacaggcccactgctgcttgctgaaataaaaaattgaagtgaattggtacaaaaatctccctcttcctcccaactccccgccaccccgcccctgggcactccaccctcctggctttctggccttctccagaccatgtcaccatgtcacctgccctcacgggtaaatcctcgcctg

SEQ ID NO: 199961 - DNA, 601 bp, Human
cccgggggagggaatggtaataatacaggtgaggaactgaggaatttttatcctttttctgtttgctgaccagacgttctgcattgctttaagtgagtgagtggctgggatttgctttacagagaaggaggccttgcaaagagaaatagcttaatgccacttcattggcacctaagacctgctactttctttgacttaatatattgagtccagaaagaaatgcctggggcactttgaaaacttcacaggcccactgctgcttgctgaaataaaaaattgaagtgaattggtacaaaaatcyccctcttcctcccaactccccgccaccccgcccctgggcactccaccctcctggctttctggccttctccagaccatgtcaccatgtcacctgccctcacgggtaaatcctcgcctgcctccctgctggctctgcgtttcccaggtcacaggccctggagactcctttctgtctgaaatggcgccgcatgtagaggaaaacacagccaaatattctcggtttaaaaaaggagatggcatgtcagcagcagaagataatattattgccattaaacagagcctgctattgagaatcacacaa

SEQ ID NO: 199962 - DNA, 601 bp, Human
tacaggtgaggaactgaggaatttttatcctttttctgtttgctgaccagacgttctgcattgctttaagtgagtgagtggctgggatttgctttacagagaaggaggccttgcaaagagaaatagcttaatgccacttcattggcacctaagacctgctactttctttgacttaatatattgagtccagaaagaaatgcctggggcactttgaaaacttcacaggcccactgctgcttgctgaaataaaaaattgaagtgaattggtacaaaaatctccctcttcctcccaactccccgycaccccgcccctgggcactccaccctcctggctttctggccttctccagaccatgtcaccatgtcacctgccctcacgggtaaatcctcgcctgcctccctgctggctctgcgtttcccaggtcacaggccctggagactcctttctgtctgaaatggcgccgcatgtagaggaaaacacagccaaatattctcggtttaaaaaaggagatggcatgtcagcagcagaagataatattattgccattaaacagagcctgctattgagaatcacacaatgagatctttatgaggcggactc

SEQ ID NO: 199963 - DNA, 601 bp, Human
caggtgaggaactgaggaatttttatcctttttctgtttgctgaccagacgttctgcattgctttaagtgagtgagtggctgggatttgctttacagagaaggaggccttgcaaagagaaatagcttaatgccacttcattggcacctaagacctgctactttctttgacttaatatattgagtccagaaagaaatgcctggggcactttgaaaacttcacaggcccactgctgcttgctgaaataaaaaattgaagtgaattggtacaaaaatctccctcttcctcccaactccccgccrccccgcccctgggcactccaccctcctggctttctggccttctccagaccatgtcaccatgtcacctgccctcacgggtaaatcctcgcctgcctccctgctggctctgcgtttcccaggtcacaggccctggagactcctttctgtctgaaatggcgccgcatgtagaggaaaacacagccaaatattctcggtttaaaaaaggagatggcatgtcagcagcagaagataatattattgccattaaacagagcctgctattgagaatcacacaatgagatctttatgaggcggactcag

SEQ ID NO: 199964 - DNA, 601 bp, Human
gggccctccctcctgagtaccagccttgtcacttctcccctggctgtggctccctggatgtgcatcaggcacctccatccaactgtccccagttggactccctgtctgctccttgctgcttttccggtgcccagtcctggagagggctcgctggaggttgtgctggcggtatctgcagagtcatcctagcatcttcatgtcctcgtgctgccttgagttgctttcatctctgtgttacctcttgcactcattcccttacccacacagatttgacttttgtcacctcttcctggattttggycctgtcctctgaggagtcttactgtctgtcccccacctcctgcctctcgccaggctgtttttctggtgcagctttcattgtgccgccttcttcctctgaagccttcagtgactccctcttgctcagagaatcagcccaagtgtcagaaccctccacgacgcggcctattcctgctgccccagcccagacttgcattgtcatctcagccagggatgccctccctttctttccctgcttctagaagcttcatcacccttggtggcccagcctgggtgcttcccattcactgatctcctgtga

SEQ ID NO: 199965 - DNA, 601 bp, Human
tgcttttccggtgcccagtcctggagagggctcgctggaggttgtgctggcggtatctgcagagtcatcctagcatcttcatgtcctcgtgctgccttgagttgctttcatctctgtgttacctcttgcactcattcccttacccacacagatttgacttttgtcacctcttcctggattttggccctgtcctctgaggagtcttactgtctgtcccccacctcctgcctctcgccaggctgtttttctggtgcagctttcattgtgccgccttcttcctctgaagccttcagtgactccytcttgctcagagaatcagcccaagtgtcagaaccctccacgacgcggcctattcctgctgccccagcccagacttgcattgtcatctcagccagggatgccctccctttctttccctgcttctagaagcttcatcacccttggtggcccagcctgggtgcttcccattcactgatctcctgtgatctgtggctgctgtgtggcctcttcgcaaacgttgggcttttatcccacagcccaggtggcattcagccttgcgtgtggttcaatcaaggcccctctgtctcttacattttcctat

SEQ ID NO: 199966 - DNA, 601 bp, Human
ctggcggtatctgcagagtcatcctagcatcttcatgtcctcgtgctgccttgagttgctttcatctctgtgttacctcttgcactcattcccttacccacacagatttgacttttgtcacctcttcctggattttggccctgtcctctgaggagtcttactgtctgtcccccacctcctgcctctcgccaggctgtttttctggtgcagctttcattgtgccgccttcttcctctgaagccttcagtgactccctcttgctcagagaatcagcccaagtgtcagaaccctccacgacgcrgcctattcctgctgccccagcccagacttgcattgtcatctcagccagggatgccctccctttctttccctgcttctagaagcttcatcacccttggtggcccagcctgggtgcttcccattcactgatctcctgtgatctgtggctgctgtgtggcctcttcgcaaacgttgggcttttatcccacagcccaggtggcattcagccttgcgtgtggttcaatcaaggcccctctgtctcttacattttcctatttcctgccgcctgggcagcctcactcctcagaggcactctgttaat

SEQ ID NO: 199967 - DNA, 601 bp, Human
aagtgtcagaaccctccacgacgcggcctattcctgctgccccagcccagacttgcattgtcatctcagccagggatgccctccctttctttccctgcttctagaagcttcatcacccttggtggcccagcctgggtgcttcccattcactgatctcctgtgatctgtggctgctgtgtggcctcttcgcaaacgttgggcttttatcccacagcccaggtggcattcagccttgcgtgtggttcaatcaaggcccctctgtctcttacattttcctatttcctgccgcctgggcagcctyactcctcagaggcactctgttaatgcccatgggtgaatgaatgagtgagtgaatgaatgaatgactgaatacactgacgatacttgatatcctgcttcctctgagtgatgccaagagacttagtgtcacaaggagggaggagggtttaggtatccgacgtggactgtgttcaccctgatggaagctgtcgcttgctcagcagtggctccctctgcagccccagctccctgagtccctgtggtcagatctggtcatggtgggggagggtggcagaaagaggaagccgagagcccaggcatg

SEQ ID NO: 199968 - DNA, 601 bp, Human
cagctccctgagtccctgtggtcagatctggtcatggtgggggagggtggcagaaagaggaagccgagagcccaggcatggcctgtggttgtggatgggacagctccctctgtctgggctgttcttcagaagagggtgggaacagcagctctctcattggtcctcttgcgagaaagcctgctctccaagtacagagggtcacaacatggagaaatcacatggtcccagcaccacagtggacccagcagtcattcccccagtgccttgggcttgtcccggctcttcctactgagcctccccwtggaggcaggagggctgggaggaaggtgaggtggcttcctgaagggacgtggctcctgaatgtcactgcggtacatccacggcttgtcatttgttcatccatgtggcatgtgggttgctccctccttatggcgagtacacacgtgtgaacgcatgcacacactgtaatatggatgtgtctgtaattgatactttgattattccctttgcagcactcatttgactcgggttagaaagtgtttacaaaaacgcccgaccacatcagacccaagtttcaaagtccaggaccaaagttgttgcc

SEQ ID NO: 199969 - DNA, 601 bp, Human
ctccccttgtcccctcagtctccacatggttgaggtcacacatttctcctaaggacacgggtgccctctgcaagcagatgccgggagcctgggtccactcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctyggccttgaacggctggactggaagaatccatccaccctcaggtgtcactgcgtgaatctcggccttgaacggctggactggaagaatccatccacccccttggcatagtttgggccgatctaatgcctggcactgagcagagcggagggatctcctaatgcctggtgcggtacaggggaaggatggcggagcatcctcagagacagcacagctcttcccaaaggtccagcacgcacactttaccgaatgcttttcttgtgaagggagtcattgggttgggctagccaggtaggctgggta

SEQ ID NO: 199970 - DNA, 601 bp, Human
ctctccattttcctaaggcccctgcatgcctggagctggctgtgggggcagccagagaagctgcccaatgagtctgatgggagccagacccgttactccttctactcatgatagctttagcattgttgtcccggggcaaccctttctcatgtgaaaccttgcgtggaaccccctccacctgagatatgagactgatgaatgcagaactgctctggttggaatggtgggtggcaggtgggctgtgggggagtccagatcctctccgctttctctttgtcatccccccatggcagcccctctrcctctggagaatcccagagcttggggaagcacaggatggaaaccaacccatcctggcactgcctccccctctgcccacctcccctgcaaagcttgcaatgcgattggtcctggtgtagcctccgtgttgagttgtaggggaaagggtgtttagtaagcaggcatatacccacggagtcgcttaagaaaacacctaaccacactgtaagtttttagtagtttcgtttaatatccctctctctgttcaagacaggaaccagggtagagcacctgtttcattttccctgcctaggtttgggtt

SEQ ID NO: 199971 - DNA, 601 bp, Human
agtagagatggggtttcaccatgttagtcaggctggtcacgaactcctgacctcaggtgatccacccgcctcggcctcccaaagtgctgggattacaggcatgtcccactgtgcccggccggtacattagttttaaagggaagattgactgtgggtggccaagggatttgtgttttctgacttaaccatccatggctctgaccccaagtcacccattaagggctgtttctccctttttttttcctcttcctccccaagctgacctttctctcttcttaagaagtgattactgatttctttrggttttgagggttctgtctttgactctccgtgattgttgggtgaagccatttgcttaaattccttgcttttagagcgtcttaactgccatggtaatgataaaggggagtgacagtgagtagaaattagagttctttctggttaacccatttgggaggtagctttctttgaatatgactaagtgttccccctaatgacagagaggatgttgctgggggttgggtcgcggtggctgaggctgctgtccagttaagagaattttgcaatgaactagggcagtggtttaaaaaccttgactgca

SEQ ID NO: 199972 - DNA, 601 bp, Human
aaaaattttacttttcgctattttttttttcctcctccaaataatctctggagaatttggagcctgattttcttgacaacacatctggccctgcagatgtaaagcagtgttcccagaaaacagcccgtcaaatcaataactcttgctatctttgaattttcagccttttttggcattcaaatgaggccaactttataagtggccattgctgtgctgttgaattcaagcccctccgtttttcatggtggattccttgcattgtctgctaggggggttgcattcctcgctgaaccagacctcygccctcttccccgctgccttgcagtttgctgagcttccaggcagggctgcagggtcgtgctgctggaagtattggtgacaaattcttccccagtgggtgtttcggctaaggaagcatttagtcatgtagggcctaccatgcccagcagtgcagcgtgggagaggcctggcagagggcagagctctcttctctccagccgggtgtggctggtggctccttcctcttttgtagtgtcaaaccaagggatagtatggacccagcagaactgaaagcaaagggaggacccattattagccagtt

SEQ ID NO: 199973 - DNA, 601 bp, Human
ctggaagtattggtgacaaattcttccccagtgggtgtttcggctaaggaagcatttagtcatgtagggcctaccatgcccagcagtgcagcgtgggagaggcctggcagagggcagagctctcttctctccagccgggtgtggctggtggctccttcctcttttgtagtgtcaaaccaagggatagtatggacccagcagaactgaaagcaaagggaggacccattattagccagttctggcagaggcgagcagcttctttgtgtggacaggcatatctcatgcctttttgcttcagctkggagtttgttttttttttaattactgttatttatttatttagtaccttagctcattagctgcagaaatcacaggggatgaaaaagcaggtaggatgggtccatccttaaagcaaggagagagttgaatgaggaaactgtccctgaggccttgacagatattttggagctaactctgagcccagtgagggaggacctaatcttttggaggaagtgcaactttagcttcagagttttaaatggaaactgggcagaaagccacagcttgggcacagcattggtggcgtgttgttgtgtcactt

SEQ ID NO: 199974 - DNA, 601 bp, Human
cagaaatcacaggggatgaaaaagcaggtaggatgggtccatccttaaagcaaggagagagttgaatgaggaaactgtccctgaggccttgacagatattttggagctaactctgagcccagtgagggaggacctaatcttttggaggaagtgcaactttagcttcagagttttaaatggaaactgggcagaaagccacagcttgggcacagcattggtggcgtgttgttgtgtcactttgcacagttagatggggcttcagccctctttgtaggatgaacgtttaggttcttgtccaaaygaatacacttctatatcctactaaaaatgattgcaggacagcagtgcaaaccagggctgtcctaggcaaacccaggcatctgtcactctaaaggacacaaggacacgtgttgagtcctcttgtcctccagtgagctcgggaaggggatgaccctagcagttgctctctggacctctccacagacctgccgggagtcatgggtaggagttgtgtgattctgtccttttcacaagagatggttagaagaaagtgaggagtttggagggagcagataattgatatcatttatcgggaatctgt

SEQ ID NO: 199975 - DNA, 601 bp, Human
tttgcaggaaccattgctcacagctgctccctccttggatgctataccctcactctgtaagatagggtgggaaatgtcgcctactttacccatgagagcatcgcagaagggagaggctgagggacttacccaactagtatgaggctgaatgaggactcagatgatggtcatctggctccggggccagcacttaatcctgctgggtatgttcctgggccctctctttttttgtttttgtttttgtttttttttgttttgagacagagtctcgctctgtcccccaggctggagtgcggtggcrccatctcagctcactgcaagctccgcctcctgggttcacgccattctcctgcctcagcctcccaagtagctgggactacaggtgcccgccaacatgcccggctaattttttgtatttttagtagagatggggtttcaccgttttagccaggatggtctccatctcctgaccttgtgatccgcccgtcttggcctcccaaagtgctgggattataggcgtgagccacagcgcctgggccctctcttataggaacttcaggtgctaatgttgcaggatttaggaggacgagagagaccttgg

SEQ ID NO: 199976 - DNA, 601 bp, Human
tagccaggatggtctccatctcctgaccttgtgatccgcccgtcttggcctcccaaagtgctgggattataggcgtgagccacagcgcctgggccctctcttataggaacttcaggtgctaatgttgcaggatttaggaggacgagagagaccttgggttgaaacaggagaatttttactgagtgtactcaggcccagctgacttacgtttaaaagactgggcctggaacaaagacagtacttgacatttatatatattttataaaagggggtgggctagcttgaaataagctcatagtgktgcgaaagcagggatattgaggcaggacaaagacaggattgtatatgactgttgccaagcaacctagatgtttgttatttaggtttgcctgggcaaaggcttattttataacctttattatggtgcccaggcagctgtagtttaggcttatttaggctttttatgacttttgttgtattttttagataaaacagaatacttgaagttactagttatagagaacaggaatttataaattttataaaacaaaggaaatttttttttttttttttttttatgttgagggagtgctgcgagagt

SEQ ID NO: 199977 - DNA, 601 bp, Human
ctagcttgaaataagctcatagtggtgcgaaagcagggatattgaggcaggacaaagacaggattgtatatgactgttgccaagcaacctagatgtttgttatttaggtttgcctgggcaaaggcttattttataacctttattatggtgcccaggcagctgtagtttaggcttatttaggctttttatgacttttgttgtattttttagataaaacagaatacttgaagttactagttatagagaacaggaatttataaattttataaaacaaaggaaatttttttttttttttttttttatgttgagggagtgctgcgagagtttttaggagcgtattagataatattattaagacttttttgggtctgggccatgcctttgctgcctttgggacaagttagcttaatacaggaaaacttatttttttttaattttatataaaaattctcctgtttcaacccgagatctctctcgtcctcctaaatcccgcaacactaagtgtggttcccttaagtgcactggattcaaggtgactttgtccttgcttttggatgttttggatgtaacagcgatgagatggcccctcccagagctgaga

SEQ ID NO: 199978 - DNA, 601 bp, Human
acatttattggccatctggcaggtgctgatctgggcattagaagtacagataaggtcctctttgcaaaaaacttcttgtctattgggaagacctacaaagaaaagatgaaaatgaaatgtgaagattgctgtactaaggttccagtggaacagagaagagaaatctttaaaatctgcctgggagagccaagagaggcttcagccaataggtcctatgtgagctgacccttgaaagccggctcaaattttaccctggggtggatttcacccatggggtgggcaggagaagggagtgtccacscaagagagagatgtgtgcagaagaatttggtagatgagtctggtgtattttagaatttagactccggatttgaccataggatgtttgagttctatcttcatggcttgctagctgggcaagtgacttttcatttctcggagccacagttttctttcttctttatttatttgtttttatttttattattttttttgagacagggtctcgctctatctcccaggctggagtgcagtggcccgatcttggctcactacaacctccacctcccgggttcaagcgattctcctgcctcagccttct

SEQ ID NO: 199979 - DNA, 601 bp, Human
aggtcctatgtgagctgacccttgaaagccggctcaaattttaccctggggtggatttcacccatggggtgggcaggagaagggagtgtccacccaagagagagatgtgtgcagaagaatttggtagatgagtctggtgtattttagaatttagactccggatttgaccataggatgtttgagttctatcttcatggcttgctagctgggcaagtgacttttcatttctcggagccacagttttctttcttctttatttatttgtttttatttttattattttttttgagacagggtctcrctctatctcccaggctggagtgcagtggcccgatcttggctcactacaacctccacctcccgggttcaagcgattctcctgcctcagccttctgagtagctgagactacaggtgtccaccaccacacccggctaatttttgtatttttagtagagacggggtttcaccatattggccaggctggtctcgaactcctgaccttgtgatctgcctgccttggcctcccagagtgctgggattacaggcgtgagccaccgcgcccggctctttcttctttattttatagtggtagcatacata

SEQ ID NO: 199980 - DNA, 601 bp, Human
tcggagccacagttttctttcttctttatttatttgtttttatttttattattttttttgagacagggtctcgctctatctcccaggctggagtgcagtggcccgatcttggctcactacaacctccacctcccgggttcaagcgattctcctgcctcagccttctgagtagctgagactacaggtgtccaccaccacacccggctaatttttgtatttttagtagagacggggtttcaccatattggccaggctggtctcgaactcctgaccttgtgatctgcctgccttggcctcccaragtgctgggattacaggcgtgagccaccgcgcccggctctttcttctttattttatagtggtagcatacataacacaaattttaccactcgaactattattaagtgggcagttcagtggcattgtgtattcgcattgttgtacagtcatcaccgtggtccacttccagaactttatcatcatccctaactgatcatcatccctaaactgttgccattaaacactaactccccattcccacctttctctagcccctggtggcccgtattctattatagttgtttctatggatttgactgtt

SEQ ID NO: 199981 - DNA, 601 bp, Human
tatttgtttttatttttattattttttttgagacagggtctcgctctatctcccaggctggagtgcagtggcccgatcttggctcactacaacctccacctcccgggttcaagcgattctcctgcctcagccttctgagtagctgagactacaggtgtccaccaccacacccggctaatttttgtatttttagtagagacggggtttcaccatattggccaggctggtctcgaactcctgaccttgtgatctgcctgccttggcctcccagagtgctgggattacaggcgtgagccaccgygcccggctctttcttctttattttatagtggtagcatacataacacaaattttaccactcgaactattattaagtgggcagttcagtggcattgtgtattcgcattgttgtacagtcatcaccgtggtccacttccagaactttatcatcatccctaactgatcatcatccctaaactgttgccattaaacactaactccccattcccacctttctctagcccctggtggcccgtattctattatagttgtttctatggatttgactgttctaggaacctcatgtaaatatatatgctta

SEQ ID NO: 199982 - DNA, 601 bp, Human
actacaacctccacctcccgggttcaagcgattctcctgcctcagccttctgagtagctgagactacaggtgtccaccaccacacccggctaatttttgtatttttagtagagacggggtttcaccatattggccaggctggtctcgaactcctgaccttgtgatctgcctgccttggcctcccagagtgctgggattacaggcgtgagccaccgcgcccggctctttcttctttattttatagtggtagcatacataacacaaattttaccactcgaactattattaagtgggcagttcrgtggcattgtgtattcgcattgttgtacagtcatcaccgtggtccacttccagaactttatcatcatccctaactgatcatcatccctaaactgttgccattaaacactaactccccattcccacctttctctagcccctggtggcccgtattctattatagttgtttctatggatttgactgttctaggaacctcatgtaaatatatatgcttatgacattgcagaatggccccaagttcacctatgtgatagcctgtgtcagaatttccttttttttatggataatatttcatcgtat

SEQ ID NO: 199983 - DNA, 601 bp, Human
ttctgagtagctgagactacaggtgtccaccaccacacccggctaatttttgtatttttagtagagacggggtttcaccatattggccaggctggtctcgaactcctgaccttgtgatctgcctgccttggcctcccagagtgctgggattacaggcgtgagccaccgcgcccggctctttcttctttattttatagtggtagcatacataacacaaattttaccactcgaactattattaagtgggcagttcagtggcattgtgtattcgcattgttgtacagtcatcaccgtggtccayttccagaactttatcatcatccctaactgatcatcatccctaaactgttgccattaaacactaactccccattcccacctttctctagcccctggtggcccgtattctattatagttgtttctatggatttgactgttctaggaacctcatgtaaatatatatgcttatgacattgcagaatggccccaagttcacctatgtgatagcctgtgtcagaatttccttttttttatggataatatttcatcgtatatatagaccatattctgtttatccattcatccattgattgatagata

SEQ ID NO: 199984 - DNA, 601 bp, Human
ctcctgaccttgtgatctgcctgccttggcctcccagagtgctgggattacaggcgtgagccaccgcgcccggctctttcttctttattttatagtggtagcatacataacacaaattttaccactcgaactattattaagtgggcagttcagtggcattgtgtattcgcattgttgtacagtcatcaccgtggtccacttccagaactttatcatcatccctaactgatcatcatccctaaactgttgccattaaacactaactccccattcccacctttctctagcccctggtggcccstattctattatagttgtttctatggatttgactgttctaggaacctcatgtaaatatatatgcttatgacattgcagaatggccccaagttcacctatgtgatagcctgtgtcagaatttccttttttttatggataatatttcatcgtatatatagaccatattctgtttatccattcatccattgattgatagatacatgggctgcttccaccttttggctattgtaaataatgctgctatgaacatgagtgtgcaaatatctattcaagtccctgccttcaactcttgggtgtgtgc

SEQ ID NO: 199985 - DNA, 601 bp, Human
ttcagtggcattgtgtattcgcattgttgtacagtcatcaccgtggtccacttccagaactttatcatcatccctaactgatcatcatccctaaactgttgccattaaacactaactccccattcccacctttctctagcccctggtggcccgtattctattatagttgtttctatggatttgactgttctaggaacctcatgtaaatatatatgcttatgacattgcagaatggccccaagttcacctatgtgatagcctgtgtcagaatttccttttttttatggataatatttcatcktatatatagaccatattctgtttatccattcatccattgattgatagatacatgggctgcttccaccttttggctattgtaaataatgctgctatgaacatgagtgtgcaaatatctattcaagtccctgccttcaactcttgggtgtgtgcccgtaaatggaattgccgcatcatacggtaattctgcaccacagttttctgatttgtcatataatttcagggttactgtgcagcttaaatttgattgaaggtacaaagtactgagcattgcctggcacataatcagtattaagtccca

SEQ ID NO: 199986 - DNA, 601 bp, Human
atttgactgttctaggaacctcatgtaaatatatatgcttatgacattgcagaatggccccaagttcacctatgtgatagcctgtgtcagaatttccttttttttatggataatatttcatcgtatatatagaccatattctgtttatccattcatccattgattgatagatacatgggctgcttccaccttttggctattgtaaataatgctgctatgaacatgagtgtgcaaatatctattcaagtccctgccttcaactcttgggtgtgtgcccgtaaatggaattgccgcatcatayggtaattctgcaccacagttttctgatttgtcatataatttcagggttactgtgcagcttaaatttgattgaaggtacaaagtactgagcattgcctggcacataatcagtattaagtcccatcctgaagggccccttctagcctctcctgaaaagtgaaccctttaaagcaaaaggacttttaactatttggatgaaaaaatacctcttcaaatgtagtttatggttcttaaatggaggtcctttttggcacttttgtggagtttgggtgaggagtcagatggccacatttgcatagtg

SEQ ID NO: 199987 - DNA, 601 bp, Human
ttgatagatacatgggctgcttccaccttttggctattgtaaataatgctgctatgaacatgagtgtgcaaatatctattcaagtccctgccttcaactcttgggtgtgtgcccgtaaatggaattgccgcatcatacggtaattctgcaccacagttttctgatttgtcatataatttcagggttactgtgcagcttaaatttgattgaaggtacaaagtactgagcattgcctggcacataatcagtattaagtcccatcctgaagggccccttctagcctctcctgaaaagtgaaccytttaaagcaaaaggacttttaactatttggatgaaaaaatacctcttcaaatgtagtttatggttcttaaatggaggtcctttttggcacttttgtggagtttgggtgaggagtcagatggccacatttgcatagtgaggtgtgattgggtcctggaatgtcatgccagggagcaggtgaaagccaatgagtattctgccaggtccaaaggcccagtggccagtttccatctggatgggcctggaaggcttcctggaggagggggtagtggccccagctggggaaagaggaggtaaagga

SEQ ID NO: 199988 - DNA, 601 bp, Human
ggctgcttccaccttttggctattgtaaataatgctgctatgaacatgagtgtgcaaatatctattcaagtccctgccttcaactcttgggtgtgtgcccgtaaatggaattgccgcatcatacggtaattctgcaccacagttttctgatttgtcatataatttcagggttactgtgcagcttaaatttgattgaaggtacaaagtactgagcattgcctggcacataatcagtattaagtcccatcctgaagggccccttctagcctctcctgaaaagtgaaccctttaaagcaaaagsacttttaactatttggatgaaaaaatacctcttcaaatgtagtttatggttcttaaatggaggtcctttttggcacttttgtggagtttgggtgaggagtcagatggccacatttgcatagtgaggtgtgattgggtcctggaatgtcatgccagggagcaggtgaaagccaatgagtattctgccaggtccaaaggcccagtggccagtttccatctggatgggcctggaaggcttcctggaggagggggtagtggccccagctggggaaagaggaggtaaaggaatgggtgagaacct

SEQ ID NO: 199989 - DNA, 601 bp, Human
tgcctgcctcagcctccctaagtgattattactatttttagatggtttactttagccattcaaaggaattaaatgaagaaatatttgatctaagaagaaagtttatgaagatgactgacttaaaaataatgtattaaaaattaatagcttccctgtatgtcataaataaccaatcagaaaacataatttaaaaaatccatacacaatagcaacataaaatataaaattactaggaattataagaatacattcttatatatggaatccaagaagagtcttaaataaattaaaagaaatgctrtgttagtgaacagaaaaacccaatactgtaaagaagtgtatactttagattaattttaaaattgaaaacctcaaaaggtggttgagtttttgttttgttttccatttgaccaaatgattcttaagtacaggtgaaagattaaacaggtgataagaaccaaaaaatattcaaaaaggtcataatgaataaggctgggagaccactactggctagatattaaaacaaactgtaaaaatataataattaaagctgtgtggtactagctccagaagagacagctatataagcaggttaaagtag

SEQ ID NO: 199990 - DNA, 601 bp, Human
ataaaaaaggctacatttcacactcatggtaaaattgtaaaatattcatagtattatattagaagttaactattttgaaaaccaaagtaaacatcttaccttagttcgtataccaaaatatatcccagatggattaaagaattacatttaaacagtaaagtcagaagagaccagaagaaaatacagatgaaaagccatataatttagatatttcagcaaaggcagaaatcagaaaagatggagatgcttgactacatagtaattaaaaacattactaacagtttaataataaaaggataaagaagtaggacattcgacttgcaatatatgataaagggttgatgcatttaaaatatgaaattttaacattttaataaaaaaagcatgctttaatagaaaaggtaaatggtatgagcaaggtattcacaaaaaggaaataattccaccattgaactataaaaaatattcaactgaatgagtaataaaagaaatacaaattgaagtttcactgagctaagtttttatctactaaactttcaaatattaaaaggggttaagtaagctgaaaaaaatgaaactatgttggaggattcacttttat

SEQ ID NO: 199991 - DNA, 601 bp, Human
aagcatgctttaatagaaaaggtaaatggtatgagcaaggtattcacaaaaaggaaataattccaccattgaactataaaaaatattcaactgaatgagtaataaaagaaatacaaattgaagtttcactgagctaagtttttatctactaaactttcaaatattaaaaggggttaagtaagctgaaaaaaatgaaactatgttggaggattcacttttatctgttttatttaatttcttttatataaataatacttcaggcaaatatgataaacttaataaatgtcaattctgagggggraagaataaaggagttaaataagtagaagttgtaatacccagtgttggctaggttgtggttaaatgaacactcaaactgcggataggtatttacattggcatggccctttctggagggtaataagacagacagtatctaacaagagctgtaaaaatgtgtaaacaaaaaaattcatacgccttgacctagagtaatctatatgtaaacatttagctctaaggatgttcattgtagcattatttataatgaggaaaacaggaaatgagctgaatgatgaaaattggtgactggtatagtaaa

SEQ ID NO: 199992 - DNA, 601 bp, Human
attcatacgccttgacctagagtaatctatatgtaaacatttagctctaaggatgttcattgtagcattatttataatgaggaaaacaggaaatgagctgaatgatgaaaattggtgactggtatagtaaattaaggccatccctagaaaatagtagtatatagtcattaaaatttattttgggggccgggtggtgcctcacgcctgttatcccagcactttgggaggctgaggtgggtgaattgcctgacatcaggagttcgagaccagcctggccaatatggtgaaaccccatctctaytaaaaatacaaaaattaaccgggcatggttgcacgcctgtagttccagctacttgggaggctgaggcaggagaatcacttgaacctgagaggtggaggttacagtgagctgagattgcgccactgcactgtagcctgggcaacagagtgagactctgtctcaaaaaaaaaaaaaaaatcattgtggggctgggcgtgatggctcacacctgttatcccagcactttgggaggctgagatggaaggattgcttgagcccagaaattcaagaccagcctgggaagcgtagggagaccctgtc

SEQ ID NO: 199993 - DNA, 601 bp, Human
cgtgatggctcacacctgttatcccagcactttgggaggctgagatggaaggattgcttgagcccagaaattcaagaccagcctgggaagcgtagggagaccctgtctctacaaaaaatttgaaaattacctggacatggttttgtgtgcctgtagtcccagctacttaggaggctgaggtgggaggattgcttgagcctggcaggttgaggctgcagtgagctatgatcctgccacgaacttcacaaagcaagaccctgtgtcaaaaagaaaaaaaaaaatcggctgggtgtggtggctmatgcctgtaatccccacactttgggaggctgaggtgggcggatcacaaggtcaggagatcgagaccatcctggctaacacggtgaaaccctgtccctactaaaaacaaaaaattagccgggcatagtggcacgcacctgtagtcctagctactcaagaggctgaggcaggagaatcgcttgaacctgggaggcggaggttgcagtgagcctagatcacgccactgcactccaacctgggtgacagagcaagactccatctcaaaaaaaaaaaaaaaaaaattgtggaaaatatttattaa

SEQ ID NO: 199994 - DNA, 601 bp, Human
tgtatatgtgtataataagtagataggaaaaagattgtctagacatacatcaacatagtaatagtgactttttttggatgattggatgagtcatggaagattttattttttttctccattctttctggtgttccagggttttggcattgaagtacttttgtacttagaggagttttataaaaaacaaaagttccctttgagggatactttgcatctggactgttatctcttacccacatcattcttgaggacgaagagaaaatacctgtgaggaagtatttacatttgttacggtggtgcwgggctgagtttgtgtggaccctggactcccagctgtccacacagttataaagagtaattaaaagctccctgaacaacaggtcccttatcagccttaaaccttattgttcagatacattggcttttattcatagtcttactaatcaactggggacaaaaaagacccattgaaccattagccctcagcccgagatgagaagcgcatgatggtacaatggccgtggttcagactcagatgttatgctatgttttgaattcagtccaggttcctaggaggaaaacacccatcaaattatgttgg

SEQ ID NO: 199995 - DNA, 601 bp, Human
agcttttgtacaagggtggagtgggtgtccatttgctgacgagcaccctgtgtacacgctagtttttatttgaacgaggtgctcttgtctttattatgtattgtctgcccataaatgatgtcttgaaatagaggggtgagcatcacctcatttatttcaacccatatttgtacagaaggatttttgtaatcaaatcatggggtttgtgtgtagaactcagtaagaagtaatcatgaccctgtccgttcatttgctctttgttctttcctgttattaacaatggctttggggcttttggggmgcatttagttctgcacgttgtgtatgtaagtagatgttcttctgtgggggctgcaagtccttaagttatagttggattcccttcccagcaaggaaccaacaggaaggaaaacgaagtcaaacccagtctttgcacgtggaagcttgtggcgtgactgttatttttttgtgatgttctgtacagccctgtaatctcttatttttggcaagccaactctgaatctgtggtcccgtagccccaggcaaccaaaagctgagacaaacagaggaagtgtcgttattcacatgtttctctggccac

SEQ ID NO: 199996 - DNA, 601 bp, Human
ggctcctggtatccctaagggttttggaagaagagtttcagtttttcaaagcctgctggagatgtaactgtcgtgatgtttcgtgggatctgcaagagcctgtagcgtcaggtttctttccttttgattgggatgacatgaagtctgttaatgcgggatcgtttgtgttatctgctctgataggtggttttacttgcatttgatttttgatagaatgagagatgaattgatttgttcctgatacattctgttgggatacagtccatttgataggaaggttgtttacatcacagtgtcctgyatttgggggctgccctgggatgtgaaaagtctgtttatgtctgttgacagagggtctctatgcttcttccttttctagcatttactcttatgttacaattagtgcctgcttgctgtgtgaacaggacagatttgtcttgtttgtttgggtcgtatgcagtttcatgcagaagacttagctagatgagtgactcaaagttccatgcctggggccctccaccctccttccctcaatcacgcctttatccagtcccttcccacgccctgttcctcattggaatcctctgtcctagcctatccc

SEQ ID NO: 199997 - DNA, 601 bp, Human
ttcgtgggatctgcaagagcctgtagcgtcaggtttctttccttttgattgggatgacatgaagtctgttaatgcgggatcgtttgtgttatctgctctgataggtggttttacttgcatttgatttttgatagaatgagagatgaattgatttgttcctgatacattctgttgggatacagtccatttgataggaaggttgtttacatcacagtgtcctgtatttgggggctgccctgggatgtgaaaagtctgtttatgtctgttgacagagggtctctatgcttcttccttttctagyatttactcttatgttacaattagtgcctgcttgctgtgtgaacaggacagatttgtcttgtttgtttgggtcgtatgcagtttcatgcagaagacttagctagatgagtgactcaaagttccatgcctggggccctccaccctccttccctcaatcacgcctttatccagtcccttcccacgccctgttcctcattggaatcctctgtcctagcctatcccccctgctctcccctggcatagaagggtgcatctcgtctccccacaacagcactggaaggtgctagaacacttggagaaa

SEQ ID NO: 199998 - DNA, 601 bp, Human
acacggtggtggtggggccaggagaagtcacttcttgggactttggaaagcctagaggaattccagaaatgaaacaccacacacttactggaagccaagttcgtgtttctcccactggtggaagggatatgaggtgctgtaaacgtggccttttttcagatgcagaatgcctgtctaattacaggaaacagagatgtcgccccacactgagccaaggatttcaacatctcttggagaaattctgcatggacctgaagtttgaagctttgcattgtaaccaagttggctctccttgccttcyccccaggccacgatttcgtcatcctgctttacggatggcatttcctattaagtgtctgtctgtgaacataaacatggagctgagacaaagcacagcttctccctggacccggaaagagggactcaggcgcctggggctggggcctggctccagacctgctgctgctgcctggcctggttcggggatgcctagcctaacaaggcagcctgggctgggaatcgcttaggcctcaggttgatgaagctgggagaagggttgagagggcaccagacctaagatggtggccagagccatttaatc

SEQ ID NO: 199999 - DNA, 601 bp, Human
tgaggtgctgtaaacgtggccttttttcagatgcagaatgcctgtctaattacaggaaacagagatgtcgccccacactgagccaaggatttcaacatctcttggagaaattctgcatggacctgaagtttgaagctttgcattgtaaccaagttggctctccttgccttccccccaggccacgatttcgtcatcctgctttacggatggcatttcctattaagtgtctgtctgtgaacataaacatggagctgagacaaagcacagcttctccctggacccggaaagagggactcaggcscctggggctggggcctggctccagacctgctgctgctgcctggcctggttcggggatgcctagcctaacaaggcagcctgggctgggaatcgcttaggcctcaggttgatgaagctgggagaagggttgagagggcaccagacctaagatggtggccagagccatttaatcatgtggttgtaaaattgtcagtaacttctttgtatggctagttgatctgatctctcatgtaggactcagtcccccagttggatcttggaaggtagacatttatttgaaacagacagcctggtagagtga

SEQ ID NO: 200000 - DNA, 601 bp, Human
cttctccctggacccggaaagagggactcaggcgcctggggctggggcctggctccagacctgctgctgctgcctggcctggttcggggatgcctagcctaacaaggcagcctgggctgggaatcgcttaggcctcaggttgatgaagctgggagaagggttgagagggcaccagacctaagatggtggccagagccatttaatcatgtggttgtaaaattgtcagtaacttctttgtatggctagttgatctgatctctcatgtaggactcagtcccccagttggatcttggaaggtagmcatttatttgaaacagacagcctggtagagtgaaaagagctttgtgttttaccccctcagatagtaagcaaagaaaatggaaaaagcagcgctgtctggggtgacatcctgatgcattgctggtgacagagtgaagaggtgacacatttggaacataatgtggccatctgtatgaagaaccatagttcatccagtcatcccaaccctaggactctccagagaaaaccgtttaaaatagggggaaagttatttgcatgaatatgttcataagaacattatgtataatagaggaaatttgga

SEQ ID NO: 200001 - DNA, 601 bp, Human
ggctagttgatctgatctctcatgtaggactcagtcccccagttggatcttggaaggtagacatttatttgaaacagacagcctggtagagtgaaaagagctttgtgttttaccccctcagatagtaagcaaagaaaatggaaaaagcagcgctgtctggggtgacatcctgatgcattgctggtgacagagtgaagaggtgacacatttggaacataatgtggccatctgtatgaagaaccatagttcatccagtcatcccaaccctaggactctccagagaaaaccgtttaaaataggrggaaagttatttgcatgaatatgttcataagaacattatgtataatagaggaaatttggaagaaacctataggttcttccacagggaaattgttaaggaaatgatggtagattctccgcaagaatggctcccattaaaaattgaattaggaagactctaagataatgtggtattaagaaaaaaactccatgattaaaaatgagcatgggccaggtgtggtggctcacgcctgtaatcccagcactttgggaggccgaggcgggtggatcacttgagctcattatctgatgccctgaattg

SEQ ID NO: 200002 - DNA, 601 bp, Human
aatagaggaaatttggaagaaacctataggttcttccacagggaaattgttaaggaaatgatggtagattctccgcaagaatggctcccattaaaaattgaattaggaagactctaagataatgtggtattaagaaaaaaactccatgattaaaaatgagcatgggccaggtgtggtggctcacgcctgtaatcccagcactttgggaggccgaggcgggtggatcacttgagctcattatctgatgccctgaattggctttttctcatgcacattaggttaaggtcagtagttactcacktaagttacccattgcatgtgtttccagtgacagaaaaggatttagggatggatcgttgaggtgactgctatgcatagaaatgcctagaaggaggcggtggtttaagctgtagaaggaggcaggtgccaagtgctcccagtttggggtttgagctcccacattctgtctgcacagcagcaggcaagtcccgtggcctccaggctctgcatctgtgatgtaagatcgtaaacctgtcctgcctaccttgtttgagcatcagatgagataaggtacgtgataacactttgtgaatcacttaaa

SEQ ID NO: 200003 - DNA, 601 bp, Human
ttgaattaggaagactctaagataatgtggtattaagaaaaaaactccatgattaaaaatgagcatgggccaggtgtggtggctcacgcctgtaatcccagcactttgggaggccgaggcgggtggatcacttgagctcattatctgatgccctgaattggctttttctcatgcacattaggttaaggtcagtagttactcacttaagttacccattgcatgtgtttccagtgacagaaaaggatttagggatggatcgttgaggtgactgctatgcatagaaatgcctagaaggaggcgktggtttaagctgtagaaggaggcaggtgccaagtgctcccagtttggggtttgagctcccacattctgtctgcacagcagcaggcaagtcccgtggcctccaggctctgcatctgtgatgtaagatcgtaaacctgtcctgcctaccttgtttgagcatcagatgagataaggtacgtgataacactttgtgaatcacttaaaaacactatgtctatgtgaggttgatattattgctattcaataaatgcaaacgtgtaggaaattataaaatgattcaactgttccattcctgtttttg

SEQ ID NO: 200004 - DNA, 601 bp, Human
aggatttagggatggatcgttgaggtgactgctatgcatagaaatgcctagaaggaggcggtggtttaagctgtagaaggaggcaggtgccaagtgctcccagtttggggtttgagctcccacattctgtctgcacagcagcaggcaagtcccgtggcctccaggctctgcatctgtgatgtaagatcgtaaacctgtcctgcctaccttgtttgagcatcagatgagataaggtacgtgataacactttgtgaatcacttaaaaacactatgtctatgtgaggttgatattattgctatycaataaatgcaaacgtgtaggaaattataaaatgattcaactgttccattcctgtttttgaaactttctgaagagaggtggatatgtttccctgaggtggggagctagggttgtgcctgtgttcatccaggaaaatgggatgaaaagcccaagatacatctgcgacatcatcttcagaatgtgaaattacagtgggtttggaatctgggccttctctctgcctgctccctgcctctccttccctacccacagtctccagctctgactcctggcctcccagggtcctctcccagcagcctg

SEQ ID NO: 200005 - DNA, 601 bp, Human
ggaggcaggtgccaagtgctcccagtttggggtttgagctcccacattctgtctgcacagcagcaggcaagtcccgtggcctccaggctctgcatctgtgatgtaagatcgtaaacctgtcctgcctaccttgtttgagcatcagatgagataaggtacgtgataacactttgtgaatcacttaaaaacactatgtctatgtgaggttgatattattgctattcaataaatgcaaacgtgtaggaaattataaaatgattcaactgttccattcctgtttttgaaactttctgaagagagrtggatatgtttccctgaggtggggagctagggttgtgcctgtgttcatccaggaaaatgggatgaaaagcccaagatacatctgcgacatcatcttcagaatgtgaaattacagtgggtttggaatctgggccttctctctgcctgctccctgcctctccttccctacccacagtctccagctctgactcctggcctcccagggtcctctcccagcagcctggaaggaagggacatcctcattccagggcccaggccatgaggaaggaagcagtgggcagggatgcaggctgcaggtgtg

SEQ ID NO: 200006 - DNA, 601 bp, Human
gcaagattgctgtctgggagctggacagacaggaagggaacagaactgggatgtggcagggacaggttccaggcactggcaggatgggggccagtgtgcagtgggccaagagggaatgggagcgagaaggtggggcgtcagcaacattcagctccctccatagctcgatgagaagagaggggtggggacaggcggtagctggagggtccttcaggatcattttatccgtatccctttcgtatcttttagtgagtttttgttttccctaactggattgttggcattttaagggcacagtttrtatcttctacctctttgtttcctccaaagttggccgatcaccagatcacttaaaggaggttgtttgttttataagcgttttaccagatcttggcttaacacttcccccagagttagtcataatcattctagcagggcttctagatgctgaacaatgaccgatggtgccacttgatttatatgaagatactggtttagttttaaaagcaaacttacattgaacaaagtgtaggaaagagaaaggagagggctactcaagtgcctgaaggtccgagcagtgaagaacatgtttccatatgcc

SEQ ID NO: 200007 - DNA, 601 bp, Human
gacaggaagggaacagaactgggatgtggcagggacaggttccaggcactggcaggatgggggccagtgtgcagtgggccaagagggaatgggagcgagaaggtggggcgtcagcaacattcagctccctccatagctcgatgagaagagaggggtggggacaggcggtagctggagggtccttcaggatcattttatccgtatccctttcgtatcttttagtgagtttttgttttccctaactggattgttggcattttaagggcacagtttgtatcttctacctctttgtttcctccamagttggccgatcaccagatcacttaaaggaggttgtttgttttataagcgttttaccagatcttggcttaacacttcccccagagttagtcataatcattctagcagggcttctagatgctgaacaatgaccgatggtgccacttgatttatatgaagatactggtttagttttaaaagcaaacttacattgaacaaagtgtaggaaagagaaaggagagggctactcaagtgcctgaaggtccgagcagtgaagaacatgtttccatatgcctgccacccttaggctaaggacacggtt

SEQ ID NO: 200008 - DNA, 601 bp, Human
ggattgttggcattttaagggcacagtttgtatcttctacctctttgtttcctccaaagttggccgatcaccagatcacttaaaggaggttgtttgttttataagcgttttaccagatcttggcttaacacttcccccagagttagtcataatcattctagcagggcttctagatgctgaacaatgaccgatggtgccacttgatttatatgaagatactggtttagttttaaaagcaaacttacattgaacaaagtgtaggaaagagaaaggagagggctactcaagtgcctgaaggtcygagcagtgaagaacatgtttccatatgcctgccacccttaggctaaggacacggttttcctatctgtttattgaattgggtcacttgctttagttataatatatgaagggataagactgaatttcacttctcaattaactagccctcttgctctcttttgatcacacgttctggggtcagattccagctctgccagtcagtggctgcactggccaaggccacgtggttgaccaccatccagagttctgccaagagccttacctgccagaggcacgggaggtgtggctgttgcgcagcttc

SEQ ID NO: 200009 - DNA, 601 bp, Human
ggacacggttttcctatctgtttattgaattgggtcacttgctttagttataatatatgaagggataagactgaatttcacttctcaattaactagccctcttgctctcttttgatcacacgttctggggtcagattccagctctgccagtcagtggctgcactggccaaggccacgtggttgaccaccatccagagttctgccaagagccttacctgccagaggcacgggaggtgtggctgttgcgcagcttctgtggcccaggccctctgcctggcacattttaagtaatgtgagcggrttacttaatcttactgtctgttcagctgaaaactagggccaaccctggctcagagctcagggggccgttgcgaggattaaatgagagaatccatggaagatgtttagagtcgtaccagacacataggaagtgctgaataaatcagaatggtttttactatgactctcacctttcaatgtttgtgacttaaacttatgttacagttagtcatttcactggcgtgtgctaaccaaaggtggcctggcccctccgcatccattaggagggcttgagtttaaaatccaggccctgtgagtctgc

SEQ ID NO: 200010 - DNA, 601 bp, Human
agctcttaggaaaatgcttctttagcattgcgggagaaacagtatatttgtacaaggcaagtagttcaccctgtaaggcggcacgtgctttggaggcacctaaatactacacagtgttttatgcatgggcgtttttcttacaaaggaacatagctttatcttcctgggggtgtttatcaaaccacatctatgtagcagatgctcttcaagcatttcccatattccctcgtttacaacaccctggaaccctgagttaattattagtcccatttcatggctgaggaatctgaagctctgagartttgaacttcttgtctaaagtcacatggtgaggaagtggtagaactgacctggaccccaggtatctggctctggtctttccaatagtgcctcttcagtgggtatcccttaaattctcaggggcaggtgctttctcctccttttatgccctttttttcagagcaaaaccacgttatcctaactgccaagcacaacccacaaaggctcttatctctccttcaaaaaaagccattccctgcctggttgatgaggtcacctggcattttgcagggcattttgcagggtagatgccagctcggga

SEQ ID NO: 200011 - DNA, 601 bp, Human
agcaggggaaggtgtgtgcactgacaacaggagttttagcatctgcccctccttgcttcaaggggctggcgggtacccgaggcggggtcggagggctgagtgatggctcccatcctccctcttccctcctgctccacgggtgtaaccttgaggtgggattggagggcttggtgacctctctcctccctcatgctccatgggtataaccccaaggtgggatcacaggctgagtgaaggctcctcatcctccctcctccctcctattccacgtgtgtaatcccaagatgggatcagagggcakggtggagggttacacatcctctcccctccctcctgctccacgtgcgtaacccccagctgacttacagactgtggtacctgctcaactgcttcaattccagaactggaactgcagggaagctgtttctgacatccctggttttaattacaaagggccccttgagaccttgtcagaaatactgccagcctagccctttaaaaactcatgatattgggttctctatcagtgtcgctccctggctgtaatattgtactataattaggcaagatgtttcctttgggggaaacggggtgaagggta

SEQ ID NO: 200012 - DNA, 601 bp, Human
ctgcccctccttgcttcaaggggctggcgggtacccgaggcggggtcggagggctgagtgatggctcccatcctccctcttccctcctgctccacgggtgtaaccttgaggtgggattggagggcttggtgacctctctcctccctcatgctccatgggtataaccccaaggtgggatcacaggctgagtgaaggctcctcatcctccctcctccctcctattccacgtgtgtaatcccaagatgggatcagagggcagggtggagggttacacatcctctcccctccctcctgctccacrtgcgtaacccccagctgacttacagactgtggtacctgctcaactgcttcaattccagaactggaactgcagggaagctgtttctgacatccctggttttaattacaaagggccccttgagaccttgtcagaaatactgccagcctagccctttaaaaactcatgatattgggttctctatcagtgtcgctccctggctgtaatattgtactataattaggcaagatgtttcctttgggggaaacggggtgaagggtatgaaggttctctctgtgtcatttcttaaaactccatgtgagt

SEQ ID NO: 200013 - DNA, 601 bp, Human
ctgagatcgcgccactgcactccagcctgggcaacaagagtgaaacgccatctcaaaagaaaaaaaagaaaagaaaaaagaaatggaggttccaaaaggctaaaccacagtaagggagtactgcagcaaaaactagaatttgggggctccttgacccccaagcctattctcttttcactgctggtatagtcgggttgccaaggctgccctcttggaggggccgatagctcagggaggtcaccagaggaaaggcctgtgagctctgtgcaagtcattttcaggcttgtgtcctcagtggggrctctactccctccggaagtgagtatgacattctgccctattcccttggagcagctcttcccaggagagcttcagtggaaagaaaactgtgggaaaacatttggaggcatttcatggacacgtttctgagtgttatgagctcttgaaggaagcatgtttatttccccaaagtgctcagctgtgtccgggtcctgagtttttcaagggtttataacccccggagctgaatttggatatgcaaggaagccatgggattgcagccagggaacatgctattttttgtaagtgatgatgctgttgt

SEQ ID NO: 200014 - DNA, 601 bp, Human
aagagaaagagtttgaattggactctaaggatggtagacagctactaaaggatttaataaggggaatggcagtgtttgatgaaaggtttaagatccttctagctgcttctgaagggtgatttgtagaaggacaagagatgaagccaggggagtgggtagggagattctgcccaaactgattgctacacagtgatatttttatgcttttcttttttttctttctttctttctttcctttccttccttccttccttccttccttccttccttccttccttccttccttccttccttccttccytccctctctctctctttctttctttctttctttcttttatttttgttttgggtgttgatgaggggacatacaacttaagaagaaaaattggaattattttgtcaacttttctacatcagcattttactgatggaataagcttgcatttgaactggacatcatttttgtttttattagataacattatctgtattacagataccagatatgtgtgtacccatttatttactaatcactaatacttacaaaaaagtaaattttgtcaaaagaaaattcagcttagatggccatattgtatgt

SEQ ID NO: 200015 - DNA, 601 bp, Human
atgaggggacatacaacttaagaagaaaaattggaattattttgtcaacttttctacatcagcattttactgatggaataagcttgcatttgaactggacatcatttttgtttttattagataacattatctgtattacagataccagatatgtgtgtacccatttatttactaatcactaatacttacaaaaaagtaaattttgtcaaaagaaaattcagcttagatggccatattgtatgtgtgtgtgtgtgtgtgtgtgtatatgtgtgtgtgtgtgtgtgtgtgtgtatatatataatttttttttcttgagacaaggccttgctctgttgccctggctggagtgcagcggcacaatcttggctcactgcaacttctgcctcccgggctcaagcaattctcctgcctcagcctcccaagtagctgggactacaggcatgtgtcaccatggccagctaatttttgtatttttagtagatacagggtttcaccatgttggccaggctggtctcaaactcttgattcatgtgatctgtctgccttggcctcccaaagtgcaacggctatatttctgacatatacaaatccaagcccagtt

SEQ ID NO: 200016 - DNA, 601 bp, Human
ctggctggagtgcagcggcacaatcttggctcactgcaacttctgcctcccgggctcaagcaattctcctgcctcagcctcccaagtagctgggactacaggcatgtgtcaccatggccagctaatttttgtatttttagtagatacagggtttcaccatgttggccaggctggtctcaaactcttgattcatgtgatctgtctgccttggcctcccaaagtgcaacggctatatttctgacatatacaaatccaagcccagttgatcagaatttagcagtatctgcaagatttgaaccayttcagaaatctgagctctctagcattacatggactgatgttttcttagctcagaactgcttacctgtgtgtagaaaatctaatatttaggaagaataattcattgctttaagtgttcagtcctggtttttatttctattgttgcacaagtttgatttgaccttggacaaatcatttcagtttgtattttagtgcttgtgtgcagaagatgggtagtaatagtcctggtaatcctcctgccatcatgttaactgggtgagagctcttcaagacctaggagagataatagcaggtgcaaagt

SEQ ID NO: 200017 - DNA, 601 bp, Human
aagggagaggtggtccagggtcatgttatagaggtaggccagggccacactggttggggttttgcaaaccttactggggacttgaatctttatctgaagagcagggggaagtcattggaggatttaaatcagggaatgacataagattgatggatatgctatctcctttaatcctcataacaaatgtatgtgctaggtaatatccccgttttaaagcagcacagaaattagggcagtggagattaaggagtttaccccaggacaccatgcaggtgaatgatggagccaggaaaccaactcrggtcagcttgcatccaaagtcctcagtcttccagatcagcgtacctccatagtaatataacaatgactgcagttttaaaacactttgaactcttaagatgaaagatttcccttaaattacaaagtggtattatgctgcagaaatgtgagcggtaatgagagagcaggtaatgcccgggaacttttgaaaggcccggtccgtgtggctctgctccagcaccttcaagttccctgccgtctggcggggggcgtctcataagctgctttcaacacaaagaagggtttggctgctccccggcca

SEQ ID NO: 200018 - DNA, 601 bp, Human; identical to SEQ ID NO: 22042

SEQ ID NO: 200019 - DNA, 601 bp, Human; identical to SEQ ID NO: 22043

SEQ ID NO: 200020 - DNA, 601 bp, Human; identical to SEQ ID NO: 22044

SEQ ID NO: 200021 - DNA, 601 bp, Human; identical to SEQ ID NO: 22045

SEQ ID NO: 200022 - DNA, 601 bp, Human; identical to SEQ ID NO: 22046

SEQ ID NO: 200023 - DNA, 601 bp, Human; identical to SEQ ID NO: 22047

SEQ ID NO: 200024 - DNA, 601 bp, Human; identical to SEQ ID NO: 22048

SEQ ID NO: 200025 - DNA, 601 bp, Human; identical to SEQ ID NO: 22049

SEQ ID NO: 200026 - DNA, 601 bp, Human; identical to SEQ ID NO: 22050

SEQ ID NO: 200027 - DNA, 601 bp, Human; identical to SEQ ID NO: 22051

SEQ ID NO: 200028 - DNA, 601 bp, Human; identical to SEQ ID NO: 22052

SEQ ID NO: 200029 - DNA, 601 bp, Human; identical to SEQ ID NO: 22053

SEQ ID NO: 200030 - DNA, 601 bp, Human; identical to SEQ ID NO: 22054

SEQ ID NO: 200031 - DNA, 601 bp, Human; identical to SEQ ID NO: 22055

SEQ ID NO: 200032 - DNA, 601 bp, Human; identical to SEQ ID NO: 22056

SEQ ID NO: 200033 - DNA, 601 bp, Human; identical to SEQ ID NO: 22057

SEQ ID NO: 200034 - DNA, 601 bp, Human; identical to SEQ ID NO: 22058

SEQ ID NO: 200035 - DNA, 601 bp, Human; identical to SEQ ID NO: 22059

SEQ ID NO: 200036 - DNA, 601 bp, Human; identical to SEQ ID NO: 22060

SEQ ID NO: 200037 - DNA, 601 bp, Human; identical to SEQ ID NO: 22061

SEQ ID NO: 200038 - DNA, 601 bp, Human; identical to SEQ ID NO: 22062

SEQ ID NO: 200039 - DNA, 601 bp, Human; identical to SEQ ID NO: 22063

SEQ ID NO: 200040 - DNA, 601 bp, Human; identical to SEQ ID NO: 22064

SEQ ID NO: 200041 - DNA, 601 bp, Human; identical to SEQ ID NO: 22065

SEQ ID NO: 200042 - DNA, 601 bp, Human; identical to SEQ ID NO: 22066

SEQ ID NO: 200043 - DNA, 601 bp, Human; identical to SEQ ID NO: 22067

SEQ ID NO: 200044 - DNA, 601 bp, Human; identical to SEQ ID NO: 22068

SEQ ID NO: 200045 - DNA, 601 bp, Human; identical to SEQ ID NO: 22069

SEQ ID NO: 200046 - DNA, 601 bp, Human; identical to SEQ ID NO: 22070

SEQ ID NO: 200047 - DNA, 601 bp, Human; identical to SEQ ID NO: 22071

SEQ ID NO: 200048 - DNA, 601 bp, Human; identical to SEQ ID NO: 22072

SEQ ID NO: 200049 - DNA, 601 bp, Human; identical to SEQ ID NO: 22073

SEQ ID NO: 200050 - DNA, 601 bp, Human; identical to SEQ ID NO: 22074

SEQ ID NO: 200051 - DNA, 601 bp, Human; identical to SEQ ID NO: 22075

SEQ ID NO: 200052 - DNA, 601 bp, Human; identical to SEQ ID NO: 22076

SEQ ID NO: 200053 - DNA, 601 bp, Human; identical to SEQ ID NO: 22077

SEQ ID NO: 200054 - DNA, 601 bp, Human; identical to SEQ ID NO: 22078

SEQ ID NO: 200055 - DNA, 601 bp, Human; identical to SEQ ID NO: 22079

SEQ ID NO: 200056 - DNA, 601 bp, Human; identical to SEQ ID NO: 22080

SEQ ID NO: 200057 - DNA, 601 bp, Human; identical to SEQ ID NO: 22081

SEQ ID NO: 200058 - DNA, 601 bp, Human; identical to SEQ ID NO: 22082

SEQ ID NO: 200059 - DNA, 601 bp, Human; identical to SEQ ID NO: 22083

SEQ ID NO: 200060 - DNA, 601 bp, Human; identical to SEQ ID NO: 22084

SEQ ID NO: 200061 - DNA, 601 bp, Human; identical to SEQ ID NO: 22085

SEQ ID NO: 200062 - DNA, 601 bp, Human; identical to SEQ ID NO: 22086

SEQ ID NO: 200063 - DNA, 601 bp, Human; identical to SEQ ID NO: 22087

SEQ ID NO: 200064 - DNA, 601 bp, Human
actctcttatttgcttgtgtcagtgtcatccttaattgtctgttttagagtgtggtgaatcctatggcaagccaactggtgtagattatacttgtcatattttgcagagctctctcacgttccttttctattggatcctcatctgtttcttagatgagaaaccagaaacaaaagagactgactgatggtcatgcacatagtgtaaatcaaggttttctgatgaagtcagtggtgtttgacttgttcagagaagtaagtcctgacttcaagggaggagttgtgtattactcatgttgtaackacattacctgttgaatagtaaacactccagtattggatcattagttctgtgcagttgtgtaatactcaccaagttatgaaagtgctgtatacttggaaaatgttctttggttgaattccatttattcccttaggaaagttcccctaaatgctgagcactgagggtacttggtgtctggaacataaactctgcccacaaggagctcatagtttgcttgttaaacattacgcagaaagatcacatggcttttatttaatcagaagaaattgatagttcaaagtgaacatcatttacctacct

SEQ ID NO: 200065 - DNA, 601 bp, Human
atcagaagaaattgatagttcaaagtgaacatcatttacctacctgaaccaaataacttgtgatatacattaagtcctcccttaatgtataggttctgtcaataatgtaatgtcaataggttctgtgactttaagcaaagaaagcaacttataacaaaaccattttttatccataccataacaaaagatgctgagcagaaaacaaagtcaaagttttcaagaacctattgacgtgaagttaggagataaatcagttatagttcccctttgctgatacttagtagctgcatttttctactgrttggttaaataattttctttagaggttgttaaatattttaacgtaagcatattcttagcatcgtaaaatgctgatacttggtatatacattttagtaagataacatatcttagtaaaaatatgactagttctaataggtattgctgtacaaatgtattaagtataaaaataatccagttttcaaatgacactgctttaatttggatatttctgcatactagagtttgcatattatagtcttgcttatttgactaaggggagatttgcttttctgaagtaaaataaggttattaacacatt

SEQ ID NO: 200066 - DNA, 601 bp, Human
caataatgtaatgtcaataggttctgtgactttaagcaaagaaagcaacttataacaaaaccattttttatccataccataacaaaagatgctgagcagaaaacaaagtcaaagttttcaagaacctattgacgtgaagttaggagataaatcagttatagttcccctttgctgatacttagtagctgcatttttctactgattggttaaataattttctttagaggttgttaaatattttaacgtaagcatattcttagcatcgtaaaatgctgatacttggtatatacattttagtaarataacatatcttagtaaaaatatgactagttctaataggtattgctgtacaaatgtattaagtataaaaataatccagttttcaaatgacactgctttaatttggatatttctgcatactagagtttgcatattatagtcttgcttatttgactaaggggagatttgcttttctgaagtaaaataaggttattaacacattccccacccccctacctttagactgatctcttcaacaggttacatgtagctcaacttttacttgcctgttttctgttaatgatacattttgattgtctcc

SEQ ID NO: 200067 - DNA, 601 bp, Human
aatattttaacgtaagcatattcttagcatcgtaaaatgctgatacttggtatatacattttagtaagataacatatcttagtaaaaatatgactagttctaataggtattgctgtacaaatgtattaagtataaaaataatccagttttcaaatgacactgctttaatttggatatttctgcatactagagtttgcatattatagtcttgcttatttgactaaggggagatttgcttttctgaagtaaaataaggttattaacacattccccacccccctacctttagactgatctcttmaacaggttacatgtagctcaacttttacttgcctgttttctgttaatgatacattttgattgtctccatattgcctgcctttctcccgtctacatgcagtcagctgccagggcataccatttttactctgtaatgccttaatcttctttgcatacctgctttcacctctattcaggtttgcactctccctcatccagattgcagtaagttcctaaattattccctgcttcttcgtcctgttttgcttcaaagttaatcttaaatgcagtcccagttttgtcattttcctcataagtctac

SEQ ID NO: 200068 - DNA, 601 bp, Human
atcttgctcagtcatttatcatttctgtggtcatctctttgtgcctagctcccctctataaaatgaggataacaataaaacctgtcttacagtgttgttttgatgattaaatgagtttatacacataaaacagaacagtacccagcagaaaagagccttatgaggatttagatattattacttgaaccttcatattattgttactttgaaggaagagtctttggagtatgagtatattgaggatttgtctttaaagcctactaaaaatttctcaaagtgaaggaaatagcatatatgtgtkttatacatactctttgattccactagtaaattacaaaatacattcaaaattaagctataggtttagaggcacatatgcagctggtaaaactatgaagaaaagctatgaagtaaaaggaaaaaaacatactgtaaaaagtactataaaagtcagtatagtggctacccttaagctgttggaaaggagttgtgatcgggaagggctggggaggcccttgtgggctatcttgactgggatggtggttgtacagatgtttgtaaagagtaacctggacatttttgtttcaatttttggttttct

SEQ ID NO: 200069 - DNA, 601 bp, Human
aaggtaagttagtagaaaaagtagaaccctgttgttttgtggatttaaaaatagtggcacattagctgtattccgaaacctaatgacctatggtaaaggtcttatttaatatccttaccttgtatgacatgtgacacttctttttcttaacactagcattactactgaagtctagtagacctcactcagtacagtcacttaaagtagtagtgtaagtttacccattaaataccatgaatgatagtatctgtttagcatcaaatagttttcttgctttgttttaaaatactaagttttttcwcattcatttgacaaaaaattatgagagagaatggccattgaaaacatattgctgacattttgtcatgttattaaaataaaacaaaaattagccttaggtgtttcttagtactctgtaatagtgaacaaaatattaaaatcaagttcttgaaaattgtggaataagcagaatgatgagaggttgaagcaaaaatgtattaaatcagtgaagaggttacagtatgttacgtatttgcatataagtgtttgcctagtttatcttaaagttgattgtaggaagaaaggtacgtttcttaatgct

SEQ ID NO: 200070 - DNA, 601 bp, Human
acccattaaataccatgaatgatagtatctgtttagcatcaaatagttttcttgctttgttttaaaatactaagttttttcacattcatttgacaaaaaattatgagagagaatggccattgaaaacatattgctgacattttgtcatgttattaaaataaaacaaaaattagccttaggtgtttcttagtactctgtaatagtgaacaaaatattaaaatcaagttcttgaaaattgtggaataagcagaatgatgagaggttgaagcaaaaatgtattaaatcagtgaagaggttacartatgttacgtatttgcatataagtgtttgcctagtttatcttaaagttgattgtaggaagaaaggtacgtttcttaatgctgttaaataggaaaactgaaggattggaaatagctaaaaaattttagttaatatcctcaactgtaatctcgttgccctttaaggtgatgatggaatttgtaattaagtaatcaagtatccataaggtgcttcctcagcagacagaaagaaaagtaaaagctggcggggcgcggtggctcacgcctgtaatcccagcactttgggagacggaggcaggcag

SEQ ID NO: 200071 - DNA, 601 bp, Human
gaatgatgagaggttgaagcaaaaatgtattaaatcagtgaagaggttacagtatgttacgtatttgcatataagtgtttgcctagtttatcttaaagttgattgtaggaagaaaggtacgtttcttaatgctgttaaataggaaaactgaaggattggaaatagctaaaaaattttagttaatatcctcaactgtaatctcgttgccctttaaggtgatgatggaatttgtaattaagtaatcaagtatccataaggtgcttcctcagcagacagaaagaaaagtaaaagctggcggggcgcggtggctcacgcctgtaatcccagcactttgggagacggaggcaggcagatcacgaggtcaggagtttgagaccagcctggccaatatggtgaaacactgtctctactaaaaatacaaaaattagccgggtgtggtggtgcgcgcctgttgtcccagctactcaggctgaggcagaagaattgcttgaacctgggaggtggaggttgcagtgagccgagatcgtgccactgcactccagcctgggcaacagagcaagactccatctcaaaaaagaaaagaaaagaaaaagcctaggtg

SEQ ID NO: 200072 - DNA, 601 bp, Human
caggctcaagcgatcctcctgccccagcctcctgagtagctgggactacaggcacaggccaccacgcccggctagtttttaaaaatttttttttgtagagacagatctcaccatgttgcccaggctggtctgctgatggcgttcgttagctgagatgtgctatatatagatgggttataagggctttgtgaaccctctgatgatgtgtgtgaaattgtgtgtgattgtacatatgtgcatttctctggtcggagtccgtagctgccatcaaaattgatatcatttagtccagtggttctcyaaatgtcgtctggcaacccctgaactcattccaaatgtctgtgaagtaaaaactattttcacagtagtactcaggtgatacttgcctttttcaatacattgactttgcagcagtgctgcagaagccatcttagcatgagatcaagacagtagcacaaaagagtacctgtagaggtaatcttcattaccatgtactagcagtttaaaaaaccatcagttttaagaatgtccttgaagcagtgaaaacttaatttgattaaatttctacttgaacacatgtctattaaacgttctgcatgac

SEQ ID NO: 200073 - DNA, 601 bp, Human
caaaattgatatcatttagtccagtggttctctaaatgtcgtctggcaacccctgaactcattccaaatgtctgtgaagtaaaaactattttcacagtagtactcaggtgatacttgcctttttcaatacattgactttgcagcagtgctgcagaagccatcttagcatgagatcaagacagtagcacaaaagagtacctgtagaggtaatcttcattaccatgtactagcagtttaaaaaaccatcagttttaagaatgtccttgaagcagtgaaaacttaatttgattaaatttctacytgaacacatgtctattaaacgttctgcatgacagaatggaaggtatacctagagaaagaacttctgcaagggggtaaagtggttgtctggaggaacagcattggtgcagctgttttgagtttcaactgcagttttcatggaacatcacttttatttgaagtaactgatgaactatagttattcagacttggatatttggtggacattttctcaaaagaacagtgaaactgatacttcagtgtacagtgtttgttgcccatgatgaaatttgagctttcaagcaaaaattagaattttgga

SEQ ID NO: 200074 - DNA, 601 bp, Human
aaatttgagctttcaagcaaaaattagaattttggaaaacacgtctctgccattgtgagcttgacagcctcccaatacttaaaatattttttcaaataaaatcagtagtcatattaacgaatgtgattttttgatactatgtaatgtgttaacatttggaagatctgtataactcagtaaatcagtcttttacgggtgaccgatgcatgtgatgttaaacagtcatacatcagtaaaagtgcgtgctagagcattgaattttaatgtgacagactaccgatatgttttgagattccacaagccttcaagaatccaccactgtggaattttggtgtagtatcaaaggtatatccataactacctgaaacacctattaaaatattcctccctttctaactacatatctgagtgaggctggattttcttcatatatttaactgacagaatatattgtggtgcagtacattgaatacagaagcaattaagagaatcttcattctgttaggccagattaaattaaagagatttgcagcagtgtaaagcaatgtcattaattttgttggtggggagggggatgtagtcatttttcataacatttttg

SEQ ID NO: 200075 - DNA, 601 bp, Human
ttctagaatcttcgaatgatctctctttttccagttcacagggtctgtggaccggtgatctggtttaagaacttctgctctaatcttgagttatgcctgtgtttacacacttactgaaacttctgtgctggattctaaatttggaagaatcaaggatatttgtgtggtaataatggtgtttagactatttaggagggtattttttcttaccggtcctcttattactttttcctgagataatatgggagggattaatcatctgtaaaataccagacttgacagatttagtgtgttcccatcttttttttttttcctttattaaaaactgtctctcatgggtaaaaacattagaaggatatattggattttgaaccagttgcttattttatactttaatcagaaggaaatttaagtttttcagtagcttgtattaagagagaaatcagagtaggtaaaagggattgggggcaaaattttaaaaattttctaaagatccagaagaacatggttagatctggagcagtgttacttttcaaacctgccattgcaggctcattgtaggtctgtctgctctgtatgaaagtagaaatagtaccttttt

SEQ ID NO: 200076 - DNA, 601 bp, Human
tgctctgtatgaaagtagaaatagtacctttttggtgttaccctgcgtgtctgttttttcctgcttaccacaaggtaagattcttaagggtggatgactttctaagggaacaaaagaggaatctttccttttggctaatagagtgggaaggctctaattcaagagaaacaggctattgtaggcaataaatagttctgaccaaatttcttatcaaggcatgcaacatgcaaaaatgtttgttaaaggaattggtagtagcaaaggcattgcttgttctgtctttcttctccttgacataaartgagcattatttttttttctagcaacagaaccaatttttaatgaaaatttttagctacctaatgtttttatgcatattatagaaaacatataacattaaatttaccatcttaaccattttcaaatacactgttcagtagtgttaactctattcatattgtgaaacagatcctcagaactttttcgtcttgcaaaactgaaactctatacccgttaaataactcccttcttcccctcccctcagctcttggcagctaccattctactttctgtttctgtaaatttgactgctttagattcc

SEQ ID NO: 200077 - DNA, 601 bp, Human
agggaacaaaagaggaatctttccttttggctaatagagtgggaaggctctaattcaagagaaacaggctattgtaggcaataaatagttctgaccaaatttcttatcaaggcatgcaacatgcaaaaatgtttgttaaaggaattggtagtagcaaaggcattgcttgttctgtctttcttctccttgacataaaatgagcattatttttttttctagcaacagaaccaatttttaatgaaaatttttagctacctaatgtttttatgcatattatagaaaacatataacattaaatttrccatcttaaccattttcaaatacactgttcagtagtgttaactctattcatattgtgaaacagatcctcagaactttttcgtcttgcaaaactgaaactctatacccgttaaataactcccttcttcccctcccctcagctcttggcagctaccattctactttctgtttctgtaaatttgactgctttagattcctcctccaagtggaatcatacagtctttttgtgactggcttatttcataatgtcttcagggttcatccctgttgtagtatgtgacaggatttccttcctttttaa

SEQ ID NO: 200078 - DNA, 601 bp, Human
aaaaatcccatattgcaggtctaagaccataaatttgtcttttactgctttcaaatggtcgtgagttggaattttccaattagtatttttagagacttctctaggtgaatgtttatggtagcctacaagctaccatacaaaattacaaaaattagctgggcatggtggcacgtgcctgtaatcccagccactcaggaggctgagacaggagaatcgcttgaacccaggagttagaggttgcagtgagccgagatcgtgtcactgccttccagcctgggtgacagagcaagactccatctcaaaaaaaaaaatgagtttctagactggacgtggtgactcacatctgtaatcccagcactttgggaggccaaggtgggtggattgcttgaggtcaggtgttcgagaccagcctggccaacatggtgaaacaccgtctctactaaaagtacaaaaattagctgggcttggtggcgcttgcctgtaatcccagctgctcagaaggctgaggcacgagaaatacttgaacccaggaggcaaatgttgcagtgagcaaagatcgcgccactgtactgcagcctgggtgacagagcgagactctgtc

SEQ ID NO: 200079 - DNA, 601 bp, Human
cttcgtcctctcaccagagatgccatcacaggtttcttatatatcattccagaagtattttattttgtatttgcaatgtttttaacagcgcatctttatcattttggacttgaaagtaggaaaatgtattctaggaatccatgaattattaagcaaggtctataggccctgccttaaagaggatctgatgagttgcctgagaaattagcattttcttttaaccagtagattaaaaccatacagatttctatatggagagttgctgagaaggttgtacacatttggaatttacatctagatrtgtaattagtggactctaaacaaagctaagtaaaatctataatatctaagatatacaagtctttaaaaataacagtttgggttcacagatactggagtcttcggattgtagaccttaagtcttctttctccacttgaatctgattgttcctggcagtgtgtaaagtgatcggttcattttggtgatttatttaattaagactgtactacacattatagaataggctagatcctaaagacataatgtgtgttcttaagtgttcagtaaacacgtaggcctttttggtcacttgtccaccat

SEQ ID NO: 200080 - DNA, 601 bp, Human
actattaatttgactaatttaaaattattgtgctgagccgggcacggtggtgcaagcatgtaatcccagttaattgggaggctgaggtgagaggagcacttgaagccacgagttcaaagctgttgtgcacagtgatcatgcctgtgaacaaccactgcactccagtctgggcaacgtagcatgaccctgtctctgaaacaatgaacgaaaaataatgtgtgacaacagaaattcaagcttctttttttctctcttgttttcccttttttctccagttcctccagtgttttattcttccctrtaattatatattctgcatcttccctcaagagtaatataattgggtggggtggggtgcacctagaacatgcaggagggtccaaagcacccttcactattggtgtcagtttctcatagcagggagggatggagtttgggaacatctgaagggatggtgtcaggcacacggaggctctaaaacaccctgctattggctccccttgctacctagggcaacgttgtaaatagcatattttttacattataaatattttctctttctcctcgttcttctactcacttgtttgtatgatgatctgaa

SEQ ID NO: 200081 - DNA, 601 bp, Human
aagtagctaggactacagatgcgcgccaccatgcctggctaattttttgtatttttagtagagacatggtttcactatgttggccaggctgatctcaaacccctgacctcaggtggtttgcctgccttggcctcccaaagtgctgggattacagggatgagccaccgtgcctggcctattttcatatttctaaactacatgctcatacagctgtttttaaaagcaatccacagatggaaatggtagctaagaactgaggtccgctaggctcttcctactgctcctcccagctttcttggtrttgttacactgtgttgattgtttaagccagtgttcacagttgtagtagactggataatggtccccgaaagaaatctgcgtcctaatctctggaacctgtgactgttaccttatatggcaaaaggacttgcagatgtgagtaaatcaaggatttttgagatagggagatcatcctaggttatcctggtaggctgtaaatatgtaagcacaaggatgctataaaagggaggcaagaaaatcaaaggaggaagcaagagataggagtgattgcaaggaaagggtcacaagccaagaaatgcag

SEQ ID NO: 200082 - DNA, 601 bp, Human
tcccttcccccccccccccccaactattttccatttcctttttgctttacattctgggggagttcctcagttttgttctcaactctttcatttatttttaccattgcatttttaagagctcttttgctctttggaaataatgttggtggtggtagttttaagcagccccggttttataaatggagtatcttgtctttgagaagattaatagttttttgggtttcttttcattttctaatctgagcatctatttcctttgagtttcttttttcttattcatattggtagactggtatctggkaatccttggttgtctgttagttcttaagaatgaggtagtaagagtaaattaggagctttgtgtccactggcagagatattcggctggtgggcttcactgtagggtgatgagccagggacccgcagtcagtatctctagatgagaaggaacttctagtgtcttatctcagtgggaggtgggtaagtgggatgggtcacatcttaagcctggctgctgacattctgggagccaggaagatcaccgagcaactcatggattactatgcagcctttcatttaatcttgtttttaatttgacgcc

SEQ ID NO: 200083 - DNA, 601 bp, Human
ctgatattgtgtacttctttttttgaggtggagtctcactgttgttgcccaggctggagtacaacggtgcgacctcggctcactgcagcctccgcctcctgggttaaagcagttctcctgcctcagcctcccgagtagctgggactacagacacctgccaccacgcccggctaatttcttttgtatttctagtagagatggggtttcaccatgttggccaaggtgttctcgaacttgtgagctcaggtgatccacctgcctcagcctcccaaagcgctggaattataggcctgaaccaccrtgcccagcttgtgtactgtttttaatggccttttctttcttcaattaatagcaaaaaaatgatacaaattaaaatagcttttgtctaagatactaacctgcatttttagacctaaatttcaggcatgaagcagtcagccaaaagccgtgaggttttaaagaacttaatatatcagagaaaacttcagctttcttagataaaaatcagtttatatttttttactcctgaaataatttaaattaacacatatatttgtcttagaatgaagacatttgtcaaagaccttttgggctgctgtta

SEQ ID NO: 200084 - DNA, 601 bp, Human
ctatacttattcactaggaaatcacatttaagtgtcatgtgactttaaatgttttctctgagctgatgataccctaattatatctccttttccctaatctgctgtcagatcaatctagctgactatgtagaaaacacacacacagtttcttgcacaacacttctgataacatatattcatctgtaagtttttctctgtacatcaagcaagcaatcagttttgcagcagacaccagctgggtgtccccccattcagttccaacactgtctacctggaaatagcatcatattccccaggttgmgggggctcggtcccacaagactgcccccactttttccaatgccagttggaagccccaggttgtttacctgtgcctctgaccaagtggccatacatagaggttaccaagacctccttcttgggttcgattaatttgctagagtggctcacagaactcagggcaaacatttaccactttattatgaagggcattttaaaggatacaaatgaacagctacatgaagagatatgtaggacaaggtctggaagggtcctgaatgcaggagcttctatccccgtggagttggagtgcgccacctac

SEQ ID NO: 200085 - DNA, 601 bp, Human
gacaccagctgggtgtccccccattcagttccaacactgtctacctggaaatagcatcatattccccaggttgagggggctcggtcccacaagactgcccccactttttccaatgccagttggaagccccaggttgtttacctgtgcctctgaccaagtggccatacatagaggttaccaagacctccttcttgggttcgattaatttgctagagtggctcacagaactcagggcaaacatttaccactttattatgaagggcattttaaaggatacaaatgaacagctacatgaagagakatgtaggacaaggtctggaagggtcctgaatgcaggagcttctatccccgtggagttggagtgcgccacctacgcagctcctggatgtgttctagtttaccttcctggaagccctccaaactccgtggaggcttcattatgattaagtcattggccgtttgtgatctgctcagtcttcagccccactcccttccacttctctgtggctaccacctgagttctgactcctctactctcttaggctactgcagtaacataggaaccatttcttccttcctccagttttcattgttttcacac

SEQ ID NO: 200086 - DNA, 601 bp, Human
ttgttaggtaaatgttaaatgttgctgtctaatgataaccatattttactattactggctcaggtcactatcattgctaaactgggatttctgtggagtaactccaggttggtctccagttttccctttgcttaggttcctcccagttctcagtctccttcacttcagtttgagcaatctaaggtgcatgtctgactggattgcttttacttaaaattcccaagtggacttctttttgtcattggaataaagtctgtaaaatgttttgtaacataccttaaagactccgccattttctctraatattttgcctctttgttttcagtttgtgggtgaactagaacaattctggcaggaaacaaactgtattgggtgtgactctaccaagaaagatggatagtgaagtgctttctgattcttatagcatagccatagtaatcctaatttgtaaagattttagggagatattaatagccagatacccattctaattataaaaataccttaattaggcatacatagatgcaagagtttcatactgtactacttgtttgtataatctccttgagaagctatttacattatacttaataaggccact

SEQ ID NO: 200087 - DNA, 601 bp, Human
ctacaaactgttttacttaccaagggttttttcaggggatagaggccacgacttttagtactaaagtttactgtgtaaatcaagggaatgttatactttgaaatgttgggattttttttacaaagaattcttcacagttttgcaaaatcacatcactactgcaatgctgctaatggattttgagttgtgggtaccatatacccgtgtaagtctacatttaacactgaaccctttgtgttgagtactctgcatacagtgtcatcataccttgagtatttacatttagtcatcatgttttcaratagtcccgccctgccccttcccaggactgcagtgatacttacgttagagcacttgatgttatcccacaggtcaggtcttggttactttttcttcctgtctttgctttattttgttttgattatagggtagttcttcaacttcttgatattttccactacagtatttaaatctgttagtcttatccaatgtatctttcacttcaaatagtatgtttttttatttttagtcacatttttgtctttcgtcttttatttctcatcatgttgatgatttattcttttttctttttttttttttt

SEQ ID NO: 200088 - DNA, 601 bp, Human
ttttcaaatagtcccgccctgccccttcccaggactgcagtgatacttacgttagagcacttgatgttatcccacaggtcaggtcttggttactttttcttcctgtctttgctttattttgttttgattatagggtagttcttcaacttcttgatattttccactacagtatttaaatctgttagtcttatccaatgtatctttcacttcaaatagtatgtttttttatttttagtcacatttttgtctttcgtcttttatttctcatcatgttgatgatttattcttttttctttttttyttttttttttttgagacacagtctggctctgtcgcccaggctggagtgcaatggcaccatcttggctcactgcaacttcacctcccgggttcaagcgatcctcccatgttcaagcaatcctcccacctcggcctcctgagtagccgggaccgcaggagcacgctacagcacctggcttagtttttttgtttttttagtagagacagggtttcatacgttggccagactggtctcaaactcctgacctcaagtgatccacccgcctcagtgctgggattgcaggcgtgagccactgtgcct

SEQ ID NO: 200089 - DNA, 601 bp, Human
tacttaaacaggccagacgcagtggctcacgcctgtaatcccaatactttggaaggctgaggtgggaggatcacttggccaggagttcaagagcaagccggccaacatattgaaagcctgtctctactaaaaatacaaaaaaaaaaattagctgggtgtagtggtgcatacctataatcccaactgctcaagaggctgaggcagggagaattgtttcaacccgggaggcagaggttgcagtgagctgagatcatgccactgcactccagcctgggtgacagagcaagactcttttgtctcaaaaaaaaaaaaaaaaagaagaagatacaaattgatatcaaaataccttttgaaaaaaaaatacttaagcaattcctctcagttgtttcttcccctcctttatttttatttttttaaaacgggcatttacatattaacttggtccttatgtcttgtaattcatgctgtagttgtttattttgccttaggatactcctttgatttttcttaagcatttactgaatcctttattggttaatgcttcatctgtagggattacagtgctttctcttagccacattagggggtagaatttagaatg

SEQ ID NO: 200090 - DNA, 601 bp, Human
gttgatgttgcttggctctaaatattttactaaacacagacattttgacaatgaaaaagaggcaataaactgaatacttacacattatcccttttttcatcatccagagatttatagaattctgtgctgccaccttatccctatagtgctaaatatgagtcctgagtctgacagttgatcactgtgtgatttttcttaggctggttaatcactctaatttgtttttctatacattgaaaatgatatgcatattacagtgatgttataaagattaagagagaataaatgcccacttagcacratgtttggcacattttggttgtaacatctgtatgtgctttggcattagtttgatatgactttgtgttattttaatgccagtatccagttaatataaagcagagtttggcaaacattttctgtaaagggccagatagtaaatgtttccagtctgtgccgtctattcaactcatgggcatggctaagttccattaaagaattatttacaaaaacaggttgtgggccgtagttttccaacctgtgactagaggttacttttgtatttctttgtcttttttgtttttgttgctgttttcatttg

SEQ ID NO: 200091 - DNA, 601 bp, Human
cagtgatgttataaagattaagagagaataaatgcccacttagcacaatgtttggcacattttggttgtaacatctgtatgtgctttggcattagtttgatatgactttgtgttattttaatgccagtatccagttaatataaagcagagtttggcaaacattttctgtaaagggccagatagtaaatgtttccagtctgtgccgtctattcaactcatgggcatggctaagttccattaaagaattatttacaaaaacaggttgtgggccgtagttttccaacctgtgactagaggttasttttgtatttctttgtcttttttgtttttgttgctgttttcatttgacagctttggtacaatgtatttcttaactattgagtatttcaaataccttcagctgtattaaaaattatataggtaatacagttataaccctctttgcactttgattaatttctttcagatcacttatttgagacatagtcctcaagtggaattatgaaatcaaagagtgactccataaagtgcctcacaacacaagagctgaggtatttagagaatgccaaggctactaataatttagtcttttaatggatag

SEQ ID NO: 200092 - DNA, 601 bp, Human
gctgtatgtgttctattgtgtttcttataatacataagaaacagaagataggtggcaataaggaaacggccttatgaagtaaaaaccgaccaatgacactgttgtcattcccactaccaattgctcttccactcacaaaagaaagcaattatttcaccttctaagagtgaaacctgcctgggtgctgacagtttagaaagagggggtggaaaaagtaagaatttcattctgtataataaattaccaatcccttggtttgcattaatagtgtatagataaaatttaagaacattacattactttttttttaacaaaaatactcttatgccttttaaatactacctttatatcgcacaatttggaagtcaatgtgtatctaaaattgctgggttgacttaatgcatagtagggcagtggactaatgttctgaaaggtccttctttattaactgtattagaatgttcttttgtaagattaatacaggcatttttcattgtaaaataacattgtgattggtgataggacagatttttccttttaaagaagttgtttgttctttggcattttggtggtggtggtttgtgagaatataactcaactg

SEQ ID NO: 200093 - DNA, 601 bp, Human
agaatttcattctgtataataaattaccaatcccttggtttgcattaatagtgtatagataaaatttaagaacattacattactttttttttaacaaaaatactcttatgccttttaaatactacctttatatcgcacaatttggaagtcaatgtgtatctaaaattgctgggttgacttaatgcatagtagggcagtggactaatgttctgaaaggtccttctttattaactgtattagaatgttcttttgtaagattaatacaggcatttttcattgtaaaataacattgtgattggtsataggacagatttttccttttaaagaagttgtttgttctttggcattttggtggtggtggtttgtgagaatataactcaactgatatactatactaaagtatgcacaaattcggtatgatagctctgacagtgatgtcagtttttgcttttaaaaaacatgatacacagtgcattgtttaaaggtgcagaattctcaaattccagcattcttgggtttgcaataaaagtcagtatccggccaggtacggtggctcacgcctgaaattccagcatattgggaggccgaggtaggcggatca

SEQ ID NO: 200094 - DNA, 601 bp, Human
tgatatgggaagattgcttgaacccgggaggtcaaggctgcagtgaggtatgattgaaccactgcattccagctggggcaacaaagcgaaaccccatctcaaaaaataataaattggcgtggaatgtgccttcccaccccacccctcagtctcaaatctcaattgttttactgtaatgctgtccttactgacttaatcatctctaggttttacgtgttcagttcacttaaggaatattaaggtttcttccttattagaaattgagcccggctgggtatggtagcgcttgcaaacttccagmagtttggaaggctgaggtgggaggatcactgaagaccacaagctcgagactaccttgagcaacatagtgagaccctgtctctacaaaaaaattttttaaaaattagccaggtatggtggtgcatgcctgtagtaccagctattcaagagactgaggtgggaggattgcttgagcccagaagttcgacatgattgcaccactgcactccagcctggtcaaaaggcctttttttttttttaaagactcttttaagaaaaaaaaaagtccatgctgcaccaaacctacctgtctaactttact

SEQ ID NO: 200095 - DNA, 601 bp, Human
acgctaagttctgaaactagtgagtcgggaaagaaaaactaatatctttttttgttttgtctcaattatacagcagatataatttctacagtagaatttaatcattctggagaattactagcaacaggagataaaggtggtagagttgtcatctttcaacaggagcaggaggtaagtgtttaaagtttattgtctaaatttcagtttgatcttaggactagagcttgtgttgcactggagaatctcatcagaggatgttggaattttaaaagaagtgtgtgtttattgaatacaatgtccwatatatagacagctctggttctcttagctttgtatgtgtgcatgtgtgtacatgagcgtatgttgttttggtttaaaaacataacactaattgtaaaaatacttgattagagaagggggtggaaagtgatggaataatccaagattttaacggttttgaagccttggcccttcattataatttttcctttgaaactccgtaaagcaaagttgctttgacttcttctcaatgcttggtttactttgtacaattgaggggtgagaggctagtttaaagaaaaagcagctcaattattttgat

SEQ ID NO: 200096 - DNA, 601 bp, Human
gtttaatatttttagctgtcatttaatagcattgttataactaatatatttgtataggtattctgctacacggaatctctgttgtagaatcagggcacctaaagaaattgaggcacacaagtaaagtgatttccctgatgtaatcacagccatcatgtgatcagtgagagtccaaaattctgataacaaatccagtgttctttatagcatgacccgatataagtgacccatgttatttttatagcttctaatagcttttgacagcaaagtaaatgatagggtatattctttttgttaatgraaatattaatacagggttttgaggagaagagtccaaacagctattaaagtggataatgatgttctctaggttttagggatttttgttgtttccatgggtgctcaaattaggtaattagcagttgtcaaagtagctggtttcctactgagttgggttgctcagaccttcagtttctctgagactttgtgatgtaccctgtaaggtagtgtgggtgtgtgggtgctgggttaaagggacagctaagacagaaggtgaggagggaggttgtacctctttccacttctttttataatttttcta

SEQ ID NO: 200097 - DNA, 601 bp, Human
caagattactaaatcagaatatgtatgtatatggtgcattcatagaatgtaagagctaacatttatagggctttctagggattcttaacttttttgttgtcatcccatggattcctttgatagcctagtaaatcctgtagacttctcagattttttttttttttgagatggagtctcactctgttgcccaggctggagtgcagtggcgtgatctcagctcactgcagcctccaccaccagggttaaagcagttctcctgcctcagcctcctgagtagctgggactacaggtgcacaccacyacacctggctaatttttgcatttttggtagagatgggttttcaccatattggccaggatggtctcgatctcctgacctcatgatccacccgtctcgtgatccacccaccttggcctcccaaagtgttgagcgtgagccaccgtgcctggccagaatgtttaaattgcataaaatatttaagattataaaggttgaaataatttaccaaaatattcataattgagtaatatatgttttaagtggataacagctggattacgatattaaaatgtcatttctgtttgacagagtcacaagaat

SEQ ID NO: 200098 - DNA, 601 bp, Human
cctcagcctcctgagtagctgggactacaggtgcacaccaccacacctggctaatttttgcatttttggtagagatgggttttcaccatattggccaggatggtctcgatctcctgacctcatgatccacccgtctcgtgatccacccaccttggcctcccaaagtgttgagcgtgagccaccgtgcctggccagaatgtttaaattgcataaaatatttaagattataaaggttgaaataatttaccaaaatattcataattgagtaatatatgttttaagtggataacagctggattaygatattaaaatgtcatttctgtttgacagagtcacaagaattgctaatactatatgcagtttgttacctatgcccataatcaaaagaaatgctgaaatttagctggaggttagtgaaaataaatgtgtacattttccccccatccaggcttataaaatccctgggttctgtcattggacccttgtgtccatgagccctcaatttttaacccctggtagtgcagtctccttttgccagctgggggcccaggtaccagattacccatccaaagtcatacagttaataaggaagtgattcttc

SEQ ID NO: 200099 - DNA, 601 bp, Human
gccatcagattcttgtcagctacctgttaatcttttggggctccttagggtattacatttcccaaaagcaaaatatcatgtattttaaatatttaaaatatcggctcaatgggtacctaattttacccgttgagcagaaatttgaattaaccatatttcttatacagggtgagtatcccttatctgaaatgcttggaaccagaagtgtttcaaatttcagatgttttcggattttggaatatgcgcatgtgtacataatgagatatattggggatgggacccaagtcctaaacacaaattmaattgtttcatatacaccttatacatatgacctgaagataattatacaacattttaaatcatttgtgcatgaaacacagttttgactgtgacccatcacatgaggccaggtgtgaaattttccacttgtgtcatgttgacagtaaaaagtttcaaattgtggagcattttgggtttcagattttcagattaggtatgctcaacctatccccaagaaattctccaccaaaaacaactccaaatctatgaaattaataatgcccagtaattttggaattaattatttaattaataaacttgg

SEQ ID NO: 200100 - DNA, 601 bp, Human
ggaatttatttacctttccttcttcctgtgctctccctagcctcacacatataaaacatttcattgtattcttattattaataatttttccctcttaattataaattcattatgctcgatgtagataattcagtaaatatggataagtggcaaagaatgcatgtataaccccaccaaacaaaaataagaacttttggtatataccaaaggcctgtctttctgaatatctgattataaatttagggttgtatgattttttttctcacatactgtatagtgaataccttttcatgtcattcarttttctgtatcaccatctctgtaatgacatgacatgacataattatgtttatttgatctagtctctattgttagattcctagattgtttatttctgcctcttttttcagggttgggaggtgagcgactgcccctttgcagttactgtgtttttccctctttctaaaaaaagaaaagtagcaacttggtgattgaaaatacattatttcattggattttggttttactttacgccttaatactcccaataattaaagcatcttgttctatgccctctttttctagtggtgtatttattgaa

SEQ ID NO: 200101 - DNA, 601 bp, Human
acatataaaacatttcattgtattcttattattaataatttttccctcttaattataaattcattatgctcgatgtagataattcagtaaatatggataagtggcaaagaatgcatgtataaccccaccaaacaaaaataagaacttttggtatataccaaaggcctgtctttctgaatatctgattataaatttagggttgtatgattttttttctcacatactgtatagtgaataccttttcatgtcattcagttttctgtatcaccatctctgtaatgacatgacatgacataattakgtttatttgatctagtctctattgttagattcctagattgtttatttctgcctcttttttcagggttgggaggtgagcgactgcccctttgcagttactgtgtttttccctctttctaaaaaaagaaaagtagcaacttggtgattgaaaatacattatttcattggattttggttttactttacgccttaatactcccaataattaaagcatcttgttctatgccctctttttctagtggtgtatttattgaatttggatgggccacatattgtgagagacggcatcagctctttttct

SEQ ID NO: 200102 - DNA, 601 bp, Human
agtaaatatggataagtggcaaagaatgcatgtataaccccaccaaacaaaaataagaacttttggtatataccaaaggcctgtctttctgaatatctgattataaatttagggttgtatgattttttttctcacatactgtatagtgaataccttttcatgtcattcagttttctgtatcaccatctctgtaatgacatgacatgacataattatgtttatttgatctagtctctattgttagattcctagattgtttatttctgcctcttttttcagggttgggaggtgagcgactgcscctttgcagttactgtgtttttccctctttctaaaaaaagaaaagtagcaacttggtgattgaaaatacattatttcattggattttggttttactttacgccttaatactcccaataattaaagcatcttgttctatgccctctttttctagtggtgtatttattgaatttggatgggccacatattgtgagagacggcatcagctctttttctcacgaggcattatgtttttcagctttgttgattggctgcctttaaattttattttactttttgtttttctgcccacagattattt

SEQ ID NO: 200103 - DNA, 601 bp, Human
tgggccacatattgtgagagacggcatcagctctttttctcacgaggcattatgtttttcagctttgttgattggctgcctttaaattttattttactttttgtttttctgcccacagattatttaaacattcttttgttcccttttaaatttattatttagttagactttattaccctacattatgtgatgaagtgatttttttctcttccaccttccccacccattcacagattaccagtcgggttattattattattattattattattattatttattttagttttacagagtctcrctctgtcaccctggctggagtacagtggcatgatctcagctcactgcaacttccaccacccaggttcaagtcatccttatgcctcagcctcccgagtagctgggattacagacgtgcaccaccatgcctggttaatttttgtgtttttagtagaggcagggttttgccatgctgaccgggctggtctcaaacttctggcctcaagttatctgcccacttaggcctcccaaagtgctgggattataggcatgagccaccacacccagctggttattacattatttattgaaattttttcac

SEQ ID NO: 200104 - DNA, 601 bp, Human
tgggattacagacgtgcaccaccatgcctggttaatttttgtgtttttagtagaggcagggttttgccatgctgaccgggctggtctcaaacttctggcctcaagttatctgcccacttaggcctcccaaagtgctgggattataggcatgagccaccacacccagctggttattacattatttattgaaattttttcacatggatttaaaatgcacattagatcagtcatctgcagagttgtgtctagacttcactatattttagcttttcaaagtcttattcaaggatgatgaactctrctagtctttctactttattcgttccttcttacagttgagttgtgtagataggttttgaaatgtattgaaattgggttctttctcaaatatctctctatagcctttcagagtaaatacttgatcagaatagttgttgttgcatatttcttagtgtctagttattaagaaggatttgacttgtgcctttacaaaggggaattttctagcgaacttcatctgtagtcaatttatcaggggtatggaggactttcttattagaatgttaccagtggaaaggacattgaagactatctgatccga

SEQ ID NO: 200105 - DNA, 601 bp, Human
ttttcttaaatttttaaattttttccacggagcaaagtaaatatttcctacatttttgcagagtttcatttaaggaaggagaaagttagtacaggttgagcattcctaacccaaaatccaaagtattccagaattggagacttattgaatgctgatgtgataccacaagtggaaaattcccctggcctcatgtgatgggtcacagtcaaaactttgtttcatgcacaaaattaattaaaatgctgtataaaattactttcaggctatatgtataaggtatatacaaaaccactgaattttrtatttagacttgggtcccctccctaagataatatcatgaatatgtaaatattccaaaatatggaaaaaaatgtgaaatctgaaacacttctggtcctaagcatcttggataagggatactcagcctgtaaaagcacaatggagttacttatatttagaagtagctgttgaaaaatgttaagtgaaattctttcagaagtttgcctttaagtcttgactattcttagtatgtttattgcagaaaataggaaaaatgtgtatcatttccacaaagaataaaatcaaaaccatcccataacag

SEQ ID NO: 200106 - DNA, 601 bp, Human
ccagaattggagacttattgaatgctgatgtgataccacaagtggaaaattcccctggcctcatgtgatgggtcacagtcaaaactttgtttcatgcacaaaattaattaaaatgctgtataaaattactttcaggctatatgtataaggtatatacaaaaccactgaattttgtatttagacttgggtcccctccctaagataatatcatgaatatgtaaatattccaaaatatggaaaaaaatgtgaaatctgaaacacttctggtcctaagcatcttggataagggatactcagcctrtaaaagcacaatggagttacttatatttagaagtagctgttgaaaaatgttaagtgaaattctttcagaagtttgcctttaagtcttgactattcttagtatgtttattgcagaaaataggaaaaatgtgtatcatttccacaaagaataaaatcaaaaccatcccataacaggaatgaaaaatgaagacctgtgtgtgtgtatgtatgtgtggttttctcagggatttttgttttgttttacagaatgagactcatgttgtacatatcactttgtaatgtttagttttatttactgtca

SEQ ID NO: 200107 - DNA, 601 bp, Human
ttgagtagttgttgtgttgttttgagacagggtgtttctttgttgcccaggttggagtgtgcagtggtgcgcttacagctcactgtagcctcaaacttctggactcaagtgatccttcccacttcagcctccccagtagctgagactacaggcgtgcactgcaacacttgactaattttttttttctctctctctttttttggtagggatggtctcactgtgttgctgatcttgaactcctgacctcaagcaatcctctgtcttggcctcccaaagtgttggattacaggcatgagctgcsactcctagccagagctgctttttatatgtttattggctatttggatgttatcttttggaagtgactatcgaaatctcttataattttctgtgttgtgtgtcatttttcttactgatttgtagactttctttacactttttgtagatgaactctttttcagttacatttgttggaggatccaggggcagtggctcacgcctgtaatcctagcactttgggaggctgaattggttggatcacttgagcccaggaaattgagaccaggctgggcaatatagcaagacctcatcttttttaaaa

SEQ ID NO: 200108 - DNA, 601 bp, Human
gatcacttgagcccaggaaattgagaccaggctgggcaatatagcaagacctcatcttttttaaaaaacaaaacaaaacaaaacaagaaaacccacacatttgttagaagtatttttcattctgtgacttgccttttcatttttttgaatagtatatttttataaatagagattattaatataatacagttgatcagtatttttcttagggttactggtttttctgtcctgtataagaaatacttttcaaccccaaaatccagggaagacatttccgttatcttttagaactgtatgactsgtactgtagctactagatccatgtggctattcagattaatggggagttgagtctgttctctctcccctaatgcaagaccctgttgcagtggtccctgtctccatggccctctttaaagtcagccttactaccttataaataagtaaataaataaatttaaattattaaaaataaattgtagaattaacttccttagttgcagtagccacattttaggtgttcagtgtgtgcctagtgctcaacatgactagtggcaaccatactggacaacacagatacagactatttccatcattgcag

SEQ ID NO: 200109 - DNA, 601 bp, Human
tccatgtggctattcagattaatggggagttgagtctgttctctctcccctaatgcaagaccctgttgcagtggtccctgtctccatggccctctttaaagtcagccttactaccttataaataagtaaataaataaatttaaattattaaaaataaattgtagaattaacttccttagttgcagtagccacattttaggtgttcagtgtgtgcctagtgctcaacatgactagtggcaaccatactggacaacacagatacagactatttccatcattgcagaaaagttctcttgggtcmtgttatcctaaaacttaattattgtaccttcacatttatatctcttattcatctgtaatcactttacgagtggttttgggaaggggtcgagcttcattttatttcctatgaatagtcaacctaacaccatttagtgaaaagaccatcctttccccattgcccagcaaggcaacctttgtcatcatttaggcctgtttctgggccatctgttctgtttcattggcacattggtgtatcctcatgccagtacacagtctttatgactttgctttaaaacttggttatgatgtcctttagtga

SEQ ID NO: 200110 - DNA, 601 bp, Human
gaaaagtctgctgcagctccctgtggtctactgtcagttaccacttgtacccatctgttttatagcctcttcagttttgttactgctgctgtcatttctgccattactctttgtcctgtggacttgtttttaaaagttctgttatgatcactttaataaagtttcaggagagaggggaggctaatgcatgtgctcagcctggcatcttgagctttttagacagaattttctccttttgtgatacattaatttatttcctgttgcaaagagatggagcttcttgcagtccacgaaactgccrtatacctctatgattttgtttttggattctgtaagataccatgtttagtagacctgtgttgttgtccacgagtctacaggaagatgttcatgttttgtttcagaaaatatttctgttgttttgtgcttttcttaactcatcaaatacaatgtgtggctcgcccttggcccttcatattgcttaccttaattgtgtagaccataaccagtttctactttgactaaagtttgacgtacacaagttacttgaatgtggggattctgtctatccctctacgccctagtgtacatagtactatat

SEQ ID NO: 200111 - DNA, 601 bp, Human
cagaaaaatgctgctcagtttttattgtctaccaatggtaagtatacatattttctttccatgtgcccactgtgtgtacctgttgcacatatcctgtagcctaggagaggaatcatttaacagagatacttgtaaaaaggacttttgtttttctatacagaatgtaaactctacttttttactgtcacttgcagtttttagattctctgaaagattctctgatagcaattttttgtttactacacctccaatttgtagtgaaaagaatgggctgctataccattggatttaggtcaggtamtatttctgtcatttctcagtctcgtaatcttgggcaggttactaacactgaattgaattttcctcagcagcaaactagagatagcaattttttattatagtattattatgaatattaaataacttcacatacatcatgagtgcaagtgctcaataaatgttaatttattcctcctttttaagtgtttgtaaactacacagagtatctcaaactgcagatacaaaatactcaaaggatggtctccattccaggatacgctataggagagcactttcttacttgatcaccattagcatattg

SEQ ID NO: 200112 - DNA, 601 bp, Human
actctacttttttactgtcacttgcagtttttagattctctgaaagattctctgatagcaattttttgtttactacacctccaatttgtagtgaaaagaatgggctgctataccattggatttaggtcaggtaatatttctgtcatttctcagtctcgtaatcttgggcaggttactaacactgaattgaattttcctcagcagcaaactagagatagcaattttttattatagtattattatgaatattaaataacttcacatacatcatgagtgcaagtgctcaataaatgttaatttrttcctcctttttaagtgtttgtaaactacacagagtatctcaaactgcagatacaaaatactcaaaggatggtctccattccaggatacgctataggagagcactttcttacttgatcaccattagcatattgccttcttcccagcaatccacatggctggaaggagattcctctcctactgtttacttgccaagggaacattttttgttgttttttgagacaatgtctgtcgcccaggctgaagtgcattggtgtaatcacagctcactgcagcctcgacctccctacctcagtctcct

SEQ ID NO: 200113 - DNA, 601 bp, Human
atgaaaaactttttcctgtgaattgtttggactttgttggggtcttgagtctaaagggaatcattagagtgactgaggagatactttagtttctgggtagccgtagtctataaaaatttgtgattaaaacttttttgaggttggtgctagggtgaggggaacctcttattttctcatcccctcactattaatttaaaaagcaaattctaacacctagaccataaacatttgcagaatatatacttaaatgacttcaggatgaaatgggggaagaaattcagcacttcctccatctaattgwtgcccctcgtccacagtattagttcttagaaatgctgttcacaaatgcctgatggccatcagcgttggccgcctcctgggtgcccgtttttctgatcatgaaagctttccccagccagtccattgagatgcgtaccctctgccttctctgttttcacaatagactgcattcccctctcttgtccttattagaagaaaaataaagagaagtaactatttaaagcctgtaaatcacagcactatgggtggagggaacagtttattcctgtcatatgctagcttctagtcttgggtcagtttt

SEQ ID NO: 200114 - DNA, 601 bp, Human
tcagacttcatctctggtttgtcatgttagctatcacaaggtcaagtttcaagataaattttctttggaaatcaaaaaagtagatacagatcaaatcttctagttgtagctaaaaaataccaagaattagatgttatgggttaattttctttttagcctctttaatctgaaccataaacatttattagcttggcatgtctttcaagcaaaatattgaaactaagaactgcaaattctaatagtattgcaaccagtaaaagaagatatattatccacattgttcattttttcttcagcactygaaaggatcaacatcagttgctttttaaaactaaatctatgtaatattgttctattttatgttctcaaaaactgaaataatgaagttttctgaatcttaattgctatttgaaactgagccttttgtaatttctgtttttcatgtgtcttattgacaggtgccagtctttaggcctatggatctaatggttgaggccagtccacgaagaatatttgccaatgctcatacatatcacatcaactcaatttctattaatagtgattatgaaacatatttatctgcagatgatttgcggattaa

SEQ ID NO: 200115 - DNA, 601 bp, Human
ttctcagactttttaaatatgagatttctagtttatccttttttgacatattagtaaatacagaattatataattcaaaaaacaggcacagctttgttagcttttgacattgtataatatgatactatcaaatttttaataatatatgcccagaataaccatataatttatcaccaaaccaaggcatggttacgctatgcatacatgtgcatttataatggaaaatataggcttcagttaaatttatgcccagaaaatggtatttaagaaagaaataggcacagtttcagtgttgttatcmgtagttaatggactgaaagccaagaatagtgatattcagatattgctataatgttcttttattagtctcttaactgtgccattttcaagtgtttttggcctgaatgttttattcaggcttataaaggctatgtgtgccatgcccagaatggagttttcctttgtcataccagtaggaaaatgtacctccctgaagggcttgtgtgttttgtaaaaggacaaaatgcctttattgttactgagaagattgagattaataggtttaaaaggtgtgtgtatgtgtctgtatatgccctttttt

SEQ ID NO: 200116 - DNA, 601 bp, Human
tttccagatgctacattaacacctcatagaagtggtctttcatatgtatgttatgtatgatgttaaccataatatatatggttaaaattttagtagtagttatcctttgctttttataatttccagttttgccgtagtgtaattcctttttcgtattcatttttagtaaaatgttacccattatttaaagataaaataagtcttactttgagtcttttagttgtctatttgccactatgttccagtagaacagaaagtagtaaaacataattttggaattaaactgacatttaaagtaatsagagatacttcaacaacagttttatcacagagcttaatatgattccgatttcatggtgttgtgtgttacagaggataatagaacttatagaatgttttctttcatctggcttttaaaattatctgatttttgacataaggactagtaaacctagagttctgttaatagcaaacattgcctttgagtgctactactaaacctgaggcatcaagaagaaagaaggaaagggaagaagaaaaaaaagattaacaaatttgaagagtaaagagatactgaaataaggtgtggcgcacagctaca

SEQ ID NO: 200117 - DNA, 601 bp, Human
gttacagaggataatagaacttatagaatgttttctttcatctggcttttaaaattatctgatttttgacataaggactagtaaacctagagttctgttaatagcaaacattgcctttgagtgctactactaaacctgaggcatcaagaagaaagaaggaaagggaagaagaaaaaaaagattaacaaatttgaagagtaaagagatactgaaataaggtgtggcgcacagctacaaccagtttttcattgtatttaagcagataattagcagttttatgttctattatcagaaaaaaackatttgttttccttaatattaaaaatttttttttaactatttcaaacttagagaaaatttgttagaataacacaaagaactcttggctggccttgacccaggttcccctgtcgctgtttgctgtatcacgtgttctattctctgtttatttatagctatatttgtccacataggtacgtgcgcatgtgctcacatgcaacttgtgtgccacatgggaatttattccatttacgccagatgtgatgcccataaccctaaattcttgaatgagtatttcctgacaaaaacactttccaacata

SEQ ID NO: 200118 - DNA, 601 bp, Human
atccggagacccactgaaactgaccagttactgtaactatgtcctttatggcacagaacaaagtcagtctggttcagtatccagcatttagttgtcatctcttgttagtctcctttattctgaaacagttcctcagtctctccttgtctttcatgaccttggcattttgaagaacacaggccagttattttatagaatgtttcctcatgattagattcaggctatacatttttggcaggaataccacagaaatgctggcctaatgatacctttttaaagtttcaagtagccacagcctagrtgtcctaatacattaaaaccacgcaaactcagatgatatggggatgtcaatctaaattacacaagccatttttaaagaaatacagttttgtcatcttcaggggcacgcattaccttgagtttgattaaagttgttgccaagtgtcctttgggaattgacattactaaatagataataatttgtactcagtaggtgacctttgtatgtaagtattactttgaacaattccccagtatcctgtaatccttatttacaataataatttgaaccattggtaagcagcggtagcagaccctttcc

SEQ ID NO: 200119 - DNA, 601 bp, Human
gtgtcctttgggaattgacattactaaatagataataatttgtactcagtaggtgacctttgtatgtaagtattactttgaacaattccccagtatcctgtaatccttatttacaataataatttgaaccattggtaagcagcggtagcagaccctttccaaattaagagcttcaaacttacgaagttttgtttgtgaggatacttaataaatgtcgagcagtaatgggtggcaaatagaactgacaaggaagtgtcttgggcagtttaaaaattttgccacccctttaaactgatacttwtataaatatttgcttaaaatgttctaagtggtaaaagtaaaatgatgttctgttaagaaaatattacagcctgggcaacatagcaagaccctgtctctacaaaatatttaaaaattatctggacatggcagcatatgcctgtagtcacagctactcaggagactgaagtgcaaggactgcttgaacccaggaggttgaggttgtggttgcagtgagctgtgattgtgccaccacatttcaacccgggtgacagagtgaaaccctgtcttgaaaaatacatatatataggccgggcacggt

SEQ ID NO: 200120 - DNA, 601 bp, Human
aatgatgttctgttaagaaaatattacagcctgggcaacatagcaagaccctgtctctacaaaatatttaaaaattatctggacatggcagcatatgcctgtagtcacagctactcaggagactgaagtgcaaggactgcttgaacccaggaggttgaggttgtggttgcagtgagctgtgattgtgccaccacatttcaacccgggtgacagagtgaaaccctgtcttgaaaaatacatatatataggccgggcacggtggctcacgcctgtaatcccagcactttgggaggccaaggcmggcggatcatgaggtcaggagattgagaccatcctggctaacgtggtgaaaccctgtctctactgaaaatacaaaaaaaactagccgggcgtggtggcggacgcctgtagtcccagctactcaggaggctgaggcagaagaatggcatgaacccaggaggcagagcttgcagtgagccgagatcgcaccactgcactccagcctgggcaacagagcgagactccgtctcaaaaaaaaaaaaattatacacacacacacacacacattatgtaccacttaatatttctcaggagcagatta

SEQ ID NO: 200121 - DNA, 524 bp, Human
aagattatttatttatgagacagagtctcactctgtcacccaggctggagtgcagtggcacaatcttggctcagtgcaacctccgcctcccgggttcaagggattctcctgcctcagcctcctgagtagctgggactacaggcacgtgccactacacccagctaatttttttttttttccgagacggagtcttgctcagttgcccaggctggagtgcagtggcrcgaccttggctcactgcaagctccacctcccgggttcacaccattctcctgcctcagcctcccgagtagttgggactacgggtgcctgccaccacgccaggctaattttttttgtatttttagtagagaccgggtttcaccatgttagccagaatggtctcgatctcctgacgtcgtgatctgcccaccttggcctcccaaagtgctgggattacaggcgtgagccactgcgcccggcccaaaaaatgtaaatcataagataaagcattggtttcttgtgaacagctacagctacttcat

SEQ ID NO: 200122 - DNA, 601 bp, Human
ttccacagatagttgctcctttgagaagctggctggcctggttgatcacatagcctgtagttgcaaaaatacttaacaacgataattctgcactcctaagaagttttacttgaggatgctgtcaactttgctgatagttttggtagccataaaaagaataagcagaaaacccagttaattagtaccgtatttctggtttattctagtgattgagttgatgtcaacagcccctgtcccttagtttaaatctgcttttgaagtagcttcctatggtttaattgccgaatcattttacttgaamacaatttcttgttctgcttgtttgactgagtgtactgtctattttcacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaat

SEQ ID NO: 200123 - DNA, 601 bp, Human
ccttcgccttcttgcctccggtcccctcaaccccatcccaactctccaatcctttaatcatctttgccattcactaccccccacctcccgcagtgcagcagctgctctgtgggtgtctacataccagtgtgtatgtgttgcacactttcctgcatgtgtaccactaaatgctgtggactgcattgggcatgcctgtctacatgagacccttatctagctcccactactgggggaaaggggcctaatggctatttctcccacagctccaggacaaacgcctcagaatactttcagccataarcagggagaggaaaaagaagataaatattccgagatccaaatagcaccgaccccaccaagccaaaggtcaaggcctttcctttcgggagagccactggaaaagaaagtgctttgagttcccctcctttcctatgcaaaattagagccatctctctcccccccagcttccccactgggaagttcttcctgaagtctaagctccatcctacctgctgtgatcatggatagacagagtgacatcgaccacaatacagtcagacgtccagcttctagaacacagcttctagtacctaaccgcccc

SEQ ID NO: 200124 - DNA, 601 bp, Human
cttcctcccttttgagaacccatcacctctcttcattgggatctcaaaagttttggtttttgggcggggcacgatggctcacacctggagtcccagctacctggaaggctgaggccggaggatcgcttgaatgggaggctgcagtgagccatgatggcaccactgcactcgagcctggacaacagagcaagatcctacctcaaaaaaaattaaaaagttgtggtttttggtcttcaaagtatactggaaagttgggcaagaggggtaatgctgagggtaaagctcctttgaccagggggcaaaaaaaaaaaaaaaaaaaaaaaaaaagctccctctgcatggtttcctcgtctgctcagctcctaggagagtggccacagcatccagccagaggcaccaagccaaggtcagtgaccaggcctagagcccagagcctcctgggagggtaagtttaaatgagtaaatatggtcccacctgggtgtggccagcgacaggccagagcttcggacatgtccctcccctcccagcctacagcagaaagaaaagaagtcagacaggcacaagtgcctcccgcccccttggctatcagggtcctgtgca

SEQ ID NO: 200125 - DNA, 601 bp, Human
gcctgggaggctcacattggccttgtgtctgccttgagacaagcccagcctcttgtggtccaagccttcccactctagtgtctcttctcattcatcccatgcggcagctcacagggacagcaggaggggtctcggagtgtcatttgttcctgccctcacacccttgctttgggggctttctccatgacactcaagtcaaaacaataccctcctcaccttgccaccaaaggctgattctctgccctctgctgaggaatcctggttttctcttcccttcaatttctcctcctcctctcaggtstccgtgggcctcctttccattgccccgtcctgcagggcaggatctctcctttaatctcagacaaaagccctttatacttcataactaggaaagcttaaaagtcacttacatctctgagactcagtttcccaattcaaaaaaacagttttagagagaaacagtcttcttatattcccatgctcagtacaaagcttggcacacaggaacataagaaatggaagtttccttcctcccttttgagaacccatcacctctcttcattgggatctcaaaagttttggtttttgggcggggcacgat

SEQ ID NO: 200126 - DNA, 601 bp, Human
caaccctcaaccctaggtatttgctggtgggctgaggatgagagaatcacgagggataagcaagcatgcagccagagggatctggcaagactcgtggggctaagtgtggaggaggcaggttctgagacaaggagacggctggatggggaggggagggctgggctcagcttcccaacccatcccagggccaaacggagccctaggccaggaggaaccctcaaggcctcctcaatccctaccctggacaccaaaggcattccttgcccccacccctgcttctgggtagctgccttagcaggcmagtcctgggccaggctggggctgaaggtctgagagaaaagatgcaaccatcacactttttctggcggaaactccttcccttcccatgtgaggcaggtagcaccacctccctttcacaggtatggaaactcacacagagatgggcagggacttcctcaaggtcaccagaaataaggggcagaggcagactgactgttgggcacagggcttctgcttacaacctggatgggagtgggagggagtctccctccaccggggagttctagcacattccttccagggcccattccccaggtctggg

SEQ ID NO: 200127 - DNA, 601 bp, Human
ttcctctgaggggaagtcctgcctgttgtctactcttgactcccctgctacagtttacaaccagggccccacccctcagaacaggtgaggggctaagcagttcccctaactcccctccttcttagctccccacccccaggctgacaggtgggggagataagagggagcagctgggctaggacacctgtccccacccagccatcatgggccccagaggcctgcataaggagactcagcatagaggaggcagtggtggtggctggaggaaagggcccataggttaaggagagaggtgacaggmaagtctgagaaacccactttcagatcatcccatcctcctggtctaccccaaccatcatccctcaccaaaagcacaatacacacatgctttaaagggaaaatctcaaggtttgaggtcatccctcaaaccccttgctctattcccttgttacttgatccaactggagtgggaagaccccaggaaaagagaccaagccccactctcctcactccacccgcctgccgtgcatttctacttgaaactcagggatgggctctccccgtattctttgttctctcaaccctcaaccctaggtatttg

SEQ ID NO: 200128 - DNA, 601 bp, Human
ccctcacacactgggaatgcctatcagacccacctgcttgtggttactgagcagcaactagcccaaggtcactgtttggtccctggtgggaccagctctagaacccaagcctaaggctgtcttcatactccatcccagcaggccgagctgcaatgactcaccaccactcatttgcatgaggatttgcatagcgtctctgaccttattccttcaggctcaacttcccattccaggacctgggtcacccccacccaggatccgtaggcacttgcggacaccaagtggagttcttggcacctcwggcctttgttcccatctttcccctccagaaagcattcttggatttatagtaactcccagtgatacagtatagagctctcagtccaactgggtcccctactcttgtctaggcagagatggggaaggggtgtgaaatcacgaggaataagcaagcatggcagctacaggagtttggtaagattcacagggtgaagtgtggctctgtcactgccttggggcgtcacaggagaagaatcccattcccctctttagtgctaaggttggggcggcagcagcaggagggaggtgagctgtcctttac

SEQ ID NO: 200129 - DNA, 601 bp, Human
ccctccctcggggactcccctcccccagtccagcagcctcagggctgggcaggggctatttttagcctgggcactgagctaattttaactcaccgacaggggacctgggggcgggctgttggtttgtgggggcaggcagtccaggaaagctgggcctagggcaggggtggtctcaggccccaggcaccctaagaactcaaatggggggcaggccctgcagtctcagcttaagggacaggaaccgacttgccaaggggagcacacggtatggagagcagggctgagccctccccctagcttycgctggacaactctcccgagccccaccctagccttcccgccctcttctccctggcaagtctcctgggatggggtcatcctgttctctgcccaggagatgcctctccagtgagggtctgtctcctgagcctcctccatgtcttcctcaccccagcttgttcttcctgtagtctagctctcatccttcctgtagcagctgtgaggccatttggctctctacaaggcagcagcctgtccgccagggtccagcacttcccactgcagctctgaccttccccttatggcctctgggctggctcct

SEQ ID NO: 200130 - DNA, 601 bp, Human
ctgtgtgaaggtggcctggggccagtggggagagcggtgaaggggagaggtcagggtagcctccttgcagctgcagcagggctgagcagggctgtccttcccatggagctgcaggggaattcctttccgatagccagcctctatcctctctttcttgctcttggcaggggagtacctacctgtccttctcccctacacccttccacccatatctgttcccatcctagtggtcccaaggctcaaagaaactacagggcatctgcttccagagctcccataccagcacaggtcaaaagggagyagatgcccagagaagctgagtgagcagcctcgcatcacagagcagtgggcctcaacctgctcttcctcatggtgagaaagggagctctcattaggcaggcccttcatctcttcctcccaggctgctccgggctgcaggctgaggactggaggggaaggcaggaggcgctggagacagctgtcatccctcctcccgccccttccctgtggctgggctgcagggcatgaaataagcagcaggcgctgggggagggggtgacaatccaatccacctgtcacccccacagtcaggcagcctcaa

SEQ ID NO: 200131 - DNA, 601 bp, Human
accatgagtgtgtaccaccatgccaagctaatttttttgactttttttttctttttttttgtgagacagagtctcactctgtcacccaggctggagtgcagtggcgtgatcttggctcaccgcaacctctgcctcccgggttcaagcgattctcctgcctcggcctcccaagtagctgggattacaggtgtctgccaccacacctggctaacttttgtattttcagtacagacaggatttcaccatgttggacaggttggtctcgaactcctgaccttgtgatccacccacctcgacctcrtgctccatgggccctgggcctcctactggtaccctgggacaagagcaacaccagcccagccagccctgagtggcccagcagacacctgagccccaaaccagctccagacaccccattcctcacctgtgaccccagtgtctgccaagttcccattgcaaaggctccagcccagggatttcagctcccctgcttcccagtgcaatccaaagactgtgctttctagagctacagtggtgtgggctttggcagggaaggtaggggagggcacacagagggcaaggggagggggctacaaatagt

SEQ ID NO: 200132 - DNA, 601 bp, Human
tccatagagccccatgcccagagaccctactgtagagtctagggatgtagacccccagccactgtctgatcctctgcacccactgcacactacctggggagaggtgtttgatgacagagaacaactcttacccctaccccccagctcccactgccaatggctgctgagtttccctggagcctttccagcccaactctacatggcccctacggtaccacagtagatgctaaagttcagccttggtctcttgctcatgagggaaggaggagagggaaggcaaggaatctatcaatttgggagragctgggatactggccccatcccattaccaagactgctccccagcctagctggagagcttctgctttgcctggatatctacagaaaacaatgcagataaatgcattgcgcttcaaacgactccctacccttctccttcttcttttttttttttttttttggtggtggttgttgttttttaagatagggtcttgctctgttgtccaggctggagtgtacaaatcacagctcactgcagcttcaaccttccagcctcagcctcccaagtagatgagaatacaggtgtatgccaccacaccca

SEQ ID NO: 200133 - DNA, 601 bp, Human
cggcacaccttacactgtgctcatgaacggtctgggaacagtgctcagttcatggtctgcaggataccttctgcacagcctcctggaaagggagggtcatgagaggactctgagcccccaaaacccccagccctgctccctgggcacacaggccagactcacagcgcccctgtgagaggctggcagcatctgagctccaccctcaacatgaggcaatgctgtctgcctgaggcaatggtatgccacagccaggcacaagctggagctcacaccaaggcccagactctttcccctcggtcaytgctgtcctcaggctccaggacagagtaaatggacctcctggcttccaaggtctgggtctcagagaatatcccatggcccattcttctctctagaacctgcttgtactatagacacctgggtgctccagctgctcctctggcctagaactatggttcccattctgaagcttggagaagagacaacgctgagaggacatctgcccagtcagtgaacaacaagcatggtatacctggtgccaggatgggatgtctctggtgcccctggctcaagaacataccagagcaggtctagagcagtg

SEQ ID NO: 200134 - DNA, 601 bp, Human
ccctcttggaatgcctgaagggagtagaggcagaggcctgctccctgccctcacccacttcgtacggctctaggacttccctacctgtcggttccgctcgtcggtgattcgctggatctgaatctttttcctccccatcttctccgggggtcctcagtgctacggaggggaggggctcgctgggtggtgggtctcggcacaccttacactgtgctcatgaacggtctgggaacagtgctcagttcatggtctgcaggataccttctgcacagcctcctggaaagggagggtcatgagaggwctctgagcccccaaaacccccagccctgctccctgggcacacaggccagactcacagcgcccctgtgagaggctggcagcatctgagctccaccctcaacatgaggcaatgctgtctgcctgaggcaatggtatgccacagccaggcacaagctggagctcacaccaaggcccagactctttcccctcggtcattgctgtcctcaggctccaggacagagtaaatggacctcctggcttccaaggtctgggtctcagagaatatcccatggcccattcttctctctagaacctgcttgta

SEQ ID NO: 200135 - DNA, 601 bp, Human; identical to SEQ ID NO: 33598

SEQ ID NO: 200136 - DNA, 601 bp, Human; identical to SEQ ID NO: 33599

SEQ ID NO: 200137 - DNA, 601 bp, Human; identical to SEQ ID NO: 33600

SEQ ID NO: 200138 - DNA, 601 bp, Human; identical to SEQ ID NO: 33601

SEQ ID NO: 200139 - DNA, 601 bp, Human; identical to SEQ ID NO: 33602

SEQ ID NO: 200140 - DNA, 601 bp, Human; identical to SEQ ID NO: 33603

SEQ ID NO: 200141 - DNA, 601 bp, Human; identical to SEQ ID NO: 33604

SEQ ID NO: 200142 - DNA, 601 bp, Human; identical to SEQ ID NO: 33605

SEQ ID NO: 200143 - DNA, 601 bp, Human; identical to SEQ ID NO: 33606

SEQ ID NO: 200144 - DNA, 601 bp, Human; identical to SEQ ID NO: 33607

SEQ ID NO: 200145 - DNA, 601 bp, Human; identical to SEQ ID NO: 33608

SEQ ID NO: 200146 - DNA, 601 bp, Human; identical to SEQ ID NO: 33609

SEQ ID NO: 200147 - DNA, 601 bp, Human
gttagtaagtaatggatataaaattaaagcaggccgggcgccgtggctcacgcctgtaatcccagcacttttgggaggccgaggtgggcagatcacctgaggtcaggagttcgagaccagcctggccaacatggtgaaaccctgtctctactaaaaatacaaaaattagctgggcgcggtggtgagcgcctgtaatcccagctactcgggaggctgaggcaggagaactgcttgaaccctgggaggcggaggttgcagtgagccaagatcgcaccactatactccagcctgggacagagckagactctgtctcaaacaaacaaaaaaattaaagcaatagtccgggcgcagtggttcacacctataatcctagcactttgggaggctgaggctggctgatctcttgaggtcaggagttcaagaccagcctggccaacatggtgaaactccgtctctaaaatacaaaaaatcctgtctctaaaaatacaaaaattagccaggcatggtggtatgcgcctgtaatcccagctactcgggaggctgaggcaggaggatcacttgcagctgggaagcagaggttgcagtgagcagagactgcacc

SEQ ID NO: 200148 - DNA, 601 bp, Human
gtttcactatcttggccaggctggtctcgaactcctgacctcgtgatccacccaccttggcctcccaaagtgctgggattacaggcatgagccactgtgcctggcctgaatttcttttaaaagcaccttaaatacctttgtccagccacaaacatctttattaagtgtctatatcctcccagtatagtatgtttcaggttttttttttttttttttttttttttttttgacacagagtctcactctgttgcctaggctacagtgcagtggcaggatctcggctcactgcaacctccgcctsctgggttcaagtgattctcctgcctcagcctcccaagtagctagactataggtgcgcgccatcatgcccagctaatttttgtatttttaatagagacagggtttcaccatgttggccaggatggtctcaatctcttgaccttatgatccacccacctcggcctcccaaaaatgctgggattacaggcatgagccaccgtgcccagcttgtttcagggtcttataatctgaacttcagtatcctccttcttcatgtctactctaaatcatgctcacacaatttacaccaacctctcttgct

SEQ ID NO: 200149 - DNA, 601 bp, Human
agtggcatgatctcagctcactgcaagctccgcctcctgggttcacaccattctcctgcctcagcctccagagtagctggaactacaggcgcccgccaccacgcctggctaatttttttgtatttttagtagagacagggtttcactgtgtgttagccaggatggtctcgatctcctgacctcgtgatccacccgcctcggcctcccaaagtgctgggattacaggcgtaagccaccgcgcctggccaagctcatagaaaatcttttgttaactataattgaaggaaattattgaaaatamaaaaaaaaaagacaaaacaaaaacaaatacaaagaccacatttaccctcaccaataaacctaaacgtatacataattattattgatatgatttggatctgtgtccctgcccaaatctcatgtggaattgtaatccccaatgttggaggaggggcctggtgggagggaattggatcatgggggcagatttctcccttgccattctaatgatatgagttctcacaagatctggtttaaaagtgtgtagcacctcccctcttactctcttcctcctgctccagacatgtaagacgtgcctatt

SEQ ID NO: 200150 - DNA, 601 bp, Human
cagtggcatgatctcagctcactgcaagctccgcctcctgggttcacaccattctcctgcctcagcctccagagtagctggaactacaggcgcccgccaccacgcctggctaatttttttgtatttttagtagagacagggtttcactgtgtgttagccaggatggtctcgatctcctgacctcgtgatccacccgcctcggcctcccaaagtgctgggattacaggcgtaagccaccgcgcctggccaagctcatagaaaatcttttgttaactataattgaaggaaattattgaaaatrcaaaaaaaaaagacaaaacaaaaacaaatacaaagaccacatttaccctcaccaataaacctaaacgtatacataattattattgatatgatttggatctgtgtccctgcccaaatctcatgtggaattgtaatccccaatgttggaggaggggcctggtgggagggaattggatcatgggggcagatttctcccttgccattctaatgatatgagttctcacaagatctggtttaaaagtgtgtagcacctcccctcttactctcttcctcctgctccagacatgtaagacgtgcctat

SEQ ID NO: 200151 - DNA, 601 bp, Human
tatggggcctaggcatcttttttaaatctaaagtgtatggtatttttttccagctaaattttaagggtcccatgttatactcagtgtcatggtttttgaagtaaacttccaaagcaatatatgttatggataaaaaaattatagtcacttggccaggcatgggagctcatgcctgtaatcccagcactttgggaggccgaagtggttggatcacctgaggtcagaagttcgagaccagcctggccaacatggcgaaaccccgtctctactaaaaatacaaaaattagctaggcatggtggygagtgcctgtaatcccagctactctggaggctgaggctggagaatcgcttgaactcgggagccagaggttgcagtgagccgagattgcaccattgcactcaagacaagagcgacaagagcgaaactccatctcaaaaaaaaaattacagtcattcaatcagtgcttcttcttggatgattaaaagaaattatagtcacttaagctcacagaaaatcttttttttttgtttttttttgacagtctcgctccgtcgcccaggctgaagtgcagtggcatgatctcagctcactgcaagctcc

SEQ ID NO: 200152 - DNA, 601 bp, Human
ctaagcaagggaaggagagagtaacagtggagactgggaagaatctgacagtggcagagaagacagatcagaaagacaaggacatcagtaggcagcaaatgacacactccagatgaaaaggaaggcagaaggaatgaagagaaggggaaggccatggtacacctctcccatccatttcaatcactctagtccagaactttaatttgaaacatacttccttaggacaataccaagtgtctggttaatgttatctccctcagaatttagtagctactgtgtaaattttctgtaagaggttttygtttttacaatctatactttttagatggatatccatcaccttaaacatttatcttttttttgagacagggtctcactctgttgcccaggctggaatgcagtggcaataaaatggctcactgcagcctcaacctctggggctcaagcaatcctcccacctcagcctcctgagtacctgggatcacaggcacgtgcaccatgcctggctaattatttgaaatgggggtctcaccatgttgcccaggctggtctccaactcctgggctcaagcaatccacctgccttggcctcccaaagtact

SEQ ID NO: 200153 - DNA, 601 bp, Human
gggggagaaggtatgggaagtagcttggcctaattaggatgtagggtctgtatgggcagagtgggagagaaggctggaggcagaaaatagctagactactggaggggggtgcagtgagaggcagaaaagctcagccctgatgccgtaagcaggagcaatctaagcaagggaaggagagagtaacagtggagactgggaagaatctgacagtggcagagaagacagatcagaaagacaaggacatcagtaggcagcaaatgacacactccagatgaaaaggaaggcagaaggaatgaagagraggggaaggccatggtacacctctcccatccatttcaatcactctagtccagaactttaatttgaaacatacttccttaggacaataccaagtgtctggttaatgttatctccctcagaatttagtagctactgtgtaaattttctgtaagaggtttttgtttttacaatctatactttttagatggatatccatcaccttaaacatttatcttttttttgagacagggtctcactctgttgcccaggctggaatgcagtggcaataaaatggctcactgcagcctcaacctctggggct

SEQ ID NO: 200154 - DNA, 601 bp, Human
gtggagggaaaagggtacttcaaacagaacaaaggcacaaaggaaagaataaggactgagttgggggagaaggtatgggaagtagcttggcctaattaggatgtagggtctgtatgggcagagtgggagagaaggctggaggcagaaaatagctagactactggaggggggtgcagtgagaggcagaaaagctcagccctgatgccgtaagcaggagcaatctaagcaagggaaggagagagtaacagtggagactgggaagaatctgacagtggcagagaagacagatcagaaagacaargacatcagtaggcagcaaatgacacactccagatgaaaaggaaggcagaaggaatgaagagaaggggaaggccatggtacacctctcccatccatttcaatcactctagtccagaactttaatttgaaacatacttccttaggacaataccaagtgtctggttaatgttatctccctcagaatttagtagctactgtgtaaattttctgtaagaggtttttgtttttacaatctatactttttagatggatatccatcaccttaaacatttatcttttttttgagacagggtctcactct

SEQ ID NO: 200155 - DNA, 601 bp, Human
tcacaggtcaggagtttgagaccagcttggccaatatggtgaaaccccatttctactaaaaatataaaaaagtagccgggcacggtagcacacacctgttgtcctagttactcgggaggctgaggcagagaatcgcttgaacccgggaagtggaggttgcagtgagccaagattgcgctactgcactgcagcctgggtgacagagtgagactctgtctcaaaaagaaaaaaaagaaaaaaagaaaagaaaaaagaaaagaatgaatagcaaagagcaatatgaactgaaggcagaaaacarggagacatagctcaaagctgggtcttgagaaggcttcagatataatggagtggagggaaaagggtacttcaaacagaacaaaggcacaaaggaaagaataaggactgagttgggggagaaggtatgggaagtagcttggcctaattaggatgtagggtctgtatgggcagagtgggagagaaggctggaggcagaaaatagctagactactggaggggggtgcagtgagaggcagaaaagctcagccctgatgccgtaagcaggagcaatctaagcaagggaaggagagagtaacagtgg

SEQ ID NO: 200156 - DNA, 601 bp, Human
ctgaatgaattccagcattcagtacttcaggctcatcttcaaaaaattctttcctagactagaccacagtaaagttcccacttaacctacccaatgatctatgaccctctgaatctaatcagatttttttttttaaacctcaaaatagacccaggagtttaagatgggtatctactcaaagatgggactctacttaagtcagttttatggttttggcaattgtgatctcattgccaaaaatctctggacatggctaaatcaatctatttgatgagtatctatatcagacaccaaaaaacasacagggcaagaaccaaccaacaaaacaaatctgtggaagccaagagggtccagaaccaaaagggcattctcataccaaggaactgatgagagagaacactagaaagcttacaaaatgaggggagaatcgcctgtcaaactcccgctgagccaggattcctccctgtccaggtgcactggtagagccaatctgaaaagaagaaaagaacgacattaagggaagtccacctcatgaagttccacctcatctactctgagaaagggcagtcccaaccaacccaactctatgcattagagtctt

SEQ ID NO: 200157 - DNA, 601 bp, Human
gcttgaacccgggaggtggaggttgcagtgagccaagatcgggtcacagcactccagcctaggcaacagagcgagactccatctcaaaaaaacataaataaataaaaataaaaataaataataaataaaagctaagaatcaaagaagcagtttattcctaatttcacagtctcatctgttcatagtggggccaggattagagtcagtggccaagcttccatcctgggttctttcccttcccaggccctaccatcatagtataccagggaaagacctggagaagccagcaggttgaccaccraaccaaggctgggccaccttcctcctgggtctggtctccagcctcccagttgtacccttcccccagcccttcctggatgcactgatcagcctgtgcttccttgccctgtttttctttataaatagagccatgttctcctctctctctctctcttttttttttttttttttttgagatggagtcttactctgtcacccaggctggagtgcaatggcacgatctcagctcactgcaacctctgtctcccaggttcaagcaattctcctgcctcagcctcccgagtagctgggattacaggtg

SEQ ID NO: 200158 - DNA, 601 bp, Human
tccccgggggaagggcagtgacaggggtgtgtgtagatggaaggagaggcctcaattgcaggcaggcagagggctgggcctttgagcaagatacacccaagagcctgggtgagcctccccgaccttcctcttccctatcttcccggcaggaccagtccatgggcaattggcagatcaagcgccagaatggagatgatcccttgctgacttaccggttcccaccaaagttcaccctgaaggctgggcaggtggtgacggtgagtggcagggcgcttgggactctggggaggccttgggtggygatgggagcgctggggtaagtgtccttttctcctctccagatctgggctgcaggagctggggccacccacagcccccctaccgacctggtgtggaaggcacagaacacctggggctgcgggaacagcctgcgtacggctctcatcaactccactggggaagtaagtaggcctgggcctggctgcttgctggacgaggctccccctgatggccaacatcggagccagctgcccccaacccaagtttgccaattcagggcccctttctagagctctctgttgcaggctccagacttctccac

SEQ ID NO: 200159 - DNA, 601 bp, Human
cagagcactcaccacctccgcgcccagggcggtcagccggttgtggctcacgtccagctcggtgaggtggtggccgagctcggccaccgccgggggcagccgggcgaagcggttcctgcgcaggaccaggacgcgcaggctgcccagcgccgaccccagcccctcgggtacctcctccaggccgttgttccccaggttcagtgcctcaatgtccccgaggttggccggcagcacgagctggggggaggcgggggactcgagcgcgtcggccccggccccggggcaggccccggcggcggtragcgtgagctggcgcaggttgctccgcagcttcctggcacgcagggcggcgtcccgccacagcctcgcggtcttcaggttgccactgtccatcccagccatggcggggccccgggccgacagcctcacgcggacgcgggagcccgcagctacatgccgcgccgcgccccgggccctccggctcctgcccctgcctgccctcccgcgctcggcggccggcggccgcgggtcctagcgcagccagcggccgagcgctggcggctagggggcggcggcgacgcgagcggctccgggggacgcc

SEQ ID NO: 200160 - DNA, 601 bp, Human
ctgtccagaatctatctgttcaaccacctgaaatttccttccaccaaatgtgggctacatcgacaagaggggaaaggagatggcaaatgttgtgactggaacccattttggaagtctgagtctgttaggagaggatgacacttgtgactgcatttcataaggctcaggtacttactaccttttgctcatctccaaatctccctgtgtttcccttacgaagctttcctggagaacccgtgaagttaaacaaacattctgccaaatgacaaccaagtatctccaaaaacatatcttacagcayaccacagaagaacttctccctctctccacttacctggaaaagcatgtggattgggcgatcctctcttaaggcacttagaacagagaatgtgcacggtgtagtgcagtccaggccattcctgaagtaggacattcagttcctccaccaagggggttatggcttgccatgcggtccatatatttggtaatgatgcatggctagcaatggacagggtgtctggctgcaggactcccctggcaggtctgtaactcacaaccacaggaactttccctctataggcaaagatctgaaatttaccat

SEQ ID NO: 200161 - DNA, 601 bp, Human
taagaaaagtgagcagtaatttttactttctaattacattctgaatgtaagcagagtgcttaaatgcttgaggggatggataccgcattttacaatctgatttctatgcattgcatgcctgtatcaaaacatctcatgcaccccacaaatatacaaacctatgtactcacgaaaatttaagttttttaaaaaattgtgacactggacacttgaaactcaaactcatctacccctttgagacgtgtctaatgaacactttagccaacgatcagtaagaggctaacatcggacactgtccagratctatctgttcaaccacctgaaatttccttccaccaaatgtgggctacatcgacaagaggggaaaggagatggcaaatgttgtgactggaacccattttggaagtctgagtctgttaggagaggatgacacttgtgactgcatttcataaggctcaggtacttactaccttttgctcatctccaaatctccctgtgtttcccttacgaagctttcctggagaacccgtgaagttaaacaaacattctgccaaatgacaaccaagtatctccaaaaacatatcttacagcacaccacaga

SEQ ID NO: 200162 - DNA, 601 bp, Human
tcaacctagatccagggcaacggaaagatgtcaccttcggaaatattggtattcaattccttcctgatactattaccagctgcattcttgttgtccctctctgaccaggacaaagatcagagtgggacgcagtcttccatttcatcacccctccgggtcccctgggggtggggacccaggtgagaaacgtgcaaggatgctattgttctgtctggtttgtgcttaggacacttggaatgttgttaaccacctgctccacaaaaaaacaaaaaacaaaacacacacacacacacacacacamaaacagttgtttaaagaactacaaaggatgaggaaatggacacgttcccaactaaaaactagtttgataccaattaaccaggctcaaaagaaaaaaatcccatataagtaaaacgcaaaacttatggagacagtaaaaagatctgtggttgccggggttggggggaatgaattggcagagcacagaggatttttaaagcagtagaactactctgtatgatactataatgggggatacaggtcattggacatttgtccaaacccacagaatgcccaacacagagtaaaccctgtgtaaact

SEQ ID NO: 200163 - DNA, 601 bp, Human
tttattactttggattaagaatggcttcaggttgctccttcagtaaactaccctgtaaatgcgtaactcccagtcactttattccatttggtatcacaataaagaagtatcttgcttccatgaataacacacaatgacaaatataaaacaaactgaagagtctaccaagtcatggagtgtgacaagattccagataaacatacagaatggatgtctcagttgactggtaactgaatacgctggcttttttcatgcttaagaattaaattcaacctagatccagggcaacggaaagatgtcwccttcggaaatattggtattcaattccttcctgatactattaccagctgcattcttgttgtccctctctgaccaggacaaagatcagagtgggacgcagtcttccatttcatcacccctccgggtcccctgggggtggggacccaggtgagaaacgtgcaaggatgctattgttctgtctggtttgtgcttaggacacttggaatgttgttaaccacctgctccacaaaaaaacaaaaaacaaaacacacacacacacacacacacaaaaacagttgtttaaagaactacaaaggatgag

SEQ ID NO: 200164 - DNA, 601 bp, Human
caataacctatgtctctccttttgttgttaataacattcgtttttattactttggattaagaatggcttcaggttgctccttcagtaaactaccctgtaaatgcgtaactcccagtcactttattccatttggtatcacaataaagaagtatcttgcttccatgaataacacacaatgacaaatataaaacaaactgaagagtctaccaagtcatggagtgtgacaagattccagataaacatacagaatggatgtctcagttgactggtaactgaatacgctggcttttttcatgcttargaattaaattcaacctagatccagggcaacggaaagatgtcaccttcggaaatattggtattcaattccttcctgatactattaccagctgcattcttgttgtccctctctgaccaggacaaagatcagagtgggacgcagtcttccatttcatcacccctccgggtcccctgggggtggggacccaggtgagaaacgtgcaaggatgctattgttctgtctggtttgtgcttaggacacttggaatgttgttaaccacctgctccacaaaaaaacaaaaaacaaaacacacacacacac

SEQ ID NO: 200165 - DNA, 601 bp, Human
atattttataattatatgtatatgtatatattttataatcctgctctaaaaacaactgatgatttattcctattcaatctataagataattttacaatttttcaatcatttgttttccacattgaaaaaaaatctcttccttatagcctggattgcaaaaccaggtgtgcctcatttgaaaggcaaatagacaacacaagacaaggggcttgtttctgcatctcagtacaagcttgtctgtggaatttatgactggtaaaaattaaacataaagagctgacgttagcaaaaaaaacaaaamaaaaaaaaaaaaaacctccagcctcgcccctaactcctcaaagttcttagaagatctttacttgctcaataacctatgtctctccttttgttgttaataacattcgtttttattactttggattaagaatggcttcaggttgctccttcagtaaactaccctgtaaatgcgtaactcccagtcactttattccatttggtatcacaataaagaagtatcttgcttccatgaataacacacaatgacaaatataaaacaaactgaagagtctaccaagtcatggagtgtgacaagattcca

SEQ ID NO: 200166 - DNA, 601 bp, Human
gtacatattttataattatatgtatatgtatatattttataatcctgctctaaaaacaactgatgatttattcctattcaatctataagataattttacaatttttcaatcatttgttttccacattgaaaaaaaatctcttccttatagcctggattgcaaaaccaggtgtgcctcatttgaaaggcaaatagacaacacaagacaaggggcttgtttctgcatctcagtacaagcttgtctgtggaatttatgactggtaaaaattaaacataaagagctgacgttagcaaaaaaaacaaaaaaaaaaaaaaaaaaacctccagcctcgcccctaactcctcaaagttcttagaagatctttacttgctcaataacctatgtctctccttttgttgttaataacattcgtttttattactttggattaagaatggcttcaggttgctccttcagtaaactaccctgtaaatgcgtaactcccagtcactttattccatttggtatcacaataaagaagtatcttgcttccatgaataacacacaatgacaaatataaaacaaactgaagagtctaccaagtcatggagtgtgacaagat

SEQ ID NO: 200167 - DNA, 601 bp, Human
ctccatctcaaaaacaaacaaacaaacaaaaaaacatgaaaaggcaaaggctgccaatagattcaaagggtttctgctgaattaatatatattttaataatctagggattcaatgaatctatttttaatgtatgctctacttaaacactcaacataattctgttcccacatttagcttttatttctaactcattattttaacttttaccaaatctttcgtaactgtaacaattactaacaaatgatggctatcacagaaaaatacagaagaggaaaatgttttttgcatcttcttaatgtracgagaaatgtactataatcatgttttctactattctataccctctgctacttttgaaaaacaacacaattcaaaaaaaaacaaaaagactataagacaaaaatatgtacgttggtgtatatatacatatatattttatatgtacatattttataattatatgtatatgtatatattttataatcctgctctaaaaacaactgatgatttattcctattcaatctataagataattttacaatttttcaatcatttgttttccacattgaaaaaaaatctcttccttatagcctggattg

SEQ ID NO: 200168 - DNA, 601 bp, Human
agagacagtaatttactatttacttttactgtaacatcccaaagttaagaaaattcaaagtccaactttttcagcgttgcatataaaattgttatagtttataggacaacttaacgcttttataaaacataaaagtaaacaatttttaatgtccccagaagcaaaatgacttcttaaaaagacaaaggtggccaagcctagtggctcacgcttataatcccagcactttgcgagactgaggtgggtggatcatctgaggtcaggagttcaagaccagcctggccaacctggcgaaaccccygcctctactaaaaatacaaaaattagccaggtgtggtggcgcatgcctctaattccagctacttgggaggctgaggcaggagaatcgcttgaatccaggaggcagaggttgcagtgagtcaagatcactccactgcactccagcctgggcaacagagcaagactccatctcaaaaacaaacaaacaaacaaaaaaacatgaaaaggcaaaggctgccaatagattcaaagggtttctgctgaattaatatatattttaataatctagggattcaatgaatctatttttaatgtatgctct

SEQ ID NO: 200169 - DNA, 601 bp, Human
agcaaagggattacagccctgagccactgcacgctgcccattacttttcttgtataaaccaaaataagaaaagagaaatttaccattatacttcccgtggtcaactacagtagggcagctcaggccagaaaatccaacaggacaaggccaaaataggcttttcacataaaaatactttaaaagatattagtgcaactttatacattttttctgtataaaatcaagagagacagtaatttactatttacttttactgtaacatcccaaagttaagaaaattcaaagtccaactttttcagcrttgcatataaaattgttatagtttataggacaacttaacgcttttataaaacataaaagtaaacaatttttaatgtccccagaagcaaaatgacttcttaaaaagacaaaggtggccaagcctagtggctcacgcttataatcccagcactttgcgagactgaggtgggtggatcatctgaggtcaggagttcaagaccagcctggccaacctggcgaaacccccgcctctactaaaaatacaaaaattagccaggtgtggtggcgcatgcctctaattccagctacttgggaggctgag

SEQ ID NO: 200170 - DNA, 601 bp, Human
gaaactagtgattgctggatgtgcattttccaatcatttctttttttttttttaagagacagggtcagagtgcaatggcacaatcatagttcactgcaacctcaaactcccatgctcaagtgattgtcccacctcagccccccaactagctgggaccacaagtgtgcacgcttagctgatttttattttttatttttttttgtagacacggagtctggctacattactcaggctggtctcgaactccttgacccaagtgatcctcctgcctcagcctcccaaagcaaagggattacagccstgagccactgcacgctgcccattacttttcttgtataaaccaaaataagaaaagagaaatttaccattatacttcccgtggtcaactacagtagggcagctcaggccagaaaatccaacaggacaaggccaaaataggcttttcacataaaaatactttaaaagatattagtgcaactttatacattttttctgtataaaatcaagagagacagtaatttactatttacttttactgtaacatcccaaagttaagaaaattcaaagtccaactttttcagcgttgcatataaaattgtta

SEQ ID NO: 200171 - DNA, 601 bp, Human
tggatcacgtgaggtcaggagttcaagacgagcctggccaacatggtgaaacctcgtttctactaaaattacaaaaattagctgggcgtggtggtgcatgcctgtaatcccagctactcgggaggctgaggcaggagaatcacttgaacccaggaggtggaggttgcaatgagctcagacagcgccactacactccagcctgggcaacagagcgagactcagtctcaaaaaaaaaaaaaaaaaaaaaaaagaaagggctcccatggatagaagcaagttaataggtagatgagaagaaaamcagaaatgtccaattcctcctttccccactcattcccctcctataatacagagttaaagcccctcacctcttcacggacaaaggggaataacctcagagtatgacataaaatatccactaaataaaaaatactggttgggtatggtggctcacgcctctaatcccaacattttgggaggctgagtggggaggaccatttgaggccaggagatcaagaccagcttgggcaacataaaaaggccctatctctatttcacaaacacacacacacacacacacacacacacacacacacacaca

SEQ ID NO: 200172 - DNA, 601 bp, Human
tcaaaaagggctcccatgggccaggcgcagtggctcatgcctgtaatcccagcactttgggcagccaaggtgggtggatcacgtgaggtcaggagttcaagacgagcctggccaacatggtgaaacctcgtttctactaaaattacaaaaattagctgggcgtggtggtgcatgcctgtaatcccagctactcgggaggctgaggcaggagaatcacttgaacccaggaggtggaggttgcaatgagctcagacagcgccactacactccagcctgggcaacagagcgagactcagtctcaaaaaaaaaaaaaaaaaaaaaaaagaaagggctcccatggatagaagcaagttaataggtagatgagaagaaaaacagaaatgtccaattcctcctttccccactcattcccctcctataatacagagttaaagcccctcacctcttcacggacaaaggggaataacctcagagtatgacataaaatatccactaaataaaaaatactggttgggtatggtggctcacgcctctaatcccaacattttgggaggctgagtggggaggaccatttgaggccaggagatcaagaccagcttgg

SEQ ID NO: 200173 - DNA, 601 bp, Human
gtcaggtgtccttaatcaaaaagggctcccatgggccaggcgcagtggctcatgcctgtaatcccagcactttgggcagccaaggtgggtggatcacgtgaggtcaggagttcaagacgagcctggccaacatggtgaaacctcgtttctactaaaattacaaaaattagctgggcgtggtggtgcatgcctgtaatcccagctactcgggaggctgaggcaggagaatcacttgaacccaggaggtggaggttgcaatgagctcagacagcgccactacactccagcctgggcaacagascgagactcagtctcaaaaaaaaaaaaaaaaaaaaaaaagaaagggctcccatggatagaagcaagttaataggtagatgagaagaaaaacagaaatgtccaattcctcctttccccactcattcccctcctataatacagagttaaagcccctcacctcttcacggacaaaggggaataacctcagagtatgacataaaatatccactaaataaaaaatactggttgggtatggtggctcacgcctctaatcccaacattttgggaggctgagtggggaggaccatttgaggccaggaga

SEQ ID NO: 200174 - DNA, 601 bp, Human
ccacccgctggttttcaaaacaaaacaaaacaaaatcagcaggcattctgatgccctaatggatggatggtcaggtgtccttaatcaaaaagggctcccatgggccaggcgcagtggctcatgcctgtaatcccagcactttgggcagccaaggtgggtggatcacgtgaggtcaggagttcaagacgagcctggccaacatggtgaaacctcgtttctactaaaattacaaaaattagctgggcgtggtggtgcatgcctgtaatcccagctactcgggaggctgaggcaggagaatcasttgaacccaggaggtggaggttgcaatgagctcagacagcgccactacactccagcctgggcaacagagcgagactcagtctcaaaaaaaaaaaaaaaaaaaaaaaagaaagggctcccatggatagaagcaagttaataggtagatgagaagaaaaacagaaatgtccaattcctcctttccccactcattcccctcctataatacagagttaaagcccctcacctcttcacggacaaaggggaataacctcagagtatgacataaaatatccactaaataaaaaatactggttgggta

SEQ ID NO: 200175 - DNA, 601 bp, Human
gcctacctgatgtgctttccacaaagactggaaacacaaagcagacctccatccccagggaacagggacgccaaggctgccagagacaagagagggcagtactgggcctgcacccacccgctggttttcaaaacaaaacaaaacaaaatcagcaggcattctgatgccctaatggatggatggtcaggtgtccttaatcaaaaagggctcccatgggccaggcgcagtggctcatgcctgtaatcccagcactttgggcagccaaggtgggtggatcacgtgaggtcaggagttcaagacsagcctggccaacatggtgaaacctcgtttctactaaaattacaaaaattagctgggcgtggtggtgcatgcctgtaatcccagctactcgggaggctgaggcaggagaatcacttgaacccaggaggtggaggttgcaatgagctcagacagcgccactacactccagcctgggcaacagagcgagactcagtctcaaaaaaaaaaaaaaaaaaaaaaaagaaagggctcccatggatagaagcaagttaataggtagatgagaagaaaaacagaaatgtccaattcctcctttccccac

SEQ ID NO: 200176 - DNA, 601 bp, Human
aggatcacttggacccaggaggtggaggttgcagtgagccatgactgtgccactgcactccagcctgggcgccagagcaagactccgtctcaaaacaaaaacaaaaagaaaagaaaagaaaagctgaaccagagaggactgagacctgagcctacctgatgtgctttccacaaagactggaaacacaaagcagacctccatccccagggaacagggacgccaaggctgccagagacaagagagggcagtactgggcctgcacccacccgctggttttcaaaacaaaacaaaacaaaatcarcaggcattctgatgccctaatggatggatggtcaggtgtccttaatcaaaaagggctcccatgggccaggcgcagtggctcatgcctgtaatcccagcactttgggcagccaaggtgggtggatcacgtgaggtcaggagttcaagacgagcctggccaacatggtgaaacctcgtttctactaaaattacaaaaattagctgggcgtggtggtgcatgcctgtaatcccagctactcgggaggctgaggcaggagaatcacttgaacccaggaggtggaggttgcaatgagctcagaca

SEQ ID NO: 200177 - DNA, 601 bp, Human
agtctcaaaacaaacaaacaaacaaacaaacaaaatatcataaacaaccaaaaaagcacttgccaggcatcaattaagaaatagccgtgcgtggtggcacacgcctgtaatcccagctactcaggaggctgaggcagaagaatcacttgaacccgggaagcagacgttgcagtgagctgagatcgcgccattgcactccaccctgggcgacagagtgagactccatctcaaaaaaataaataaaataaaataaaaatgagagtttgagttctttcaaaataaccaacctgctctgaccccytctacctgatctgccctgtgccaggcattgcacagcttcattcatgctagagcagccttggagaaggcaggccaaacaggggttcctaatccctccctgctgaagtgaaggctgccagcccccagaagaaggtaaacctgacaaccaccccccagcaattaatgttgcaatcagaaaagctgaaccaggctgggtgcggtggctcatgcctgtaatcccagcactttgggaggccgaggagggaggatcatctgaggtcaggagtttgagaccagcctggccaacatggtgaaaccctgt

SEQ ID NO: 200178 - DNA, 601 bp, Human
aggcaggagaattgagccactgcactccaacctggtgacagagtaagactccgtctcaaaaaaaaaaaaaaaaaaagaaagcagcagccagtgaaccatcagctttgggaggttggagtattcactgcctcaaggccaggtggtagaaggctttctgtggccagctcctgcattaaatgcacatttgcatcctgctgctaagtgccccttgcccactcttcccccatttctgtaagaattaggcggtagatatggaaggcaggaatatgtataccagaaaaaccacatgggacaatgacamtggcttcctttaaaatgcataaagataaagaacatcacaggccgagcatggtggctcacacctgtaatcccagcactctgggaggccaaagcgggcagaccacctgaggtcaggagttcgagaccagcctcactaacatagtgaaacccccatctctactaaaaaaaaacacacacaaaaattagctgggggtggtggtatgtgcctgtaatcccagctacgtgggaggctggggcaggagaatcacttgaacccaggaggtggaggttgcagtgagctcagatagtggcactgcactcc

SEQ ID NO: 200179 - DNA, 601 bp, Human
gttgcctgtaatcccagctactcgagaggctgagacaggagaatcacttgaacttaggcaggagaattgagccactgcactccaacctggtgacagagtaagactccgtctcaaaaaaaaaaaaaaaaaaagaaagcagcagccagtgaaccatcagctttgggaggttggagtattcactgcctcaaggccaggtggtagaaggctttctgtggccagctcctgcattaaatgcacatttgcatcctgctgctaagtgccccttgcccactcttcccccatttctgtaagaattaggcgrtagatatggaaggcaggaatatgtataccagaaaaaccacatgggacaatgacaatggcttcctttaaaatgcataaagataaagaacatcacaggccgagcatggtggctcacacctgtaatcccagcactctgggaggccaaagcgggcagaccacctgaggtcaggagttcgagaccagcctcactaacatagtgaaacccccatctctactaaaaaaaaacacacacaaaaattagctgggggtggtggtatgtgcctgtaatcccagctacgtgggaggctggggcaggagaatc

SEQ ID NO: 200180 - DNA, 601 bp, Human
aattagtcaggcgtggtggcagttgcctgtaatcccagctactcgagaggctgagacaggagaatcacttgaacttaggcaggagaattgagccactgcactccaacctggtgacagagtaagactccgtctcaaaaaaaaaaaaaaaaaaagaaagcagcagccagtgaaccatcagctttgggaggttggagtattcactgcctcaaggccaggtggtagaaggctttctgtggccagctcctgcattaaatgcacatttgcatcctgctgctaagtgccccttgcccactcttccccsatttctgtaagaattaggcggtagatatggaaggcaggaatatgtataccagaaaaaccacatgggacaatgacaatggcttcctttaaaatgcataaagataaagaacatcacaggccgagcatggtggctcacacctgtaatcccagcactctgggaggccaaagcgggcagaccacctgaggtcaggagttcgagaccagcctcactaacatagtgaaacccccatctctactaaaaaaaaacacacacaaaaattagctgggggtggtggtatgtgcctgtaatcccagctacgtg

SEQ ID NO: 200181 - DNA, 601 bp, Human
gaatgtttccttcttggtctccagaaataagtcagccctgctagcagtggattctgggaactgttatccacgcagccaccatcatatagagtacacatgcaatcatctctgcattacgccagccacccttccatgaccttccaggaactcacaccagcaggtgtaacctgtacacactttccgggaaccactgaaaacatcttccttcctgcacctattccacctccaccatcagacctcacgctcctcaccatctatatgctccccactatagaatgttggctgggcatggtggctcacrcctgtaatcccactttgggaggctgaggcgggcggatcacctgaggtcaggagtttgagatcagcctggccaccatggtgaaacgctgtctctactaaaaatacaaaaattagtcaggcgtggtggcagttgcctgtaatcccagctactcgagaggctgagacaggagaatcacttgaacttaggcaggagaattgagccactgcactccaacctggtgacagagtaagactccgtctcaaaaaaaaaaaaaaaaaaagaaagcagcagccagtgaaccatcagctttgggaggttgga

SEQ ID NO: 200182 - DNA, 601 bp, Human
gcctctgtcttcctctgcccacattcttctcctgctccaacgtgcactttttagactctttgcttctataaatttacagcaaaagaaaaaaacttgttggtgatagcttttcattaaatttactcttttaataaacaaagccccagtattttcagctaagagattgaggaaggaaaaatgttctgaaggatttagtgccaaaaataaaaataactcagaatgtttccttcttggtctccagaaataagtcagccctgctagcagtggattctgggaactgttatccacgcagccaccatcrtatagagtacacatgcaatcatctctgcattacgccagccacccttccatgaccttccaggaactcacaccagcaggtgtaacctgtacacactttccgggaaccactgaaaacatcttccttcctgcacctattccacctccaccatcagacctcacgctcctcaccatctatatgctccccactatagaatgttggctgggcatggtggctcacgcctgtaatcccactttgggaggctgaggcgggcggatcacctgaggtcaggagtttgagatcagcctggccaccatggtgaaa

SEQ ID NO: 200183 - DNA, 601 bp, Human
acgacacttatctaatctggtaatcatctacatttgtatcactgccaccatcaccacccgctgccactctaccttcattaggtcttgccagtcattccaggagttaaacttaaaatttatctttaaaaaaaagctctatgcagaagacaagaattacacaacatttatttgtacttctcttctacgtgttctttacggagctcgtgtatgtcacccctcattaaatcacatacaccctagaacagaccaggaggctcggatgccctcctttctgtcctctcatccacactaagaggatccycacaaccgtgtccaagatctccaatcaacatggcatctccaggcctagccccaaaacccctactcttaagttacaccttggaaagaaagttgctacaaagcctggcaaaagaattcccagtcacttggccccaggaagaatgacaccaatgtatctgccccacccctccaaaggtgcttggctgagatgtggcaggtgcacaacactgggaatgtactaaatgacagggaatagtttactttaaaatggctttttcatattatgtgactttcactcaataggaggaagaggaggaggaag

SEQ ID NO: 200184 - DNA, 601 bp, Human
agtaacattcaaatatgcaaatgattttctccatatggggtcagattccgtatttacaagaatcaacaatgacattaaccaagatcccaacacagctccccaagcccaagatcaggtattttattttcctagaactcccagttcagtacaaacttctgtatagagcaggtattcaacagtgattgacgacacttatctaatctggtaatcatctacatttgtatcactgccaccatcaccacccgctgccactctaccttcattaggtcttgccagtcattccaggagttaaacttaaaakttatctttaaaaaaaagctctatgcagaagacaagaattacacaacatttatttgtacttctcttctacgtgttctttacggagctcgtgtatgtcacccctcattaaatcacatacaccctagaacagaccaggaggctcggatgccctcctttctgtcctctcatccacactaagaggatccccacaaccgtgtccaagatctccaatcaacatggcatctccaggcctagccccaaaacccctactcttaagttacaccttggaaagaaagttgctacaaagcctggcaaaagaatt

SEQ ID NO: 200185 - DNA, 601 bp, Human
atggtgactcacgcctgtaatcccagcactttgggaggccgaggcaggaggatcacttgaggtcaggagattgagaccaggctggccaacacgatgaaaccccgtctctactaaaaattcaaaaaaaactagctgggtgtggtggcacatgcctgtagtcccagctagttgggagatgaggcaggagaatcacttgaacccgggaggcggaagctgcagtgagccaagatcgcatcactgcactcaagcctgggtggcagagagagactcccatctcaaaaaaaaaaggtaaggactcctkaagaaaaggcatttcttttccttggaaaggctgattcgtttgggaagtttttagagatcctcatatacaatgaatttcctttttccagcatcctcacaagttctgcctgagatttctcgcaaacaagtaatccaaactgaaagtcaactcaaaagaaggacttgaccattactttccacctactcatacatctgaaggaaattcaaagctgtggcctgctttgctcagtaggatcacattttttttctggaaaaatcaaaagccagggttccccccaaagtaacattcaaatatgcaaat

SEQ ID NO: 200186 - DNA, 601 bp, Human
gtacttcaaagcatctctcagcaaagaaatccagcagtcatatatttttattatgatgatatgcactttaatggatgctgtctttggagtcagcattcatatagtctttggtgttcagaaatgactgatgatttgaatccttccccagatgggagcaagtctataaatgacaaaaaaggtaaggactactgccaggcatggtgactcacgcctgtaatcccagcactttgggaggccgaggcaggaggatcacttgaggtcaggagattgagaccaggctggccaacacgatgaaaccccrtctctactaaaaattcaaaaaaaactagctgggtgtggtggcacatgcctgtagtcccagctagttgggagatgaggcaggagaatcacttgaacccgggaggcggaagctgcagtgagccaagatcgcatcactgcactcaagcctgggtggcagagagagactcccatctcaaaaaaaaaaggtaaggactcctgaagaaaaggcatttcttttccttggaaaggctgattcgtttgggaagtttttagagatcctcatatacaatgaatttcctttttccagcatcctcacaagttc

SEQ ID NO: 200187 - DNA, 601 bp, Human
ggtaagtcaaacaacggcacccaggcgaaatatttttctggttttatgttttccctttccattgcgtttttaaaaattccttcttttcaaaaaaagaaaaaaaaaaaggaaaaaaggagggaaggacagaaagagtgaggaggaagggagggaggcttgttctagagacctaaaattcactactgctataacctagtactaatacaatgttaatagcatagacttcattttaggaataaggaggatctaagaaaattaaactctttaattttctcaacatttaatatgctaatagtacaaragtacttcaaagcatctctcagcaaagaaatccagcagtcatatatttttattatgatgatatgcactttaatggatgctgtctttggagtcagcattcatatagtctttggtgttcagaaatgactgatgatttgaatccttccccagatgggagcaagtctataaatgacaaaaaaggtaaggactactgccaggcatggtgactcacgcctgtaatcccagcactttgggaggccgaggcaggaggatcacttgaggtcaggagattgagaccaggctggccaacacgatgaaaccc

SEQ ID NO: 200188 - DNA, 601 bp, Human
ttcctagggctgctgtggggattaaataagatcacccctaggaggcacttagcactgtctctgcaacatgagaaaacgtcaacattgtcacctcttctatttttctccaaaaatagggagactgatgtgatgattaacacaattacctttatgacatgaaaaacaagaatcatattaaaacaataataaagttggtaagtcaaacaacggcacccaggcgaaatatttttctggttttatgttttccctttccattgcgtttttaaaaattccttcttttcaaaaaaagaaaaaaaaaaargaaaaaaggagggaaggacagaaagagtgaggaggaagggagggaggcttgttctagagacctaaaattcactactgctataacctagtactaatacaatgttaatagcatagacttcattttaggaataaggaggatctaagaaaattaaactctttaattttctcaacatttaatatgctaatagtacaaaagtacttcaaagcatctctcagcaaagaaatccagcagtcatatatttttattatgatgatatgcactttaatggatgctgtctttggagtcagcattcatatagtc

SEQ ID NO: 200189 - DNA, 601 bp, Human
agaacaatgcttttaaaactctagttgatgggccagtgggtcactggcaagtgtctaccagtccatgaatgccatttaaacaaagaagtctctcccttactataatttctaaatgcaaaacgcatctgtgcccacacatgcccacccctaggcctgctgaagtctttgtctgctccctgccttttaaatggcattctaacttgaaatgctccacccacctcccttcttcaggtggttaactagaaatcatcctctgacactcaactacagtgtggcctttctgggaacccttctctgagacccctgatggcgctctccccaccttacctccacctgaccatgacctccgctgacctctgcacgggcagctcctgtgcagtaccagactgtctgcccagaacttagaatatgaagggagaggaggtgagctggtgtactctggaaatcaatggcaacctaactgagacccaagtgacggtgggtcagagcagaggtttggggctgatatcctagagttctctaactctggggaattcacttaatttctaaatgtcaatttctccttctgaaagcaaagacagtaataatacctacttcctag

SEQ ID NO: 200190 - DNA, 601 bp, Human
aacacattttagagtgctgggttacacccactctttcttcatcacatgtacagaaaggcaaagagtgtgggtaatctcttaaattttaaattcccacttggtatgaggataaaacatccaagaaacatttcctgtgcagaacacaccaagcttaggtgtagaaaatacaacggtgtggaactcgagaggatggttctaggatacaaataaaaacaaccacgcagcgcgggaagatttttgtttagaaaacagatgggacagaaaggcagatgcaatgttttgagtcaatgagatacagttygttcttaattatatttcattgatttcttacatggacagaacatcattcttgctgccactgttttattttgatcagcggtatatctatctgtaaacatgtacaatttgtaattattgctatgtctaaacactgcatcacgtgtaatggctgaattaagctgtgaaatgcgtaattatgctgaaaacaatggtgttccaatacacatcaccaaagccaatttaaaaaaattaccttgtttcaaatcacaaagcgaagccttcataaccctcgaggctttttttaggtcccaccactttgatt

SEQ ID NO: 200191 - DNA, 601 bp, Human
aagtatgttttaaacacagaagcaactataacaggatttaattgcttacttttttttttttttttttacaggtcaaacacattttagagtgctgggttacacccactctttcttcatcacatgtacagaaaggcaaagagtgtgggtaatctcttaaattttaaattcccacttggtatgaggataaaacatccaagaaacatttcctgtgcagaacacaccaagcttaggtgtagaaaatacaacggtgtggaactcgagaggatggttctaggatacaaataaaaacaaccacgcagcrcgggaagatttttgtttagaaaacagatgggacagaaaggcagatgcaatgttttgagtcaatgagatacagttcgttcttaattatatttcattgatttcttacatggacagaacatcattcttgctgccactgttttattttgatcagcggtatatctatctgtaaacatgtacaatttgtaattattgctatgtctaaacactgcatcacgtgtaatggctgaattaagctgtgaaatgcgtaattatgctgaaaacaatggtgttccaatacacatcaccaaagccaatttaaaaa

SEQ ID NO: 200192 - DNA, 601 bp, Human
ggctggctgcagtgaggcctggcccaacagcccctaaggcaaattcctgaagggactaaatagaaaatgagtggatattccctattccaagggaaaaaataaaaataaaaaaaaagatgggaacaatacagtaaccagggaaaagcacagagcatgcacatgtgtgtttttcttggggagggggaaatgcatatatttcagaggcttaacaaatacattcaaaagaacacctgctccatcccagacaggcagcagaacatcgtgcaagagtgagacggagacaaccgggcagtgccactcrtgagccatctgggagtgaggggtgtcagggaaggggacagatgcaccctacagggctttgcatcccagttcttattactgtaccttgggcacaaaacagcccagctctaggcaagccagtgagccatttttggtatcatagtgttcttttggaaaattcacatttctatttttagttcttccacatgcaattcataagcaatagccctccggaatcaaagtcacctcagctatgccatgagtcaagagaatcccagtgaatatattttttaatagcatgttcagggaaaatgtgaccagc

SEQ ID NO: 200193 - DNA, 601 bp, Human
tggcttttctttttagctaagcaagaaaatgttatcagccctggtaatcaacaagatgcaatcatccctgctatttgggtaagcttttaatgccgcaccacattacacagaggaggctcagatgcataggctcggatgcatgaacagcattcaagaagtgtctgggagaggttaacacacagctgataagctctggctggctgcagtgaggcctggcccaacagcccctaaggcaaattcctgaagggactaaatagaaaatgagtggatattccctattccaagggaaaaaataaaaataaaaaaaaagatgggaacaatacagtaaccagggaaaagcacagagcatgcacatgtgtgtttttcttggggagggggaaatgcatatatttcagaggcttaacaaatacattcaaaagaacacctgctccatcccagacaggcagcagaacatcgtgcaagagtgagacggagacaaccgggcagtgccactcgtgagccatctgggagtgaggggtgtcagggaaggggacagatgcaccctacagggctttgcatcccagttcttattactgtaccttgggcacaaaacagcccagct

SEQ ID NO: 200194 - DNA, 601 bp, Human
ggaaaccgtatcaactccctgagatgaaaatctgccccattccagaaatgagctaaatcaaaggagggagaaggaaggaagaggaggctaaggcaaaaagttattcacactttgcataaacatgcccggatggcaagcattataaaacgatctgtgtaacataagcttctgggtccatgggaggcaagggagcatgtgactgtgcacggatatgaacaaagccagcgacacaccaccagattcttcaaaagcaaatatttgtctatgaccaaagaatcgggattcttttctaacaaagagsaatgtacaccgttctaattcctgattcttcctcctgctttacagtgggttatgatctcgatggaaatccccccatgaataaatgtgtctgcaatcacaaatggccccataaatcagaagatttatgaactgtaaaaggggacggcaggaggattccaaccttgcagcttccttcatgcggaccacctggggccggatgcatggcagtttatcacttcctggaaacagtcatctggcttttctttttagctaagcaagaaaatgttatcagccctggtaatcaacaagatgcaatcatccc

SEQ ID NO: 200195 - DNA, 601 bp, Human
ctactaaaaatacaaaaattagctgggcatggtggcacatgcctgtaatccctgctactcatgacaatgaggcacaagaatcatttgaaccagggaggtggaggttgcagtgagccaagatcactccactgcactccagcctgggcaacagagtgatcacaaacacgcaaacaaagaaaaaactacttggggacttgacatctattcattcatttccccctcacaacatctaaggagactctgatagcaggtgtaaatgcttgggaactgttagaattatttttacctatttacagacgamattgaggcccagggaggccaagtggcttcccagaggtccaggcccccgacttcctaatccactgatttaattacatccaaggctcagatgcatgggctcagatgtatgaatggcattcaagaagtgcctgggagaggttaacatactgctgataaaagatgcaaggcctctttctctaatgctggtttaatataaagcaagtaagctgcatggcaatattcatctctagctacagctaaggtgacacttgttctgtcaccctacctaggaaaccgtatcaactccctgagatgaaaatct

SEQ ID NO: 200196 - DNA, 601 bp, Human
tttatttcaatttcctttattattaggtggaaaagtagttaacagctatgcaaagcaggtgcagagaggaggaggaggaaggcaaaaagagggccgcttttgaggtgcatgaaccaagaagagtcgctgcctgctctgtgccatcatgcagctgttaatgccacaaggctgctctcccaccctccccaaagttgataatgaaaaatcaaagcacaaacaaaagcaatgcacagaacaggatagcaaaacccgatcatcctgcaccaaccacatctcttcagtgcatctgctttgacctctkcttttacaagcactaccactgaaaataagctagaacaaaagctgattcgttatgcacaaccataaagaactccggggcacgctacatacataattcatcatgccaagcacgcgacaatcagcatcatttatctttgcggtattttaaagcggtgacaggttactagatatttataaagtctcttatttctatgagacccttccaaatttaagaaataaagaaccttattcctctgcaaatggcactgcttacaaacctaagactatatatctcctggaattcacctggtatccatcataa

SEQ ID NO: 200197 - DNA, 601 bp, Human
cttaacatagaaagaagttataaatgactatgcaaccttacaactggcttccacccatagtcatcgctacttcatatgcaaacagcacctctgatatctcactcagattctaaagaaatctttgctaggggaagagaaaaagggagaggaaaaaaaagacattctctgctgtgttttacatttcttaatcctctctagtttcgtctagagtttagagaaagtcagtgagaaaaaagattatgggcatgttcctaaccatttatttcaatttcctttattattaggtggaaaagtagttaasagctatgcaaagcaggtgcagagaggaggaggaggaaggcaaaaagagggccgcttttgaggtgcatgaaccaagaagagtcgctgcctgctctgtgccatcatgcagctgttaatgccacaaggctgctctcccaccctccccaaagttgataatgaaaaatcaaagcacaaacaaaagcaatgcacagaacaggatagcaaaacccgatcatcctgcaccaaccacatctcttcagtgcatctgctttgacctctgcttttacaagcactaccactgaaaataagctagaacaaaagc

SEQ ID NO: 200198 - DNA, 601 bp, Human
atgaatgggacggaaacggttcatatgactacttggatatctctcatcctgtgaaccagtctaacaagcaattaccttgaggaatctgaaaataaaatcgtgatatgaattcatgaatcaggaaagaaccgtgtacttgcataattagccttctttagagaatggggaaatacatatctgatacaagacaatttttaaggtgtaatcccatcatttgcaagtcactaagaataaatgtgaaggtgacagtgggaaaaaaaagaaagagaaagagagatgggttggtatgatctatttttarcttacagttcagctacacataatatattaacaaaatttctgatactgctaaggtgcattaatatagattaaaggaaacaagataataaaggagatggactgagctcttcaagtctgtactagtaggaaatggaattaaacacaggctgtggggttttatgaaagtcacaatggtcatcagcatatgcaaacccactaaattcttcaccatataaactttttgttacatttttataacaaaagttaaaaatataccctcacatttttgaaagtatgcttcttatggttcctaagataccaa

SEQ ID NO: 200199 - DNA, 601 bp, Human
ggattacaggcatgagccactgcagtcagccagtaaggatcactcttatccctagtaaaaaggatccgtgatacaaaatggccactgagtcccttctctctccccagtctcttacacattctcataaacagtgattgactcacttattttctgcagaagacagaatggcatgaatgggacggaaacggttcatatgactacttggatatctctcatcctgtgaaccagtctaacaagcaattaccttgaggaatctgaaaataaaatcgtgatatgaattcatgaatcaggaaagaaccgygtacttgcataattagccttctttagagaatggggaaatacatatctgatacaagacaatttttaaggtgtaatcccatcatttgcaagtcactaagaataaatgtgaaggtgacagtgggaaaaaaaagaaagagaaagagagatgggttggtatgatctatttttagcttacagttcagctacacataatatattaacaaaatttctgatactgctaaggtgcattaatatagattaaaggaaacaagataataaaggagatggactgagctcttcaagtctgtactagtaggaaatg

SEQ ID NO: 200200 - DNA, 601 bp, Human
cgatcctcccacctcaacctctcaaagttttgggattacaggcatgagccactgcagtcagccagtaaggatcactcttatccctagtaaaaaggatccgtgatacaaaatggccactgagtcccttctctctccccagtctcttacacattctcataaacagtgattgactcacttattttctgcagaagacagaatggcatgaatgggacggaaacggttcatatgactacttggatatctctcatcctgtgaaccagtctaacaagcaattaccttgaggaatctgaaaataaaatcrtgatatgaattcatgaatcaggaaagaaccgtgtacttgcataattagccttctttagagaatggggaaatacatatctgatacaagacaatttttaaggtgtaatcccatcatttgcaagtcactaagaataaatgtgaaggtgacagtgggaaaaaaaagaaagagaaagagagatgggttggtatgatctatttttagcttacagttcagctacacataatatattaacaaaatttctgatactgctaaggtgcattaatatagattaaaggaaacaagataataaaggagatggac

SEQ ID NO: 200201 - DNA, 601 bp, Human
gcaccaccacgcccagctaattttttattttttgtagaaatggggttttgccatgttgcccaggctggtcttcaactcctgggctcaagcgatcctcccacctcaacctctcaaagttttgggattacaggcatgagccactgcagtcagccagtaaggatcactcttatccctagtaaaaaggatccgtgatacaaaatggccactgagtcccttctctctccccagtctcttacacattctcataaacagtgattgactcacttattttctgcagaagacagaatggcatgaatgggayggaaacggttcatatgactacttggatatctctcatcctgtgaaccagtctaacaagcaattaccttgaggaatctgaaaataaaatcgtgatatgaattcatgaatcaggaaagaaccgtgtacttgcataattagccttctttagagaatggggaaatacatatctgatacaagacaatttttaaggtgtaatcccatcatttgcaagtcactaagaataaatgtgaaggtgacagtgggaaaaaaaagaaagagaaagagagatgggttggtatgatctatttttagcttacagttc

SEQ ID NO: 200202 - DNA, 601 bp, Human
cggctgcaactacaggcatgcaccaccacgcccagctaattttttattttttgtagaaatggggttttgccatgttgcccaggctggtcttcaactcctgggctcaagcgatcctcccacctcaacctctcaaagttttgggattacaggcatgagccactgcagtcagccagtaaggatcactcttatccctagtaaaaaggatccgtgatacaaaatggccactgagtcccttctctctccccagtctcttacacattctcataaacagtgattgactcacttattttctgcagaagayagaatggcatgaatgggacggaaacggttcatatgactacttggatatctctcatcctgtgaaccagtctaacaagcaattaccttgaggaatctgaaaataaaatcgtgatatgaattcatgaatcaggaaagaaccgtgtacttgcataattagccttctttagagaatggggaaatacatatctgatacaagacaatttttaaggtgtaatcccatcatttgcaagtcactaagaataaatgtgaaggtgacagtgggaaaaaaaagaaagagaaagagagatgggttggtatgatc

SEQ ID NO: 200203 - DNA, 601 bp, Human
gtaaaacaagtggtgtctattatttctctcaggaaggcagaaaaactagggcagggattactgcagctacagaatgactgtcctccacacctctccttgttcaggcggcttggcctactctcctgacagtgcagccacggaaaaagtgccaaagcatgccaacctcaaacagaggtgatgacagagaagctgaaatcctggtttccctggggatttggctggccaatttttagaaagctctactcctagctgaagtgcttttattattctctttttctaagcaggaagaatacagaagaasagggcctgggaacctaggagcacttctctttaccattggttcagtaaaatcagtgtcattttgcctgcgaaaagctctctaactgatccctgttttatcagacgataaaactctgacgctgaatgggaacctagaacagggatctatggcaacttagcaaggatcacttcttttttgtttttttttttttcttttttgagacagggtcttactgtcctctaggctggagtacggtggcgtaatctcagctcaccgtagcctctgccgccctggctcaaacaatcctcccacctcagcctc

SEQ ID NO: 200204 - DNA, 601 bp, Human
tgccgaaattgtctcatccaaaaaattacttgagatttcttttggctttaggtatgaaccacatattagttactagaaagggtatctagtttccacctagattaaaaaacaaaccaaaaacatgtttcaggccaggtctggtggctcatgccggtaatcccagcacttgaggagggcaaggtgggtggatcacttgaggtcagcagttcaagaccagcctggccaacatggtgaaaccccatttctactaaaaatacaaaaagttagctgggcacggtggcatgcacctgtaatcccagtyactcaggaggccgaggcaggagaatcgctcgaacccaggagctggaggttgcagtaagccaagattgtgccactgcactcaaccctggatgacagagtgagactccatctcaaaaaaaaaaaaaaaaaaaaaaaagaaatgtttcactgtcaagatgacaggctgagaaattatttccccataaaaacctagctccacttagtttaagaaacaaaactcaaaaggcaaaaatcagaaactcctggatacaaaaatcagaaatgggaaaagagacacaaggtacagaggatggagaggaag

SEQ ID NO: 200205 - DNA, 601 bp, Human
ttgaacttggggtcacttggcagtcattttatctttaaactcacacctacaggcactagggaaaaaaggaaagggaaggagagagggagagagagaggactcagataagatgatatcataaagttatataacatggtgccgaaattgtctcatccaaaaaattacttgagatttcttttggctttaggtatgaaccacatattagttactagaaagggtatctagtttccacctagattaaaaaacaaaccaaaaacatgtttcaggccaggtctggtggctcatgccggtaatcccagcwcttgaggagggcaaggtgggtggatcacttgaggtcagcagttcaagaccagcctggccaacatggtgaaaccccatttctactaaaaatacaaaaagttagctgggcacggtggcatgcacctgtaatcccagtcactcaggaggccgaggcaggagaatcgctcgaacccaggagctggaggttgcagtaagccaagattgtgccactgcactcaaccctggatgacagagtgagactccatctcaaaaaaaaaaaaaaaaaaaaaaaagaaatgtttcactgtcaagatgacaggct

SEQ ID NO: 200206 - DNA, 601 bp, Human
atttctcctaaaatcctcatatatttacatcatcttacagaaccacaatgagcataaaattagctactctcttcctatcatttgtaccagctacccaccagacacttttgaaatgtatcatgtaaactgaattttccagttgcatgccaggataaaagtccttgaacttggggtcacttggcagtcattttatctttaaactcacacctacaggcactagggaaaaaaggaaagggaaggagagagggagagagagaggactcagataagatgatatcataaagttatataacatggtgcygaaattgtctcatccaaaaaattacttgagatttcttttggctttaggtatgaaccacatattagttactagaaagggtatctagtttccacctagattaaaaaacaaaccaaaaacatgtttcaggccaggtctggtggctcatgccggtaatcccagcacttgaggagggcaaggtgggtggatcacttgaggtcagcagttcaagaccagcctggccaacatggtgaaaccccatttctactaaaaatacaaaaagttagctgggcacggtggcatgcacctgtaatcccagtcact

SEQ ID NO: 200207 - DNA, 601 bp, Human
aacacagaagggtaagttaaaaaaacaaagccattttctgcccctatgctcaaccaaatctgctgctactggccatgagggccgcccactgcacgattcaaggatgccattcacaccaagcaacaaaatggccctgcccgactcctcctcctctttgcccaccctcccacattagtagaaacaatgtcttcctatcagaatcaccaagtaaaaatatttttaatgttccttggaccaaattcatatcctaaatattcttatgttaaccttgatgtgtttcagacaagtcaaaatgcaatcwacaaataactgtttcagtgagatcactttttatttctcctaaaatcctcatatatttacatcatcttacagaaccacaatgagcataaaattagctactctcttcctatcatttgtaccagctacccaccagacacttttgaaatgtatcatgtaaactgaattttccagttgcatgccaggataaaagtccttgaacttggggtcacttggcagtcattttatctttaaactcacacctacaggcactagggaaaaaaggaaagggaaggagagagggagagagagaggactcagataa

SEQ ID NO: 200208 - DNA, 601 bp, Human
atatcaaggagctgaaactcaccagatcactgcatttggacaaggagacaccagacccttcacccattatggctgcctcagtgaccaccagcttcctgttgaccaactcctcttccttataccttcctaattcctgtttaccggcatgtagttacattgccttcccactatataagcccccaattttagttggtcagggagatggatttgagactgagctcccatctccatggctgcagtacccgattaaagccttcttccctggcaacacttgtctcagcagtgattggctttctgtgcrgcaagcagcaggacctaaaccaaatctctggtgttctggtaacataaacacagaagggtaagttaaaaaaacaaagccattttctgcccctatgctcaaccaaatctgctgctactggccatgagggccgcccactgcacgattcaaggatgccattcacaccaagcaacaaaatggccctgcccgactcctcctcctctttgcccaccctcccacattagtagaaacaatgtcttcctatcagaatcaccaagtaaaaatatttttaatgttccttggaccaaattcatatcctaaata

SEQ ID NO: 200209 - DNA, 601 bp, Human
catttccctaacatactggtccttaacccagaccatggcctgttttcactaagagtctggcccttacctgtaactgaaacccaccccatcatctcacagaactaatctattaatatgcagtttctaatgagcttagaaattgacccaccctgtcttaaaacttaagaaagttgcatttgttttatctgaattcctttctcagaaaaccaaccatcagggctcccagatatcaaggagctgaaactcaccagatcactgcatttggacaaggagacaccagacccttcacccattatggctrcctcagtgaccaccagcttcctgttgaccaactcctcttccttataccttcctaattcctgtttaccggcatgtagttacattgccttcccactatataagcccccaattttagttggtcagggagatggatttgagactgagctcccatctccatggctgcagtacccgattaaagccttcttccctggcaacacttgtctcagcagtgattggctttctgtgcggcaagcagcaggacctaaaccaaatctctggtgttctggtaacataaacacagaagggtaagttaaaaaaacaa

SEQ ID NO: 200210 - DNA, 601 bp, Human
aaaatgtttctaacctctgttttgaccatctgattcctacctatttggacttcctcagagaatcatttccctaacatactggtccttaacccagaccatggcctgttttcactaagagtctggcccttacctgtaactgaaacccaccccatcatctcacagaactaatctattaatatgcagtttctaatgagcttagaaattgacccaccctgtcttaaaacttaagaaagttgcatttgttttatctgaattcctttctcagaaaaccaaccatcagggctcccagatatcaaggagstgaaactcaccagatcactgcatttggacaaggagacaccagacccttcacccattatggctgcctcagtgaccaccagcttcctgttgaccaactcctcttccttataccttcctaattcctgtttaccggcatgtagttacattgccttcccactatataagcccccaattttagttggtcagggagatggatttgagactgagctcccatctccatggctgcagtacccgattaaagccttcttccctggcaacacttgtctcagcagtgattggctttctgtgcggcaagcagcag

SEQ ID NO: 200211 - DNA, 601 bp, Human
aaaggttctcttgtacccctctgcagtaaatcccttccccataccaccggccccagacctgctttctgacagtgtatcagttttgccttttctagaacttcatataaatggagtcatacaatatgtactcgactggcttctttcactcagcataatgcttttgagagtcatccatgtcgctttatcagtagttcatctcttttccttgctatgtcgcataccacaatgtgtttatctgtgcaccagacaagttgtttccagtatgtggcaattgtggaaaaagctgttatgaacatttgtrtatctttttaaaatgtattttcatttcccttgggtgaattaactcagaatgaaattgctgagttagctagtaaacatgtgtttaactttatatgaaactagcaaactgtttccccaaatgctgtatcattttccactcccaagagcagcgtaggaaagctccagttgtcacagctcctcgtcaacatttggtatggtcagtctttttcatcttagccactctagggaacatgcactagtatctcctagtggtttaatttacatttctctaatgattaatgatgttgacatcttatactta

SEQ ID NO: 200212 - DNA, 601 bp, Human
ttttaatttcatcacttaacgtttcttgggctgaggtaatatcaaactcatctttacattcatccactgtaatttcaagtagaatgcctgaaaagtggtagacatatataaaacatctaccgaactgaattaaagcaaaataaaacatgtaatgtaaaacagaacactcaggccttgtgtcttacaaaatccttgaaacttcacaatcgagatgtgaccattgccaagtctttccaatgaattaaaaagcaaacaaaatttctactatacttatgccacgtgaaattgctgcttttgtagrtcaagaatgattggatatcaacaatttcatgtggttcagtctaacagaatataatcaatcacacaaactaaggtagaaaatctggatatatctccaacaacaatgttccacttaccacaatattcatatacaaaggatataatcacaaggtatataccaaattagtgtgaaaacagcatgtttcaggacatctaaggaaatcgtataatcaaaacttattttttaaattaacaagatataataaaggcattttacgtgtaataaaattcaccaattttaaacgtagaacttgatgcattt

SEQ ID NO: 200213 - DNA, 601 bp, Human
tattcaaagacagcttaataaaatacagttgatcgtttaacaacacgggtgtgaactgtgctggtctacttatatgacagttttcttccacccctaccatgcctgagacagcaagaccaacccctcctcttcttcctcctcctcagtctactcaattttaacatgacaaggatgaagaccttcaccgatgatttacttccatttaaggaacagtaaatatatttcctcttccttacggttttctcagtaacattttctttgctctagtttactatattgtaagaatatagtatctaatatmtataatgtacaaaatatgtgctattgactgttaatgctatcagtaagacttccagtcaacagtaggctattagtagttaaattctgcaaagtcaaaagttagatgttcaactgaatggggggtcggtgcccccaatgcctgcattgttcaagggtcaactgtattttttactaattttaagtgatatctggtattaatcccattttcagttaagtggcagttcaaacaaattaaaataacttacccatcaggactgcataccttaggtggaggatttaggatctgaaacacatttggctg

SEQ ID NO: 200214 - DNA, 601 bp, Human
taacattattaccctttgaaaattctaataaatgaaagaaaatttaaatttaatatttaaaattatattaaatggcccatccagttttggagcctaggaagggttcaacaagagtgatttattttactaagacctagagcaacagatgagacctatgttactgaaaacgattatgcaatgctataattacaactatattaaaaatatgccttttgggggatactctcttcattgtggcgatggcctcacaggtaaaaaacaaaaatagacagtcctccctcggtatatatatggggggttkggttctagggcccccatccccagcacaccaaaatctatgcataaagtcctgaagttggccctcgggacctgcatatgagatgagccagccctccgtatgcacaggtggcgtcgaggtggacccaagcagttcaaatctatgttgttcaaggatcaactacactcatgattcagaccaaaatagaaataaacaaagtgaaaatatccgtaacaacaaggataaagcattctcagtcaaaaaagactatatagaggaacacaagccagatatctgttttatatttctcaacatattttctgc

SEQ ID NO: 200215 - DNA, 601 bp, Human
caacaccaccaattttggggaaacctttttctaaacaaatgagaaaatccaagatgattcaaatagctgagctgaacaaaacaaaatgctctgagacaatgactggtgttcactgatctgggtcatttgcctgcctccacgcctgacagcctttgacctatcccaaagcaacagccatctgtctagtatctgaacagaaattgggacggagcacagggggtatacaaggcagggagtagttaagaagccagcaagggaaggaaggaaattgtttagtaagtgcccactacatgccaagcaytgtcttaggcatttttatatgcattattttattcagtccttacaagagctgtatgacataaattttgcttttttaaaactaagcaagtctcagatgtctccatgtcatcaaaatctaaatatataacattattaccctttgaaaattctaataaatgaaagaaaatttaaatttaatatttaaaattatattaaatggcccatccagttttggagcctaggaagggttcaacaagagtgatttattttactaagacctagagcaacagatgagacctatgttactgaaaacgattatgca

SEQ ID NO: 200216 - DNA, 601 bp, Human
agttcaggcccggcgcggtgtctaacgcctgtaatcccagcactttgggagtcccaggcaggtggatcacaaggtcaggagctcgagaccagcctggccaatattgtgaaaccccgtctctaccaaaaaatatataaaaattagccaggcatggtggcgggtgcctgtagtctcagctactcaggaggctaaggcaggagaatcgcttgaacccgggaggcagaggttgcagtgagccaagatcgcaccaaggcactctagcctgggcaacagagcaagactccgtctcaaaaaaaaaacaaaaaaaaatcttttgtttgtaaactcagtagatatataactgtcctacagtgacattgacaagttaacttttaaaatacctaaagcaagtttccctgtagagttgggcaaattccatatgctgactgcccacttgttgatacattttgctatcaggaacccaacaccaccaattttggggaaacctttttctaaacaaatgagaaaatccaagatgattcaaatagctgagctgaacaaaacaaaatgctctgagacaatgactggtgttcactgatctgggtcatttgcctgcctccac

SEQ ID NO: 200217 - DNA, 601 bp, Human
gaattctaattaaaaatgagttcaggcccggcgcggtgtctaacgcctgtaatcccagcactttgggagtcccaggcaggtggatcacaaggtcaggagctcgagaccagcctggccaatattgtgaaaccccgtctctaccaaaaaatatataaaaattagccaggcatggtggcgggtgcctgtagtctcagctactcaggaggctaaggcaggagaatcgcttgaacccgggaggcagaggttgcagtgagccaagatcgcaccaaggcactctagcctgggcaacagagcaagactmcgtctcaaaaaaaaaacaaaaaaaaatcttttgtttgtaaactcagtagatatataactgtcctacagtgacattgacaagttaacttttaaaatacctaaagcaagtttccctgtagagttgggcaaattccatatgctgactgcccacttgttgatacattttgctatcaggaacccaacaccaccaattttggggaaacctttttctaaacaaatgagaaaatccaagatgattcaaatagctgagctgaacaaaacaaaatgctctgagacaatgactggtgttcactgatctggg

SEQ ID NO: 200218 - DNA, 601 bp, Human
tggcctaaaaaacccaatatcacccaaaggaagcaggaggtcctgattctgttctcagcagcaactgcctggctcagtccgtgtgtctgctctcaagaccccgactatgcccctgcaggctccatttctcctactacacaaacaaggctcttgccacccactcaggcttatttacttgcactgtgtacatatacaccgactcacacacacactcacataccccccaaaaaaaatggaggcttaaaataccccattttgtcacagtttgctcggaagctactccctctagttcaacaggcgrcaagctcctgtcctacctgcccctttctaccttttgggaataaaaaggagcaaccagaaatagcagagaaagcggaagggaaccaggatctgactcgtaattacagttccataaacccagacaactatttttgttagttaacctggacaatcgcacaaggtgtctgctcattcttaaaaaaaaaaaaaaaaaaaaaaaaccacacacaacttagattgctagtgcctggcacgtacaaggcaaacagtgtgggtacaaccattaggtcaggtcctagctacgtatatatatttgagatgg

SEQ ID NO: 200219 - DNA, 601 bp, Human
aaatctgaggtcaccaggcggatccctaataaggacagagcgctccctcaggaacagcgatgccaagcccagttttggatacatagggagtgggtggtggaatgccggcttccattcgaaggagacccctctccagcaccatgggagtcgcacccttagcagatattctgtcctccagagagctgaggtttcaggagtgccaagcaaggtataaatgtcattagcgtgagtacttaaaacataccacaatgtccaggtgcggtgactcacacctgtaatcacatttgggaagccgaggcgsgcagatcacttgaggtcaggaattcgagaccagcctgtgcaacatggtgaaacctcatctctactaaaaatacaaaaattagctgggtgtggtggcatgcacctgtaatcccagctacttgggaggctgaggcaagagaatcgcttgaacctgggaggcggaggctgcagtgaactgagatcacgccactccagcgtaagcaacaaagcgagaccctctctcaaacacacacacacacacacacacatacacacaaacacacacacccacaagagggtttagacctggtgcctgctggtt

SEQ ID NO: 200220 - DNA, 601 bp, Human
gaaaaaatgttttccctcaacaaagttgaagcttaagtgtaaatctgaggtcaccaggcggatccctaataaggacagagcgctccctcaggaacagcgatgccaagcccagttttggatacatagggagtgggtggtggaatgccggcttccattcgaaggagacccctctccagcaccatgggagtcgcacccttagcagatattctgtcctccagagagctgaggtttcaggagtgccaagcaaggtataaatgtcattagcgtgagtacttaaaacataccacaatgtccaggtgckgtgactcacacctgtaatcacatttgggaagccgaggcgggcagatcacttgaggtcaggaattcgagaccagcctgtgcaacatggtgaaacctcatctctactaaaaatacaaaaattagctgggtgtggtggcatgcacctgtaatcccagctacttgggaggctgaggcaagagaatcgcttgaacctgggaggcggaggctgcagtgaactgagatcacgccactccagcgtaagcaacaaagcgagaccctctctcaaacacacacacacacacacacacatacacacaaacac

SEQ ID NO: 200221 - DNA, 601 bp, Human
caagtaattctgaaagccttgcagaaagtaatacttgcagcaagtaatttcagttcactgattttctgccttcaccaccccacatgtgcataatgtgtgtgcacttacacgtgtgtgtattctgtgtcagtaagaaacgtggggttattataaagatatttgccagttgcaaattagaccttcacagctgcggtcctgttcagtccaactgtggccccaaagagcctcccctgggctgaaaatgcattttgtgtctcctggtcaagaaatgagcagtccaagtggacacttcattgtggtsaagggaaactatgcttttgtataaataaactatttgtctaaacttcaaacaggtaagggtagataagctttactttctagcaagggcaaaagttatctcctttccctttctctcagagggaaccaaatcctgaagacggttcatggctcaaagccctaattgcctggtatgacccagggaaaactccattttaagaaaatgtactttcctttaaatattctgagacagaaagcaaccaggtctctgaagaagctgctagactttctcaggatggtagaaactttcaggaaagcaaaggaa

SEQ ID NO: 200222 - DNA, 601 bp, Human
actcaaaaacccctgatcatttaactggaaattgaattaaaatacttcatgagataaagacaagcccttttactactaacggagctgggcagttattaattttttttaaacaatcagatctcgcaagaggtagttatttttaaaccataaattgagtactcaatagagaatggacaaagattttggtccttacattaggacgtgttttttaaagcaaacaaatgaaaaacacagactgctatggcaagcagtcggcccacaggctacttaacacaaatgaattaaatagccacagaaccamtttaatcaaacagtgcgaagtcggtttccgttctcaaagctggtgtttttaaaaactggttaaatcaagttaccttttttcttctgaaggtaggaagagggatttacttctgaattcaaaacactattatacttacttttttcttaaattgctacatgatggaattgaccacttcctcccactagcagggtaaaggtacacaatgcaaagaacagctctgcagcaattaattcctttttaccttttttttttttttttttttttttttttttggagacatagagtctagctctgttgccc

SEQ ID NO: 200223 - DNA, 601 bp, Human
aaaaaaaaaaaaaaagaagccatgccatcccacttcattttcctctccactgcaggcaaaggaataaaagtgaaagccattaacataaagagacacacgtaaagggcaaacggctcaggcagaactcaaaaacccctgatcatttaactggaaattgaattaaaatacttcatgagataaagacaagcccttttactactaacggagctgggcagttattaattttttttaaacaatcagatctcgcaagaggtagttatttttaaaccataaattgagtactcaatagagaatggacaamgattttggtccttacattaggacgtgttttttaaagcaaacaaatgaaaaacacagactgctatggcaagcagtcggcccacaggctacttaacacaaatgaattaaatagccacagaaccaatttaatcaaacagtgcgaagtcggtttccgttctcaaagctggtgtttttaaaaactggttaaatcaagttaccttttttcttctgaaggtaggaagagggatttacttctgaattcaaaacactattatacttacttttttcttaaattgctacatgatggaattgaccacttcct

SEQ ID NO: 200224 - DNA, 601 bp, Human
tgaacccgtgttagccatttggagggagtgcctctactttccattttaaaaagggccagtcaggcctaaagaggaagaaaaaaaaaaaaaaaagaagccatgccatcccacttcattttcctctccactgcaggcaaaggaataaaagtgaaagccattaacataaagagacacacgtaaagggcaaacggctcaggcagaactcaaaaacccctgatcatttaactggaaattgaattaaaatacttcatgagataaagacaagcccttttactactaacggagctgggcagttattaattttttttaaacaatcagatctcgcaagaggtagttatttttaaaccataaattgagtactcaatagagaatggacaaagattttggtccttacattaggacgtgttttttaaagcaaacaaatgaaaaacacagactgctatggcaagcagtcggcccacaggctacttaacacaaatgaattaaatagccacagaaccaatttaatcaaacagtgcgaagtcggtttccgttctcaaagctggtgtttttaaaaactggttaaatcaagttaccttttttcttctgaaggtaggaagag

SEQ ID NO: 200225 - DNA, 601 bp, Human
cttttaaaactagttcatttaaaatgttctcagctcaaagttcccaagcctcacagaatctcccctctgctgctggcacctctctgatctcttttctccttcttcccctgcttgcagccttcctgttgtgcctcaaacaaaccaagaacacagctgtctcggggcctctgcacttgttctccctgcctcaaatgctcttccctcacataataagattgctcattcccttacttcattcaaggttctgctgaattagccctcctagacaggttttccttggctgctttatttaaaatagcascgacccaccccgcccatcattctgtctctcatcacaagtatgtaaaacccataaaaacaatgactttgtgcagtgtctacgatgacctttgatacactgcattcaacaaatgcttgcagaatgaaggaataaacttattatgcatctactatatgccagacacaataaatatttgttgaatggatgaataaatgaatgagtgaattccaacatccctcctccaaacacactcagaaaaacaattgtcttagatttttcagaggaatcaccaaaatgaggctaacaccaatgatatttttc

SEQ ID NO: 200226 - DNA, 601 bp, Human
gtattctgaatgcacatgtgtttttccctttagagttacgaacagaaatttaaactgaccctctgtcattcatatgcaaagaggataaaatcaagtggattttttatgttctgcttcaactgccattctttttcagatttaatcagctgaacaaataatggtagttttctaggttagttcacataaaagtcagaaacagtcctatagacacttaaaaacttttttaaaaaggtgctttcatcatcaataccagtattggcaagattacaattgatgtatctgtgaagcagcagaaaatcayattccttttcagtaatattagcatatcacagagcataccgggtagtgaaacccaagcctgggtgcacgcttatctagcggcagacccaggagcagaagattatgagtggcatctgtgaggctgccggaaacaggttctcaatgagacacttataatttcattaaatggcctttgacaagaccctcctgctggggggcccatggcaggctccggggaatgcttcttcctcagtggtcttttctagtctttatcctgaattttcctttttttgacttaatatttccctatcttaagcttagt

SEQ ID NO: 200227 - DNA, 601 bp, Human
ggaaaactaagaagacctataaaatggattaagatacaactaccctcagtattctgaatgcacatgtgtttttccctttagagttacgaacagaaatttaaactgaccctctgtcattcatatgcaaagaggataaaatcaagtggattttttatgttctgcttcaactgccattctttttcagatttaatcagctgaacaaataatggtagttttctaggttagttcacataaaagtcagaaacagtcctatagacacttaaaaacttttttaaaaaggtgctttcatcatcaataccartattggcaagattacaattgatgtatctgtgaagcagcagaaaatcatattccttttcagtaatattagcatatcacagagcataccgggtagtgaaacccaagcctgggtgcacgcttatctagcggcagacccaggagcagaagattatgagtggcatctgtgaggctgccggaaacaggttctcaatgagacacttataatttcattaaatggcctttgacaagaccctcctgctggggggcccatggcaggctccggggaatgcttcttcctcagtggtcttttctagtctttatc

SEQ ID NO: 200228 - DNA, 601 bp, Human
ggcactactactacatcaaaacagtgtctggcacagaggccataaccactggccaaataagcaaatttaagttctaatactggtcagtgaggttgttgctgtattttcaagaagaaggcccaaaactatctgcatgacaaagcaatccttggatgaagataagaacaagagcaacaaaagaagaagaagaagaaaagaattcatttttgttggagtaagaggaaaactaagaagacctataaaatggattaagatacaactaccctcagtattctgaatgcacatgtgtttttccctttasagttacgaacagaaatttaaactgaccctctgtcattcatatgcaaagaggataaaatcaagtggattttttatgttctgcttcaactgccattctttttcagatttaatcagctgaacaaataatggtagttttctaggttagttcacataaaagtcagaaacagtcctatagacacttaaaaacttttttaaaaaggtgctttcatcatcaataccagtattggcaagattacaattgatgtatctgtgaagcagcagaaaatcatattccttttcagtaatattagcatatcacaga

SEQ ID NO: 200229 - DNA, 601 bp, Human
ggatcatgaggtcaggagatcgagaccatcctggctaacaaggtgaaacccggtctctactaaaaatacaaaaaaaaaattagccgggcgcggtggcgggcgcctgtagtcccagctactcgggaggctgaggcaggagaatggcgtgaaccccggaagcggagcttgcagtgagccgagattgcgccactgcagtccgcagtcccgcctgggcgacagagcgagactccgtctcaaaaaaaaaaaaagaaagcgaaagagggccaggtgctgtgactcacacctgtaatcccaacatttygggaggctcaggtgggcaaatcacttgaggccaggagttcgagaccagcctaggcaacatttcaagaccccatctctacaaaaaataaagaaactcagatacggtgttgtgcacctttagtcccagctactcaggatgctgaagcaggaggatggattgagcccaggaggttaaggccgtagcgagtggtgatcatgccactgcatgccagcctgggctaaagagtgggactccgtttcaaaaataaataaacacataaataaaaagaaagtgagagagaaagcagggagcggggtctgt

SEQ ID NO: 200230 - DNA, 601 bp, Human
tgcaggacacaggacggatgctcatagtgctccctgtgatctctccaatttctcacttgggcctttgcaatctgcatttacaaattagcatggtttgaattaacagaaaaacaaaagagtagtatctggttagcatctaagaaagcgaaagaggccgggcgcggtggctcacgcctgtaatcccagcactttgggaggccgaggcgggtggatcatgaggtcaggagatcgagaccatcctggctaacaaggtgaaacccggtctctactaaaaatacaaaaaaaaaattagccgggcgcrgtggcgggcgcctgtagtcccagctactcgggaggctgaggcaggagaatggcgtgaaccccggaagcggagcttgcagtgagccgagattgcgccactgcagtccgcagtcccgcctgggcgacagagcgagactccgtctcaaaaaaaaaaaaagaaagcgaaagagggccaggtgctgtgactcacacctgtaatcccaacatttcgggaggctcaggtgggcaaatcacttgaggccaggagttcgagaccagcctaggcaacatttcaagaccccatctctacaaaaaataaaga

SEQ ID NO: 200231 - DNA, 601 bp, Human
aacccctactcagtctcagcaaggcatgcagttaaaaataatcagagccggtgtttctctacggtgaaagaatgagccaagcaatgtgggaggctgagtgccaacaaggctgcgcctttataatcatcttagtaaccggacagcctgctgcaggttttcaagggaagtcctgaaagaagcagcacgacccaccctaccttcttccggagaaactgtaacttcacaggtctgattttcttttctttttttttttgaaacggaatttcgctctgttgcccaggctggagtgcggtggctcaayctcggctcactgcaacctctgcctcccaggttcaagcgattctcctgcctcagcctcctgagtagctaggattacaggcacccaccaccaagcccagctaatttttgtatttttagtagagacagggtttcaccacgttcaccaggctgatctcgaactcctgacttcaggagatccacccacctcagcctcccaaagtgctgggattgtaataggcgtgagccaccatgcccgaccccacgtctgattttgaatgctaacatttcctcggtacacagtaactcacaacatcaaagtgac

SEQ ID NO: 200232 - DNA, 601 bp, Human
ttgctgcagaattttaggaaatatgccatcctactttggcaaccttatgtgagattttctgcatttaaagaaagagggatgtgtgttctgcattagctccagaaataaaaacccctactcagtctcagcaaggcatgcagttaaaaataatcagagccggtgtttctctacggtgaaagaatgagccaagcaatgtgggaggctgagtgccaacaaggctgcgcctttataatcatcttagtaaccggacagcctgctgcaggttttcaagggaagtcctgaaagaagcagcacgacccaycctaccttcttccggagaaactgtaacttcacaggtctgattttcttttctttttttttttgaaacggaatttcgctctgttgcccaggctggagtgcggtggctcaacctcggctcactgcaacctctgcctcccaggttcaagcgattctcctgcctcagcctcctgagtagctaggattacaggcacccaccaccaagcccagctaatttttgtatttttagtagagacagggtttcaccacgttcaccaggctgatctcgaactcctgacttcaggagatccacccacctcagcct

SEQ ID NO: 200233 - DNA, 601 bp, Human
ccctgtgtctactaaaaatacaaaaattagccaggtatggtggcacacacctgtcgtcccagctactcaggaggctgaggcatgagaatcacttgaacctgggagacggagcttgcagtgagccgagattgtgccactgcactctagcctgggccacagagtgagactccatctcaatacaaaaaaaaaaaaaaaaaaaaagaatggttcattaccatctggaacatcttgttcaaatctcaaggacttggcagccatgatggtgccggtcattcatggacccgacccggtaatgacataycatcaaactcggcacactgtacacgaaagcaaaagtatccttcagttcttctgaaggcacaatcttttaagatggatgatcacttcttcaacattcctttaggaacaagtccattagttagatgccgttggttcttagaatccctgtccccctaaatctcacacctcactacacttctagtcgaattctatgtactggatgcctaacctagtgatttgccttgccttgtgtgataaacatgctcctaaaaagatggtgtagaaggtaccactttttaaagtactacaggattcctgattc

SEQ ID NO: 200234 - DNA, 601 bp, Human
attattgattacatatatcaatgaaacaccatcatgatatccttgtaacacgagcccaaagagtaacggtcacctggctgaatccacctgtttctaagaaacaaagaatatctcatttcacatagtattacagtggaagatccagaacctaccatgcctggactgtctcagatgagtatttccagagctttaatagcaagtcaagataaacacaataattggaggaaaaagaaaaaaaagatacaaacccactagtatttgaatgcattctcttaattctagtaaatggatatacatatamgtatatatacacatatatgtttgtacagtgtaactcaatgtttttaaggaattgttatccatcaaaagacatatccaagcacctactgttccaaccccactgccactacctcattattaggaagactccagggacgcaacaaaatgctcattactggccgggcacagtgactcacgcctgtaatctcagcactttgggaggccgaagcgggcagatcacttgaggtcaggagtttcaggctagcctggccaacatggcaaaaccctgtgtctactaaaaatacaaaaattagccaggtat

SEQ ID NO: 200235 - DNA, 601 bp, Human
taaataaataacaagtgttagctaggatgtggagaaactggaactcttgtgcactgtgggtgggaatgtaaaatggtacaaccgctacagaaaacagtattatgactgctcagtaaaatcagcgaaatgatttaacaccatgtgacccaccattccacccctacatgtttactcaggagaaacaatgacatgtccagcacacaaagacttgtacatgcatgttcataacaattttatttataatcaccccaaactggaaacagcctctatgtctatcagctggtgaatggataaataaacyggcatattcagcaataagatggatgaagtactgacctgtgcaacacctcaagagtgagtgtcaaatacattacactgagtgaaaaggtcagacaaaagactatccgttaggatttctacgaagctctagacaaggcagatctaatctatagtgacaaaaagcccatcagtggttgcctgaggctggcatgagggaggcctggctgggaagaggcagaaagcaaccccaggattgaggggaagggtctatattcttgattgtggtggtagatacctaaatctgtcacaattcacccaaatg

SEQ ID NO: 200236 - DNA, 601 bp, Human
tgttcatacaacaatgaaattgcctaatgacacatttctcagtatccccatcattaagggatgcatgactgtattcattcatgtaacaacataaataaacctccaaaacattatgctaagtagaagaagccagatctgtggttcctcaactgtgcacgaaaccaccccagggcccccagtgaactcacagacatgccactggatattttaaatcttggagggaaacagcaataattgtgggacaccatgtaagctacttttaatgagttctctggatctaatggaactggtaggtatcccytttaactttcaacaccataaaaaattatggattctaaaggcactgtgaaccaaggaagtttgcaaacctctaaaccagacacaaaaaaagtacatactaaatgactgaatgtataggaagctctctaatagggcaacctaattcccatggacagaaagcagatgagtggttgttcgagggtgagcattaggggagtgagggtacatttggggtaatgggaatgctctctatcttgattgggagtgaatgcatgtcaaaacccatagaatctatcacacacttaaaaaaataggtgcattt

SEQ ID NO: 200237 - DNA, 601 bp, Human
cttcctaaaatggaatactactcaacaacaaaaagaaacaggctacactttgggaagctgaggtgggcggatcacctgaggacaggagttcaacacctgcctggccaacatggtaaaaccccgtctctactaaaaatacaaaaattagctgggcatggtggtacatgtctgtaatcccagctactcaggaggttgaggcatgagaatcgcttgaacccgggaggcggaggctgcagtgagccaagatcgtgccactgcactccagcctgggcaaccgagtgagactctgtcaaaaaaaacaaaaaaaacaaaacaaacaaacaaacaaacaaaaaacaggaacagactactgtcacatgcagcataatgacattttatactatggtggtcccataagattataatggagtggaaaaattcctatcacggagtgacatcatagccgccataactcaattttttaaaataaatttagtgttgcctaagtgttccatgtttataaagcctacagtaatgtgcagtaatgtactaggccttcacatttactcattactcattcactgactcacccagagacacttccagtacgcaggctccattc

SEQ ID NO: 200238 - DNA, 601 bp, Human
actgcagtacttcctaaaatggaatactactcaacaacaaaaagaaacaggctacactttgggaagctgaggtgggcggatcacctgaggacaggagttcaacacctgcctggccaacatggtaaaaccccgtctctactaaaaatacaaaaattagctgggcatggtggtacatgtctgtaatcccagctactcaggaggttgaggcatgagaatcgcttgaacccgggaggcggaggctgcagtgagccaagatcgtgccactgcactccagcctgggcaaccgagtgagactctgtcaaaaaaaacaaaaaaaacaaaacaaacaaacaaacaaacaaaaaacaggaacagactactgtcacatgcagcataatgacattttatactatggtggtcccataagattataatggagtggaaaaattcctatcacggagtgacatcatagccgccataactcaattttttaaaataaatttagtgttgcctaagtgttccatgtttataaagcctacagtaatgtgcagtaatgtactaggccttcacatttactcattactcattcactgactcacccagagacacttccagtacgcag

SEQ ID NO: 200239 - DNA, 601 bp, Human
atgaatgaacatactgcagtacttcctaaaatggaatactactcaacaacaaaaagaaacaggctacactttgggaagctgaggtgggcggatcacctgaggacaggagttcaacacctgcctggccaacatggtaaaaccccgtctctactaaaaatacaaaaattagctgggcatggtggtacatgtctgtaatcccagctactcaggaggttgaggcatgagaatcgcttgaacccgggaggcggaggctgcagtgagccaagatcgtgccactgcactccagcctgggcaaccgagwgagactctgtcaaaaaaaacaaaaaaaacaaaacaaacaaacaaacaaacaaaaaacaggaacagactactgtcacatgcagcataatgacattttatactatggtggtcccataagattataatggagtggaaaaattcctatcacggagtgacatcatagccgccataactcaattttttaaaataaatttagtgttgcctaagtgttccatgtttataaagcctacagtaatgtgcagtaatgtactaggccttcacatttactcattactcattcactgactcacccagagacact

SEQ ID NO: 200240 - DNA, 601 bp, Human
aaaaattaaaaattagccaggcgtggtggtacatgcctgaagtctcagctactcaggaggctgaggtaggaagactgcttgaaaccaggagttcaaggctgcagtgagccacgattgcacgaccacactctagcctgggtgacagaacaagaccctgtctttaagaataaataaattaaatcaacaaataaacaaaaagctagacatgcactttccatatgacctagcaattctaatcttagagcaatgacaatatatgcttacacaaagccttacatgtgaatgttcatagtgactttaktcacattgccaaaaaaatgagaagaacccaaatgtcccatcaaatgaatgaacatactgcagtacttcctaaaatggaatactactcaacaacaaaaagaaacaggctacactttgggaagctgaggtgggcggatcacctgaggacaggagttcaacacctgcctggccaacatggtaaaaccccgtctctactaaaaatacaaaaattagctgggcatggtggtacatgtctgtaatcccagctactcaggaggttgaggcatgagaatcgcttgaacccgggaggcggaggctgcag

SEQ ID NO: 200241 - DNA, 601 bp, Human
gagaggcggaagtgggaggatcgcttgaggccaggagttcaagaccagcctgggcaacacagggagaccccatgtctacaaaaaaattaaaaattagccaggcgtggtggtacatgcctgaagtctcagctactcaggaggctgaggtaggaagactgcttgaaaccaggagttcaaggctgcagtgagccacgattgcacgaccacactctagcctgggtgacagaacaagaccctgtctttaagaataaataaattaaatcaacaaataaacaaaaagctagacatgcactttccatawgacctagcaattctaatcttagagcaatgacaatatatgcttacacaaagccttacatgtgaatgttcatagtgactttattcacattgccaaaaaaatgagaagaacccaaatgtcccatcaaatgaatgaacatactgcagtacttcctaaaatggaatactactcaacaacaaaaagaaacaggctacactttgggaagctgaggtgggcggatcacctgaggacaggagttcaacacctgcctggccaacatggtaaaaccccgtctctactaaaaatacaaaaattagctgggca

SEQ ID NO: 200242 - DNA, 601 bp, Human
taatacatacatctggcaaaggacttgtttctagaatatatttaaaaactcatacagctcaatgataagacgacaagcaaccctattaaaaatgggcaaaaattagaacaagatacttcacacacacacacacacacacacacacacacacacagccagtaaccacagaaatggcacaatgagcaaagatgctcatcattagctatcagaaacacaaacagaaaccttacgaagatacacaacataaccactagaatgcctgcaattaaaatgactgacaataccaagtactgatgaacaygtgatgcaaccagaatttttttcttttttttttttttttttttcaagacagagtctctctctgttgcccaggctggagtgtggtggctcaatcatagctgacggccaccttgaactcctaggctcaagcgttcctcccacttcagcctcctgactcgccgagactacaggcacatgccattactacatgctaagttttcacttttaattttttgtcgaggcgaggtctcttttagttgcccaggctaagaatttttacaaactattggtcgaattgtgtattagcccattcttacactgc

SEQ ID NO: 200243 - DNA, 601 bp, Human
aaaataaacctcaatccttacttcaaggcgcacatgcacgcacacacacacacacacacacacacacacacacacgcaccaaagtaacttgaaatagatcctagacctaaatgcaaaagccaaaatcacaaacttctaggtgaaggtcttcttaaccttgagagggacagaaagaaagaaaaaaaaaagtactaaccagaagacttcgacaaattgaaatgttgaactcttgctcttcaaaagacacttgaagaaaatgaaaaagcaagccacccactgggagaacatgtttgtaatacayacatctggcaaaggacttgtttctagaatatatttaaaaactcatacagctcaatgataagacgacaagcaaccctattaaaaatgggcaaaaattagaacaagatacttcacacacacacacacacacacacacacacacacacagccagtaaccacagaaatggcacaatgagcaaagatgctcatcattagctatcagaaacacaaacagaaaccttacgaagatacacaacataaccactagaatgcctgcaattaaaatgactgacaataccaagtactgatgaacatgtgatgc

SEQ ID NO: 200244 - DNA, 601 bp, Human
agccatactacctgatctggaaagctaagcagggtcgggcctcgttagtacttggatgggaaaaatacatctccacaatcacctgatttcaaaacgtaccacaaagctacaagaatcagggtaatgtgaacagacatatagatcaatagaacagaatagagttcagaaatagacaaacacataaatggtcaatttttttttttttttttgagacagtctcactcggtcgcccaggctggagtggtgcaatctcagctcactgcaacctccgcctcccaggttcaagcgattcttgtgcctyagcctcctgagtagctgggattacaggcatgcgccaccacacccatctaacttttatatttttagtagagacgggtttcaccatgttagccatgctagtctcaaactcttgacctcacgtgatccgtctgcctgcctcagcctcccaaagtgctgggattacaggtgtgagctaccgcccccagccgtcaattgatttttgacaagagcccaggcaatttaaaggagaaagaatagcttttttcagcaaatggtgctaaaacaactggatatctgtatggaaaagaaaataaacctcaat

SEQ ID NO: 200245 - DNA, 601 bp, Human
atacattgggggttggggcttcaacatataatttgggagtcacaaatcagtcccaagcaatgccaactttgaaaaatgatactcttacttcatttttccaatatgagtagaataatgcatttgataaaagtttgatcgaataaatccaacttaaaaatacaccttcttgtctacagccatactacctgatctggaaagctaagcagggtcgggcctcgttagtacttggatgggaaaaatacatctccacaatcacctgatttcaaaacgtaccacaaagctacaagaatcagggtaatgygaacagacatatagatcaatagaacagaatagagttcagaaatagacaaacacataaatggtcaatttttttttttttttttgagacagtctcactcggtcgcccaggctggagtggtgcaatctcagctcactgcaacctccgcctcccaggttcaagcgattcttgtgcctcagcctcctgagtagctgggattacaggcatgcgccaccacacccatctaacttttatatttttagtagagacgggtttcaccatgttagccatgctagtctcaaactcttgacctcacgtgatccg

SEQ ID NO: 200246 - DNA, 601 bp, Human
cacagtgggctctcgggggtctcttccaataaggacactaaccccactgaatcagcaaccaccctcatgatctcatttaaccttaaaacctccttatagactctatctccaatatacattgggggttggggcttcaacatataatttgggagtcacaaatcagtcccaagcaatgccaactttgaaaaatgatactcttacttcatttttccaatatgagtagaataatgcatttgataaaagtttgatcgaataaatccaacttaaaaatacaccttcttgtctacagccatactacctratctggaaagctaagcagggtcgggcctcgttagtacttggatgggaaaaatacatctccacaatcacctgatttcaaaacgtaccacaaagctacaagaatcagggtaatgtgaacagacatatagatcaatagaacagaatagagttcagaaatagacaaacacataaatggtcaatttttttttttttttttgagacagtctcactcggtcgcccaggctggagtggtgcaatctcagctcactgcaacctccgcctcccaggttcaagcgattcttgtgcctcagcctcctgagta

SEQ ID NO: 200247 - DNA, 601 bp, Human
gtgcctgcatggttggtgtctggtgagggcctctccctagcttgtagaatgctgccttcttgttatgtcctcacatggcagagagagacacagtgggctctcgggggtctcttccaataaggacactaaccccactgaatcagcaaccaccctcatgatctcatttaaccttaaaacctccttatagactctatctccaatatacattgggggttggggcttcaacatataatttgggagtcacaaatcagtcccaagcaatgccaactttgaaaaatgatactcttacttcatttttccmatatgagtagaataatgcatttgataaaagtttgatcgaataaatccaacttaaaaatacaccttcttgtctacagccatactacctgatctggaaagctaagcagggtcgggcctcgttagtacttggatgggaaaaatacatctccacaatcacctgatttcaaaacgtaccacaaagctacaagaatcagggtaatgtgaacagacatatagatcaatagaacagaatagagttcagaaatagacaaacacataaatggtcaatttttttttttttttttgagacagtctcactcgg

SEQ ID NO: 200248 - DNA, 601 bp, Human
tcacagtccagaggctgggaggtccaagatcagggtgcctgcatggttggtgtctggtgagggcctctccctagcttgtagaatgctgccttcttgttatgtcctcacatggcagagagagacacagtgggctctcgggggtctcttccaataaggacactaaccccactgaatcagcaaccaccctcatgatctcatttaaccttaaaacctccttatagactctatctccaatatacattgggggttggggcttcaacatataatttgggagtcacaaatcagtcccaagcaatgccawctttgaaaaatgatactcttacttcatttttccaatatgagtagaataatgcatttgataaaagtttgatcgaataaatccaacttaaaaatacaccttcttgtctacagccatactacctgatctggaaagctaagcagggtcgggcctcgttagtacttggatgggaaaaatacatctccacaatcacctgatttcaaaacgtaccacaaagctacaagaatcagggtaatgtgaacagacatatagatcaatagaacagaatagagttcagaaatagacaaacacataaatggtcaa

SEQ ID NO: 200249 - DNA, 601 bp, Human
tactaaaaatacaaaaattagccaagcaaggtggcaggcacctgtaatcccagctactgaggaggctgaggcaggagaatcgcttgaacccagtaggtggaggttgcagtgagccgagatcacgccactgcacttcagcctgggcgaaagagtgagactctgtctcaaaccaacaaacaaaagattgcgagatctttgagaaaggagattgcgtggggtatcctcagtgcctgacacaatggcaggaccaatggatgacagcaagttaaactagaagggaggggaagacacatttcagatraatacaaaaaagagacttgaacagaactgtccacaaatggaacagattgcctcacgtgaggtcacgttcagaggtgcccagaggccagatggtctgctgggaagaccatacagaagattcttcactgttcaactagaacagtgcttctcagccttgctttagagtgtgcctgcttcggcaggtctggggtgtggcctgggattctgcattcctaatattctcccaggggaggtcgaagctgctagtccagggaccacatttgaaatgcccgggactagatgacctctaatttctctccaa

SEQ ID NO: 200250 - DNA, 601 bp, Human
tatgtgtaccgggctgcacccccacctggaggtcctctccagcacccttctccgtgcagctcagcaccctggacatcatcttcttcactgcctttctcacactgtgctctagttcattcatggacatctctatttctatatcagatcgtgagatctgtccagcgccatggcccatgcctgtaatcagagcacgttgggaggcctaggtgggtagatcacttgaggtcaggagttcaagaccagcctggccaacatggtgaaaccccatctctactaaaaatacaaaaattagccaagcaasgtggcaggcacctgtaatcccagctactgaggaggctgaggcaggagaatcgcttgaacccagtaggtggaggttgcagtgagccgagatcacgccactgcacttcagcctgggcgaaagagtgagactctgtctcaaaccaacaaacaaaagattgcgagatctttgagaaaggagattgcgtggggtatcctcagtgcctgacacaatggcaggaccaatggatgacagcaagttaaactagaagggaggggaagacacatttcagataaatacaaaaaagagacttgaacagaactg

SEQ ID NO: 200251 - DNA, 601 bp, Human
gccgagctcttatcccgcccctagctcagtccttcatgtctttcctttagatcaggctctgtcaatctgctaagagcacccctgcctccctcttccggcccgttactgcagccagcagccttcttcctacaatgcaaatctattctccccagcctctcacattcaagtgaactccttggacactgcagaatgggccctttgtgatccagccccctgcccactttcccagctccttgctactttaacataaggaaatcaaacttttcagggaccccaatacgtcacctctcatgcctctgcwaagctcttctctgggtgcggagcgccctcccagaaccccttccccatcctgagtctggcagattccaactcagtatgtgtaccgggctgcacccccacctggaggtcctctccagcacccttctccgtgcagctcagcaccctggacatcatcttcttcactgcctttctcacactgtgctctagttcattcatggacatctctatttctatatcagatcgtgagatctgtccagcgccatggcccatgcctgtaatcagagcacgttgggaggcctaggtgggtagatcacttgaggtc

SEQ ID NO: 200252 - DNA, 601 bp, Human
tgattaggaatgccaccttttcccaatctggaggcacagtgtgaagcagcctacatctgccaggactctgacatatgccctaccttcgagaacgtttcagtgaatgatgctgatgcaaatatacaagggaactcgtcaatcatttgtgtcgcttacaaccaagagaataaattaacaggatgaaaccagagattaaaaaacatctcaaaagcatggagcaacaggaactgtttaacaagataatgtctaataggatatagtttgaacttacacttaggtgcggtgaaatcaaagccatcaratacagaagagaaatagtggggaggcagaacacatgccaaggcctccttgggacactgccagtagctctgacctagggcagtctgaagctgcagtgttctcagatggccttcaaagacgcagggccatactgtatcttaggccgtcttcacagaaagaaggtaacagcccgggccctagtccacattgctcacaccattacctagagcctgcaattcagtttcagacacgaccagttaaggggaatatcaactagaccactccacggaggaaaaacgcaaaagctaagggcatttaaaac

SEQ ID NO: 200253 - DNA, 601 bp, Human
tactcatgtttcgtctaataatttttatgagttcattatttaagtctaaatctttcagacaatttaatttctttttttttaagagactttctttgttatgtagtttatttttatctaaggaatgttggagggaccccagctcccttttttttctaacagctcttcagctgtcctaaaccacatttattgatgaatttacttcccccggtgattaggaatgccaccttttcccaatctggaggcacagtgtgaagcagcctacatctgccaggactctgacatatgccctaccttcgagaaygtttcagtgaatgatgctgatgcaaatatacaagggaactcgtcaatcatttgtgtcgcttacaaccaagagaataaattaacaggatgaaaccagagattaaaaaacatctcaaaagcatggagcaacaggaactgtttaacaagataatgtctaataggatatagtttgaacttacacttaggtgcggtgaaatcaaagccatcagatacagaagagaaatagtggggaggcagaacacatgccaaggcctccttgggacactgccagtagctctgacctagggcagtctgaagctgc

SEQ ID NO: 200254 - DNA, 601 bp, Human
tggtcaactcaatatgtctgttttctcatcctttcaccagcaaggtgggtattatcagacttagccacatccaatttcacagatgaaaacaatgagacctctttattttcctttgcatttttaaacaaagtgaagtttactatgttttcacaagctcacttctagcaatgaacattggtttaactattccatttttcatttttcctattgacttctaagacttctttccatgtgaaaggaattagctctgacacataggctgcaaatatttttctccaatatattacttgttttttgaccrcatttatggaatttttgcccaacagaactttaaattttcctcatgaaatttttcttttaggaaagttagcctttttctttacagcttctgtgttttgtgacacgctttggggggaaaaaagtcttctgtctacattccaagatatatttaaaatttactcatgtttcgtctaataatttttatgagttcattatttaagtctaaatctttcagacaatttaatttctttttttttaagagactttctttgttatgtagtttatttttatctaaggaatgttggagggaccccagctccct

SEQ ID NO: 200255 - DNA, 601 bp, Human
agagaattgtgccatttttaacactacacaatattttgctggacacctacagatggtcatataagctacctctattttttgctagtataaatgctattattacaaatatctgcgtagttatttttgtgtacatgctggaaaacatttacagggtcattagtggaatgactgagtctaagaatacgaaccttttaaattctagtctaaggatattgtagaaatgcccttcaacagcactggtcaactcaatatgtctgttttctcatcctttcaccagcaaggtgggtattatcagacttarccacatccaatttcacagatgaaaacaatgagacctctttattttcctttgcatttttaaacaaagtgaagtttactatgttttcacaagctcacttctagcaatgaacattggtttaactattccatttttcatttttcctattgacttctaagacttctttccatgtgaaaggaattagctctgacacataggctgcaaatatttttctccaatatattacttgttttttgaccacatttatggaatttttgcccaacagaactttaaattttcctcatgaaatttttcttttaggaa

SEQ ID NO: 200256 - DNA, 601 bp, Human
acgtagagaattgtgccatttttaacactacacaatattttgctggacacctacagatggtcatataagctacctctattttttgctagtataaatgctattattacaaatatctgcgtagttatttttgtgtacatgctggaaaacatttacagggtcattagtggaatgactgagtctaagaatacgaaccttttaaattctagtctaaggatattgtagaaatgcccttcaacagcactggtcaactcaatatgtctgttttctcatcctttcaccagcaaggtgggtattatcagasttagccacatccaatttcacagatgaaaacaatgagacctctttattttcctttgcatttttaaacaaagtgaagtttactatgttttcacaagctcacttctagcaatgaacattggtttaactattccatttttcatttttcctattgacttctaagacttctttccatgtgaaaggaattagctctgacacataggctgcaaatatttttctccaatatattacttgttttttgaccacatttatggaatttttgcccaacagaactttaaattttcctcatgaaatttttctttta

SEQ ID NO: 200257 - DNA, 601 bp, Human
atttagtatcctgaacctttcctagttagtacgtagagaattgtgccatttttaacactacacaatattttgctggacacctacagatggtcatataagctacctctattttttgctagtataaatgctattattacaaatatctgcgtagttatttttgtgtacatgctggaaaacatttacagggtcattagtggaatgactgagtctaagaatacgaaccttttaaattctagtctaaggatattgtagaaatgcccttcaacagcactggtcaactcaatatgtctgttttctcatyctttcaccagcaaggtgggtattatcagacttagccacatccaatttcacagatgaaaacaatgagacctctttattttcctttgcatttttaaacaaagtgaagtttactatgttttcacaagctcacttctagcaatgaacattggtttaactattccatttttcatttttcctattgacttctaagacttctttccatgtgaaaggaattagctctgacacataggctgcaaatatttttctccaatatattacttgttttttgaccacatttatggaatttttgcccaacagaact

SEQ ID NO: 200258 - DNA, 601 bp, Human
gaacaggtatttattttctcaaattctggagtctggaagtccaagatcaaggtgctggcagggttggtttcttctgaggcctctctcctctgcttgcaggtggctgccttctcccggtgtcttcacgtggccttccctctgaggatgtttgggtacaaatttcctcttcttgtaagaaccccagtcctactggattagggcccaacctaatgacctcattgaaccataattacctctttaaagaccctaactccaaatactaccttctggagattaagatttccaaatatgaattttagasggaacacaattcagccataacaaaggctaagtaagaacctgtttaaaatcctggatgtcttttcttgctaaaggagctgactcttagttctctccttcagctcctggagattgtgtaattaactggaggaggctcagaggtagaaggagcctaagatactatctattctagcctctcattttgcagttgaggctgaagttcacagaggttaaatgacctggttctgagtaactggttggacagctgtacccaagaggttctgataatggatagttgtcagcttcctatcaacttccttcc

SEQ ID NO: 200259 - DNA, 601 bp, Human
ccatgcccagcctaagaacaggtatttattttctcaaattctggagtctggaagtccaagatcaaggtgctggcagggttggtttcttctgaggcctctctcctctgcttgcaggtggctgccttctcccggtgtcttcacgtggccttccctctgaggatgtttgggtacaaatttcctcttcttgtaagaaccccagtcctactggattagggcccaacctaatgacctcattgaaccataattacctctttaaagaccctaactccaaatactaccttctggagattaagatttccamatatgaattttagagggaacacaattcagccataacaaaggctaagtaagaacctgtttaaaatcctggatgtcttttcttgctaaaggagctgactcttagttctctccttcagctcctggagattgtgtaattaactggaggaggctcagaggtagaaggagcctaagatactatctattctagcctctcattttgcagttgaggctgaagttcacagaggttaaatgacctggttctgagtaactggttggacagctgtacccaagaggttctgataatggatagttgtcagcttcc

SEQ ID NO: 200260 - DNA, 601 bp, Human
tgtaaagggacagaagactgcatcagcttgctaaggctatcataacacaggactacaggctggagaacttaaagaaaagggttgcggtttttttgttttttgagatggagtctccctctattgcccaggctggagtacagtggcgcaatctctgctcactgcaacctccgcctcccgggttcaaggaattctccggcgtcagcctccagaatagctaggattacaggtgtgcgtcaccacactcagctaatttttgtgtttgtagcagagacagagtttcaccatgttggccaggctggtstcaaactcctgatctcaagtgatccatctgcctcagcctcccaaagtgctgggattatgggtgtgagccaccatgcccagcctaagaacaggtatttattttctcaaattctggagtctggaagtccaagatcaaggtgctggcagggttggtttcttctgaggcctctctcctctgcttgcaggtggctgccttctcccggtgtcttcacgtggccttccctctgaggatgtttgggtacaaatttcctcttcttgtaagaaccccagtcctactggattagggcccaacctaatgacc

SEQ ID NO: 200261 - DNA, 601 bp, Human
atgcagagctcccctcacaaagtgtaaagggacagaagactgcatcagcttgctaaggctatcataacacaggactacaggctggagaacttaaagaaaagggttgcggtttttttgttttttgagatggagtctccctctattgcccaggctggagtacagtggcgcaatctctgctcactgcaacctccgcctcccgggttcaaggaattctccggcgtcagcctccagaatagctaggattacaggtgtgcgtcaccacactcagctaatttttgtgtttgtagcagagacagagttycaccatgttggccaggctggtctcaaactcctgatctcaagtgatccatctgcctcagcctcccaaagtgctgggattatgggtgtgagccaccatgcccagcctaagaacaggtatttattttctcaaattctggagtctggaagtccaagatcaaggtgctggcagggttggtttcttctgaggcctctctcctctgcttgcaggtggctgccttctcccggtgtcttcacgtggccttccctctgaggatgtttgggtacaaatttcctcttcttgtaagaaccccagtcctactgg

SEQ ID NO: 200262 - DNA, 601 bp, Human
tttccctacagggaagaaaacaacgggaaatcatataaaaataggagagatttaattttgtgcttaaataaacatgcttttcattccctacttagcaaaaacagttccccctaggagctcaggctacctgcctgtgaggcagaactaaatctatgcatccgtacagctcttttgtctgacacctgaccagtggggtcctctatgctcccttgagaagaagccagtaaacagacaggcaaactccataaataaggccaccttctcaggggctctgcggggagcaggatgcctggaggccaayctctcctcaccttccatcatctaagcatctcacatcttgcatcttcttaagcatcttaagaaatacaggactgcctccctccaagcacacagggtaccccggagtccttacccactccagcacaggaaaaccagccctcatttagcctcagaaaagatccagtctcccttaaatggcctggaacactgcaggccatttcagagtcttctggctcagatgcagtgctagggtgagggcttaaagggcaatgaaagtctttctctttctctctctttcacacacacacacacacacaacaca

SEQ ID NO: 200263 - DNA, 601 bp, Human
tctctgatgtagcacagaagatagtgggggctgagaaaagaaagaatctcgcctctcagagatgtgcctgtctccatgcgcttcaaagatcttagccacgtcgtgcataatgtatgagtgagcgctcacagaaaaggcctgttacgcagttctctatcacagcagatttccctacagggaagaaaacaacgggaaatcatataaaaataggagagatttaattttgtgcttaaataaacatgcttttcattccctacttagcaaaaacagttccccctaggagctcaggctacctgcctgygaggcagaactaaatctatgcatccgtacagctcttttgtctgacacctgaccagtggggtcctctatgctcccttgagaagaagccagtaaacagacaggcaaactccataaataaggccaccttctcaggggctctgcggggagcaggatgcctggaggccaatctctcctcaccttccatcatctaagcatctcacatcttgcatcttcttaagcatcttaagaaatacaggactgcctccctccaagcacacagggtaccccggagtccttacccactccagcacaggaaaaccag

SEQ ID NO: 200264 - DNA, 601 bp, Human
aaatatattttctacttaattttctaggcttcataaaactcctcacaaatttagcatgaagtagaacaatcgcctaaatagggcacacaaacatgtccttggttctcccaggccaccacttccctaattctcccgtcttcagtctttgacacaggtaatgaacccacaggtcaccgagaagagcatcacctgcgaaatttcaagacccacggtggctgtgctccatctctgatgtagcacagaagatagtgggggctgagaaaagaaagaatctcgcctctcagagatgtgcctgtctccmtgcgcttcaaagatcttagccacgtcgtgcataatgtatgagtgagcgctcacagaaaaggcctgttacgcagttctctatcacagcagatttccctacagggaagaaaacaacgggaaatcatataaaaataggagagatttaattttgtgcttaaataaacatgcttttcattccctacttagcaaaaacagttccccctaggagctcaggctacctgcctgtgaggcagaactaaatctatgcatccgtacagctcttttgtctgacacctgaccagtggggtcctctatgctccct

SEQ ID NO: 200265 - DNA, 601 bp, Human
accaagtcagggggactgagatggtgacagggaaccaagccagggggatttagaaggggacagggaccaagtcagggggactgacacagggacaggaaccaagtcagggggactgagacgggcacagggaccaagtcagggaaactgagaaggggttggaatgactgaaaaccagaaaatcaggacaggaggtaccgacaggctggtggcgggaagggagggtaacagagccaggcatgggatcccgcacagaggacacagacagaagaccgggaaggagagacagagggacacaggacartctcgaattctagtccatacagagattctcttccccatccttggaatctggggatagctctcctcctgccagaatcctgactttcctttcaaattagctcaagagctctgactagaacacagtaactacaaacggtttttctcaggggtatccatttttctcattaactgtaaatgtttatttgcaagttactatgtggctctaacaaattattataaaaacagcttctgaagccttgctttcagatgaataatgtttctctctgtatccagagaaatgtactgtgaaggcccggtgggc

SEQ ID NO: 200266 - DNA, 601 bp, Human
gcatcgtgcgcagctgcagagcaagctggtctgaggggagaggaaaatggagcgagtcctcagggagagggtgagatggcactgagacgtgaccatgcctgatgcagagggacagagatgggggcaggggatggagcgggagacaggggaccacgccaggggcactgagatggggacagggaccaagtcaggggggattgagatggagacagggacccaagtcagggggactgagatggggacagggatcacgtcagggggattgagatggagacagtgacccaagtcagggggcctgagrtgaggacagggaccaaatcagggggaatgagatggagacagggacccaagtcagggggactgagatggagacagggacccaagtcagggggactgagacggggacagggaccaagtcagggggactgagatgggggcagggaccaagtcagggagactgagatgaggacagggaaccaagtcagggggactgagatggtgacagggaaccaagccagggggatttagaaggggacagggaccaagtcagggggactgacacagggacaggaaccaagtcagggggactgagacgggcaca

SEQ ID NO: 200267 - DNA, 601 bp, Human
ggtgagagatagaattagtctgtggtgggggactgaagccaagagaggctggggcggtcatttgcatcgtgcgcagctgcagagcaagctggtctgaggggagaggaaaatggagcgagtcctcagggagagggtgagatggcactgagacgtgaccatgcctgatgcagagggacagagatgggggcaggggatggagcgggagacaggggaccacgccaggggcactgagatggggacagggaccaagtcaggggggattgagatggagacagggacccaagtcagggggactgagatrgggacagggatcacgtcagggggattgagatggagacagtgacccaagtcagggggcctgaggtgaggacagggaccaaatcagggggaatgagatggagacagggacccaagtcagggggactgagatggagacagggacccaagtcagggggactgagacggggacagggaccaagtcagggggactgagatgggggcagggaccaagtcagggagactgagatgaggacagggaaccaagtcagggggactgagatggtgacagggaaccaagccagggggatttagaaggggacag

SEQ ID NO: 200268 - DNA, 601 bp, Human
gatcagacagctccctggggatttgaaattggggtgagagatagaattagtctgtggtgggggactgaagccaagagaggctggggcggtcatttgcatcgtgcgcagctgcagagcaagctggtctgaggggagaggaaaatggagcgagtcctcagggagagggtgagatggcactgagacgtgaccatgcctgatgcagagggacagagatgggggcaggggatggagcgggagacaggggaccacgccaggggcactgagatggggacagggaccaagtcaggggggattgagatgsagacagggacccaagtcagggggactgagatggggacagggatcacgtcagggggattgagatggagacagtgacccaagtcagggggcctgaggtgaggacagggaccaaatcagggggaatgagatggagacagggacccaagtcagggggactgagatggagacagggacccaagtcagggggactgagacggggacagggaccaagtcagggggactgagatgggggcagggaccaagtcagggagactgagatgaggacagggaaccaagtcagggggactgagatggtgacagg

SEQ ID NO: 200269 - DNA, 601 bp, Human
agtcaatcatcactgattaatcacactttgatttatgccagaacttcacattttcttaaaaggtggggggtgctttttaaatatcgcacaaaaaagccagcagtgtttaaatcttcctttgatgttgctacacagacttgatgtatattaaatcctcctctgcctccaagcatgcaaagatgttagcagatactacgcaggttttccatcaaggttttaataaaatcctattgctatcaaacctagtctaggtgcctaatagtaacttttccaactatgtgcaaaagacagctgggtttastcaccgtaggagcatgtggacatctgaggaaatcactgattaactgtggataagcccgcgtcaaaaggagaacagcgcagcgctggctttggggtctggctccagctctgccatctcctagcagcgggtcgctcgacaaatggctctgacagctctaggcctgagtgcacacgtctaagggcaaggtcaccgcatgcctcgtaagactgtggtgaagcctgcacgagatgctatacgcaagtgtgtagcatgaggccttgagaccctggccacacacaagacgaggactctccacccggc

SEQ ID NO: 200270 - DNA, 601 bp, Human
gccgaattttacagaatgcaagtaagtatgtacaaagatcgaagatcggcatggagaatagcatgaagcagtaacctccctcccaaatttgcttacaactcttatgtccatacaaagttgttattaatgccacaggttatgaaaataccagtcaatcatcactgattaatcacactttgatttatgccagaacttcacattttcttaaaaggtggggggtgctttttaaatatcgcacaaaaaagccagcagtgtttaaatcttcctttgatgttgctacacagacttgatgtatattaartcctcctctgcctccaagcatgcaaagatgttagcagatactacgcaggttttccatcaaggttttaataaaatcctattgctatcaaacctagtctaggtgcctaatagtaacttttccaactatgtgcaaaagacagctgggtttagtcaccgtaggagcatgtggacatctgaggaaatcactgattaactgtggataagcccgcgtcaaaaggagaacagcgcagcgctggctttggggtctggctccagctctgccatctcctagcagcgggtcgctcgacaaatggctctgaca

SEQ ID NO: 200271 - DNA, 601 bp, Human
caggtccaacggccactccctgcgagtccttgggtgtcagagggagcagctgccaggtggaaacggaatgaactgcctgcctgaactgcctgccgggggattagcagcttctgtgcaaagcttacaggatgcctctaaggcccctgtggcaggaggtcaaagaatcttaacaaggaggtgggaagtggaaatagaaggtcacttactactaagcctatttccaccctgcatttttggttcttggatttcatcacgccgaattttacagaatgcaagtaagtatgtacaaagatcgaagatyggcatggagaatagcatgaagcagtaacctccctcccaaatttgcttacaactcttatgtccatacaaagttgttattaatgccacaggttatgaaaataccagtcaatcatcactgattaatcacactttgatttatgccagaacttcacattttcttaaaaggtggggggtgctttttaaatatcgcacaaaaaagccagcagtgtttaaatcttcctttgatgttgctacacagacttgatgtatattaaatcctcctctgcctccaagcatgcaaagatgttagcagatactacgc

SEQ ID NO: 200272 - DNA, 601 bp, Human
ccccctgcctgttcccaggggtctgcaggtccaacggccactccctgcgagtccttgggtgtcagagggagcagctgccaggtggaaacggaatgaactgcctgcctgaactgcctgccgggggattagcagcttctgtgcaaagcttacaggatgcctctaaggcccctgtggcaggaggtcaaagaatcttaacaaggaggtgggaagtggaaatagaaggtcacttactactaagcctatttccaccctgcatttttggttcttggatttcatcacgccgaattttacagaatgcaastaagtatgtacaaagatcgaagatcggcatggagaatagcatgaagcagtaacctccctcccaaatttgcttacaactcttatgtccatacaaagttgttattaatgccacaggttatgaaaataccagtcaatcatcactgattaatcacactttgatttatgccagaacttcacattttcttaaaaggtggggggtgctttttaaatatcgcacaaaaaagccagcagtgtttaaatcttcctttgatgttgctacacagacttgatgtatattaaatcctcctctgcctccaagcat

SEQ ID NO: 200273 - DNA, 601 bp, Human
ctgccatttgcatcgtggaattaaatgatctaagtggagagccactggatgctttgaacaaacccacatcacacatttaatgaagaaaaaatagcagcagtgagagagagaagctctcaagcaagacctggcaatgcttctaatttcactgtccttcctacccctcttcctttaaaagccaacagagatgacagcctacgtgagtcagcacagggaagtggggaggcctctgggtctcagttccacatatcttccccctgcctgttcccaggggtctgcaggtccaacggccactccctgmgagtccttgggtgtcagagggagcagctgccaggtggaaacggaatgaactgcctgcctgaactgcctgccgggggattagcagcttctgtgcaaagcttacaggatgcctctaaggcccctgtggcaggaggtcaaagaatcttaacaaggaggtgggaagtggaaatagaaggtcacttactactaagcctatttccaccctgcatttttggttcttggatttcatcacgccgaattttacagaatgcaagtaagtatgtacaaagatcgaagatcggcatggagaatagcatgaagc

SEQ ID NO: 200274 - DNA, 601 bp, Human
tagtcaggatgggaaaaactccaggggtgccccgggaaaatctctagccgtctggccaggcagttaaaggtggccttgaccaagtgcgaagcatgattccaggccaaagctgtgctgccatttgcatcgtggaattaaatgatctaagtggagagccactggatgctttgaacaaacccacatcacacatttaatgaagaaaaaatagcagcagtgagagagagaagctctcaagcaagacctggcaatgcttctaatttcactgtccttcctacccctcttcctttaaaagccaacagaratgacagcctacgtgagtcagcacagggaagtggggaggcctctgggtctcagttccacatatcttccccctgcctgttcccaggggtctgcaggtccaacggccactccctgcgagtccttgggtgtcagagggagcagctgccaggtggaaacggaatgaactgcctgcctgaactgcctgccgggggattagcagcttctgtgcaaagcttacaggatgcctctaaggcccctgtggcaggaggtcaaagaatcttaacaaggaggtgggaagtggaaatagaaggtcacttactac

SEQ ID NO: 200275 - DNA, 601 bp, Human
ccaggctggagtgtggtggtatgatcacagctcattgcagcctcagcctcccaggctcaagcaatccttctgcctcagcctcccgagtttctgagaccacaggtgcgcaccaccatgcccagctgactttttctatttttgatagagacggggtctttacattacccaggctggtctcaaactcctgagttcaaactatcctcccgcctcggcctcccaaagtgttgggactgcaggcatgagccaccacacccagtctatacagactatctatgaaacacaaaacttaaaataaacaatyccagtgtaaatttagtttttgttctgatttttcccccagaacagctctctcacatttaaaaagtctttctctaaatttatttaattacaaaaattaacagtgctggtttgaataaggaaataaatataaagatgtgcaaagaaaagaatataatcctttcccttactcccccttcccaagtccccagagttagactgctatgctcccccttcccaagtccccagggttgggactgctgtgctcccccttctcaagtccccaggattagactgctgtgtgcccttccctacacctttttcc

SEQ ID NO: 200276 - DNA, 601 bp, Human
tggccagtaaaaaagaatcaaacagctctctatatatcaatattttgcagtgtatatattaaacttttaaaaagcatacaaaacactgtttctattctactaccattttggggtgggagactttctctccctactcattatatacatgcaaatatatatattataaacaaatctctagattttttaaaccatagagcatttctttaagaatatccaagaattggccgggtgcggtggctcacgcctgtaatcccagcactttgggaggccgaggtgggcggatcacgaggtcaggagatcragaccatcctggctaacagggtgaaaccccatctctactaaaaacacaaaaaattagccgggcatggtggcgggtgcctgcagtcccagctactcgggaggctgaggcaggagaatggcgtgaatcgggaggcggagcttgcagtgagccaagatcacgccactgcactccagcctaggcgacagagcaagactccaactcaaaacaaaaaaaaaaaaaaaaaagaatatccaagaatctggccaaagtggctgcctccagaaagggaaatacatggctgtggacagaacagacaacttc

SEQ ID NO: 200277 - DNA, 601 bp, Human
ctgtggaactgacttagcctcctgagcctcatttttctcatctgtgctctgtggatagtaaatgccaaatatggaccttataggaacactacaagaattaaacaatacttgcaactgacttaaccctaggcttggcacataatagcaactcactcaatgttgacttccttcctcacatccttgttaccctgaaatataaaaaccaaagtttgggcaaaaatatcttctagaaagagaggtgtctatgagagaagcaactgcaagggccctgactttcctacttccttctctaaagtccctrtcgctatcattatatttcatcccacttccaatgcagaccttgttctataaagaatatctagcactttcacatgtttctgaaggaagtgtattatttgtagcccctttttggagaaaaattattctgcttcaaggtatttattctacggatatactaacatgtgtcaaagaatacaatctcgagtctttagtgttgtttctggagtaaaatattgaaaataatcaaaatgctcatcaatagaaggctggctaaataaagtcggcttatataatggaatatcacgtggccagtaaaaaagaa

SEQ ID NO: 200278 - DNA, 601 bp, Human
tccttggccacagccccagccttgctgcagcctcgagtgctgccgcagtgcccctggactccatcccagcccgcagatgggggggctctcgcccctcctgttctccttgctgtggctctaacccagcagtccccaacctgtttggcactagaaaccagtttcgtggaagatgatttttccagggatggcggaggagggggatggtttctggatgaagctgttccacttcagatcattaggcattagattctcataaggagtgcacggatccctagcatgcagaattcacaatagagttcawgctcctatgagaacctaatgtaatgctgccgctgatcggacaggaggcagagctcaggcagaaatgtgagctacggggagcagctataaacacagatgaaactgctcactcctgccctgcagcccagttcctaacagcccatgaactggtactggtctgtggcccggggactgaggacccctgctctagcccgtatctatacatacattctcacctatgcatcccattatggactaagaacaccaagaaatcatggccacccatacgtcatactctttcagaatgttctaagttaggtgg

SEQ ID NO: 200279 - DNA, 601 bp, Human
taataaagccatttgaaataaaaagtatgggcagttgccaacctacacatacttgactttcaaaaataataaatggcctcattcctcctcacagtgctctctctgaggctttcaacaattccacctaagaggccacctattgccctgtatccttggccacagccccagccttgctgcagcctcgagtgctgccgcagtgcccctggactccatcccagcccgcagatgggggggctctcgcccctcctgttctccttgctgtggctctaacccagcagtccccaacctgtttggcactagraaccagtttcgtggaagatgatttttccagggatggcggaggagggggatggtttctggatgaagctgttccacttcagatcattaggcattagattctcataaggagtgcacggatccctagcatgcagaattcacaatagagttcaagctcctatgagaacctaatgtaatgctgccgctgatcggacaggaggcagagctcaggcagaaatgtgagctacggggagcagctataaacacagatgaaactgctcactcctgccctgcagcccagttcctaacagcccatgaactggta

SEQ ID NO: 200280 - DNA, 601 bp, Human
atggaaacacacctactgactgaaggacccacatgtaagagctgacatttagggaaaggtaagccaaggttaacatactcttacccatctctaatcaactaaagacatatataagcgtggcttctttctcctcttcttcttcagcctcaggaaatgactccctacctgtttacaaggttcagagaactgtaacttaaaagtgagacacgagctttagttcatccaacactatccccctcgaaatgtcaaagagacaccaaggctaagggtaattagagatcaggacactggctgctttcartatagaagcacacagcaatctagtggcagactccgaaaactagctccaaagagcaccatcctctctccatctaaactggatattacatcacttctgataaaatgagtaaccaccataataatctctgtcagctatgagaaaatttaccctggcttctatgaaaggaaaaaaaaaaagcacttgatttcttgagctgagaaattacattaaattacctccaagctctttgttaattgacgtccatttgtatcagaggtaattcgcttaataaagccatttgaaataaaaagtatgggcagt

SEQ ID NO: 200281 - DNA, 601 bp, Human
acataaacaaattgtggcatattcgtacaatagactactatctaggaaggaaaaggaatgagccatggatatatacgccaacatcgatgacctgggaataactatgttgagtaaaacaagccagaccaaaaacagagtgcatagtggatgagtccattatacaaaattctagacaatgcaagctaagctggagtgacaggaagcagatcagtggctgctgggggtgaggatgggagccaggaaggaatggaagtgagcaaggagtgagggtgatggacatactcatgatggggtctggggygacgattttatgggtgtatgtatatatcaaaatctatcaaattggaccctcaactatgcatttttctgtgtgcaagttatatctcaattacaaacaaacaaaaacacaaaaccctatggttaacccaaaacctaaactatcaccaagaaatatcaattggggttatggcatgaccatcctccccaagaaaataaaatgcttgacagattctgagcgggacaaatttcactgatcatatcccatgagtttcatgctaaagaatcagggaatctcatagatcaaatgcacacacaggcagaa

SEQ ID NO: 200282 - DNA, 601 bp, Human
gccgctcctagatatttactcaacagacaacaaagcatatatccatacaaagacttgtagcagcttcatctgaagtagtcaaaaagtagaaactccctcatttgaaggaatacaagtgtccgttaaaaggtcggcacataaacaaattgtggcatattcgtacaatagactactatctaggaaggaaaaggaatgagccatggatatatacgccaacatcgatgacctgggaataactatgttgagtaaaacaagccagaccaaaaacagagtgcatagtggatgagtccattatacaaamttctagacaatgcaagctaagctggagtgacaggaagcagatcagtggctgctgggggtgaggatgggagccaggaaggaatggaagtgagcaaggagtgagggtgatggacatactcatgatggggtctggggtgacgattttatgggtgtatgtatatatcaaaatctatcaaattggaccctcaactatgcatttttctgtgtgcaagttatatctcaattacaaacaaacaaaaacacaaaaccctatggttaacccaaaacctaaactatcaccaagaaatatcaattggggtta

SEQ ID NO: 200283 - DNA, 601 bp, Human
ccatgtccctgcaaaggacatgatcttgttcctttttatggctgcattgtattccatggtgtatatgtaccacattttctttatccagtctatcattgatgggcatttgggttgattccacgtctttgttattgtgaatagtgctgcgatgaacatacacatgcatgtatctttataacagaatgatttatattcctttaagtatatacccagtaatggaattgctgggtcaaacggtatttctggttctaggtctttgaggaattgccacactgtcttccacaatggttgaactaattcrcactcccaccaacagtgtaaaagcattcctatttctccacagcttcgccagcatctgttgcttcttgactttttaataattgccattctgactggtgtgagatggtatctcattgtggttttgattcacatttttctaatgaccagtgatgttgagctttttttcatatgtttgttgcatgcctactagaatttataaaatgaaaaacactcagcataatcaattgttgctgaggatgtgggggaactggaactctcctacactgtgggtggcatttcttgaaaagttgaaacatacacc

SEQ ID NO: 200284 - DNA, 601 bp, Human
ttgctgaggatgatgggttccagctccaaccatgtccctgcaaaggacatgatcttgttcctttttatggctgcattgtattccatggtgtatatgtaccacattttctttatccagtctatcattgatgggcatttgggttgattccacgtctttgttattgtgaatagtgctgcgatgaacatacacatgcatgtatctttataacagaatgatttatattcctttaagtatatacccagtaatggaattgctgggtcaaacggtatttctggttctaggtctttgaggaattgccacmctgtcttccacaatggttgaactaattcgcactcccaccaacagtgtaaaagcattcctatttctccacagcttcgccagcatctgttgcttcttgactttttaataattgccattctgactggtgtgagatggtatctcattgtggttttgattcacatttttctaatgaccagtgatgttgagctttttttcatatgtttgttgcatgcctactagaatttataaaatgaaaaacactcagcataatcaattgttgctgaggatgtgggggaactggaactctcctacactgtgggtg

SEQ ID NO: 200285 - DNA, 601 bp, Human
tgcggtgtttggttttctgttcctgtgttagtttgctgaggatgatgggttccagctccaaccatgtccctgcaaaggacatgatcttgttcctttttatggctgcattgtattccatggtgtatatgtaccacattttctttatccagtctatcattgatgggcatttgggttgattccacgtctttgttattgtgaatagtgctgcgatgaacatacacatgcatgtatctttataacagaatgatttatattcctttaagtatatacccagtaatggaattgctgggtcaaacggtawttctggttctaggtctttgaggaattgccacactgtcttccacaatggttgaactaattcgcactcccaccaacagtgtaaaagcattcctatttctccacagcttcgccagcatctgttgcttcttgactttttaataattgccattctgactggtgtgagatggtatctcattgtggttttgattcacatttttctaatgaccagtgatgttgagctttttttcatatgtttgttgcatgcctactagaatttataaaatgaaaaacactcagcataatcaattgttgctgaggatgt

SEQ ID NO: 200286 - DNA, 601 bp, Human
gctattcttctcaatgccctccctttctcaccgccccccacacaggccccagtgtgtgttgtttccctccctgtgtccatgggttctcattgttcagctcccacttatgagtgacaacatgcggtgtttggttttctgttcctgtgttagtttgctgaggatgatgggttccagctccaaccatgtccctgcaaaggacatgatcttgttcctttttatggctgcattgtattccatggtgtatatgtaccacattttctttatccagtctatcattgatgggcatttgggttgattccaygtctttgttattgtgaatagtgctgcgatgaacatacacatgcatgtatctttataacagaatgatttatattcctttaagtatatacccagtaatggaattgctgggtcaaacggtatttctggttctaggtctttgaggaattgccacactgtcttccacaatggttgaactaattcgcactcccaccaacagtgtaaaagcattcctatttctccacagcttcgccagcatctgttgcttcttgactttttaataattgccattctgactggtgtgagatggtatctcattgtggtt

SEQ ID NO: 200287 - DNA, 601 bp, Human
gaaaagacactcaacgtgatgcatattggggagctgtaaatgaaaaccacatgagatactacttcatgcctgctagaatttctttttttttttttttttcttattttaggttctggggtacatgtacaggatgtgcaggtttgttacatgggtaaacgtgtgccatgggagtttgctgcatagatcaacccatcacctaggtattaagcccagcatccattagctattcttctcaatgccctccctttctcaccgccccccacacaggccccagtgtgtgttgtttccctccctgtgtccrtgggttctcattgttcagctcccacttatgagtgacaacatgcggtgtttggttttctgttcctgtgttagtttgctgaggatgatgggttccagctccaaccatgtccctgcaaaggacatgatcttgttcctttttatggctgcattgtattccatggtgtatatgtaccacattttctttatccagtctatcattgatgggcatttgggttgattccacgtctttgttattgtgaatagtgctgcgatgaacatacacatgcatgtatctttataacagaatgatttatattccttt

SEQ ID NO: 200288 - DNA, 601 bp, Human
atatttgcaaagtatgtatctgataaaagacctatgtgccaaatatgtaaagaactctgaaaacttaagaaaataaataaaataatttttttaaatgggtaaagttctaacaggcaccaaagaaggtaaaccgatggtaaataggagcatgaaaagacactcaacgtgatgcatattggggagctgtaaatgaaaaccacatgagatactacttcatgcctgctagaatttctttttttttttttttttcttattttaggttctggggtacatgtacaggatgtgcaggtttgttacatgsgtaaacgtgtgccatgggagtttgctgcatagatcaacccatcacctaggtattaagcccagcatccattagctattcttctcaatgccctccctttctcaccgccccccacacaggccccagtgtgtgttgtttccctccctgtgtccatgggttctcattgttcagctcccacttatgagtgacaacatgcggtgtttggttttctgttcctgtgttagtttgctgaggatgatgggttccagctccaaccatgtccctgcaaaggacatgatcttgttcctttttatggctgcattg

SEQ ID NO: 200289 - DNA, 601 bp, Human
tagaccatctaggtttgtgtaagtgcactctgtcatgttcgcacgatgacacaagcgcccaagggtgcgtttctcagaacatatgcaaattgttaagcaaggaatgactgcaatttctttatttaaatggtaagcctgtcatgaaagttaaaaaagttaagctcttccaaaaatgctgaatgaaaagacaagtcacagactgggagaaaatatttgcaaagtatgtatctgataaaagacctatgtgccaaatatgtaaagaactctgaaaacttaagaaaataaataaaataattttttwaaatgggtaaagttctaacaggcaccaaagaaggtaaaccgatggtaaataggagcatgaaaagacactcaacgtgatgcatattggggagctgtaaatgaaaaccacatgagatactacttcatgcctgctagaatttctttttttttttttttttcttattttaggttctggggtacatgtacaggatgtgcaggtttgttacatgggtaaacgtgtgccatgggagtttgctgcatagatcaacccatcacctaggtattaagcccagcatccattagctattcttctcaatgccct

SEQ ID NO: 200290 - DNA, 601 bp, Human
ggcctcgaactcctgacctcaagtgatctgcccacctcagcctcccacagtgctggaattacaggcatgagccagcatgcctggtcaccattttttatctttatactgtattttgattgtaccttttctaaggttagatgcacaaatacttaccatcgttgttacaatggtcacaatattcagtacagtcacatgctgtacaggtttgtagcccaagagcaataggctagaccctacagcctgggtgtgtagtaggctagaccatctaggtttgtgtaagtgcactctgtcatgttcgcaygatgacacaagcgcccaagggtgcgtttctcagaacatatgcaaattgttaagcaaggaatgactgcaatttctttatttaaatggtaagcctgtcatgaaagttaaaaaagttaagctcttccaaaaatgctgaatgaaaagacaagtcacagactgggagaaaatatttgcaaagtatgtatctgataaaagacctatgtgccaaatatgtaaagaactctgaaaacttaagaaaataaataaaataatttttttaaatgggtaaagttctaacaggcaccaaagaaggtaaaccgat

SEQ ID NO: 200291 - DNA, 601 bp, Human
ctgctgggtcccagggtggtgggcacatctctggagatctttctttctgcaattctctcctctgggtcggctatctaggccaccctcctggcaccacagcctggaaactctcaagacagtaagctggggcaatgacagggcttgcctccttcatttctcatagctcaggatcactgtcctttgttgcctgatgctcatggtcttggaaatcattacttcttatatttgactggggtttttgccctaggtgtgcaaatgaatatggttcctgtgacactgtcttggcgggaaggggtaatgwggctacaggcatgttttgcttttgctttgtgcttgtttttgccataggttttttagtgcttgatactgtgaataaaatacagtcaggcactgtctaatgacttcttttttgcctttttgatatagagtctcgctgtcacccaggcttagagtgcagtggagtgatctgagctcactgcaacctccacctcctgggttcaagcgattctctggcctcagcctcctgagtagctggggttacaggcgtgcaccaccacgcccaactaaaggttgtatttttagtagggacggggtttcactt

SEQ ID NO: 200292 - DNA, 601 bp, Human
ggtgtggggtagggggagactgaagccggcgtaagatcttagcatccccctttttgtcctccagtcttggttacttacacgggctggtcagtacgctgctgggtcccagggtggtgggcacatctctggagatctttctttctgcaattctctcctctgggtcggctatctaggccaccctcctggcaccacagcctggaaactctcaagacagtaagctggggcaatgacagggcttgcctccttcatttctcatagctcaggatcactgtcctttgttgcctgatgctcatggtcttgsaaatcattacttcttatatttgactggggtttttgccctaggtgtgcaaatgaatatggttcctgtgacactgtcttggcgggaaggggtaatgtggctacaggcatgttttgcttttgctttgtgcttgtttttgccataggttttttagtgcttgatactgtgaataaaatacagtcaggcactgtctaatgacttcttttttgcctttttgatatagagtctcgctgtcacccaggcttagagtgcagtggagtgatctgagctcactgcaacctccacctcctgggttcaagcgat

SEQ ID NO: 200293 - DNA, 601 bp, Human
atcctctctcaacaccagcttttctttatctactcccctacccaagtgtcatccgcagaataaaatccagccgggacttgaggccatttgaaacccacagcatctatgatgacgggaaaagcactaaattgcacaactaatttaaacccagcactgccaagcctcttcaacctctgaaaaattataattgcaaaccagaataaaaatttttttttttttgagatagggtcttgcgctgtcacccaggctggagtacagtggcgcaatcatagctcactgcagtctcagcatcccaagtaamtgggaccacaggcacacaccatcatacctcatttttttatttttattttttgtagagatgaggtctcgccatgttgcccagcctggtctcagactcatggtctcaagtgatcctcccacttcagcctcctaaagtgctgggattaccggcgtgagccgccatgcctggccaaggccagggttattctcctttgggtaactaacgtccacctgacgcatactagctgatgctgcgtctcctctgcagggacgtaagctccacaagagtgggattttccttactcactgtgggatcccaagc

SEQ ID NO: 200294 - DNA, 601 bp, Human
cccttttcctgctctggataaagttccagcagacttggctaaggatgagacaagcttcacagatcaaagacagttggggagagggggagggggaggagcagagcacaaacctagctcagccctctcctctcacaaaacacaagtcaagattataaaaagcccacagtgctgcactgaagtgctttcaaaaggttactctttattttgatagcctgtcacctacttcttactggaaaatggttccagactcagagaggttactgcagacggcataaaagcattcagacgacaacgttctctycccaacattcattttccttgcaagagaaaataggacgaacccttatgacctgaaattataaaactagcgcccaaggaccttatcaaaatctacctgactttgaagtactaaggggaatcatgtgaagtccttaataatgatcagaagccaggccgggcgcagtggctcgcgcctgtaatcccatcactttgggaggccgaggcgggcagattgcttgagaccagaagttcgagaccagcctggccgacatggtaaaacctcatcctactaaaaatacaaaaattagccaggcatggtggt

SEQ ID NO: 200295 - DNA, 601 bp, Human
aatgcttaatgatttgtcactcccatcaccaccagatgggaccagctagttgcaggaaaacaagctcagggctcccactgattccacattatagtgagttgtataattatctcattatctattacaatgtaataatagtagaaataaagtgcacgacaaatgtaatgcacttgaatcatcatgaaaccatcccaccaaccccagtctgtggtgccgaacaaggttggagacagctgctcttggtgatatagacatacagtgagatgcacacacaccctgccctttgttgctctacaatggycctacatgtaagtatgtccttaagaaaatgtgcacaaggacttacaccatcctctcctcactgaccctaaaaaggtctgacaccatgtgacccaagtcaaagccgcctcttcccgccactcactcgtcccaccacgcctccctgcagacgcgtgtgccacttggctccattttgctcgctaagggtttatataaatacaaatccacccaagaaaggaaaactatttccccttttcctgctctggataaagttccagcagacttggctaaggatgagacaagcttcacagatcaaagacag

SEQ ID NO: 200296 - DNA, 601 bp, Human
actccagaaataaacaatcatcagttttaaatctagcaccattctagtagcatgatgaaatctcgacctgtccagctccataccccccagcaccatgaaatctcctgtgtccactgtccccacactgtagacgctcccctgggaaccctcctctgcccagtgtccccacactgtagactctcccctgggaaccctcctctgcccagtgcccccacactgtagacgctcccctgggaaccctcctctgcccagtgtccccacactgtagacgctcccctgggaaccctcctctgcccagtgyccccacactgtagacgctcccctgggaaccctcctctgcccagtgtccccacgctgtaaacgctccccacctgctcatcacttaggcactttctcggttatcagatccactgtcaaagtgttgcagtgcttaatacgtcacccttattttacttcataatggcccgaaagtgtaagagtagtgatgctggcgatttggatctgccaaagagaagctgttaagtgctttagtaaaaagctgaaaggtcttgacttaataaggaaagaaaaaaaattgcatgctgaaattaccagatctaca

SEQ ID NO: 200297 - DNA, 601 bp, Human
ctgtggtttttgcttccaaaggtttcggctaccagccatcaatctgggtctgaaaatattaaatgaaaaactccagaaataaacaatcatcagttttaaatctagcaccattctagtagcatgatgaaatctcgacctgtccagctccataccccccagcaccatgaaatctcctgtgtccactgtccccacactgtagacgctcccctgggaaccctcctctgcccagtgtccccacactgtagactctcccctgggaaccctcctctgcccagtgcccccacactgtagacgctccccwgggaaccctcctctgcccagtgtccccacactgtagacgctcccctgggaaccctcctctgcccagtgtccccacactgtagacgctcccctgggaaccctcctctgcccagtgtccccacgctgtaaacgctccccacctgctcatcacttaggcactttctcggttatcagatccactgtcaaagtgttgcagtgcttaatacgtcacccttattttacttcataatggcccgaaagtgtaagagtagtgatgctggcgatttggatctgccaaagagaagctgttaagtgctttagt

SEQ ID NO: 200298 - DNA, 601 bp, Human
cattcagattccaaagagaatcacttacaatttcatttcggtctctgtggtccattcattctccctaatcctcacttactgcctctcaaaagagctgtctacattctcatctcttccctcccctatgaaaaagcgtatagcttctgtatcccactgtgattccctttgaatgttaataaatttatttgccttagtaatcttcttattcttattaatttgcctttcatcagttgattttcactgaaccttcttctgagagcaaagggaaagttttccctgtaccccctacaatgaaaagaargcattcgcgtggatggcatgcacacttaaaaacctcaccatccacaagaagtggccagagctggtgtgaaaggctgagactaattcaaggaagtaaattaatagtgggacacactgtaagtagctaaaacttccgaggtcaatgttgcaaaggagagctaaggccttctacaacattattctcttagtaacaatttaaaaagcaaaatgaacttgaacttgtcattcatctgtatgtatcactatatatagtgatatatttagatatacagtggtcccccatcatctgtggtttttgctt

SEQ ID NO: 200299 - DNA, 601 bp, Human
gtccctctaaccttgtcttgtgcctccccaaaccacaagggcagggactattcctggaacgtccttatctgaccaagagcgctcaccaaaagaaacataaatgctttctatgccctccctggaatctcattatctcagaaaaaaagcctgacgaatgtgaccacacctgacagacattttcccgagataatgtctgcctctcaggcccattcagattccaaagagaatcacttacaatttcatttcggtctctgtggtccattcattctccctaatcctcacttactgcctctcaaaagarctgtctacattctcatctcttccctcccctatgaaaaagcgtatagcttctgtatcccactgtgattccctttgaatgttaataaatttatttgccttagtaatcttcttattcttattaatttgcctttcatcagttgattttcactgaaccttcttctgagagcaaagggaaagttttccctgtaccccctacaatgaaaagaaggcattcgcgtggatggcatgcacacttaaaaacctcaccatccacaagaagtggccagagctggtgtgaaaggctgagactaattcaaggaag

SEQ ID NO: 200300 - DNA, 601 bp, Human
gagaatcgcttgaacccgggaggcagaggttgcagagagccgagattgtgccactgcactacagccctggggacacagccagactctgtctcaaaaaaaaaaagaaaacacagaaaggaaccatgaggcaccacttgaagcttcaatgaggtggttttatgatgttgggggtatagaaaatcattcctcaaaatatggcacctgagcacgctgggcgcttttgaaagctgagcggcccctgaagtaagcctcagaatgaaggtccctctaaccttgtcttgtgcctccccaaaccacaagrgcagggactattcctggaacgtccttatctgaccaagagcgctcaccaaaagaaacataaatgctttctatgccctccctggaatctcattatctcagaaaaaaagcctgacgaatgtgaccacacctgacagacattttcccgagataatgtctgcctctcaggcccattcagattccaaagagaatcacttacaatttcatttcggtctctgtggtccattcattctccctaatcctcacttactgcctctcaaaagagctgtctacattctcatctcttccctcccctatgaaaaag

SEQ ID NO: 200301 - DNA, 601 bp, Human
cactttgggaggccgaggcaggcaaatcacctgaggtcaggaattagagaccagcctggccaacctggtggaacctcggctctactaaaaaaacaaaaattagcggggcatcgtggcacatgcctgtaatctcagctactccagaagctgaggcaggagaatcactggaatccaggaggcagaggtttcagtaagccgagactgtgccattgcactccagcctgggcgacagagtgagactctgtctcagaaaactaaactaaaataaaataaagcatccgggaggatgttcgtaggttaygtgcaaataccatgccactggatatcagggacttgagcatccaaagactttggtacccatgggggtcctggaaccagtgccccacagatatcattccttttcaaaacgactcaaactcataggctcacttgataattgaatatatcgtaaggtatggttccaacgacagctacaaaaacttacaccatcaaaaattatgaccctctcctagaaccgttttcattttcagcacacatctctgcaactcttcaaaatgtaggaatccactgagttctgggcaatttaacaatgtaaggaaat

SEQ ID NO: 200302 - DNA, 601 bp, Human
caggagttcaagaccagcctggccaacatggtgaaacccccattctctactaaaaagatgaaaattagccagggatggtggtaggcacctgtaatcccagctacctgggaggctgaggcagaagaatcgcttgaacccgagaggcagaggttgcagtgagccgaaatcgcaccactgcactccagcctgggcgacagagcaagaccctgtctcaaaaaaaaaaaaaagaaagaaaaagaaaactaaattccatctgtactgaacatgtatagacctttttcttgtcattattccctaaacaaaaatagtataacaactatttacataacatttgtattgtattagttattataggtaacctagagatgatttaaagtaagggaggaggctgggagcagtggctcacacctgtaatcccagcactttgggaggccgaggcaggcaaatcacctgaggtcaggaattagagaccagcctggccaacctggtggaacctcggctctactaaaaaaacaaaaattagcggggcatcgtggcacatgcctgtaatctcagctactccagaagctgaggcaggagaatcactggaatccaggaggca

SEQ ID NO: 200303 - DNA, 601 bp, Human
tcctctgggtgccaacaaattccctgggaagctatcttggggggtgaaggagcaggctgtgcggaaagcaggctacagaactttctgggaaacatgatgaggcaacagctgtggtccctggaaggccacccacacgggatgctgaattcatggggaaggcaggtggaacatccttaaaggggctgagttgctgctgaacttgcaagagacttacccaaggtatgcaggctatcggtagatttggcaacaatcttcctgcatagccactaacaagtcagctggggtacccacaggtatattmtaccactaagccacatatactcttaaggggttttggggattcaaagagtggttccccaaaactgtagggatgttgcattcttcctgtgaacaaggtttgctcttggctcaattacagagttagccctccttatcagtgagttttgcatccacggattcaaccaactgcaggtcgaaaaaattgtttttaaactgcacctgggctggacgtggtggctcatgcctgtaataccagcactttgggaggccgaggggtgggggcagatcatttgaggtcaggagttcaagaccagcctggcca

SEQ ID NO: 200304 - DNA, 601 bp, Human
cccatccctggcaccagcctggtgcagcaggcttcttggctagtatgtcacagctttcggtggtcagatcattttgccagagaatttgaaataacaggctgggtgcagtggctcacacctgtaatcccagcactctgggaggccgaggtgggcggatcacaaggtccggacatcgagactatcctggccaacatggtaaaaccccgcctctactaaaaatataaaaaattagtggggcgtggtggcacgcgcctgtagtcccagctattcaggaggctgaggcagcagaatcgcttgaacmtgggaagtggaggttgcagtgacccaagattgagacactgcactccagcctggacgatggggtgagactctgtctcaaaaaaaaaaagaaagaaagaaagaatgtacagcagactattaagcctccattatcaactctaactgtaccccagactgtccacgtcacacagagccaggtaactggttttgtttgggtcttatctctagcaggactgccatccatggaaacagagcacgaaggtggaaggcactgagaagtttcacacatgtgaaaaattcacttgatgttaacaaatactga

SEQ ID NO: 200305 - DNA, 601 bp, Human
gaaaactctctcctggttggaattccacacaggccccagctccacctgcttttatctgcctggacactcagaataacaacagcagatgccaagcccctgtcctcagcacccatccctggcaccagcctggtgcagcaggcttcttggctagtatgtcacagctttcggtggtcagatcattttgccagagaatttgaaataacaggctgggtgcagtggctcacacctgtaatcccagcactctgggaggccgaggtgggcggatcacaaggtccggacatcgagactatcctggccaacrtggtaaaaccccgcctctactaaaaatataaaaaattagtggggcgtggtggcacgcgcctgtagtcccagctattcaggaggctgaggcagcagaatcgcttgaacctgggaagtggaggttgcagtgacccaagattgagacactgcactccagcctggacgatggggtgagactctgtctcaaaaaaaaaaagaaagaaagaaagaatgtacagcagactattaagcctccattatcaactctaactgtaccccagactgtccacgtcacacagagccaggtaactggttttgtttg

SEQ ID NO: 200306 - DNA, 601 bp, Human
cgtgtaatcttcacaatggccctagatgggtttatcctcattttacaaatgaggatgctaatgctcagggaggttatgcgatgtacccagagtcaggagctaaccagcagcagacttgggatgtgaacttgggaacccacttctggggcccttactctttgcccccaggctaatgcctccccaaagcagggactgcttctttatgccagaactcatctttcctaaatgagcaatctaaaaacgctatttttaattaatgaactaagcggcatacttttatgaaaaacattaatttcctgaygtgtacatttttatatagtgtcgcacaatattaagtgaatgtaatttgagttccttaaccaaactcctgtaaacagcaaactgctacaaaagttaatttagcatcattagcttgtagcatggctatgtggatatcaaaaatgcacttcaaacaccagctaggaaaagatcctcaaatataaaaatgcaagttaaaaatgtaaatgttaaatgcttatcaaagtaataaaatgaacccaagtaacagcatgttcgagctagactggaacctggaaggcatccagtccaaacatcaactagt

SEQ ID NO: 200307 - DNA, 601 bp, Human
cgtataatgatatgaaattcctttgcttcaaagtactgtatttctggctgggacagtggttcatgcctctaatcccagcactttgcgaggcaaagacgggtggatcgcttgagcccaggagttcaagatcagcctggccaacatggtaaaacccagtctctactagaaatacaaaaatcagccaggcatgttggcgggcacctgtaatctcaggtattcgggaggctgaggcatgagaatcacttgaatccaggaggcagaggtttcagtgagctgagatcaggccactgcactccaaccygggcgacagagtgagactccgtctcaaagagcaaaagaaaacaaaaacaccgtatttctaaatgtctcatcccccgcaaaggccacactgatagcgcaggcccatatcagcactgggcctgcagttttaaatgtacacctcgtgtaatcttcacaatggccctagatgggtttatcctcattttacaaatgaggatgctaatgctcagggaggttatgcgatgtacccagagtcaggagctaaccagcagcagacttgggatgtgaacttgggaacccacttctggggcccttactcttt

SEQ ID NO: 200308 - DNA, 601 bp, Human
ggcatttgtggcaggtgcctgtagtcccagctacccaggaggctgaggcaggtgaatcgcttgaacccggaaggcagaggttccagtgagcccagattgcgccactgcactccagcctgggcgacagagtgagaatctgtctcaacaacaacaaaaaaaaaaaaagaaaagaaattctagagactccaaagaagagcagtccccccttatccctcagacatgcgttccaagaccccagcggatgcatgaaaccgaggacagtaccgaagactatacagactatgtttttgcctataagtakatacctatgataaagtttaatttataaattaggcacagtaagaaatttacaacaataaataggacaatgataatatactgtattaataattaaacttttatgaatatggtctctcaaaaactattattatgctgcattcacatgtatttggaccacagttgattgcaggtaactgaaatcacagaaagtgaaaccatggataaggggaccactgtatctgctgacgtataatgatatgaaattcctttgcttcaaagtactgtatttctggctgggacagtggttcatgcctctaatccc

SEQ ID NO: 200309 - DNA, 601 bp, Human
aggtggatcacaaggtcaggagttcgagaccagcctggccaataaggtgaaactccacatctactaaaaatacaaaaatcagctaggcatttgtggcaggtgcctgtagtcccagctacccaggaggctgaggcaggtgaatcgcttgaacccggaaggcagaggttccagtgagcccagattgcgccactgcactccagcctgggcgacagagtgagaatctgtctcaacaacaacaaaaaaaaaaaaagaaaagaaattctagagactccaaagaagagcagtccccccttatccctcrgacatgcgttccaagaccccagcggatgcatgaaaccgaggacagtaccgaagactatacagactatgtttttgcctataagtagatacctatgataaagtttaatttataaattaggcacagtaagaaatttacaacaataaataggacaatgataatatactgtattaataattaaacttttatgaatatggtctctcaaaaactattattatgctgcattcacatgtatttggaccacagttgattgcaggtaactgaaatcacagaaagtgaaaccatggataaggggaccactgt

SEQ ID NO: 200310 - DNA, 601 bp, Human
atgatgctgatgtcatccagaagaattatgtctgttcaggaggactttgcaaggtttgtgcagatgcagtttaacctggatttttgtggtcatatctatggagctgggatcaggagccaggtcccggggccagagggactttgagaactcacttggaacaggggctgatcacagtcggcgtgggtgggtaaaccaaggcaacatttactcgctcgctgccgttcttggggcaaatgatctctgccactccttccggtctgggctgactcagcaactcccctgtaggaggagagagaaaaaygtgttagggagatgtgcactaaaaatgggctcattttacaaagacagcactgcccggggatgggggcagggggagaagggcagaggtgaagcaacgaaggatgtgagaacaaatgtgcaaccaagaacagcagaactgcctgggcgccggctccagcgcctaaatcctcctctgcgtcaccgtggagaaaattttcatggttatggcaggaaggcccacactagacaaagacagcatctgtcactgctctgctcaccttccttttaacagactgactccagggatctttatctagatatc

SEQ ID NO: 200311 - DNA, 601 bp, Human
ggttcatgtctctcttggctctggaaagtttacgccaatgcaaagtatattgaatttttgtttcctctgtttcataccttgctggttctgtaatatccccttgagctttaagaacttgcggggtattaaaaaaaagagacagaagaaaaagaaaacatataatatccccttatccatcctcacccaggtgtatctgaaagaaagggaccaatatgtacaatttcaaagaaattaaaagagaaacaataaaatttccgttgtttgatatgttcaggacaggggatattcaggttaatattcrgttggtgcaaaagtaattgtgcaattacttttaacagttattctgtaatcctattttaatatttaagaagcacttcaagattcacaatgtcttagggtcagtgataaattaaactatgcacatgatagttaaatagtactctgaatacaagagcattagataacagtttcccttgggtgttcggtgatattttccagcaaggatagattagggatgttctatgtaatgagtttcccagtttggagaaacggggcactgagccgagtgccctctacttctactgcagcagctaatgagtaa

SEQ ID NO: 200312 - DNA, 601 bp, Human
cagtacaagaagcccatgggaaaacactgataaagctggcttggtgccaggaaggtttctagcgcaaatggatattttaactcctacctctatcgcacctattcgacggcacttggctatggcaaaacaataggttcatgtctctcttggctctggaaagtttacgccaatgcaaagtatattgaatttttgtttcctctgtttcataccttgctggttctgtaatatccccttgagctttaagaacttgcggggtattaaaaaaaagagacagaagaaaaagaaaacatataatatcccyttatccatcctcacccaggtgtatctgaaagaaagggaccaatatgtacaatttcaaagaaattaaaagagaaacaataaaatttccgttgtttgatatgttcaggacaggggatattcaggttaatattcagttggtgcaaaagtaattgtgcaattacttttaacagttattctgtaatcctattttaatatttaagaagcacttcaagattcacaatgtcttagggtcagtgataaattaaactatgcacatgatagttaaatagtactctgaatacaagagcattagataacagtt

SEQ ID NO: 200313 - DNA, 601 bp, Human
ctgagaccccaagtctcaggctcaggcccaagctgtgttgacttaagcacagattctttgccagctatcctaaccgatccccccaaatctcccgcttccaatccactgtcaaccacccatgaatgggaccttccccggagcctggcccggcctccacatgagtttgtttttgtccatgtgttcatggatgtaaactgtgggtgcttaaggcggtgaaggtgggggaacactgggcagctcgagcacaggcttcacatctacgtgtgcttttctataaagtcacacaagagatcatttaccycttgcagctgcactaaaatatggtaattttccaagaaacgtcttgccaggaatatgaaacttccctacttagagaacattccttcatttagagttgagaattatattgcaaagctgtcatccatttcatgagactttttttttaacctctttcaaaataaaatgattctgatagctaggtcaaaagtggttcaatgcctaaagaggcttcctcggcatttggatgtctggcgccatgtaccgccgcttacccatgactttaggctgcttgttcgttcaggttcaatacgctgtcgagaga

SEQ ID NO: 200314 - DNA, 601 bp, Human
tgctgagaccccaagtctcaggctcaggcccaagctgtgttgacttaagcacagattctttgccagctatcctaaccgatccccccaaatctcccgcttccaatccactgtcaaccacccatgaatgggaccttccccggagcctggcccggcctccacatgagtttgtttttgtccatgtgttcatggatgtaaactgtgggtgcttaaggcggtgaaggtgggggaacactgggcagctcgagcacaggcttcacatctacgtgtgcttttctataaagtcacacaagagatcatttamcccttgcagctgcactaaaatatggtaattttccaagaaacgtcttgccaggaatatgaaacttccctacttagagaacattccttcatttagagttgagaattatattgcaaagctgtcatccatttcatgagactttttttttaacctctttcaaaataaaatgattctgatagctaggtcaaaagtggttcaatgcctaaagaggcttcctcggcatttggatgtctggcgccatgtaccgccgcttacccatgactttaggctgcttgttcgttcaggttcaatacgctgtcgaga

SEQ ID NO: 200315 - DNA, 601 bp, Human
gctgaggcagaagaatcacttgaaccctggaggtggagtttgcaatgagctgagatcgcaccactgcactccagcctgggtgacagagtgagaccctttgtcaaaaaagaaaaaaaaaagcctgacctctatggtgacctgcttaagttacctcggctggagttgaaagccagtgcaatagccccggacttccaatgtctagtgcctgctgagaccccaagtctcaggctcaggcccaagctgtgttgacttaagcacagattctttgccagctatcctaaccgatccccccaaatctccygcttccaatccactgtcaaccacccatgaatgggaccttccccggagcctggcccggcctccacatgagtttgtttttgtccatgtgttcatggatgtaaactgtgggtgcttaaggcggtgaaggtgggggaacactgggcagctcgagcacaggcttcacatctacgtgtgcttttctataaagtcacacaagagatcatttaccccttgcagctgcactaaaatatggtaattttccaagaaacgtcttgccaggaatatgaaacttccctacttagagaacattccttcatttaga

SEQ ID NO: 200316 - DNA, 601 bp, Human
agtcctagctacttaggaggctgaggcagaagaatcacttgaaccctggaggtggagtttgcaatgagctgagatcgcaccactgcactccagcctgggtgacagagtgagaccctttgtcaaaaaagaaaaaaaaaagcctgacctctatggtgacctgcttaagttacctcggctggagttgaaagccagtgcaatagccccggacttccaatgtctagtgcctgctgagaccccaagtctcaggctcaggcccaagctgtgttgacttaagcacagattctttgccagctatcctaaycgatccccccaaatctcccgcttccaatccactgtcaaccacccatgaatgggaccttccccggagcctggcccggcctccacatgagtttgtttttgtccatgtgttcatggatgtaaactgtgggtgcttaaggcggtgaaggtgggggaacactgggcagctcgagcacaggcttcacatctacgtgtgcttttctataaagtcacacaagagatcatttaccccttgcagctgcactaaaatatggtaattttccaagaaacgtcttgccaggaatatgaaacttccctacttaga

SEQ ID NO: 200317 - DNA, 601 bp, Human
tccctgagaaattctaacttaacaggtctgattaagaaagcctgaccttggctgggcacggtggctcatgcctgtaatcccagcattttcggaggctgaggcagatggatcacttgaggtcaggagttcgagaccagcccagccaacatgatgaaaccccgtctctaccaaaaaatacaaaaaattagctaggtgtggttgtgtgcgcctgtagtcctagctacttaggaggctgaggcagaagaatcacttgaaccctggaggtggagtttgcaatgagctgagatcgcaccactgcackccagcctgggtgacagagtgagaccctttgtcaaaaaagaaaaaaaaaagcctgacctctatggtgacctgcttaagttacctcggctggagttgaaagccagtgcaatagccccggacttccaatgtctagtgcctgctgagaccccaagtctcaggctcaggcccaagctgtgttgacttaagcacagattctttgccagctatcctaaccgatccccccaaatctcccgcttccaatccactgtcaaccacccatgaatgggaccttccccggagcctggcccggcctccacatgag

SEQ ID NO: 200318 - DNA, 601 bp, Human
ttttatgaaaggctactgcaactggtcttaaatgtctttatgtcaaaacgatgttactgccaaaattcctgtgcaaagtaaccacggtacttctgagaatacttacaaacagctagcaagtaactggaatttagtggggatcttgcttgaatgggaactctacagtatagaggcaataatccaagattttaaaagggtatttcgaaatgcaataactcagccttcccctctattattattagtacttcctaaaaaaggagaaagcttagctcaaccattttcaaaccaccaccccacccgttttttttttttttttttgctaattctgttaacacatgatcagccaaaatcagaatgaactaacttcttcagtctcagaactcccaccattccccacatatcggagcacagacagatacggtatcgctgcaggagaaacgtcaaccatcaggaaataagagtgacacatgcccatttcctgtatattcaagggtcagtccattaagaaaccacatgttagaatgtgggtcgcattccagtaatgcctcaaggtaaaacattttcatatgatgacctgttgaatttgcttggtcttttaccc

SEQ ID NO: 200319 - DNA, 601 bp, Human
tggaaggctgaggcaggcagatcacctgaggtcaggagtttgagaccagcctggccaacatggcaaaaccctgtctctactaaaaatgcaaaaattagccaggcgtggtggtgcatgcctgtagtcccagctactcggggggctgaggcaggataattgcttgaacccaggaggcggagggtgcagtgaaccaagattgtgccaatacactccagcctgggtgacagaccaagactctgtctcaaacaaagaaacaaaaagtattgaggagacatgaagaacagagtgactggttacagtyaggatggttacgggaggctccccagaggagctgacatatgaccttggcctcagcgaccaatgggccttaactgggtaggagagaagggcagcagccagccagtggactgagaggcagccacggcccaccacggctgacctcccatggtaagggagtatctgtgtgttggcagagtggctgggtctgattgtgcagggccttgtgagccacggccaggagtttgaacttgagcctgtgatcaccaggaagccatccaaggcttttcaacagggagagatgtgatgaggtctgatgttaaaa

SEQ ID NO: 200320 - DNA, 601 bp, Human
ccactgctttggaaggctgaggcaggcagatcacctgaggtcaggagtttgagaccagcctggccaacatggcaaaaccctgtctctactaaaaatgcaaaaattagccaggcgtggtggtgcatgcctgtagtcccagctactcggggggctgaggcaggataattgcttgaacccaggaggcggagggtgcagtgaaccaagattgtgccaatacactccagcctgggtgacagaccaagactctgtctcaaacaaagaaacaaaaagtattgaggagacatgaagaacagagtgactsgttacagttaggatggttacgggaggctccccagaggagctgacatatgaccttggcctcagcgaccaatgggccttaactgggtaggagagaagggcagcagccagccagtggactgagaggcagccacggcccaccacggctgacctcccatggtaagggagtatctgtgtgttggcagagtggctgggtctgattgtgcagggccttgtgagccacggccaggagtttgaacttgagcctgtgatcaccaggaagccatccaaggcttttcaacagggagagatgtgatgaggtctg

SEQ ID NO: 200321 - DNA, 601 bp, Human
atgggctcattcaagcatgataataacgacatcaccaaaacaaagcaaagcaaagcaaaacaaaacaaaacaaaacaaaaaaaccaaaaacctctcatttactaactacatgccaggaattaggttgttcactctagtgcattatttatcttcaactcctaataatcccaccatgtaagctccatcttactcagtattattattatttttttttttttgagacagagtctcgctctgttgcccaggctggagtgcagtggcgcaatctcggctcactgcaagctccgcctcctgggttcaygccattctcctgcctcagcctcccgagtagctaggactacatgtgcccgccaccacacgcggctaattttttgcatttttagtagagatggggtttcaccatgttagccaggatgatcttgatctcctgacctcatgatccgcccaccttggcctcccaaagtactgggattacaggtgtgagccactgcgcccggcctcagcatcttactaggaagggaactaaggttccaaaagatgaaataacttccccaagggtgcatactagcgagtgacagagccaggcctttcactagggtga

SEQ ID NO: 200322 - DNA, 601 bp, Human
gttcacagaacacgctggggtgagtgcagagggtctgccaggtgcaaaagatggtccaggtgttcagatgctctcttttctccatggaaattccacagccacaaacgtcactggtttctgtgcttttcaccaacattcttcctgtatgggtggacaagaagaaagcacagagatgacaaaaacgtactggacaatgctaccctcaataagaaaaggaagtgatgatagaaatctattttctgcacatattttcatttctacttccaggactcattataaacatgtaaatgtcaggcaactwatgtccccacaaaggaaagagtcattttagcagtctatttgccaaacatttctgttggtgtgttaagctcagttcagctataagagggaactgtactaactggctgtcatcacttattccactgtaattttatagcttaactagacctctaactaacaacccaaaactctaaacacggaactgtttcctttcaataaacacacacggtcacacgcagacacacaccaaataatcctctagaagaaggaatatatactaaaaagtgagatgtctgtctgcctaaaatgcatgattttactt

SEQ ID NO: 200323 - DNA, 601 bp, Human
cgctccttggaggatcacagttctgaggttcaggttgtaaaacatttgctccatgttctcgtccatgcttccccccaccaccccctccccacctcttccccagtcatccaaaaagcaccctgcaagcacgcgttgtcactcaagttcacagaacacgctggggtgagtgcagagggtctgccaggtgcaaaagatggtccaggtgttcagatgctctcttttctccatggaaattccacagccacaaacgtcactggtttctgtgcttttcaccaacattcttcctgtatgggtggacaasaagaaagcacagagatgacaaaaacgtactggacaatgctaccctcaataagaaaaggaagtgatgatagaaatctattttctgcacatattttcatttctacttccaggactcattataaacatgtaaatgtcaggcaactaatgtccccacaaaggaaagagtcattttagcagtctatttgccaaacatttctgttggtgtgttaagctcagttcagctataagagggaactgtactaactggctgtcatcacttattccactgtaattttatagcttaactagacctctaactaac

SEQ ID NO: 200324 - DNA, 601 bp, Human
tatacatattttacactagttatggaacagcaatgaacgtcagtcgatccctctttcacatttaacagaactgaaatctgagtgctctaaatactgccacctgtactgtaactatggcttatatgtgcacggaaaacaaaatccctgagaagccattcgactttttttttttttttttcttttcttcaagtagcgcgctccttggaggatcacagttctgaggttcaggttgtaaaacatttgctccatgttctcgtccatgcttccccccaccaccccctccccacctcttccccagtcrtccaaaaagcaccctgcaagcacgcgttgtcactcaagttcacagaacacgctggggtgagtgcagagggtctgccaggtgcaaaagatggtccaggtgttcagatgctctcttttctccatggaaattccacagccacaaacgtcactggtttctgtgcttttcaccaacattcttcctgtatgggtggacaagaagaaagcacagagatgacaaaaacgtactggacaatgctaccctcaataagaaaaggaagtgatgatagaaatctattttctgcacatattttcatttctactt

SEQ ID NO: 200325 - DNA, 601 bp, Human
tcttatactaaaataagaaatcagccccatcttggcacagttctcatgcagaatattgcacccagtgtgaactaacgctagaagcttcaaactgtataaatttaaatgtatttgcatattataaaaataaagataaacatatacatattttacactagttatggaacagcaatgaacgtcagtcgatccctctttcacatttaacagaactgaaatctgagtgctctaaatactgccacctgtactgtaactatggcttatatgtgcacggaaaacaaaatccctgagaagccattcgactttttttttttttttttcttttcttcaagtagcgcgctccttggaggatcacagttctgaggttcaggttgtaaaacatttgctccatgttctcgtccatgcttccccccaccaccccctccccacctcttccccagtcatccaaaaagcaccctgcaagcacgcgttgtcactcaagttcacagaacacgctggggtgagtgcagagggtctgccaggtgcaaaagatggtccaggtgttcagatgctctcttttctccatggaaattccacagccacaaacgtcactggtttctgtgct

SEQ ID NO: 200326 - DNA, 601 bp, Human
tagaagtgtcattcagcaaaaataagaccaactaaaaacaaagacactggagcattcccttaacacaggcgcgcacacacaccctcctcaaagaggcctttatgttccccacgagcaaaggacaacaatatcatttttactattcatacagtaacctgcacggaattcaactcacgctcagactgtacaatgccaaacagcgcttctgaaacgcgaagagcgtccagcagagtcaggtacttaattaccaaagtaaacaactcgaccacaagggtctgcaagcctggagaggacttttttccccccccccaaacaaaaaaggagagtaacttgacaaactgttttaaaaaaaatcacaaatggcccttaactactataataaagcaattactcctcccacccccaagcaaataaaataggtgctcgaaagggcgctcgctagtctgtgttccctaattttatgaaatgagaacaggttgcacttccgtaccccctcccccaagctcagcagtctcccatgttttcagtagagaggtaaatataacctccaccaactggccggggaaactctccttctccaaaagcatgggacgcctcgaga

SEQ ID NO: 200327 - DNA, 601 bp, Human
ttcaaggctgcagtgagctatgatagcgccgctgcactacagcctgggtgacagagcgaaatcttaaccccccaaaaaaaagaaaagaaaagaaatttaagaatcacattttaaataatagtttatctgaagaaaaaataataaagtttaaaaagccttcccattaaaagtatttccccaaggaaaaataaacatggaaaatgactttctagtcaactaagtcctaacaattgcaaaatagaagtaattttaataagtgattttttaacagcaaaaaaataagatccattttattatttcyattatcttgaattttcaccttctcatccttaagtttatatttcagcctgaacttcagaaacagacacttaggcctttatatttttaaaggaattaattttctaactcaattcttgttatctcaggatttgatgaatctagctcacaaaagtcaatgctttcaaaatcaaaacacttttacgatcacctataattctcactaaaagctctgtatgttgttatgtaattatcatattgacagtttaacttcatctgaaatttagaagagctagttttaactttagaagatcatactttccat

SEQ ID NO: 200328 - DNA, 601 bp, Human
ctgagtaatctttccataaatcatactgcttgctgtacatatttacatagcttttgagattttacaacatacttctaccgatcacagtaaaaacaagactatgcaaaatcaaatatgaaaactagccctatttccctttttcttgcaatatgaaaaatatctatgctctagaatctgatgtcagccacactcctctctttgtaaatatgttactgttaggattacagattaaaatctcaacctctgtactccactaaaattaagaaactataaattcactactcttctgctacttcactartaactctacaacatctgcacatcagataagtcatatcccattgcaaaacacatccctcaagtgtctaggattcttcccttttgaaaactatctcctccttgagatttactgttcaatgacaacaaactcacaatgaaatcaaatgccaaggaagagaactgtcctaattttgcttaaatgaaagttaacaaggaaaccattttgattccaacttttgttactgaaatttattttaaaactcagtatacctttctcccttgagtgacagagtaccctaacatgttttaatcctcctctgag

SEQ ID NO: 200329 - DNA, 601 bp, Human
aagatatccatattttgcttaggtaggcattctgaacagaaattctttttttcttagaacaaagttcattttaccacaacaattacttcttaagagtatcagaaaaactgtgaactaaactatgcaattcaaccctaatctcaacaatgtaaatatctcttgtttaaagaaaaaaatctatacttatcagagaggcaaaaattttaaataacaaaaacaaagagaaagaggcactcatagactgctatcaaatatgatttactaacacctttctttttttttttttttttttttttgagayggagtctcactctgtcacccaggctggagtgcagtggcatgatcttagctcactgtaacctctgcctcccaggttcaagtgattcttctgcctcagcctcctgagtagcggggactacaggcacacgccaccacgcccagctaatttttgtatttttagtagagacagggttttaccatattggacagactggtcttgaactcctgaccttgtgatctgaccacctcggcctcccaaagtgctgggattacaggtgtgagccaccacgcccagccttgctaacacctttctaaaagtaat

SEQ ID NO: 200330 - DNA, 601 bp, Human
cttagaagtaaatgataagaatatagccaaatagaataggctgtactaactatataaataacttgacaaacccaaaaaactgtataacatggaaactagcaagttaacccatttctatttataccaatgtttgtgggccagcaaatctttaaatttacactaaaaagttcatgacataattcagttccacagtaacatatctaatttcctattgtaattatatactcaccctaattctgtcatgccatccatgaactcctgtttggagaactcgcactgtgttgctgctctgaacttccaygcaataatcaacacactaatgctggctggatcgagtgccaggtcatcacagaactgctgtatgccatctattccaattttattctcatcttgagggtctttaaaaataacaatgcaatattaaagtagtgtcatattatgctacattatgaaaactgaaaaaggtaatgctttatatgccattttttaaatgaccacaatatatggaaggcatgaaacgatattactctaacatacactttcccattatttaaagccattctccttactaacagcattcttaaagtgtagagatatatgc

SEQ ID NO: 200331 - DNA, 601 bp, Human
gtcaagctggtctcaaactcccaaactaaggtgatccacccacctcggcctcccaaagtgctggaactacaggcatgagccaccgcgcctagcccctggtgtggtttttgtatcttgactggacgctgactgactgcaatgtcactcagactcgaatcatgactctaatactacctaattctataatttctctgtacctcaatttcttcatctctaaaatggggatagaaaactattctcaaaaagttgctgtgaagaggtaggagaagtacttagcacagttaactgaaataaaataatsttcaataaatgttagctattattattcaatagtggcccactaaaaaacagaaagggcagcttgttacctaccaacagactgattacttctgtctgcaacctcattaaatatggacaactagaggtcacaggtaaaacctctacccatgacttttcaatcaatttatccaaagacattcagctaatcagctgtcaaagtgttaagtgaaacaagtagtaacttctaaggcatcttccagtttttaaattctaggattttataaatgcagggttcaaagtctcacattaggaaataacttta

SEQ ID NO: 200332 - DNA, 601 bp, Human
aaaatcctatctatattgagcaatcaagttggaaaggaggctttattattgagaatttcgctttacaaatatgttatgaatctttcatcaattcagtcatgtttagtaactcgtggggccataccacattacaaaggttatacatttatcccttcctctctacctttccgtcacttcctcaatctaatccgttcatataatctgtttctcaatactttttccccccaatttaaaaaataaagtggaattagtgcagaaggccccttattagcctctccaactactatatcttcaaaaaccaaaaaaaaaaaaaaaaaaaaaaaaccctcatttaccttcactgggtaagttacttaaccttcctgtgcctaaatttcctcatcttcaaattaaggataataaactgctagcactttattactatgtatttggcacggcacatagcaggtggtaaattactgaatgaaaggatgaatcactcaaaaaattggtaaacattaaatgaggcagtgctatggtttggatatagttggtttgttccaccaaaactcgtactgaaattttatccccactgtggtggagctggaagatgaggcctggt

SEQ ID NO: 200333 - DNA, 601 bp, Human
ctaaaccaatatcaaaatccaaatcatcatcactttcttcacttcttctgcagcttcttctatggttggaacttagattattttcaatattctctgtttttcctggttctttattgaacagaatagcaatgtcttcttctttccacattttgcgcaaacttcaagttcataggcacatggtctacacgttatgagataagaatcttccactgtcttttgtaaacatttaacacattttttaggttggataatggtttgtatttgctatattttacatgccactcaagaacttctttacagygctgacatactccatcaggagggtttttttttttgagactgagtctcgctctgtcacccaggctggagtgcagtggtgcgatctcggctcactgcaacctccacctcccaagttcaagtgaacctgcctcagcctcccgagtagctgggattacaggcacccaccaccacacctggctaatttttgtatttttagtagaaacagggtttcaccatgttggtcaggctggtctccaactcctgacctcaggagatccacctgccttggcctcccaaagtgctgggattacaggcgtgagcc

SEQ ID NO: 200334 - DNA, 601 bp, Human
aggctagcaatataataatgtcattttatttttacatgaggtggttcctttcttatacaaccatcaattctgaatctggtttagtttggtattagataatacatcatacacaatttatattgttcgtgtctaaaatttgtctacttttctaaaggtttttctgatttcctcattaggatttcacagtatcttttgtgaaatagtcagaagttggtcagaatttcacattcttaaattgacttttttttttttttgagactgagcctcgctcttgctgtccaaaatggagtgcaatggtgcratctcggctcactgcaacctctgcctccagggttcaagggattctcctgcctcagccttccgagtagctaggattacaggcatgcgccaccacacccggctaatttaaactgacttttaatacagtaatattaattcacttgagggtctcctcctgtgttttctaaaccaatatcaaaatccaaatcatcatcactttcttcacttcttctgcagcttcttctatggttggaacttagattattttcaatattctctgtttttcctggttctttattgaacagaatagcaatgtcttctt

SEQ ID NO: 200335 - DNA, 601 bp, Human
aggatgaacatggaaatgaattgagactagacccaatcacagtccctaaaagaaacaaaatgttgccagctcactggggaggatggaatggtgattaaaaatcctattcacaatgtcttttttaatcaatctcaacaaattttataacaatgaaaaaagagatataaaataacatatatagtataagtctgttcatacaaagttcaaaaccagtgcacattttcaaatggttcagcaaataaaatatgtgtgtacatccatctactgagatataaagaaaacgtggtaaaatgttaacaaytgggaatccaggtgaagaatacgcaaaagttcacagaactattttgctaccttttctgattgatattttcaattgatatttttcaaaacaaaaagaggaaagttaaaaaaccagacaaagctaatttatatcgtttaggaacagaaacatgggtagtaaaagaattaagactataattatcaaaattcagaataatttccaactctgggaagaaagatgagcttttgctgaacgagagccttgctgggatcttctgatgccggcagtttcttcacctggctgtataaatgcatgaacttt

SEQ ID NO: 200336 - DNA, 601 bp, Human
caaaggaccacagtgctttgagatcgacctttcaggcatgaatctggtgtcacttccatgttaaaattcttcaatcatttccaattacctttagataaaatttgcacttcttgtcaaatgaactcacttgcagttcctcaaaggtggaatgttctttcacctctgagcaagtgaacatgctaacccctcaacctgaaatggcttcttttttcctttggtcttgaaaatgtgcattcattcttcaaggctcaaaaactataccctttttgaaggtactgcaaactaccccagactgactaawgatgctcttgactccatgctctcagtgaaagcagtcaagtgtttttgaataaaaaaggaagactttaactcaaaaagattaataagttataactaagagctgaaatacataagattaaacaaggataaaatgttaattgtcacaggtataggaaaagaagcccttagaaagaaatttataagtgatgaagagagcagcttagctagcgagaggtgatttaacatagtagtttacagtatgagttttagtctcttaaacccctactctaccaccagttaagtgaccttgggcaactgggct

SEQ ID NO: 200337 - DNA, 601 bp, Human
ctcctttcaaaggaccacagtgctttgagatcgacctttcaggcatgaatctggtgtcacttccatgttaaaattcttcaatcatttccaattacctttagataaaatttgcacttcttgtcaaatgaactcacttgcagttcctcaaaggtggaatgttctttcacctctgagcaagtgaacatgctaacccctcaacctgaaatggcttcttttttcctttggtcttgaaaatgtgcattcattcttcaaggctcaaaaactataccctttttgaaggtactgcaaactaccccagacwgactaatgatgctcttgactccatgctctcagtgaaagcagtcaagtgtttttgaataaaaaaggaagactttaactcaaaaagattaataagttataactaagagctgaaatacataagattaaacaaggataaaatgttaattgtcacaggtataggaaaagaagcccttagaaagaaatttataagtgatgaagagagcagcttagctagcgagaggtgatttaacatagtagtttacagtatgagttttagtctcttaaacccctactctaccaccagttaagtgaccttgggcaa

SEQ ID NO: 200338 - DNA, 601 bp, Human
tatattctagactcagatatctaactgcctgaagacatcttccaacttggtatccacgaacaacttcaactcaggagggctcaaactgaactctatcttacctctatagacctgctcttccttctatgtcaccacccactatagtatttctcaatggaacacttctcattagcaccacccccatccccaccaccctgcacccccttcccatggccagtagaaaccttaggtcattacgacaaaaaccccacaggttccccagatgtctcctgaaagtgttgataatccctgagaaaggctscttccttcctcatcatacacaaccaaccaaagtaccttttaaatctatctcttctccatccccactgggaaggcttatgttaggatattcctcatttctaactaaatcactgggatagctccataaccaatctctcttctagttcagctttcactcctttcaaaggaccacagtgctttgagatcgacctttcaggcatgaatctggtgtcacttccatgttaaaattcttcaatcatttccaattacctttagataaaatttgcacttcttgtcaaatgaactcacttgcagttcctca

SEQ ID NO: 200339 - DNA, 601 bp, Human
ggcagcagaatcgcttgaacccaggaggcacaggttgcagtgagctgagactgcgccactgcactccagcctgggtgacagagcaagactccatctcaaaaaaaaaaaaaaaaaaaaaaagtcactgaacttaaggaatttacaaccaagcttatacaaaagactaacagatgaaaaagagatacaaataagtacaaaagtacatcaagaagtaaaaaggttcctaaactgaaaacctaaaacatggataaaaattacttatgcctttctggaagacatgaatgctgagtaggaattgaargaaacagaagaatatggattggtaaatgtatgaaggtatttcatacattcagaagagcattaaaaaaagcttggagctggtcacagtggctcatgcctataatcccaacactttgggatgccaaggcaggaggattgcttgaggccaggagtacaagagagcaagacccctgcttctataaaacattaagaaattagtcaggcattgcagcgcatgcctgtagtcctagctccttgggaggctgaggcaggaggactgctgagcccaggagtttgaagacttgcaataagccatgcttgc

SEQ ID NO: 200340 - DNA, 601 bp, Human
tctgatggaagaaaaaataacaatacttaaggttgaagataccataaaccaaaaatcaatctttatttttttgctgagacctcaaaaaaaagggaacctataaaaatatacttaaaatataacctcattaaatgaattttattggaatagcatcattggaagaattttgaccagtgactatttactcagtatcaaaatgagttatccagacaagtgttaaattaggcttgtgaaatttcattaacaattaaacctggaattaatttcaagattaattccttatagattatctgtagtttgaaaaaaaaaagtacattattgaagtaactttttttttgtttttttgagacggagtctcactctgtcatccaggctggagggaagcggtggaatcttggctcactgcaacctctgcctcccaagcttcagtgattctcctgcctcaccctcccaagtagctaggactgcaggtgtgagccaccatgcctggctaatttttgtatttttagtagcgacagggtttcaccgtattggccaggctggtctcaaactcatgacctcaagtgatctgcctgccttggcctcccaaagtgctgggatt

SEQ ID NO: 200341 - DNA, 601 bp, Human
agttgaccataacccaagtaacatttcttaagaatgttataggaatagatggacttatgaaggaaagtaaaggtttcacaactccaagacttatgacataatctctacactggggcccatcacctgtagaaaaaaaggattaatttactcaataaaacatactgacagtaagcattttcagaaaacacaaagcactgggaatatgctgcttcatgtattttatccagatacactgttcagttttagacaataacaagcaggctcacattcaaggtctctgagccaagagaggcaacataargtgataaggtattcttttgcacattattcccatcttcagcattttgctgctcacttaattaaactgctgcttttaacttctctctcaacaatactcttggtttaacaaactttcatgtgataaaaaagatgtatcaagaaaatatttgttgaatttgtacttatgatcccgtatcagagcatcaaggttatgaactataaattactctatacacttagaaaactatgtcagaagaaaagggtgaaccagtgctagaatagtggttctcaatgtgattattgggctctagctcaggcctcc

SEQ ID NO: 200342 - DNA, 601 bp, Human
tgcccaggctggtctcgaactcctgcactcaagtgatcctcctgcctcagcctcctaaagtgctgggacaataggcataagccaccacacctggcctcttgtaaatctttcaaagcaaaatattgaaattcacaatttaatcaaagaacttggctattaaggagccaaaaccaaaaattacttacacattttttaagatcctaaactatctggggctaaaaacaaacaaaaactctaccacagagatcatgttcatctaatgaattttatatattatgtcactgtttgatacagtaaaatwctaattttaatttgttccatacaaattaaattctggccaaaaggcataggcctttaaattgtaaagaaatgaagcagcttgtccaacactggtcaccatgccaaactgtttttaaagaaccacatgagttcctgattgttgctaaacatttcattcatgtgttttcccttacccattatattcctggtttctctaacacaccaaaggctggtctggcttttacaagcactcagggcagttttccacctcattcatactccctgagttgctttttcctctgccatctgtgttagtaaaaat

SEQ ID NO: 200343 - DNA, 601 bp, Human
caatgtgtggtctttatctggatactgatttggtaaaattgtgaaaaaataatgaagcagtaaataaaatccagatactgactgaatatttaacattaaggttttaaaaagtctactagtggtattgtggttatgttaaaaaaaataggcggccgggcgcggtggctcacgcctgtaatcccagcactttgggaggctgaggcgggtggatcatgaggtcaggagatcgagaccatcctggctaacaaggtgaaaccccgtctctactaaaaaatacaaaaaattagccgggcgcggtggygggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaaaaaaaaaaaaataggcttaaattttagagctgcaagctgtgtaaaatgatatctggaatttgtatcaaaataaatttggaggagtagaggtacagagaaaaaagctacatggggttccattacactattttattttatgaaattatgg

SEQ ID NO: 200344 - DNA, 601 bp, Human
tagtagcctagcttctttaacaaataaattgaaaagaggaaagataaaagaaaggagaagaaagttgcacagtaagaggcttaaaatatatagcaagcagatgcaatgtgtggtctttatctggatactgatttggtaaaattgtgaaaaaataatgaagcagtaaataaaatccagatactgactgaatatttaacattaaggttttaaaaagtctactagtggtattgtggttatgttaaaaaaaataggcggccgggcgcggtggctcacgcctgtaatcccagcactttgggaggcygaggcgggtggatcatgaggtcaggagatcgagaccatcctggctaacaaggtgaaaccccgtctctactaaaaaatacaaaaaattagccgggcgcggtggtgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaaaaaaaaaaaaataggcttaaattttagagctgcaagctgtgtaaa

SEQ ID NO: 200345 - DNA, 601 bp, Human
cggaattagaaagtcaccattttgcaactcctagtaaaacaagggatcctaacaaggatcatcaatggctacctaaaaaccataggtgaaagattaatggataactttataaccatcagctggaataggctgtaacacctcagatcactcaacaatcttaatatcactacatgtaagacagactgtgtctcctcatgtgaatcattaggaaatagagttgtgcatgacatattcttgcctaaaaaactgaactcgatttacaggaaacacagagaaacagatttatcttctctttaattasagatcagtgttcagaaccctcatgctgtgattgtttcttctactttgtggttttttttttttttttttttttttgagacagggtcttgctctgtcactcaggctggaatgcaatggcatgaccatggctcaccacagcctcaacctcccggattcaaatgatcctcccaccgtagcttcccaagtagctagaaccacaggcgcatgctaccacaccaaactaatttcttttttaaaaaaagtttttgtagagatggagtccccctatgttgcccaggctggtcttgaactcctgggctca

SEQ ID NO: 200346 - DNA, 601 bp, Human
tctttccttccactaattgttaagttacttatggcccaagcagcttctttttgagtgccaaaatccccctgtaaaaaggcaaaacaaaggctataaaaattgccacatagagtaaactggaaaaaatgtttgctgtgatgatttttcaactgcttatttcccaaggtctccttttagtctttctgtatatatcattttttcttattaagacaggtctttgaactattcccaatctaccctaaatacatggagacacctttctgtgaaatctcctggaaacaaactgagttgatattattayctaatattatcagattaaatgaagttgatgataaaatgaaataaaaatagtaaagaaaaaatttaaaaatctacaatttcactacaaagtcacgtaaacgaacatattcttttacacacaaagcttttacacacaaaaatgatacccaccattaatgaaactatgataaagatgttatacattgccttttcaaatatgaagcgaagaaatatttaaaagtcattaaaaaattcatatacataaacttcataatctcatttttgagaatttaccaagaaaataacataaagcagagtaata

SEQ ID NO: 200347 - DNA, 601 bp, Human
aaaagccttcataggaggctggttacttctccagctttgtctcttcatagtttctaccccatactgtgtgattcagcaacactgaactacttataatttgctgaatgctatttctgacctcagactttgctcatggtgttatctctgcctggaacacctttcatccctttttaccttattaatccttattcatctctcaaaatccagctcaggtgcacttcctgcttcttccagaatggattaggcatcccattttgttgtacatttctattagggtaattagcacattaaatcagttcayatttatcaagactagactacatgccttgagggcaaggactgtgtcttgtttaccactgtcttcccagtaacttatcacagtgcctgttcaatatatggcagcaattcagttacctaagcatatgcaagaggctgagcaggactgcacatatagaatacaatatttactttattctgttacttgaatatctaagacagaaaaatatagatgtgctatattagtcggcaaataaaggtagttacaaagagaacattaagatgtggaataagagcttataataaacttacctccacattcttc

SEQ ID NO: 200348 - DNA, 601 bp, Human
tcacaatctaagtcaagaacgaaaactacatgttgaggtattagaaattatgaggctattacaattagtcaccaaattgcaaattatgattttcaaaaatccaacttcaagacatacgatcaaagttactcttaaaagaatatgccaggctgggcgtggtggctcatgcctgtaatcccagcactttgggaggccaagatgggagaattgtttgagtccaggagttcaagctcagccagggcaacatagggagaccttgtctctacaaaagacttaaaaagttatccgggcatagtggcawgcacttgtaatcccagctatttgggaggctgaggtgggaggatcacctgagccagggagggggaggttgcagtgagctgtgactgcgccaatgcactccagcctgggccccgtctttaaaaaaagaaagaaagaaaaaaaacttttcttaattttatttctggtttatttaactggcattatattctaaataggactaagcttaaacaactgtaagtaaatagtctataattttcttttctaatattgtccttgtcaagttaatgttcaaactatacatacttaacaaaatgtttaataa

SEQ ID NO: 200349 - DNA, 601 bp, Human
gctacgggttgtcaatggcctcagtgctttcggcctatgctcttatttacactgaccacaaagtggattggagtgctatagggtcacagagaagaccttcaattatcaagtacaggttttaaatttaccctggcttttaaaggaatagggcacactgttttttactatttctttctctttctttctctctttgactctctctctctcctctttgtctctctctctcttctgtctctctcactgtctctctctcctctctgtctctctctctttctcctccatttctctctctctcctctgkctctcttttccctcagccatttacaaacttggggccctggcaagggtggtggggagtgggtcctacataactgcccatgtcaagagctgtatgcctaaattgggagggacaccagggataagactccctgggttatagcctaggtgcctaaggacgcagcgcagagcttccttagatccctttggagatacaacttgctagaggaaatggaagtctgaaccaatagtacctaggaggcagggatcagaggaagtatattcagaggtaaggagaattttggggctacactttgaagaaagt

SEQ ID NO: 200350 - DNA, 601 bp, Human
agtgcagagaacacctgcatatcctttgctgaggcttccctactgttggcattttaccttatttgccttatccctcatcttccatgtgtatgtgcatatctgtgtactcacacacattgcttttttctgaaccatttgagaataagttgtatgcgccatggccgtttatccttgtacatgttaaccattgcagagagtagaggctgctcccacttaaccccaccccatcgttctcactaacacctgctatgtgccaagccctgtgtcacgtgggaaggtctcatgggtgcaggaagccctstagttaaagcccaggttggcccaggtggaggcaagctggcatcactgcatgtcagggttattgttttagttggcggttctgggtttaggaatgaagactgctgttgtggaagatttgtgctgtgttaggctgcgccttcgctgctccacttcccaagctagcttgtgggcactttccccaccccttccttcccacttcccagagtactgagtgattatatcctcttagcagcggtggccggtgatttgtttgtgcaggtgtccttctagcagtgacggcaggtaatcttgttacgcacag

SEQ ID NO: 200351 - DNA, 601 bp, Human
cattttaccttatttgccttatccctcatcttccatgtgtatgtgcatatctgtgtactcacacacattgcttttttctgaaccatttgagaataagttgtatgcgccatggccgtttatccttgtacatgttaaccattgcagagagtagaggctgctcccacttaaccccaccccatcgttctcactaacacctgctatgtgccaagccctgtgtcacgtgggaaggtctcatgggtgcaggaagccctgtagttaaagcccaggttggcccaggtggaggcaagctggcatcactgcmtgtcagggttattgttttagttggcggttctgggtttaggaatgaagactgctgttgtggaagatttgtgctgtgttaggctgcgccttcgctgctccacttcccaagctagcttgtgggcactttccccaccccttccttcccacttcccagagtactgagtgattatatcctcttagcagcggtggccggtgatttgtttgtgcaggtgtccttctagcagtgacggcaggtaatcttgttacgcacagatcctcttagcagtaatgggaggtgagtgatctgtgtgtgtcctcttag

SEQ ID NO: 200352 - DNA, 601 bp, Human
gaataagttgtatgcgccatggccgtttatccttgtacatgttaaccattgcagagagtagaggctgctcccacttaaccccaccccatcgttctcactaacacctgctatgtgccaagccctgtgtcacgtgggaaggtctcatgggtgcaggaagccctgtagttaaagcccaggttggcccaggtggaggcaagctggcatcactgcatgtcagggttattgttttagttggcggttctgggtttaggaatgaagactgctgttgtggaagatttgtgctgtgttaggctgcgccttygctgctccacttcccaagctagcttgtgggcactttccccaccccttccttcccacttcccagagtactgagtgattatatcctcttagcagcggtggccggtgatttgtttgtgcaggtgtccttctagcagtgacggcaggtaatcttgttacgcacagatcctcttagcagtaatgggaggtgagtgatctgtgtgtgtcctcttagcagtaagggcaggtgatctagctgtgcacgtgtcctcttagccatggtgggaggtgatctggttgtgcaggtgtcctcttagcagtgatg

SEQ ID NO: 200353 - DNA, 601 bp, Human
catagttgtggagaggattgtttgtggctggccagggcactggatgaggggcaggagtcacagcagagggacccagaaggtcaacacagggatgatcagcaggagactgaccacaggaccgggccagatgctccattgaaactaggtctgctgatgcagaggtctctccggtgccactggctgcttcttagggcctccaggtagattagtttacctacagaactctgtctatggtcttagaataagaggacctggaagagttagaggcttgttgggggccatggcaggcctttgctgcagytcttggaggtttcttggccactcctgacagtgggagcagctcttcggatttccccatctaccctatttgcgaaggatgcctgctagaccagcatggtaagccatggggcatggagagagcccaagggtgtagaagatcttgtctggacaatctagaaaaaataaagttgatatttcttcacatttgctaacattcatacatagaatattttacataaatggaattatattttttatttaatttttgtatttaacttattttgagatctttgtagatcagtgcatatataacttcattctt

SEQ ID NO: 200354 - DNA, 601 bp, Human
caaatggaatcttgcttttgttgcccaggctggagtgcagtggtgcaatctcagctcactgcaacctccacttcctgggttcaagtgattatgctgcctcaacctcccaagtagctgggatgacaggcgtctgccaccatgcccggctaatttttgtatttttagtagagatgggattttgccatgttggctgggctggtctcaaactcccaacctcaggtgatccgtctgccttggcctcccaaagtgctgagattacaggcatgagccactgtgcctggcctaactcattcttttttaraaatctttttactttggaaatatttcaaacctacataacagtaggttgacttggcaagtggaaaccccttcacctggccttttcaggatgggagcgtgtcgccttctgacatgtttccatcaacttgaaattcctttttaccaggcacatcttgtaccttacctgccccacactggaatggggcattttcccacagagcgctggttccttttggtgggagatggtatttagaaagcaggattttggtggtagatgtgtttattgctagctactagagtatgctgcgactccatcttttca

SEQ ID NO: 200355 - DNA, 601 bp, Human
gcagtggggtgatctcggctcactgcaacctccgcctcccgggttcaagcgattcttctgcctcagcctcccaagtagctggaactacaggcatgcgccaccacacctggctaatttttgtatttttagtaaagatggggtttcaccatgttggccaggatggtctcgatctcttgacctcatgatctgcctacctccacctcccaaagtgctggtattacagccgtgagccactgtgcctggcccatactgtttctttagttctaatccagcgttccaggttcttgcttgctttctctgytgcatgtttgtttctctctttttctacagtgagaaccctggctcccaacagcatcagtaggtttactcatttgcttagtcttacactgcacccagaatagtttcagaagtactgcattcgcaccactagtaacagcagacctattaagtagaatttaatttaatttaattttttttagctctttgtgttttcagattgatggtgtatactcaaggttcttgggttcaaaagctacttggattaattctcttctctcttccatgtgattgttacacagttaggttcaaaactgtgttgagg

SEQ ID NO: 200356 - DNA, 601 bp, Human
gatctcttgacctcatgatctgcctacctccacctcccaaagtgctggtattacagccgtgagccactgtgcctggcccatactgtttctttagttctaatccagcgttccaggttcttgcttgctttctctgttgcatgtttgtttctctctttttctacagtgagaaccctggctcccaacagcatcagtaggtttactcatttgcttagtcttacactgcacccagaatagtttcagaagtactgcattcgcaccactagtaacagcagacctattaagtagaatttaatttaatttwattttttttagctctttgtgttttcagattgatggtgtatactcaaggttcttgggttcaaaagctacttggattaattctcttctctcttccatgtgattgttacacagttaggttcaaaactgtgttgaggcagggccgggtggttcacacctgaaattccagcactttgggaggctgaggtgggtggattgcttgagcccagaagttctaaaccagcctgggcaatatggcatctctgcaaaaactacaaaaattagctgggcatgatggcacacgcctgtagtcccagctacttgg

SEQ ID NO: 200357 - DNA, 601 bp, Human
ccactagtaacagcagacctattaagtagaatttaatttaatttaattttttttagctctttgtgttttcagattgatggtgtatactcaaggttcttgggttcaaaagctacttggattaattctcttctctcttccatgtgattgttacacagttaggttcaaaactgtgttgaggcagggccgggtggttcacacctgaaattccagcactttgggaggctgaggtgggtggattgcttgagcccagaagttctaaaccagcctgggcaatatggcatctctgcaaaaactacaaaawttagctgggcatgatggcacacgcctgtagtcccagctacttggaggggactgaggtgggaggatcgtttgagcccagtgagcagaggttatggtgagctgagatcatgcctctgcactccagcctaggcaacagagcaagacctgcctcaaaaaccaaaaccaaaaaaaaaacctgttttgatttgaaaccatgtttattaaataatattgagagtggtatttactgtaacctcagtatttataacaagcccctctttcattacactaattggtaaggaagcatctcaattttgaacgg

SEQ ID NO: 200358 - DNA, 601 bp, Human
ctgcaccatgattccaaaagctgatgaaagagctgtatggcagagggagctaagtggagcgccaccacctggggcctcctgcctaagaaccgggcaccttttcactgagttgggcatcgctagtgttcacagttctgactgcaccagcatcttgtgtggacactgatgctgtgatgtctctttgggcttgggtgatcaattcaggccagctggtgaccaccctctgtgatctcaccacacagtgattgcaatcaaatctacctgtgtgtttccagaagcttgggaggcttattagagtgtyaccttcttttgtatggacggactttgtgggttttcaaccgtgtggatgtattacttcttaacaaacattcatgaaagtaaaagatgaggaaaaggtattttaaaaggaaaaaaatgtgtataactgaatataaaacatactacttaacagaaaaaatagatctaaaatgcttagaacccacaaaaaagttaaatgaaattttagcttaatgctgttgcatatttctgctttataattgcagcatgagatgtgatgtctttttataggaagtaggtttactcatattaacctcattttaca

SEQ ID NO: 200359 - DNA, 601 bp, Human
ttttactttaagttccaggatgcatgtgcagaacatgcaggtttgttacataggcatacatgtgccatggtggtttgctgcacctaacaacctgtcatctaggttttaagccccgcatgcattaggtatttgtcctaatgctctcctcccgccttttcaatgtgaaccttcccacccaccctgcttttcttgtcttcttcccatagcttcagcaggctccaggtgccgcagccctgactcctcagggcccacccctgctgtgtccacacaaatgcccccaggaagctgacacttccccgcwgcctgttcctgcagtccctgccttggttcttagctgatgctgtcttatcactgccaccccatccccatttctgagcatcaggcaccctcatcagcacttggcatgtaatagctccattaaccttaactgtaaccccgttttttggatagagtttttcgtgtgttaaatcttgtgttcaacttaggttttgaaataagagcaggaaatgaagctttcagactgcaaatgtttcctttgaatgttctttaaagaccccatatgataggacatgtgctttttgtgagtgtaactccctgtggt

SEQ ID NO: 200360 - DNA, 601 bp, Human
accctcaccgagtagctgggaccacaggtgttcaccatcatatgtggctaatatttttattttaatttttgtagagactggatccctgtgttgcccaagctggtctccaactcctgggctcaagtgatcctcctgtctcagctttccaaagtgttgggattacaagtgagagctactgtgctcagtgtggtctgtgtatctttactaagcttttgatcaaagacttttttaattttaaagaagtctgatttatcattttttcttgttatggtcatgctttctgtttttgtctaataaatcyttgcctaccccaaggttacgaagttcttctccttccctagtaaaatctgagcttcgtgggggcagacaccttatggttctcctcctgctcttctcacttgtgtcctgtacaacacctggcccctaggaggtacacggcggtgttcatggaaggagcaaatgagttgtcttaaggattcataataatgtattctaagcacttgatatactgcctggcacatgcaaaatgagcattcaggaatctgatttgactacagctgttctttctcttagagaaattggctgcgctatcctgtggcta

SEQ ID NO: 200361 - DNA, 601 bp, Human
caggtgttcaccatcatatgtggctaatatttttattttaatttttgtagagactggatccctgtgttgcccaagctggtctccaactcctgggctcaagtgatcctcctgtctcagctttccaaagtgttgggattacaagtgagagctactgtgctcagtgtggtctgtgtatctttactaagcttttgatcaaagacttttttaattttaaagaagtctgatttatcattttttcttgttatggtcatgctttctgtttttgtctaataaatccttgcctaccccaaggttacgaagwtcttctccttccctagtaaaatctgagcttcgtgggggcagacaccttatggttctcctcctgctcttctcacttgtgtcctgtacaacacctggcccctaggaggtacacggcggtgttcatggaaggagcaaatgagttgtcttaaggattcataataatgtattctaagcacttgatatactgcctggcacatgcaaaatgagcattcaggaatctgatttgactacagctgttctttctcttagagaaattggctgcgctatcctgtggctatgatcgaaatgtggtgcgagtgtt

SEQ ID NO: 200362 - DNA, 601 bp, Human
tttgagacagagtcttgttctgttgtacaggctggagtgcagtagcgtgatcttggctcactgcaacctcgcctccccggttcaagcgattcttgtgtctcagccttccgagtagctgggattacaggtgtgtgccaccacgtccagctaatgtttgtattttagtagggacagggtttcgccttgtccaggctggtctcaaactcctagcctcaagtgatcctcctaccttggcctcccaaagtgctgggattataggcatgagccaccatactgggtcaagggtgacttttttttttttaaagacagaatcttgctctgtcgtccaggctggagtgcagtggtacaatctcggctcactgcaacctctgcctcctgggtttaagaaattctctgcctcagcctccagagtagctgggattacagacatgtgccaccatgcccagctaatttttttgtatttttagtagagtcaaggtttcaccatcttggccaggctggtcttgaactcctgaccttgtgatccacgtgccttggcctcccaaagtgctgggattacaggcgtgagccaccacgcctggccaagggtgactgtttttaa

SEQ ID NO: 200363 - DNA, 601 bp, Human
taggcatttagtgcatgcctccatgtgtggggtgttggtgacatggagtatggggcagcaataaagatgtgtccctcagccagacacagtggctcatgcctgtaatcccaaaactttgagagcataaggtgagaagattgcttgagctcaggagttcgagaccagcctgggcaacatagcaagaccttgtctttactaaaaataaaaaataaaaaattagctgagtatggtggtatgtgcctgtagtcccagctacttgggagtctggggcaagaggatcactggagcccagggtgtctaygctgcagtaatctgtggtcatgccgctgcattccagcctgggtgacagagcgagaccctgtctcaaaaaacaaaacatttacatgtatgtaaaatgtccctatatgtatactcgagaacagggtttggcaaactatacctgcaactggccactgtttttttttgtttttcgctaaagctttattggacatgcctatgcccacgcattcccatattatctgcagctgctttagctccacggcagcagggttgagcagctgtggcagagagagggtggcctgtgaagctggccacctggaaa

SEQ ID NO: 200364 - DNA, 601 bp, Human
ttaaagaaactgtcaaattgttttccaaagaagttgtaccatttacattttcactgggagagttccagttgcttcacacacttgccaccacttggtatggtcattctttttcattttagccattctagtaagtggtttctcttcatggttttttgtttttgtttttgtttgttgagacggagtctcattctgtcgcccagactggagtgcagtggtgcaatcttggctcactgcaacctctgtctcctgggttcaagcaattctgcctcagcctcctgaatagctgggattacaggcgccygccaccgcacccatctaatttttgcgtttttggtagagatggggtttcatcatgttggccaggctggtctcaaactcttaacctcaggtgatccacccacctcagcctcccaaagtgttgggatcacaggcatgggccgccgtgccccaccttttcatgctttaatttgcatttccttaatgactagacgttgagcatcttttcatgtgcttgctagccatctgtatatatcttccttggttaagtgaccattaagatcttttgcctattttatttattatttttttttagagttgggga

SEQ ID NO: 200365 - DNA, 601 bp, Human
tcttattgaaatttgagcatgctttatatattctggttacaagcaagccctttatcagatacatgatttgcaaatgttttctctctgtgtgtggtttgtctatgcattatcttaacatgtcttttgaaaaacaaaagttctcaattttgatgaagtccaatttatcaattttttttatagattgtgtttttggtagatatattaaaggtatttgcttaaaccaagggtgcgaagattttcttcttgtgttttcttctcttgagttttatagttttaggcttcacctgtaggcctatgatckattttgatttttttttttttttttcgaggtggagtttcactcttgttgcccaggctggagtgcaatggcactatctcggctcaccacaacctccgcctcccagattcaagcgattctcctgcctcagcctcccgagtagctgggattacaggcatgcaccaccatgcctggctaattttgtatttttagtagagacagggtttcaccttgttggtcaggctggttcggagctcccgacctcaggtgatctacccgcctcaggctccgaaagtgctgggattacaggcatgagccactggg

SEQ ID NO: 200366 - DNA, 601 bp, Human
ggtgcgaagattttcttcttgtgttttcttctcttgagttttatagttttaggcttcacctgtaggcctatgatcgattttgatttttttttttttttttcgaggtggagtttcactcttgttgcccaggctggagtgcaatggcactatctcggctcaccacaacctccgcctcccagattcaagcgattctcctgcctcagcctcccgagtagctgggattacaggcatgcaccaccatgcctggctaattttgtatttttagtagagacagggtttcaccttgttggtcaggctggtycggagctcccgacctcaggtgatctacccgcctcaggctccgaaagtgctgggattacaggcatgagccactgggcctggctattctgaattttttatgcggttcaaggaatggatcaaagtagttgttctttgttcctctttcttcctcctcctcctccttcttctcttctttcttcctcctcttcctcctcctttttttaacttcattttgtagatgaactccttccttccttcttcctttctttcctcctcctcctcctcttcatttttctttcttccgtgtttcgcagtaccattc

SEQ ID NO: 200367 - DNA, 601 bp, Human
actgtctagaggtttattaatattactgatctcaaaaaaacaacttttgtttttcttattttctctatttttctgttttcaatttcagtaatgtccactctcatctttattatttcttactgctgggtttcatttgctcttcttttgtaatttccttttttttcaggttcaagcgattctcctgcctcagcctcccacgttgctgggattacaggcgtgcatcaccacacccaactaatttttgtattttagtattcaccatgttggccaggctggtctcgaactcctgtccattcaccaygttggccaggctggtctcgaactcctgacctcaagtgatctgcctgcctcagcctcccagaatgctgggattacaggcatgagccaccacgcccagcccttgctggttttctatctgcttgttctatcaagagggttattaaaagctctgactttaattgtggattcgtctattagcagttacagtagtttctgtttcatgaattttgaagtttcttttgtaaattttaatagatacataaacatttaggattatgtcctcttgaatcaatccctttatcattattaaatgaccttcttt

SEQ ID NO: 200368 - DNA, 601 bp, Human
gcctcagcctcccacgttgctgggattacaggcgtgcatcaccacacccaactaatttttgtattttagtattcaccatgttggccaggctggtctcgaactcctgtccattcaccatgttggccaggctggtctcgaactcctgacctcaagtgatctgcctgcctcagcctcccagaatgctgggattacaggcatgagccaccacgcccagcccttgctggttttctatctgcttgttctatcaagagggttattaaaagctctgactttaattgtggattcgtctattagcagttayagtagtttctgtttcatgaattttgaagtttcttttgtaaattttaatagatacataaacatttaggattatgtcctcttgaatcaatccctttatcattattaaatgaccttctttattcctggtaatatttgcactgaagtctactttgtgtgatattaatacactccagctagcctttttttgagacagagtctcactcctgttgcccaggctgtagtgcagtagcacgattatagctcactgcagccttaactttccaggctcaggtgatcctcccacctcagcctctcgagtagc

SEQ ID NO: 200369 - DNA, 601 bp, Human
cagcctcccaaaatgctgggattatggagatgacaggaatgagccatgtacctgcccttccagctatcctttgattagtgttaacatggtatatctttttttattcttttattttctcttatttatgcctatataaagtgagtttgttttaggtaatatgtagttgtatcttgattttttccctacatgacaaattctgcctttcagttggagtgtttagatcgttctgcgtatttattgattaggcaagtttaattaaaatctaccatattaccctttgttttcatttgtaccatctgtytgtcttttttttttccttcttttggattattttttattctcttctatgttggcttacttgccacaactcttgtgttattttagtcgggttcatcattaacttatcatagactaccttcaagtgatggaccactttacctgtagtttgagagccttaaaacagtgtgcttctgtttctctcttcccacctttggtgctactattgtcaaaattttacttctgtgtatgttataaactgcacaatacagtatctgtgtgtttgctttaaataattgtaggtcaacagctttttctttcagaa

SEQ ID NO: 200370 - DNA, 601 bp, Human
taccttcaagtgatggaccactttacctgtagtttgagagccttaaaacagtgtgcttctgtttctctcttcccacctttggtgctactattgtcaaaattttacttctgtgtatgttataaactgcacaatacagtatctgtgtgtttgctttaaataattgtaggtcaacagctttttctttcagaactttaacatgtcacatcactgtcttctaggctgtatcgtttctaatgagaaatctgctgtcatctagatctttgtttttctgtgcatgtcttctttttctgcctgcttttargattttatcgctgattttaagcaattcaattccaatgtgacttggaattgtattgtttgtatttctggtgcttgtggttcattgagctacctggatttgtgggtttatagttttcatcaaattgggaaattttccccattgtttcttcagatgttgtgtctgttcccccatgtattagggtgtgtgaggttgttccacagcttactgatgatttgcacattttttcctggtattttttcattctgtgttttagttcagagtgtttctattattatatcttcaagtcactaatcttttcta

SEQ ID NO: 200371 - DNA, 601 bp, Human
caatgtgacttggaattgtattgtttgtatttctggtgcttgtggttcattgagctacctggatttgtgggtttatagttttcatcaaattgggaaattttccccattgtttcttcagatgttgtgtctgttcccccatgtattagggtgtgtgaggttgttccacagcttactgatgatttgcacattttttcctggtattttttcattctgtgttttagttcagagtgtttctattattatatcttcaagtcactaatcttttctactacaaaatctaacctgttaatgttctgcagcrtacttttcatcttaagtgttacagtttttatctctaggtaataggttcgtaaagggccaggcattaaatgttttcagctttgcaggccatatagtcttttctgcagctactcagctcggctgctgtagcttgaaagcagccatagacaatacatatttgtggctgtgttctgataaaacctgattttaaaaacagatgggggccaggcacagtggtacatgcctgtaatcctggcacttcgggaggccgaggcaggcagatcacttgaggccaggagttcaagaccagcctggccaacat

SEQ ID NO: 200372 - DNA, 601 bp, Human
ggccgaggcaggcagatcacttgaggccaggagttcaagaccagcctggccaacatggcaaaaccccgtctctactaaaaatataaaaattagctaggcatgatgacacatgcttgtaattccagctactcaggaggctgagggacaagaattgcttgaacacggaaggtgaaggttgcagtgagctgagactgcaccactggcactccagcctgggtgacagaatgagactctgtctcaaaaacaaacaaacaaacaaatgggaagagattgatccagcccatgggctatggtttgctgrcctactgccacttcctcaatggcctctcaccctttggtcccacagagctgcggtgcaaccctgggcagtttgcgtgtcgcagcggcaccatccagtgcatccccctcccctggcagtgtgacggctgggcgacttgcgaggatgagagcgacgaagccaactgtccaggtgagtgtgttgagtaggcggggtacacaccaccttgtctctttgttgtagctgggtgactgtgcctcttgtgaggggtggaggtgtgtgctgtcttaacacattggaaagttagtttgagccgaccccttc

SEQ ID NO: 200373 - DNA, 601 bp, Human
acatgaaaggtgtgctgtaattcctataggcttagtactgaaggaaaaccaattcattccaaccagggtattaggtaggggattaggtgacatttgaacttgtggtagttctttgagggggggttccaaaataagaagcagagatggtctggtcagattgtatttgcctgtaaagaatgctgtttaggcagggtgcgaaggctcacacctgtaacccaacactttgggaggctgaggtgggtggatcgctttaggccaggagtttgagatcagcttggccaacatagtgaaaccccgtttytaataaaaatacaaaaattggccaggtgtggtgctgcacacctataatcccagctactcaggaggctgaggcacaagaattgcttgaacctgggaggaggagattgcagtgagtcaagattgtgccactgcactttatcctgggctgcagaacaagactctgtctcaaaggcaaaaaaaaaaaaaaaaaagccaggtgcagtggctcatgccttataatcccaacacttttggaggccgaggcaggcaggatcacttaaggtcaggagtttcagaccagtctggctgacatcgtgaaatc

SEQ ID NO: 200374 - DNA, 601 bp, Human
gaaggctcacacctgtaacccaacactttgggaggctgaggtgggtggatcgctttaggccaggagtttgagatcagcttggccaacatagtgaaaccccgtttctaataaaaatacaaaaattggccaggtgtggtgctgcacacctataatcccagctactcaggaggctgaggcacaagaattgcttgaacctgggaggaggagattgcagtgagtcaagattgtgccactgcactttatcctgggctgcagaacaagactctgtctcaaaggcaaaaaaaaaaaaaaaaaagccaggtgcagtggctcatgccttataatcccaacacttttggaggccgaggcaggcaggatcacttaaggtcaggagtttcagaccagtctggctgacatcgtgaaatctcatctctactaaaaatacaaaaattagctgggcgtggtggcgagcacctgtaatcccagctgaggcaggagaatcacttgaatccaggaggtagaggttgcagtgagctgagatcatgccagtgcgctccagcctgggcgacagagtgagattctgtttcaaaaaaaaagaaaagaatgctgtttagagggggcc

SEQ ID NO: 200375 - DNA, 601 bp, Human
acgagtggtggcctgcaccagggctgagcagtgaaggcatgacaatgaggacccgtgtgtgcaagccccctgaggcttggtagggcctaggagtgttctgggtgggctgaggaggccactgccctgacaaggctcaccctgcttctccttgactcacggtcctatgattgtccttgtatagtgctgtgtcacagtctggagggtgagcagattgatttcttttttttttatttgagatggagtctcgctttgttgcccaggctggagtgcagtggcgccatctgggctcactgcaagctcygcctcccgggttcatgccattctcctgcctcagcctcctgagtagctgggattacaggcgcctgctaccacacccggctaattttttttgtatttttagtagagacagggtttcaccgtgctagtcaggatcgtctcgatctcctgaccttgtgatccgctctcctcggcctcccaaagtgctgggattacaggcgtgagtcactgtgcccggccaagcaggttgatttctaattgttcttaaagttgagattctgagcaaattaagtcataaaaatgtacaaagaatgtgtaatacgta

SEQ ID NO: 200376 - DNA, 601 bp, Human
ctatgattgtccttgtatagtgctgtgtcacagtctggagggtgagcagattgatttcttttttttttatttgagatggagtctcgctttgttgcccaggctggagtgcagtggcgccatctgggctcactgcaagctctgcctcccgggttcatgccattctcctgcctcagcctcctgagtagctgggattacaggcgcctgctaccacacccggctaattttttttgtatttttagtagagacagggtttcaccgtgctagtcaggatcgtctcgatctcctgaccttgtgatccgcyctcctcggcctcccaaagtgctgggattacaggcgtgagtcactgtgcccggccaagcaggttgatttctaattgttcttaaagttgagattctgagcaaattaagtcataaaaatgtacaaagaatgtgtaatacgtattttcttacttccttgaattaatgactgctaaatcttgtgattttttttctagtttattttaaaagaaatttttaaaaaatcatagatatagagtcaagtcctcattgacactctcccttcccccaacctcctcccctctcaaaaaaggaaactctttgtg

SEQ ID NO: 200377 - DNA, 601 bp, Human
tcatgccattctcctgcctcagcctcctgagtagctgggattacaggcgcctgctaccacacccggctaattttttttgtatttttagtagagacagggtttcaccgtgctagtcaggatcgtctcgatctcctgaccttgtgatccgctctcctcggcctcccaaagtgctgggattacaggcgtgagtcactgtgcccggccaagcaggttgatttctaattgttcttaaagttgagattctgagcaaattaagtcataaaaatgtacaaagaatgtgtaatacgtattttcttacttycttgaattaatgactgctaaatcttgtgattttttttctagtttattttaaaagaaatttttaaaaaatcatagatatagagtcaagtcctcattgacactctcccttcccccaacctcctcccctctcaaaaaaggaaactctttgtgtttgtgggggaagtagagagttagctaataaccacccttgctcaaaagctgtgaccttcctttgtatgaggagagtttcagtaacccctagggaagccctgggccattctcagtcaagttgcttttgaactagacttcaggacttctggag

SEQ ID NO: 200378 - DNA, 601 bp, Human
gagtttcgctctgtcacccaggctggaggctggagtgcagtggtgcgatctcagctcactgcaacctccacctcctgggttcaagtgattctcctgcctcagcctcccgagtagctgggattacaggcatctgccaccacgctcgtctaatttttgtatttttagtagagacggggttttgccatgttggccgggctgggctcgaacccctgatctcaggcgatctgcctgcctcggcttcccaaagtgctgggattacaggtgcatgagccaccatacctagcctctggccacctttttyttaatcacataaaatattcactctaaaataaaaatgactgaatttgctagattaaaattaagatctctcgtttattgaaagacaccaataggccaggtgcttatgccaggaatcccagcactttgggagaccaaggtgggcagattgccagagcccaagagttccagaccagccagggcaacgtggtgaaatcctgtctctatgaaaaaaaaaaaaaaaaaaaaaaagaaataattagccagatgtggtggtacacacttgtagtcccagcttctcagtaggctaaggtgggaagaatca

SEQ ID NO: 200379 - DNA, 601 bp, Human
agacactgggtgtggtagctcacacctgtaatcccagcattttgggaggccaaggcgggtggatcacttgaggtcaggagttcaggaccagcctggccaacatggcaaaaccttgtcttggtgaaaaatacaaaacttagctgggtgtggtgaggtgcacctgtagtcccagctactcaggaggctgaggcaggagaattgcttgaacccagaacgtgaagattgcagtaagctgagatcgcaccactgcactccagcctgggtgacagagtgagacactgtctcaaaaaaaaaaaaaagmcaaaaataaattgagagatgttccatgctcatggactgtaaaacgtaagatgtgactattacctaaagcaatctacagattcaatccctattaaaatgccaacaagttttttttgctgaagtagaaaaatttatcctaatgttcatagaatctcagcagactccaaagagccagaacagtcttgaaaaagaagaagaaatatgaaatcctcataattcctgactttaaaccttattacaaagctgcagtaatccaaacattgtagtattggtataaagacagacatatagaccaatggaa

SEQ ID NO: 200380 - DNA, 601 bp, Human
gtaaaacgtaagatgtgactattacctaaagcaatctacagattcaatccctattaaaatgccaacaagttttttttgctgaagtagaaaaatttatcctaatgttcatagaatctcagcagactccaaagagccagaacagtcttgaaaaagaagaagaaatatgaaatcctcataattcctgactttaaaccttattacaaagctgcagtaatccaaacattgtagtattggtataaagacagacatatagaccaatggaatagaatacagagccttagcaataagtccttgcatacartggtcaaattattttccacaaggatgccattaccattcagtgagggaaaaagtgtcttttcagaatgaatggtgctaggaaaactggacatacaaatcaaaagaataaagttagacccttagctaatgatatacaaaacttaacccaaaatggatcaggcttaaatttaagaccttaaactataaaattcttagaaaaacataataaagtcttcgtgacactggatttggcaatgatttcttacataagacacttaaatcacaggcaacaaaagaaacaatagataaattaagctacgtc

SEQ ID NO: 200381 - DNA, 601 bp, Human
aaatcctcataattcctgactttaaaccttattacaaagctgcagtaatccaaacattgtagtattggtataaagacagacatatagaccaatggaatagaatacagagccttagcaataagtccttgcatacagtggtcaaattattttccacaaggatgccattaccattcagtgagggaaaaagtgtcttttcagaatgaatggtgctaggaaaactggacatacaaatcaaaagaataaagttagacccttagctaatgatatacaaaacttaacccaaaatggatcaggcttaaayttaagaccttaaactataaaattcttagaaaaacataataaagtcttcgtgacactggatttggcaatgatttcttacataagacacttaaatcacaggcaacaaaagaaacaatagataaattaagctacgtcaaaatttaaaacttctattaattaaaagaagcactcaacagagtgaaaaggcagcctacagaatggaaaacatttgaaactcatatctggtaagggttaatatttaaaatataaaaagaattcccacagctcaataataataaatatcctggttaaaaaatgtgca

SEQ ID NO: 200382 - DNA, 601 bp, Human
gccacccaaattaaaagtagaattacctgccgggcgcggtggctcacgcctgtaatcccagcactttgggaggccgaggcgggcggatcacttgaggtcaggagttctagagcagcctggccaacatggtgaaaccccgtctctaccaaaaatataaaaaaaaattagccgagtatggtgatgcatgcctgtaatcccagctacttgggaggctgaggcaggagaatcacttgaacccaggaggcgaaagttgcagtgagctgagatcatgccactgcactccagtctgggtgacaggacragactccttcccccccaaaaaataaagtgaactttaaaaaataaataaaataaaaatacaaaaattagctgggcgtcatggcgcacgcctgttaatttcagctactggggagactgaggcaggagagttgcttgagcctgggagacggaggttgcagtgagctgagatcatgccactgcactccagcttgggcgacagagcaagactctgtctcaaaaaataaaagtagaattatcatacaacttagcagttcgactccaaagaattggaagcagagacttgaagagagatttgtacacc

SEQ ID NO: 200383 - DNA, 601 bp, Human
gtagaattacctgccgggcgcggtggctcacgcctgtaatcccagcactttgggaggccgaggcgggcggatcacttgaggtcaggagttctagagcagcctggccaacatggtgaaaccccgtctctaccaaaaatataaaaaaaaattagccgagtatggtgatgcatgcctgtaatcccagctacttgggaggctgaggcaggagaatcacttgaacccaggaggcgaaagttgcagtgagctgagatcatgccactgcactccagtctgggtgacaggacaagactccttccccccmaaaaaataaagtgaactttaaaaaataaataaaataaaaatacaaaaattagctgggcgtcatggcgcacgcctgttaatttcagctactggggagactgaggcaggagagttgcttgagcctgggagacggaggttgcagtgagctgagatcatgccactgcactccagcttgggcgacagagcaagactctgtctcaaaaaataaaagtagaattatcatacaacttagcagttcgactccaaagaattggaagcagagacttgaagagagatttgtacacccaagttcatagcagca

SEQ ID NO: 200384 - DNA, 601 bp, Human
cgcctgtaatcccagcactttgggaggccgaggcgggcggatcacttgaggtcaggagttctagagcagcctggccaacatggtgaaaccccgtctctaccaaaaatataaaaaaaaattagccgagtatggtgatgcatgcctgtaatcccagctacttgggaggctgaggcaggagaatcacttgaacccaggaggcgaaagttgcagtgagctgagatcatgccactgcactccagtctgggtgacaggacaagactccttcccccccaaaaaataaagtgaactttaaaaaataaataaaataaaaatacaaaaattagctgggcgtcatggcgcacgcctgttaatttcagctactggggagactgaggcaggagagttgcttgagcctgggagacggaggttgcagtgagctgagatcatgccactgcactccagcttgggcgacagagcaagactctgtctcaaaaaataaaagtagaattatcatacaacttagcagttcgactccaaagaattggaagcagagacttgaagagagatttgtacacccaagttcatagcagcattactcatagtagccaaaaggtggaagcaa

SEQ ID NO: 200385 - DNA, 601 bp, Human
aggccgaggcgggcggatcacttgaggtcaggagttctagagcagcctggccaacatggtgaaaccccgtctctaccaaaaatataaaaaaaaattagccgagtatggtgatgcatgcctgtaatcccagctacttgggaggctgaggcaggagaatcacttgaacccaggaggcgaaagttgcagtgagctgagatcatgccactgcactccagtctgggtgacaggacaagactccttcccccccaaaaaataaagtgaactttaaaaaataaataaaataaaaatacaaaaattagcygggcgtcatggcgcacgcctgttaatttcagctactggggagactgaggcaggagagttgcttgagcctgggagacggaggttgcagtgagctgagatcatgccactgcactccagcttgggcgacagagcaagactctgtctcaaaaaataaaagtagaattatcatacaacttagcagttcgactccaaagaattggaagcagagacttgaagagagatttgtacacccaagttcatagcagcattactcatagtagccaaaaggtggaagcaacccaagtgtccatcacagatgaat

SEQ ID NO: 200386 - DNA, 601 bp, Human
aactttaaaaaataaataaaataaaaatacaaaaattagctgggcgtcatggcgcacgcctgttaatttcagctactggggagactgaggcaggagagttgcttgagcctgggagacggaggttgcagtgagctgagatcatgccactgcactccagcttgggcgacagagcaagactctgtctcaaaaaataaaagtagaattatcatacaacttagcagttcgactccaaagaattggaagcagagacttgaagagagatttgtacacccaagttcatagcagcattactcatagtagycaaaaggtggaagcaacccaagtgtccatcacagatgaatggatcaacaacaaggtagtctatccatccagtggaatatggtttaccttaaaaaggaaggaattctgacacatgctacagcatggatggactttgaggatatgctcagtgaaataagcctgtcacaaaataacaaatactgtatgtttccatttagatgtgctatcaagatactcaaatgcatagatacaggaagtagaattgtggttgccaggggctgggaggagagaaaaattgggaggtaatgtttaatggatacgg

SEQ ID NO: 200387 - DNA, 601 bp, Human
agctactggggagactgaggcaggagagttgcttgagcctgggagacggaggttgcagtgagctgagatcatgccactgcactccagcttgggcgacagagcaagactctgtctcaaaaaataaaagtagaattatcatacaacttagcagttcgactccaaagaattggaagcagagacttgaagagagatttgtacacccaagttcatagcagcattactcatagtagccaaaaggtggaagcaacccaagtgtccatcacagatgaatggatcaacaacaaggtagtctatccatccrgtggaatatggtttaccttaaaaaggaaggaattctgacacatgctacagcatggatggactttgaggatatgctcagtgaaataagcctgtcacaaaataacaaatactgtatgtttccatttagatgtgctatcaagatactcaaatgcatagatacaggaagtagaattgtggttgccaggggctgggaggagagaaaaattgggaggtaatgtttaatggatacggagtttgtttggtaagatgaaaagttctggagatggatggtggtgatggttgttatggaactaatgtgaag

SEQ ID NO: 200388 - DNA, 601 bp, Human
aaagaattggaagcagagacttgaagagagatttgtacacccaagttcatagcagcattactcatagtagccaaaaggtggaagcaacccaagtgtccatcacagatgaatggatcaacaacaaggtagtctatccatccagtggaatatggtttaccttaaaaaggaaggaattctgacacatgctacagcatggatggactttgaggatatgctcagtgaaataagcctgtcacaaaataacaaatactgtatgtttccatttagatgtgctatcaagatactcaaatgcatagatacrggaagtagaattgtggttgccaggggctgggaggagagaaaaattgggaggtaatgtttaatggatacggagtttgtttggtaagatgaaaagttctggagatggatggtggtgatggttgttatggaactaatgtgaaggtacttaataatgccacttaactgtacactctttttttttttttgagacagagtcttgctctgtggcccaggctggagtgcagtggcacgatctcggctcactgcaagctctgcctcccgggttcacgccattgtcctgcctcagcctcccaagtagctg

SEQ ID NO: 200389 - DNA, 601 bp, Human
agccaaaaggtggaagcaacccaagtgtccatcacagatgaatggatcaacaacaaggtagtctatccatccagtggaatatggtttaccttaaaaaggaaggaattctgacacatgctacagcatggatggactttgaggatatgctcagtgaaataagcctgtcacaaaataacaaatactgtatgtttccatttagatgtgctatcaagatactcaaatgcatagatacaggaagtagaattgtggttgccaggggctgggaggagagaaaaattgggaggtaatgtttaatggatayggagtttgtttggtaagatgaaaagttctggagatggatggtggtgatggttgttatggaactaatgtgaaggtacttaataatgccacttaactgtacactctttttttttttttgagacagagtcttgctctgtggcccaggctggagtgcagtggcacgatctcggctcactgcaagctctgcctcccgggttcacgccattgtcctgcctcagcctcccaagtagctgggactacaggcgtccaccaccacgcccggctaattttcaccatgcccgactaattttttgtattttta

SEQ ID NO: 200390 - DNA, 601 bp, Human
actatgatcaaaaaataagaacaatcctctacagaagccttttcacatgcaagaaatttactgtagtactattctgtgtaatccatattcagattcttttcattatccccagaacatcctttacaggtttctttccccttttaattcaagatttattcaaggattaatgtaagtatgttattgccgtattgctttgttctttaatctagaagtattcccagccctcttttgcagggggctttgggcgtctttcatgacattgccatatttgaagagtccaggtcagttctgtagaatggcrttcaatttggacttgtctctttcttcaggattagcttcaggtgagactttttttttttaggtagcaatactatgtaagtcataaattatcaaatcacgaggcccaaggtcattttgtctcattattggtgatgttaagtttgatcactattgtgaatatttctttccctttttgtgacgaaaagtaatttgtgaataaatagtctgtggagtggtattctaggtattctccctgattctgtttccttgttgaacttgctctccagtgtgttcctgtgctggggaagcagcagcgtggcac

SEQ ID NO: 200391 - DNA, 601 bp, Human
tgtctttctgtgagcaattttaccaggtactgtgcttggcttggggaagaggccaggatacaaagtggagccacaggtcttgcccatttgagcagagggagatgttgaatttaagttcagtgacattctccagccacactcaggcctggcctcaggtttatcccggatatgtctgcctttgccctttgccaaagctgctccatctgccagaaagcccctctgttctttctcagcttccagtctcaggcccagaagctcaggtggctcttcccttctccaccaagtgctgatgccccatccyagtggctgcatccctgcatcagagctaccagcgagtctgtgggtcgagtctcctacccagagtgtcgggtgctgcaggtagcatggcttaggacatgggaccagtcctaaagagctgatggtccccaagtactgcgtgtttacagcatcaggcctgtcgtggtgccagttactgtcccacactgaggtccttaggttgtattttggggtggtaaagtaccccaaagacacctctaccaaaaaacacaagccttgaagatgcttctccctttgaggtcttcactttctgttgaaagtgtct

SEQ ID NO: 200392 - DNA, 601 bp, Human
gcacaccagggcctgtgccaagcaccaaagagccagacaggaacatactgaggtcctggcctggaggccttcacagccatgggggaccagcaggcagggggacagataggcagctcaggccccaggacaagggctgcagaggaaggttgcacacgtgggtctccttcatactgggagagaaggccctcaaggaaggggtaggggcagcctgggctctggagagaactctttcatgggccatccccatggggctggaactgctgagggattttaatttatgcaggaccctttgctgtgctakcaatgacctgttagaaaatgcaatgaagagggcctccatttcacaatagtaacttaaaaaacaaaaactgccacggcataattttaataagaagcacacgggacccatttgatgcgagcggcagtgtttcatagggctctaaagaaagcctgcattgccggactctgtgctacaggccccccctccggccttgcagccctgagtggtctgaaccatgctggccagggagactgcgactgcacaggcaggactcacagcacacatctccttttgctttcagaagtgaccggggaggtgcgt

SEQ ID NO: 200393 - DNA, 601 bp, Human
tcctgagctcaagcaatctgcccacctcggcctcccaaagtgctggaattacaggcgtgagccactgttgccagccctctgattccttgtctgcacctaaagagcttccttgcacactcaggtgtacccttcacggtgagcagatggtgctgtccagctgtggccatgcttaggggctaggggtgcccctctttttctgtaatctatgtgcctttatgaagaagtcacacacacacatgcttacataataaatacatggggatacgtgtctagaagttttactagtgccacaagacatagmtgcactttaaaaatggcatttttaattttacaactggctttgctaaaaattgtcactcttctccagtgtactaatatgaggtacccaacatttgaaggttaaagattctataaaagaggtcactggtgttacctaaggtgagctgtaaattaccaggcattcccgtgtgtgggtgtaggagtcggaagtgatgggtggaggaagtgagaggacgctggccagactcattgatactcaagtgctggctggctccttagctttgccacctgtggcatcgcccacaccttatttttttcggct

SEQ ID NO: 200394 - DNA, 601 bp, Human
ctcaggtgtacccttcacggtgagcagatggtgctgtccagctgtggccatgcttaggggctaggggtgcccctctttttctgtaatctatgtgcctttatgaagaagtcacacacacacatgcttacataataaatacatggggatacgtgtctagaagttttactagtgccacaagacatagctgcactttaaaaatggcatttttaattttacaactggctttgctaaaaattgtcactcttctccagtgtactaatatgaggtacccaacatttgaaggttaaagattctataaaasaggtcactggtgttacctaaggtgagctgtaaattaccaggcattcccgtgtgtgggtgtaggagtcggaagtgatgggtggaggaagtgagaggacgctggccagactcattgatactcaagtgctggctggctccttagctttgccacctgtggcatcgcccacaccttatttttttcggctgtgggaggcaggggcgggtcacacagtgtcatggctctcccagctgttatcctttgagctgctgttttagtggagggttggccagcccctactgcaaatgctcatgtaagtagaaa

SEQ ID NO: 200395 - DNA, 601 bp, Human
tgccgcgcagacctgccagcgcctgaatggctctctcgccaccttctccactgaccaggagctgcgctttgtcctggcccaggaatgggaccagcccgagcggagctttggttggaaggaccagcgcaagtgagtcctggattggggacctgaggggctggagtcagagtctgatgactactgagcacatggcctctgaccactcagtaaactcctggagcacagctggcagacagcaggttgggaagaccagcctcgcccactggaagcccaggagatccatgggtaggagtgtgcatcragataggtggagggtcctgggagcaggggcaggctggactctgctgctactttgtgggactgtggggcagcccctttcattggtacccctctccttgtacaagtgcagttgctgagcgcaggcagggggctgggggtgctggcttgtgtggggagaactgcttggtgtggggcttcgtgggccttgtgcaaggggtgtgcagtgtaggtgggggttccccccaagaaagcaagggggccttcgcttcaagacccaagctgggttttgactccacagttatgccctgtgagagtttggcaa

SEQ ID NO: 200396 - DNA, 601 bp, Human
gaaactaactcttagctcacaggttgttgtactaaccccatgaggacaggcctgtgagtccagtggagaagcaagagggtatagcccggagggcagggcagccccatctctgaggacagccttgtggttgcacagcatagggcagagtgtgccatccctgggctcctgccatgcggggagacctgctgatgggcatctctaggcttggggctggaaagctgggccaagggacatggactaggcaggagcttatggcggtcagccagatgccagtgcaaggtcctttcagtgctaggcctgyatgctcaggagcaggctgcaggcctgaggtgggctggctctgagtgggaagccgtgcaagtgttttcagcccccatggtagtggatatttgcagggacttatgtctttattgagatgcagttcacatgccatgaaaatctcccctgtggagtgccctgtcctatggttttagcatagtcaccgagttgtattcatggggtttcatgtctaccaagaataagattgttcttgcttaaattgtgaaagctttaccggtttagctcatagaaacagtcttggcaagagttccctgagataaaa

SEQ ID NO: 200397 - DNA, 601 bp, Human
ataagattgttcttgcttaaattgtgaaagctttaccggtttagctcatagaaacagtcttggcaagagttccctgagataaaacttttcctgccctgtgaactttcttgttttgaattttaatgcattctaacatgagtgtctcatgttagaagctcagtgttgtggaggtcagtatagctattaaaaaacaatcccagcactttgggaagccgaggcgggtgggtcatgaggtcaggagatcgagaccatcctggccaatatggtgaaaccccgtctctactaaaaaaaaaaaaaaaaatacaaaaattagctgggcgtggtggcctgtgcctgtaatcccacctactcgggaggctgaggcaggagaattgcttgaaccaggaagtcaagttgcagtgagccgagatcgcaccactgcactccatcctggtgacagagcgagactctgtctcaaaaaacaaaaaacacacagtcattgatggttgcatccctcctgccgctgagatctctgtctctgtctctgtgccctgcaggttgtgggttggctatcagtatgttatcactggccggaaccgctccttggaaggtcgctgggagg

SEQ ID NO: 200398 - DNA, 601 bp, Human
tcactggccggaaccgctccttggaaggtcgctgggaggtggcattcaaaggtgagcccttctggtgtgtgggagtgtttgaagctgggcagagtcaccctgattcggggcctcccctcctccctcttacccagtgctgcctggcccgtaggggtgctgtgcagggagtgggtgagccccagttgcagggagggctgcggtcatggggccagtgcagcctgcagatcaggccctgcattgggcggtggctgtctctggaaccctctgttgcatctcactttggccagctttctagattgtyccccgcctccttttgaagttaaagaccttggagtataaaaatgagcatgcagagtgtgcccctggcaggctggaggggaggacaagcttgccaggacaaaggtcagacgtagaatccagacctgaaggaaactatcaggcagatagagagagagagagagagagagagagagtgagcatgcatgtgtgtgtgtgcgcaaagattttatgcggagctgcttggaaataccaagacgacgtaaaggaaacatggctgctgtttcctttacattccctgggctcggacttggcttgcccttcc

SEQ ID NO: 200399 - DNA, 601 bp, Human
ggccggcttccctggagaaaagagggccccacagaggcggggccatgcctggctgctgggacagggcaggagcagaggtgggggctgcagagcccagcagactggggccacacctgctgtcccgatcctgctcaggacagatgccaccctgttctcatgaccaccagtgccctcctgagagccccagccacatttgcattccctggctttatgagtgcattgtttagattgctattgactaatcaatggcttctgggtttccaggccccagagtcaaagtttgcctcatagagcataattmtcctggtagcttgtcctcctgacactggtggttgaagagaagacatgattctgagtgggatgacagcacattcagagttggggactgggggcctcatgcttggtgtgagaatggcaagggtcctgggtgggctttaatggccaagtgcagctcagtgactccattggagcctcaggcaggagagtgaacctaaaatttagaaaaagattgaacacgtatgttggtgctggcagctgcagctggcatagagctccctatttgtgtggctcaacgtgcaaggggccccacagcatcccggag

SEQ ID NO: 200400 - DNA, 601 bp, Human
cagcccaaggctcccgtcagagtcctgcgcacacctcatgtgtggacatatgggaggggcacctggaaacttgccgccaccctgtcgaggtgaggactggatctgctggggtggcagggggtgaggagtagtgtcttggagggaggcttgagaggagggctctgcacgaggaactgctcccagtcactctggtagccagggcagctctgctcacagggcctttctctaggatgagggtccttcaggaagagcgggatgtttgaggtaagggggtgtccaggaggaagtgggaggccctggwggaaaatctgcaggagtcatccccagtgcagtatcgggaagcctccaggctcctctcacacctttggaatatgtccaggatctcatcacctggcaccagtcttgcagcccccaccgggatctaacacccaatcatccgtcacccgattgtgctcgtggcctctgtctggtctcctggccccagccccaccgctcctcacacagctgctgggggtccttttcacctctgctcccttgttcacagctctcgtttctcatagaaatcacagttccatcaaggccagcagccccttccttcact

SEQ ID NO: 200401 - DNA, 601 bp, Human
gctcacagggcctttctctaggatgagggtccttcaggaagagcgggatgtttgaggtaagggggtgtccaggaggaagtgggaggccctggaggaaaatctgcaggagtcatccccagtgcagtatcgggaagcctccaggctcctctcacacctttggaatatgtccaggatctcatcacctggcaccagtcttgcagcccccaccgggatctaacacccaatcatccgtcacccgattgtgctcgtggcctctgtctggtctcctggccccagccccaccgctcctcacacagctgcygggggtccttttcacctctgctcccttgttcacagctctcgtttctcatagaaatcacagttccatcaaggccagcagccccttccttcactaccctcatcacctaccactccccagcctcttctccagccccacaggctgccttgttcatggctgccactgtgacctcttccagggatgctccaaagacgaacacctgcccgctctgcaaggctgcacctcgggtaggcatgcagtgcccgcatgaccagcccccattcagcacctggatgcagagccaccagcagctcccctgggcag

SEQ ID NO: 200402 - DNA, 601 bp, Human
acagtgtttaaaaggggaggggctctacttaggtgagaaggcatctgtgggagatgaggagggtgtgcaggggctcgggggcctggaggaaaggtggggtggtgcacagcgtgatggtggtggcacccactgtcagcagtggagaccagccctccaggtggtatggggaggtgactccagacagtgggcccctttcctgctctgctgtgggtctgatagatgcagatgaggcaggcgagatgctgggcctgtatgtccctgggaagggggcacagctgttgctgtggctgcctgctggccyggcacaggtcttgcaggtctcagagcttcctgagagctgtcctcctgcccatggcagggcaccatgtgtccacaggcccacagcataggcctgcctccagactcactggcttttttgaggcagagccccatgtttcgtgctgggtataaacagagctccaaaagacgcaggtgagaatgctggaggcttataaatggggtgagctgcactgctgctgtcttaggagggggagagcaccaggtgtgccttcattattctgcttcttggaaaggttgctttgtgtttccattgatcctggtc

SEQ ID NO: 200403 - DNA, 601 bp, Human
cgctggctctgggatggcagctgtgcgcaggttggggagaggctttgttcttgcggatcatgtgtgtgatgttgccgagcatggtgcaggcgttcttgttgacggtggtcctctttttctttttttttttgggacagagtctcgctctgttgcccaggctggagtgcagtggcgtgatctcggctcactgcaagctccgcctcccaggttgaagcgattctcctgcctcagcttcctgagtagctgggactacaggtgcctgccaccacgcccggctaattttttgtgtttttagtagagrcgggtttcacagtgttaggatggtgtcgatctcctgacctcgtgatccgcccacctcgccctcccaaagtggtgggattacaggtgtgagccaccgtgtccacccgacggtggtcccctcataggaggtggctggcttctgctggccggatctccactccatgaccaccaccacacctttgccatcagctgccgggtccacacccacagtcctgcagtgaatcagctcgttgtagtggaaggagctgcagcctttaagttctcaggctcagtgctgtgggtctgcttattccccttgatc

SEQ ID NO: 200404 - DNA, 601 bp, Human
ttcttatttgtattcaaattactatctggggattgcatacttttggcctgaaaaacttcctttagtgtttcttataaggtggatctgcaaacaacttctctcacttgttgtttgtctgggaaagtttattttactttcatttttcagaagatatctttgctggatatggatcttggttgatggttttctgtgagcagttatcccactgccccagcctctgttgtttctgctgagaagtcagttgtttgtcttattggggttcccttagaagtaacaagtcacgtcccatttgctgcttttygtattttcgccttgtctttcactttcagcattttcactctgatgtgtcagtttgtggctcctttgcatttatcctaggaatgtggaatttgttgagcttcctggatgtataggttattgtttttcaatgaatttgagtagtttgcagctgttagttcttcgactaatttttttttgcctctttctctctctcctctccatttgttactcctgtttcacatatgttggtgtacttaatggtgtttcacatttctctgggagctctgttcatttctgttcattcttttttctctattttagc

SEQ ID NO: 200405 - DNA, 601 bp, Human
tccatctcaaaaagtaaaaataaaatagggctgggttcagcggctcatgcctgtaattgtagtactttgggagtctgaggcaagaggattgcttgaggccaggagttcaagaccaacctggctaacatagcaagaccctgtctcttaaataaaaaggtagataaaagttggtggaaaggcaaaataattaaaatagccaaagtagtttttacaaagaacaaagttggaggatccatgccacctaatgtatgagttactgtacagccatagtaatcacaacagtgtggtatcgatgaagggrcagacacatagatcagtggaacacaacagtccagaaatagtcccacactacgtataatcaggtgatctctctgtttttgtttgtttaagacgagtcaagtgcagtcgtgagaacgggaaaagagtacaacaaggagtttgatctgttactgactgtgaacaatcaatcgagatgactcactaccttcagaccagcctaatctttgacaaaggtgcaagagcagttcagtggagaaaggatagtctttcaaccactggtgctgggacagcaggacatccatatgccaaaaaatacgaacct

SEQ ID NO: 200406 - DNA, 601 bp, Human
tccaggagctgatgggtcactcctcgttttgaagcctccctggccttcactcttggtctgtggaggaagctacttctgggaccacttcctggttccattattctgtgacttctgtgagttgccagtttacccaagtcaggagtgcatggaactgccagccatgttatagatgtgtggctggtagattctcctttcatgcctgctaccactcatgtcatctctgcctccccatgggcagctcatatcgagcccctgtccccagtgtgcactgcaccagggcagggtgtgtccctcttggcgstgttgacatttggaccagatactgtgtgttgggggctgtcctggaggatgttgaacagcaccccggcctccacctgctgaatactagtagcatcccagccaagtggtggtcacgaaaagcgtgaaatggttgaagaagagcagaggaaggcgcagcagcttagactcagtgctccttggcgtctagcctggctgggactcagcttcaagcttcatggcccctcctgcctactcacccagcaaagaggtggagtcgggtccacccagccctcctacacctgcgcttggtgcgtgtgtaccc

SEQ ID NO: 200407 - DNA, 601 bp, Human
tctgtgagttgccagtttacccaagtcaggagtgcatggaactgccagccatgttatagatgtgtggctggtagattctcctttcatgcctgctaccactcatgtcatctctgcctccccatgggcagctcatatcgagcccctgtccccagtgtgcactgcaccagggcagggtgtgtccctcttggcggtgttgacatttggaccagatactgtgtgttgggggctgtcctggaggatgttgaacagcaccccggcctccacctgctgaatactagtagcatcccagccaagtggtggycacgaaaagcgtgaaatggttgaagaagagcagaggaaggcgcagcagcttagactcagtgctccttggcgtctagcctggctgggactcagcttcaagcttcatggcccctcctgcctactcacccagcaaagaggtggagtcgggtccacccagccctcctacacctgcgcttggtgcgtgtgtacccaatgtgtgggtgtggctgagccgggagagcatctcagtggggagcctgtgagacccagtgttgtgtccaggtgtcatctgcacgtgtatgccagggctgggtgcgtcagg

SEQ ID NO: 200408 - DNA, 601 bp, Human
tagcctggctgggactcagcttcaagcttcatggcccctcctgcctactcacccagcaaagaggtggagtcgggtccacccagccctcctacacctgcgcttggtgcgtgtgtacccaatgtgtgggtgtggctgagccgggagagcatctcagtggggagcctgtgagacccagtgttgtgtccaggtgtcatctgcacgtgtatgccagggctgggtgcgtcaggggatgcgcattttctctgccatggcttgttaaggattggagtgacaggcttcacgcccaaccacagcagaggcrcatttgtgaaatgatacctgagttgaccgtgcggctgcccacaggggctcactgttcccctacacagtccatcagggagttgtggcaatccgagtcccaagtgtaccttatactgtcacttctcccagtctgtcactacccggtccaggcctctgtcattcccttctctgctgcggcaggtcctcctcctggcttcctgatgccctatgctactcccttgcagcctgtcctccctacggcagccgcccgagccatgctccgcaggggcgtcacccccactccaaactgccagcaactgtc

SEQ ID NO: 200409 - DNA, 601 bp, Human
gactcagcttcaagcttcatggcccctcctgcctactcacccagcaaagaggtggagtcgggtccacccagccctcctacacctgcgcttggtgcgtgtgtacccaatgtgtgggtgtggctgagccgggagagcatctcagtggggagcctgtgagacccagtgttgtgtccaggtgtcatctgcacgtgtatgccagggctgggtgcgtcaggggatgcgcattttctctgccatggcttgttaaggattggagtgacaggcttcacgcccaaccacagcagaggcacatttgtgaaaygatacctgagttgaccgtgcggctgcccacaggggctcactgttcccctacacagtccatcagggagttgtggcaatccgagtcccaagtgtaccttatactgtcacttctcccagtctgtcactacccggtccaggcctctgtcattcccttctctgctgcggcaggtcctcctcctggcttcctgatgccctatgctactcccttgcagcctgtcctccctacggcagccgcccgagccatgctccgcaggggcgtcacccccactccaaactgccagcaactgtcatccatgagacc

SEQ ID NO: 200410 - DNA, 601 bp, Human
agcctgtgagacctccttctccacaaaaaattcagaactagccgtgcatagtgggcacagctgtagtcccagttactgggcaggctgagaatggaggatcacctgagcccagaattcaaggctgtcatgagccatggtcacgtcactgcacaccagtgtgcaatcttttaagatcctgtctcttaaaagaaaaaaaaagcaagtaataaagatcgggcaaaacaaagcgagtcgactgcctaccacacagcctgccttggatcagagcttcctgcaaacacctgtgtggttttccaggccrctcactgcagccctgttgcccacactccggttgccacattccagctgcagccctgaatgttcttccacccacctgggcccagtgcctccctgatgacaaatgcccctgccttcttgctgagccgggtcttcaccttactgagtctgagacggtttccctttgggcccctctgttctagtgactgctggtcagtgtgtctcccctacctcacaccgatggtgggacaggcccgtgtctgcctttgtgagatgggccctgcaccttgcatataccaggttcccagccacagggggcagtagg

SEQ ID NO: 200411 - DNA, 601 bp, Human
tgccttggatcagagcttcctgcaaacacctgtgtggttttccaggccgctcactgcagccctgttgcccacactccggttgccacattccagctgcagccctgaatgttcttccacccacctgggcccagtgcctccctgatgacaaatgcccctgccttcttgctgagccgggtcttcaccttactgagtctgagacggtttccctttgggcccctctgttctagtgactgctggtcagtgtgtctcccctacctcacaccgatggtgggacaggcccgtgtctgcctttgtgagatgkgccctgcaccttgcatataccaggttcccagccacagggggcagtaggtacaacaggtgtcatgtggggcaggctcctccttcaaaatctgaggcccgggggagccacccaggtcctgctcaccacccagcttcaggggggccttcaggcaggaggagtgtctcctggttttgcctagctcccctgcatcccctgtgccaggcccgtacctgcctctgacacccctctgtctcttcctgcagacgatgatgcttttgagcctgtggaggtcagcctgccagcccctggggatggtgggag

SEQ ID NO: 200412 - DNA, 601 bp, Human
cagcttttaaggtgggttgtggtgatgggggaactgtgtgcgaccggggtggacacctctggagccctgagtgcctgtggctcaggactgagcactgggatcggcccccagctgctgacgggcagagtgctggcttttctgaatgccagggtgctgaaggcaggtgtgggtgggtggacctgtcacagagggatttgggggtgtaagggctgagacaccaaggcagggagtggcttgggccctctggatcctggaggccgggtgctgttcatgaatgaggcaggatggtcacagacacgtsaggagctctgcaggcctgagggccataggacgaggctgtgtgcttgtagagaaggcccctggttacagaacacgattgggacacgctggattacacggctcaagcctggtgttgtaggagtggtcagggtggagtgtgtgaggcccggcacagaccaggggaggctcttcgtgggctgggtcagatacaacaggcctccccataccactgcgggcctttccccagaatacttagtacaggtaacccatgtccagacaaaacatggggagaggttctggttaccttggttctaaattgtct

SEQ ID NO: 200413 - DNA, 601 bp, Human
gggtggacctgtcacagagggatttgggggtgtaagggctgagacaccaaggcagggagtggcttgggccctctggatcctggaggccgggtgctgttcatgaatgaggcaggatggtcacagacacgtgaggagctctgcaggcctgagggccataggacgaggctgtgtgcttgtagagaaggcccctggttacagaacacgattgggacacgctggattacacggctcaagcctggtgttgtaggagtggtcagggtggagtgtgtgaggcccggcacagaccaggggaggctcttcrtgggctgggtcagatacaacaggcctccccataccactgcgggcctttccccagaatacttagtacaggtaacccatgtccagacaaaacatggggagaggttctggttaccttggttctaaattgtctgggacacaaggataaccaaggcaaacgtgcgagagggataatgaagaggatgccgtgctgtccaatgtgagagcgcaaggcaagggctgaggtgcttctgaggtatgcctgccactgcttcccgagtctccaggccaacagtaaacagataaattctgaaacaaaccatga

SEQ ID NO: 200414 - DNA, 601 bp, Human
ttgtaggcaacaaagagaggctggcacccaccacagtggctttctgtgtgaggggctgcctggcgtgtggcaggcctggcgcagctacccacacacctgctaccttgtagatcctggagccaggccgcagggagcggctgggtctgaagatggccaacgaggccgctgccaagaaccgggccaagaagcaggaagccttgcggagagtgacggagaatctggccaggtgaggggccgcctggctggtggggaagtgcgagggtggctctggcctgctcctgttcggcccctgccctgaccrtgtggaggcatggcccacgcggcagagtccagggcaggtccgcggggttctgcagtgggtactgtggcagctcctctatccagagcatggccgcacatggacaggatgagaggccccctccatcttctctttcctccacgtcctctttgacccgtccctaagaggcatctttaggcgtgtggtcctgctgggagctttcatcagccctgtggagagagtcatcgttccccttggagaggggtggggactccaactctcagaggcctgggggtgcaccccagcccccacagccaagggcgg

SEQ ID NO: 200415 - DNA, 601 bp, Human
tggccggccgcatccgccttcgcgaggagcgcgtggaggtgagtgccccgcccagcctttccccggagcgcgcgggccgcggctacactggactggggtcctggcgggcgggcgccctttgcaaagacggcctcggcccaagccccgccctggcgcgccggagggaggaggtccctggacggcgctgggcgtccgggggtatgaggagcgggtgagagcagggaggtgccgcgggaaaggaaccggagggctacttttcttttcttttgttttacactttcctctggtgacgaaagaggcscgcgttcacgtccagaatttgggaaattcagaagagcccgcaacccaagaaggggcgtcctggtcgccgccagctggaggctggggcgggtactaagggggttcccatctcgcgtccagacccaccgagtctgtccgcagcgaataagggcaggtggcgcgcagccgcggcccgggtgtcggctctacagcgccgtccgcccacatccctgttgcgaagctcccctctcggtccctgtgggaccctcgggagccggtgggacgcaggacctggggctagggctgagcattccccccatcc

SEQ ID NO: 200416 - DNA, 601 bp, Human
acctctttggatctgatgatgaggaggtatggcgtcttctataaagaacatatcggccaggcgcagtggctcatgcctgtaatcccagcatgttgggaggctgaggcgggtggatcacgaggtcaggagttgaagaccagcctggccaagatggtgaaaccctgtctgtactaaaaatacaaaaaaatgtggcaggcatctgtaatcccagctactcaggcggctaaggcagagaattgcttgaacctaggaagcggaggttgcagtgagccaagatcgtgccactgcatccagcctgggygacagagcgagactccgtcccaaaaaaaaaaaaaaagaatacatcgatcagcaattgtatcaatgtggttaagccaaattgcctggatttgaatcctggctttaatttatatgcctttttcaaattctgactggttgcatgatgaataaaatcaaatcaccatctttcggctgagttcgtgatggatttgcttttttctgattaagccagtcttttttgtgatgaccccactagctttaagcagaggaacaaccagctttctgaagtggattaattttttttctttacaggaaagtgaag

SEQ ID NO: 200417 - DNA, 601 bp, Human
gaggaggtatggcgtcttctataaagaacatatcggccaggcgcagtggctcatgcctgtaatcccagcatgttgggaggctgaggcgggtggatcacgaggtcaggagttgaagaccagcctggccaagatggtgaaaccctgtctgtactaaaaatacaaaaaaatgtggcaggcatctgtaatcccagctactcaggcggctaaggcagagaattgcttgaacctaggaagcggaggttgcagtgagccaagatcgtgccactgcatccagcctgggcgacagagcgagactccgtcycaaaaaaaaaaaaaaagaatacatcgatcagcaattgtatcaatgtggttaagccaaattgcctggatttgaatcctggctttaatttatatgcctttttcaaattctgactggttgcatgatgaataaaatcaaatcaccatctttcggctgagttcgtgatggatttgcttttttctgattaagccagtcttttttgtgatgaccccactagctttaagcagaggaacaaccagctttctgaagtggattaattttttttctttacaggaaagtgaagaagcaaagaggctaagggaa

SEQ ID NO: 200418 - DNA, 601 bp, Human
ggaggtatggcgtcttctataaagaacatatcggccaggcgcagtggctcatgcctgtaatcccagcatgttgggaggctgaggcgggtggatcacgaggtcaggagttgaagaccagcctggccaagatggtgaaaccctgtctgtactaaaaatacaaaaaaatgtggcaggcatctgtaatcccagctactcaggcggctaaggcagagaattgcttgaacctaggaagcggaggttgcagtgagccaagatcgtgccactgcatccagcctgggcgacagagcgagactccgtcccaaaaaaaaaaaaaaagaatacatcgatcagcaattgtatcaatgtggttaagccaaattgcctggatttgaatcctggctttaatttatatgcctttttcaaattctgactggttgcatgatgaataaaatcaaatcaccatctttcggctgagttcgtgatggatttgcttttttctgattaagccagtcttttttgtgatgaccccactagctttaagcagaggaacaaccagctttctgaagtggattaattttttttctttacaggaaagtgaagaagcaaagaggctaagggaaga

SEQ ID NO: 200419 - DNA, 601 bp, Human
taaggagatagtctcaaaacaaattgagatggatttgtttgtgtcttggagtagggtgaaaaaaatacaattcattatttgaataatgctgtttattgtttttagaacctgcacttgttgccaagtcttccatcttactagatgtgaaaccttgggatgatgagacagatatggcgaaattagaggagtgcgtcagaagcattcaagcagacggcttagtctggggctcatgtgagtttaggctttgcctttttttttttgaaactaacatctggaatttgcctacagtttcaacctttcttacaagacttttctaactaggatttttcttaatgctctttttagctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattacctttggctcttgagtatgttacataggagggtggtgtatatattcctttcatttt

SEQ ID NO: 200420 - DNA, 601 bp, Human; identical to SEQ ID NO: 200416

SEQ ID NO: 200421 - DNA, 601 bp, Human; identical to SEQ ID NO: 200417

SEQ ID NO: 200422 - DNA, 601 bp, Human; identical to SEQ ID NO: 200418

SEQ ID NO: 200423 - DNA, 601 bp, Human; identical to SEQ ID NO: 200419

SEQ ID NO: 200424 - DNA, 601 bp, Human; identical to SEQ ID NO: 23026

SEQ ID NO: 200425 - DNA, 601 bp, Human
agatgagaagaattcatctgggactggcttttgctttaggatggtgttggaagttgctcgttgtcgctaggagcctgctccactgtaagggtgtcgggatctgaagagctatggtgaaacaccactgaagcattgccaaggtgaggccctgcgtcttccgggttctttatcgtcttcctttaaattgtgcaaatggtgctgtaaggcctgtagtggggcaagcaagcaaggacattgctgtgggtgccacagacggaggaagaggcatgaatggatcgctgcctcagctatgaatagattkctccatggtttgtgcatttccagttttgagaatttttaatttataaaaggtcatccatccagggtagattctgctttttggaaaaggcagtgaatgtgccacagaggagagaagggacgtgggatgtagagagggggttgagcgggcacacacaggccactgctgcgctcccggcgagtcactcggcctcttgataggaggtgatattgactgtgcagagctgacagaggttagtggtcacaggcggggagcatctggctcaaggcaaatgactgttgctttcgttttatttgtttgttt

SEQ ID NO: 200426 - DNA, 601 bp, Human
agtgcagtggcaagagatcatcgctcactgcagcactgacctcctgggctcaagcgatcctcccaactcagcctcctgagtagctgggaccacaggtacgccactgtatctggctaattttttaatcttattttttgaagagatggggtctcgctttgttgcctgggctgatctccaacccctggcttcaagccatcctcccactttggcctcccacagtgctgggattgcaggcatgagtcactgtgactggcccagcatgcatttttgagcctttgctctgtggcaggggctgcaggayggaatacaccctcatctgcccagcgaagctcactgcactggtgcaggctcctggcaccccaagcacaggcccagctacccagacctgactcctctccaggaaggaagcagaaagccaggaatggagagaatgaggacccaggcccctgggggagtacagaattccagccaggaatctgccgtcctctgggctcaaccaccccacagaatctggtcagccaagtggctgtgagctgggctcgacagcccttcctcgagagtaaactgtggcctctaggatgtagagaggggactcaaaggg

SEQ ID NO: 200427 - DNA, 601 bp, Human
caagagatcatcgctcactgcagcactgacctcctgggctcaagcgatcctcccaactcagcctcctgagtagctgggaccacaggtacgccactgtatctggctaattttttaatcttattttttgaagagatggggtctcgctttgttgcctgggctgatctccaacccctggcttcaagccatcctcccactttggcctcccacagtgctgggattgcaggcatgagtcactgtgactggcccagcatgcatttttgagcctttgctctgtggcaggggctgcaggatggaatacacyctcatctgcccagcgaagctcactgcactggtgcaggctcctggcaccccaagcacaggcccagctacccagacctgactcctctccaggaaggaagcagaaagccaggaatggagagaatgaggacccaggcccctgggggagtacagaattccagccaggaatctgccgtcctctgggctcaaccaccccacagaatctggtcagccaagtggctgtgagctgggctcgacagcccttcctcgagagtaaactgtggcctctaggatgtagagaggggactcaaagggccagatccca

SEQ ID NO: 200428 - DNA, 601 bp, Human
gaggaagaaaaaatgatgaagccgcaggaagacagcacgtagatggaaatctcaacatactgagatggaaatcaatcacaaaactcttacaggaaaatcacagctaaaagttggtgattacatgtgggcctgcagtgcctttcctgtcacatctgctaccccactgccagcctgctgctaccccacagcagccctcccatttgtggaatgttccctggcgtgctcctgcttgcctgaatcccttccccaccttcccacctaggcaacttgcatttgctctgacgtccagggcaggtgcgartgtctcctcccagtcacagtgcccaagcccatttgtgtgtccccagcaaccaccagcacacacccagggctctggtttgcaggcctgccaggttctctggaccaaagctcctgaggacaaggacatgccctacatgtgcctccaggtcccagcacccagcgcagtgcctggcccaccaggggtatctggtaaagtggttcttgagttaaagacacaagggcaaaaccttaaatgaaaatcaaggttaagacatgaggatgaaagcttgaaagaggaaaagcaaagataattgaatgatca

SEQ ID NO: 200429 - DNA, 601 bp, Human
gaagaggcatctgaggcctctggcacattccacttcctgtaagacagtgtggtatagatgaaagcattggggcttcctgccagccaggtcagtctggctctgcacctgccagctgggagtgtgaagtgggagcagttgcacccactctcaagcacagacatgagaactgaacagaaccacggaatgggggtccagagcccaagacatagacgaggctcctccttgtccactgtggggcttgtgcaaccccttcatcaaagcgctggtgctttccacattgtaatcaaggaagttttctcasgttccttctcatcacaactagctgctggcctttttgcacactttggcacctaggatgctgaacctggaccagtgggaggcaaacaagacacacctgggatgcaaaatgtaaggaggctcccatgctcaggtcgttcaagtgcaggaaaagtttgtgtatgtgtgaaacgcacaatgccatgtggtgtctataagggcatttgaggttctgtgcttaatggatgaagtgggttctgagcattgagtctgtggattcctgatgagtttcctggtgctctgagctccgtgaacttgtaaacaa

SEQ ID NO: 200430 - DNA, 601 bp, Human
tccttgtccactgtggggcttgtgcaaccccttcatcaaagcgctggtgctttccacattgtaatcaaggaagttttctcacgttccttctcatcacaactagctgctggcctttttgcacactttggcacctaggatgctgaacctggaccagtgggaggcaaacaagacacacctgggatgcaaaatgtaaggaggctcccatgctcaggtcgttcaagtgcaggaaaagtttgtgtatgtgtgaaacgcacaatgccatgtggtgtctataagggcatttgaggttctgtgcttaatrgatgaagtgggttctgagcattgagtctgtggattcctgatgagtttcctggtgctctgagctccgtgaacttgtaaacaagcttttgtgtaggtgggtacttacagtttttgtcagattcccaaaggggtctgtgaaccccaaaatatttggaatcatacagtcaaatatctaggaagaatactttaattttctctctcagcgtgttgtggatatgaggaagtggaaaggacttggacatagaagtcagacaaagcagccacatctgagtggtctcgtcctgcagtgtagtggttagac

SEQ ID NO: 200431 - DNA, 601 bp, Human
ggcaaacaagacacacctgggatgcaaaatgtaaggaggctcccatgctcaggtcgttcaagtgcaggaaaagtttgtgtatgtgtgaaacgcacaatgccatgtggtgtctataagggcatttgaggttctgtgcttaatggatgaagtgggttctgagcattgagtctgtggattcctgatgagtttcctggtgctctgagctccgtgaacttgtaaacaagcttttgtgtaggtgggtacttacagtttttgtcagattcccaaaggggtctgtgaaccccaaaatatttggaatcayacagtcaaatatctaggaagaatactttaattttctctctcagcgtgttgtggatatgaggaagtggaaaggacttggacatagaagtcagacaaagcagccacatctgagtggtctcgtcctgcagtgtagtggttagacggctggccttgtcaaccagagggctccagtgcaaggttcagccctggcaatgtgagcaagtcactgtgtgccttcctgagatgataatagtttgaccccactgtatacgagcagccttacctgtctcgggtaggttaattatatcctctcagtcttatt

SEQ ID NO: 200432 - DNA, 601 bp, Human
catgttgtctaggctggtctcaacctcctgagctcaagcaatctgcctgcctcagcctcccaaagtgctgggattacaggcatgagtgaccatgcctggctctaccttttatgttaaagtttatataaattatttcattttaagattcttttattcctgccatttctgtggtgcaattggatttttacataaagttaaataatactttttattttggccaggcgtggtggctcacacctgtaatcccagcactttgggaggccaaggtgggaggattgcttgaggtcaggggttcgagacyagcctggccaacatggtgaaaccccatctctaccaaaaatacaaaaattagctgggcatggtggcaggcacctgtaatcccagctactcagaaggctgaggcaggagaattgcttgaacccaggagatctcagcagtgagctgagactgccgctgcactccagcttggacgacagagtgaaaaaaattaaaaattaaatgatacttttaattttatttactattttatttgaataaataaaaggatcctttaaaaagtattacacacgaaaatagggtcaaaagtcatagcccattttct

SEQ ID NO: 200433 - DNA, 601 bp, Human
gcatggtggcaggcacctgtaatcccagctactcagaaggctgaggcaggagaattgcttgaacccaggagatctcagcagtgagctgagactgccgctgcactccagcttggacgacagagtgaaaaaaattaaaaattaaatgatacttttaattttatttactattttatttgaataaataaaaggatcctttaaaaagtattacacacgaaaatagggtcaaaagtcatagcccattttcttgattttatttggtgctttatgggaaaggctaaactctctctctttttttttttttaacacattagcatggaaaggaatcatttctactttgtggtgtctgtctgtctgtctatctgatgggctctctggcacctgccagcacactgggggaagtgtgaggtcaagataggcatcttgtagatgaagagcatggcgtgctggtaaacgtttaacaaccagctttccaggaaacaaatgtattgtatacatacataagtttatagtaacatgtactgatataaaggatgcatagcacttaatttacaaataataacaaaatatgcaatagtctctgtcctaaataccgcagaggtga

SEQ ID NO: 200434 - DNA, 601 bp, Human
gcttgaacccaggagatctcagcagtgagctgagactgccgctgcactccagcttggacgacagagtgaaaaaaattaaaaattaaatgatacttttaattttatttactattttatttgaataaataaaaggatcctttaaaaagtattacacacgaaaatagggtcaaaagtcatagcccattttcttgattttatttggtgctttatgggaaaggctaaactctctctctttttttttttttaacacattagcatggaaaggaatcatttctactttgtggtgtctgtctgtctgtcgatctgatgggctctctggcacctgccagcacactgggggaagtgtgaggtcaagataggcatcttgtagatgaagagcatggcgtgctggtaaacgtttaacaaccagctttccaggaaacaaatgtattgtatacatacataagtttatagtaacatgtactgatataaaggatgcatagcacttaatttacaaataataacaaaatatgcaatagtctctgtcctaaataccgcagaggtgattgagtctcatagaaagctctcgtgactttgcactgtcatatccgtagccaagcat

SEQ ID NO: 200435 - DNA, 601 bp, Human
gcccattttcttgattttatttggtgctttatgggaaaggctaaactctctctctttttttttttttaacacattagcatggaaaggaatcatttctactttgtggtgtctgtctgtctgtctatctgatgggctctctggcacctgccagcacactgggggaagtgtgaggtcaagataggcatcttgtagatgaagagcatggcgtgctggtaaacgtttaacaaccagctttccaggaaacaaatgtattgtatacatacataagtttatagtaacatgtactgatataaaggatgcrtagcacttaatttacaaataataacaaaatatgcaatagtctctgtcctaaataccgcagaggtgattgagtctcatagaaagctctcgtgactttgcactgtcatatccgtagccaagcattggttgcagcagatgagcaagtgtggtgttggcacaaacactgaaatgttcattcatgttaaggagcagatcaaagtgaaacaacaaagagttggggcaggctgcagccttagtgccatgagcggcttctttgttgaactggataatagtttttcaatattcagaaaagtttcctcaa

SEQ ID NO: 200436 - DNA, 601 bp, Human
gtggtgttggcacaaacactgaaatgttcattcatgttaaggagcagatcaaagtgaaacaacaaagagttggggcaggctgcagccttagtgccatgagcggcttctttgttgaactggataatagtttttcaatattcagaaaagtttcctcaatgttttgtgctactcacagtgttctagctacagacaagatgctcttttaagcatagaaaatccatgaaacaaatcactgccgacctgtagcatttgcctgttcctgttgtataaatactcccaccagggccaatttcaagttgcyaacatgacttgcgtgaacatgggttcgagatgcgcagcagcacagcacgatagagtacttccgccttatagacacagtcagttaaagaacctcaaagcatagctattattaagatgcagtaaaaataatcaggaagtgatgaggtttaagtatttataacctttgttttaatagaatccatttagttgtatcttgtataattcaactttaattttttatcattttaattttatatagtttttttttctttttctttcttttttatttttctttgagaaggagtcttactctgttgcccag

SEQ ID NO: 200437 - DNA, 601 bp, Human
gtatcttgtataattcaactttaattttttatcattttaattttatatagtttttttttctttttctttcttttttatttttctttgagaaggagtcttactctgttgcccaggctgcagtgcagtggcacgatctctggtcactgcaacttccacctcctgggtttaagggattctcctgcctcatcctcccaattagctgggattacaggcacccgccaccatgcctggctaatttttgtattttaagtagagttagccaggctggtcttgaactcctgacctcaagtgatctgcccasttcggcctcccaaactgctgggattacagacatgagccaccacgcccggcccgtatagtttttataccttaatcttgcataatgatttgaataattcagctcacaaaattcctgagaatttaacaaccggctctagcataccggcacaagctggcccccagtgcatcactgacggggaggccgagtgtcttgaggccacactgcagatcagggtcctgcctgcagccaagtggggacaagtggagaataacttgcctcctgggctctcctgagtcccgagcctgacagcggaggcccagg

SEQ ID NO: 200438 - DNA, 601 bp, Human
gctttgtcacctgcccctgtgtcaggtgggacgtgagatgctctatttttttctgctccatcctgtgcccaagccttatacagggtgacccttttcagagaggcctttgccaccaggtcagtgtgagcatgtggctgggtgatttcctgccgtggaccagggatctgtgtgctgtctgaagtaagcaagggtgctctttcttggcaaggtctgagggctgagacttgcaaggagacacctgctctcttggtcaccagactggaggttcctatgtgcaggtgtggaggatggaagaggtcastctgtcctctttcttgcctgggcctcacctctgctgaggctgctggctgccctgggctcgcagtgaaaggggccatcttccaccctcccctgctggtcaagtgcatctttccaggttccggcactccacgttgccacccagacaagtgtcctgtgggaactagcaagtgggaatcaaaactacccccagagaggctcctggccgggagatgaagggatctaccctggggctaaagtctccccagcctttcttggagcttaggtcctggctttagaaagatcccattcacatccaggcaca

SEQ ID NO: 200439 - DNA, 601 bp, Human
aagaggtcactctgtcctctttcttgcctgggcctcacctctgctgaggctgctggctgccctgggctcgcagtgaaaggggccatcttccaccctcccctgctggtcaagtgcatctttccaggttccggcactccacgttgccacccagacaagtgtcctgtgggaactagcaagtgggaatcaaaactacccccagagaggctcctggccgggagatgaagggatctaccctggggctaaagtctccccagcctttcttggagcttaggtcctggctttagaaagatcccattcacakccaggcacagtggcacacacctgtaatctcagtactttgggaggccgaggcaggcggatcacttgaggtcaggagtttgagactggtctggccaacatggcgaaactgtctctactcaaaatgcaaaaattagctgggtgtggtggtgtgcgactgtaatcccagctactcaggaggctgaggtaggagaattgcttgaacccaaggaggcaaaggttgcagtgagctgagatcgcaccattgcactccagcttgagcaacagagcgagattccatctcaaaataaagaaaggaagggag

SEQ ID NO: 200440 - DNA, 601 bp, Human
catccaggcacagtggcacacacctgtaatctcagtactttgggaggccgaggcaggcggatcacttgaggtcaggagtttgagactggtctggccaacatggcgaaactgtctctactcaaaatgcaaaaattagctgggtgtggtggtgtgcgactgtaatcccagctactcaggaggctgaggtaggagaattgcttgaacccaaggaggcaaaggttgcagtgagctgagatcgcaccattgcactccagcttgagcaacagagcgagattccatctcaaaataaagaaaggaagggaggaaggaaggaaggaaggaagaaagaaaagaaaagaaaagaaaagaaaagaaaaaaaaaagaaaagatcccattcacctgcacaaaagccacacccctttgtggccaaggaaagggccacagaagaagaagtaggcccttcagaagggggagaagtaggcgccttcagaagctggttatccgtgtgtaatgccatcacagggacgtgcgtttaagatcttttatcagtcttcgtagctaaatacttttagttaattgcaggcgggaggggctactagctcaggctacatggagcatgtg

SEQ ID NO: 200441 - DNA, 601 bp, Human
ttgggaggccgaggcaggcggatcacttgaggtcaggagtttgagactggtctggccaacatggcgaaactgtctctactcaaaatgcaaaaattagctgggtgtggtggtgtgcgactgtaatcccagctactcaggaggctgaggtaggagaattgcttgaacccaaggaggcaaaggttgcagtgagctgagatcgcaccattgcactccagcttgagcaacagagcgagattccatctcaaaataaagaaaggaagggaggaaggaaggaaggaaggaagaaagaaaagaaaagaagagaaaagaaaagaaaaaaaaaagaaaagatcccattcacctgcacaaaagccacacccctttgtggccaaggaaagggccacagaagaagaagtaggcccttcagaagggggagaagtaggcgccttcagaagctggttatccgtgtgtaatgccatcacagggacgtgcgtttaagatcttttatcagtcttcgtagctaaatacttttagttaattgcaggcgggaggggctactagctcaggctacatggagcatgtgctcaaaaactgtctccaatatggtgacttgctgtttgag

SEQ ID NO: 200442 - DNA, 601 bp, Human
tgggaggccgaggcaggcggatcacttgaggtcaggagtttgagactggtctggccaacatggcgaaactgtctctactcaaaatgcaaaaattagctgggtgtggtggtgtgcgactgtaatcccagctactcaggaggctgaggtaggagaattgcttgaacccaaggaggcaaaggttgcagtgagctgagatcgcaccattgcactccagcttgagcaacagagcgagattccatctcaaaataaagaaaggaagggaggaaggaaggaaggaaggaagaaagaaaagaaaagaaaagaaaagaaaagaaaaaaaaaagaaaagatcccattcacctgcacaaaagccacacccctttgtggccaaggaaagggccacagaagaagaagtaggcccttcagaagggggagaagtaggcgccttcagaagctggttatccgtgtgtaatgccatcacagggacgtgcgtttaagatcttttatcagtcttcgtagctaaatacttttagttaattgcaggcgggaggggctactagctcaggctacatggagcatgtgctcaaaaactgtctccaatatggtgacttgctgtttgagg

SEQ ID NO: 200443 - DNA, 601 bp, Human
ggcggatcacttgaggtcaggagtttgagactggtctggccaacatggcgaaactgtctctactcaaaatgcaaaaattagctgggtgtggtggtgtgcgactgtaatcccagctactcaggaggctgaggtaggagaattgcttgaacccaaggaggcaaaggttgcagtgagctgagatcgcaccattgcactccagcttgagcaacagagcgagattccatctcaaaataaagaaaggaagggaggaaggaaggaaggaaggaagaaagaaaagaaaagaaaagaaaagaaaagaaagaaaaaagaaaagatcccattcacctgcacaaaagccacacccctttgtggccaaggaaagggccacagaagaagaagtaggcccttcagaagggggagaagtaggcgccttcagaagctggttatccgtgtgtaatgccatcacagggacgtgcgtttaagatcttttatcagtcttcgtagctaaatacttttagttaattgcaggcgggaggggctactagctcaggctacatggagcatgtgctcaaaaactgtctccaatatggtgacttgctgtttgaggacggtctaagcgact

SEQ ID NO: 200444 - DNA, 601 bp, Human
gatcacttgaggtcaggagtttgagactggtctggccaacatggcgaaactgtctctactcaaaatgcaaaaattagctgggtgtggtggtgtgcgactgtaatcccagctactcaggaggctgaggtaggagaattgcttgaacccaaggaggcaaaggttgcagtgagctgagatcgcaccattgcactccagcttgagcaacagagcgagattccatctcaaaataaagaaaggaagggaggaaggaaggaaggaaggaagaaagaaaagaaaagaaaagaaaagaaaagaaaaaaagaagaaaagatcccattcacctgcacaaaagccacacccctttgtggccaaggaaagggccacagaagaagaagtaggcccttcagaagggggagaagtaggcgccttcagaagctggttatccgtgtgtaatgccatcacagggacgtgcgtttaagatcttttatcagtcttcgtagctaaatacttttagttaattgcaggcgggaggggctactagctcaggctacatggagcatgtgctcaaaaactgtctccaatatggtgacttgctgtttgaggacggtctaagcgactgagg

SEQ ID NO: 200445 - DNA, 601 bp, Human
tcacttgaggtcaggagtttgagactggtctggccaacatggcgaaactgtctctactcaaaatgcaaaaattagctgggtgtggtggtgtgcgactgtaatcccagctactcaggaggctgaggtaggagaattgcttgaacccaaggaggcaaaggttgcagtgagctgagatcgcaccattgcactccagcttgagcaacagagcgagattccatctcaaaataaagaaaggaagggaggaaggaaggaaggaaggaagaaagaaaagaaaagaaaagaaaagaaaagaaaaaaaaaagaaaagatcccattcacctgcacaaaagccacacccctttgtggccaaggaaagggccacagaagaagaagtaggcccttcagaagggggagaagtaggcgccttcagaagctggttatccgtgtgtaatgccatcacagggacgtgcgtttaagatcttttatcagtcttcgtagctaaatacttttagttaattgcaggcgggaggggctactagctcaggctacatggagcatgtgctcaaaaactgtctccaatatggtgacttgctgtttgaggacggtctaagcgactgaggag

SEQ ID NO: 200446 - DNA, 601 bp, Human
aggtcaggagtttgagactggtctggccaacatggcgaaactgtctctactcaaaatgcaaaaattagctgggtgtggtggtgtgcgactgtaatcccagctactcaggaggctgaggtaggagaattgcttgaacccaaggaggcaaaggttgcagtgagctgagatcgcaccattgcactccagcttgagcaacagagcgagattccatctcaaaataaagaaaggaagggaggaaggaaggaaggaaggaagaaagaaaagaaaagaaaagaaaagaaaagaaaaaaaaaagaaaagatcccattcacctgcacaaaagccacacccctttgtggccaaggaaagggccacagaagaagaagtaggcccttcagaagggggagaagtaggcgccttcagaagctggttatccgtgtgtaatgccatcacagggacgtgcgtttaagatcttttatcagtcttcgtagctaaatacttttagttaattgcaggcgggaggggctactagctcaggctacatggagcatgtgctcaaaaactgtctccaatatggtgacttgctgtttgaggacggtctaagcgactgaggagtgtgccc

SEQ ID NO: 200447 - DNA, 601 bp, Human
tggccaaggaaagggccacagaagaagaagtaggcccttcagaagggggagaagtaggcgccttcagaagctggttatccgtgtgtaatgccatcacagggacgtgcgtttaagatcttttatcagtcttcgtagctaaatacttttagttaattgcaggcgggaggggctactagctcaggctacatggagcatgtgctcaaaaactgtctccaatatggtgacttgctgtttgaggacggtctaagcgactgaggagtgtgccccctgtccccacccttgagatgaggcctgataaggktgctggcatatttagtgttgggcaccctggtgctctccagcatgtggtgtttggcctaagtggcccatgtggactttgtttcaaggattttacgacaagaaacaccaaaatgaggacatctctgtggccatgtttcaggcaagggggtaatggatacagagcatatgtacacacaaacacacatgcacagagacacgtacagacacatacatgcacacagacacatagatacagacacatacacataagaatacacacagaaacacacagacacccacacatatacacacatgcacagac

SEQ ID NO: 200448 - DNA, 601 bp, Human
ccaaggaaagggccacagaagaagaagtaggcccttcagaagggggagaagtaggcgccttcagaagctggttatccgtgtgtaatgccatcacagggacgtgcgtttaagatcttttatcagtcttcgtagctaaatacttttagttaattgcaggcgggaggggctactagctcaggctacatggagcatgtgctcaaaaactgtctccaatatggtgacttgctgtttgaggacggtctaagcgactgaggagtgtgccccctgtccccacccttgagatgaggcctgataagggtgmtggcatatttagtgttgggcaccctggtgctctccagcatgtggtgtttggcctaagtggcccatgtggactttgtttcaaggattttacgacaagaaacaccaaaatgaggacatctctgtggccatgtttcaggcaagggggtaatggatacagagcatatgtacacacaaacacacatgcacagagacacgtacagacacatacatgcacacagacacatagatacagacacatacacataagaatacacacagaaacacacagacacccacacatatacacacatgcacagacatg

SEQ ID NO: 200449 - DNA, 601 bp, Human
aaggaaagggccacagaagaagaagtaggcccttcagaagggggagaagtaggcgccttcagaagctggttatccgtgtgtaatgccatcacagggacgtgcgtttaagatcttttatcagtcttcgtagctaaatacttttagttaattgcaggcgggaggggctactagctcaggctacatggagcatgtgctcaaaaactgtctccaatatggtgacttgctgtttgaggacggtctaagcgactgaggagtgtgccccctgtccccacccttgagatgaggcctgataagggtgctkgcatatttagtgttgggcaccctggtgctctccagcatgtggtgtttggcctaagtggcccatgtggactttgtttcaaggattttacgacaagaaacaccaaaatgaggacatctctgtggccatgtttcaggcaagggggtaatggatacagagcatatgtacacacaaacacacatgcacagagacacgtacagacacatacatgcacacagacacatagatacagacacatacacataagaatacacacagaaacacacagacacccacacatatacacacatgcacagacatgta

SEQ ID NO: 200450 - DNA, 601 bp, Human
aaaactgtctccaatatggtgacttgctgtttgaggacggtctaagcgactgaggagtgtgccccctgtccccacccttgagatgaggcctgataagggtgctggcatatttagtgttgggcaccctggtgctctccagcatgtggtgtttggcctaagtggcccatgtggactttgtttcaaggattttacgacaagaaacaccaaaatgaggacatctctgtggccatgtttcaggcaagggggtaatggatacagagcatatgtacacacaaacacacatgcacagagacacgtacaracacatacatgcacacagacacatagatacagacacatacacataagaatacacacagaaacacacagacacccacacatatacacacatgcacagacatgtagaaatacctagacacagaggaacacacaaagatacacaggcacacatacaggtacatctacatgcttatcaaaaacaacagcaaaaccacctaccatgacaaatactattgcagcaaaactgaacaaataaattctgtgccataaagtttcctaaacctcatctattttgtagaaatctagtcacttgagtatcatc

SEQ ID NO: 200451 - DNA, 601 bp, Human
tcagagcttttgccaactccactccctgcctgaaatgcccatctccttcagagagcttctatgtatccttggaggtccagtcctaatgtccctgcctccgataagacctctccccatcttcctctcgccctgctcctgtccccgccaggcatgacaaatctcttcccacagtgggcccaacagggaggcagatggtagaacaggttttgggccaggtgccaggtgcacgtggctcttcatcctggttccccaccgcacacctggagagctgagtgcttttcctgaggtcacgcagaaggtkaccagcctggctctggagctgtctctttgccacatcgtggggtgtctttaaggtgaccttgaatgtgcttgaagctgttttatgtcctatttgcagacctaggggaggacaatgccagggctttttgccttcccaaggtcacagcctgaagacactcagaaagatgtagttggctcatttatcattttttagaaaaaaagaaaacaacagaatgtgctgaatccttgtaactgttggccatggcactagtttcatggaaggtggaagggcaggttaggcttcttatgagggcgttcctgg

SEQ ID NO: 200452 - DNA, 601 bp, Human
cttcctctcgccctgctcctgtccccgccaggcatgacaaatctcttcccacagtgggcccaacagggaggcagatggtagaacaggttttgggccaggtgccaggtgcacgtggctcttcatcctggttccccaccgcacacctggagagctgagtgcttttcctgaggtcacgcagaaggttaccagcctggctctggagctgtctctttgccacatcgtggggtgtctttaaggtgaccttgaatgtgcttgaagctgttttatgtcctatttgcagacctaggggaggacaatgccwgggctttttgccttcccaaggtcacagcctgaagacactcagaaagatgtagttggctcatttatcattttttagaaaaaaagaaaacaacagaatgtgctgaatccttgtaactgttggccatggcactagtttcatggaaggtggaagggcaggttaggcttcttatgagggcgttcctggcctctggaggggtgtgggtgggctcaggtgaatgactgacagactggatttacgtatgttgagtgtgaatctcagtccacagcttggtgtgcaaaaacagaaaagctatctggtaat

SEQ ID NO: 200453 - DNA, 601 bp, Human
gaggtcacgcagaaggttaccagcctggctctggagctgtctctttgccacatcgtggggtgtctttaaggtgaccttgaatgtgcttgaagctgttttatgtcctatttgcagacctaggggaggacaatgccagggctttttgccttcccaaggtcacagcctgaagacactcagaaagatgtagttggctcatttatcattttttagaaaaaaagaaaacaacagaatgtgctgaatccttgtaactgttggccatggcactagtttcatggaaggtggaagggcaggttaggcttcytatgagggcgttcctggcctctggaggggtgtgggtgggctcaggtgaatgactgacagactggatttacgtatgttgagtgtgaatctcagtccacagcttggtgtgcaaaaacagaaaagctatctggtaatagctacatctctgttggggagaggaaactgacctctcaattcagggtcttcatacctttctccagggtggggtctaagttctgggagcctcatgagtctcaggaattctggggtggcctatttggtctttgtcatcagtccatgcagggggctgctagaatgtcat

SEQ ID NO: 200454 - DNA, 601 bp, Human
tggctcatttatcattttttagaaaaaaagaaaacaacagaatgtgctgaatccttgtaactgttggccatggcactagtttcatggaaggtggaagggcaggttaggcttcttatgagggcgttcctggcctctggaggggtgtgggtgggctcaggtgaatgactgacagactggatttacgtatgttgagtgtgaatctcagtccacagcttggtgtgcaaaaacagaaaagctatctggtaatagctacatctctgttggggagaggaaactgacctctcaattcagggtcttcatrcctttctccagggtggggtctaagttctgggagcctcatgagtctcaggaattctggggtggcctatttggtctttgtcatcagtccatgcagggggctgctagaatgtcatgtcagcctctgaccctggccaagccccctctcagagattccaggccacatcccaggttgagggatgcatcctcccactctggggccccccaggtgggactctcagggaggccacttgagacgcggttgcccaaactgactcaacaagatctctcagtcacgggctgaaagatctgcatcacgggctga

SEQ ID NO: 200455 - DNA, 601 bp, Human
ggctgggtgacttcctctctctggggttcagggcccagcactgctaatcgggggtagagtcaacggccttccagtgcaccctttggtggctctgtgtggcacatcaggcacactggtcaagtagggggtcatcaccaggccttgggtgcttctcaaacctaaagtcatgtggtcctcacaacagccccgtgatgtcatcaggaacctgcccactggcccagggctgggaaggactagagccaaagtgcaggctcaggactgtttgaccccaaagccagtgctctgaaccctccatctgtcytcattaaccaccgcctctgccactactgtaaggcaagagaagcgtgtcacggcgcgaaggctaagcacatgctgggaaatcacccgtggcttgcagacacatgcacagctactgggggtagatcaagagccaagaacgggtgagctcaagctgtgctcacatggggcgcgtgctaggtgactgtaggcctcagaaaacctgggatccagaacagctttcctccgctagggggctctggcacaagtttgcctgaagacatggccccatggcgaagccatcatgtgtgggaccttccttggc

SEQ ID NO: 200456 - DNA, 601 bp, Human
actggcccagggctgggaaggactagagccaaagtgcaggctcaggactgtttgaccccaaagccagtgctctgaaccctccatctgtcttcattaaccaccgcctctgccactactgtaaggcaagagaagcgtgtcacggcgcgaaggctaagcacatgctgggaaatcacccgtggcttgcagacacatgcacagctactgggggtagatcaagagccaagaacgggtgagctcaagctgtgctcacatggggcgcgtgctaggtgactgtaggcctcagaaaacctgggatccagarcagctttcctccgctagggggctctggcacaagtttgcctgaagacatggccccatggcgaagccatcatgtgtgggaccttccttggccccctcttggtgagccacattcctgtccacgcagtagctccagcccccacccgtggcttttcacttcttccttgctttccacttctgaccaccctataccagaaggtacttcatgtcagtcctctcccgcattccctctgccttcgggtctcctggaattggaactgtcactagtcaatcattacttacggggatgtgcagaaagccagac

SEQ ID NO: 200457 - DNA, 601 bp, Human
ggtggaggggttttctcagggctcgagggaggtgcctgcccatccactgagagctttgggaaggaaatgctgggcgccttttgtgcctcctactcatcaattccccccagctgcaggcaagggaggtcgttagcagcccagcctgtggggagcaagcaggccatgagctgcatgcagctggcactgctattacttaggaggcatcacaacaatgactcaggtgctgaccataacccttaaccaggtcacagtggctgcctaactgttgaagctgctacccctcctttaggttacaccgcaygaaaagttggcaatcctctctctcggtggctgctgtgggagcagctaacctcacagcacccgaagggatgtcatcgggaccccagctcggtttccagcatcagctgatgccagcaagaagccagccaggcctggggcttggcagcccagggactttaccatccaccatccacagggctgttgccctggacaggtcattgatatctgactcacagccaattcatggatgacgtgaatccaaaaatcagaggcccacgtggatttagacatggaaatgcctcaccagcttccatgagccagt

SEQ ID NO: 200458 - DNA, 601 bp, Human
tttctttttattataacataagcatctttcccactgctacttttgatcacttttgaggactcaaaatgatcatttttgggcctgcataatatttcactgtgtgaactctatcaccatttcaatcaggtgtttcgtttgcttccatatttttgtatcaccatagcaggtgatgattgaaaaaataaatgcagcttgcaaagtcattctgaattacatcgtggagctggagagtgttctttcctaatcccttcaaggaattacgatgatatggggagatgaaacattcatttgggggctggcktggggtaagctttaaattgcgtttaaagtcagtgtgatagtgacttgagtttttcatctcttttctccagctccttgacggccatatttgctggccagggttactggtgtggtctttggccagagagcagactttcctctctgtgaaatgaaatgactcataaggaaacaaaccccaaggctttgggtacatttgtcccatcatctaaaccagggtttctaatcagaagtccatgaatgattgtggggctttgtcgggggagaggtcctgaagctgagcacaaaatttggcatgtttgtg

SEQ ID NO: 200459 - DNA, 601 bp, Human
aaacttaaagtattaaaaaaaaaaatcagtttctgttaacaacaaactctggcaccagtcagcgggtttgacttcctaaaaaagtttgatttgctttctctcttagaaattctgtcttaaatttccttaaacgcaagtgtgtatacctggagcaaagaacatggggtgtaattcaatttctcttctcctttcttcctctgggaatctctgctaggtttcccacttattattgttgaaaactggcagtctttaaaggggatggacttcctgaaatacggcaaacagtcatgcaacaaaaagsagaaaattatattttcattttgggcgtcttagatgtagtgcaacattcaacatgagatcaatgtgccctcttgaccccaaagtattggctaatgatccataatcaatatttaggataacactggttgggagtatgaatgacatctttccaccattgtcttggtaaatgaaactatttactctttctggcagtggatgctgtcgggaggtggaaaagtaagcattttcttacgtttgggttttctgtgattgtttgattatttaatttattcgttcaaagaagagaaagatttactgcatg

SEQ ID NO: 200460 - DNA, 601 bp, Human
cttgggctgcaaaattcataccaagtgatccagggaggcctttgaggcattgcattcccaaagtgccttctaaatagttagccagagttatagagtggtgctcagaacaggttgtggacgtttattgaattccatgtgatttaagtgtggttggcgggcagtccacaccaccgccgcgcactgcatgagaaccctgtgtgaagggggcttggggtaatggagcagctgggcccgacccaggtggattcagagtctcccatcactcggagaagcctgcaccttggaaataattcaactccttggtctgacttttgcaagggaaatgtttggggcattttataggtctccatggctgtggtgttttatgacattgaacccaataaaactcgtaatgacacaggatctgccaaggggatcggaccttcccttctggcacaaggaaccattctgttttggtatcccaggaaatgagtggaggaaaatccttgttatttcaagtgaacagggtctgggcaaggtctctgtccctggtcaccttgaccatgtgctacctgtcactgagtctaacggttgctccaattcagctgaaagacaggactca

SEQ ID NO: 200461 - DNA, 601 bp, Human
ttatagagtggtgctcagaacaggttgtggacgtttattgaattccatgtgatttaagtgtggttggcgggcagtccacaccaccgccgcgcactgcatgagaaccctgtgtgaagggggcttggggtaatggagcagctgggcccgacccaggtggattcagagtctcccatcactcggagaagcctgcaccttggaaataattcaactccttggtctgacttttgcaagggaaatgtttggggcattttataggtctccatggctgtggtgttttatgacattgaacccaataaaactygtaatgacacaggatctgccaaggggatcggaccttcccttctggcacaaggaaccattctgttttggtatcccaggaaatgagtggaggaaaatccttgttatttcaagtgaacagggtctgggcaaggtctctgtccctggtcaccttgaccatgtgctacctgtcactgagtctaacggttgctccaattcagctgaaagacaggactcagcaaatagagccttgatctgtccacagggtactcctgtccactgttccagcaaatgtgagaaaacccacttgtcctttgcgagagag

SEQ ID NO: 200462 - DNA, 601 bp, Human
cagggtactcctgtccactgttccagcaaatgtgagaaaacccacttgtcctttgcgagagagaggcaatgctgtcttagtcccatcctaaaggcagaaggacgctaaacaagggtgtttgcgggctacaggcaagagccccgcaatggcctccccgagggatctgaggcccagcaggccatcccaggtctcagaagccttgtaagagcacagtggaggacccttcttgcacgctgagctctgagcagtgaggggaacagctgggagagaggctggggtacaagtgacacagtgcagagaygctgctcccagccgaagctgccactgtgggccttctccatccacccagcccctgtaattgcactgcccccacctctgggctcgagtagcccgtgagcctgctttctggacccatcctggcaagttgctggtggatatacctatgcagcagggcaactacaggcttaggagggctccattccagccctggctgagcatcagaatgggggtgagaggtaaaaaatacagattcctggccctgtttcatactttctgtatcatatgcaggagcccaagaagctattacagtcccagatcattt

SEQ ID NO: 200463 - DNA, 601 bp, Human
ttgcactgcccccacctctgggctcgagtagcccgtgagcctgctttctggacccatcctggcaagttgctggtggatatacctatgcagcagggcaactacaggcttaggagggctccattccagccctggctgagcatcagaatgggggtgagaggtaaaaaatacagattcctggccctgtttcatactttctgtatcatatgcaggagcccaagaagctattacagtcccagatcatttctgatccaacccaccagtcagcaatacctgctcaaatctaggagtcactgacctcagscccctccccttcctggggagctcccactccagggttgaggcacgcacatgactttcacctcttctggagtcctcccctccacattccccaacaagctgctgctctgagattcttcccctagtctctccacacaggccagcagtcactgcaaacgcccagttgcaatgcaccaagaactttcagggttttgccccgttttgctggttggtgccaggagatggaagctctcgagtggggtgtgctgtcccctgggctgggtggaggtggccacagcagagaaggaagatgggtcctggaagt

SEQ ID NO: 200464 - DNA, 601 bp, Human
ctgtatcatatgcaggagcccaagaagctattacagtcccagatcatttctgatccaacccaccagtcagcaatacctgctcaaatctaggagtcactgacctcagccccctccccttcctggggagctcccactccagggttgaggcacgcacatgactttcacctcttctggagtcctcccctccacattccccaacaagctgctgctctgagattcttcccctagtctctccacacaggccagcagtcactgcaaacgcccagttgcaatgcaccaagaactttcagggttttgcccygttttgctggttggtgccaggagatggaagctctcgagtggggtgtgctgtcccctgggctgggtggaggtggccacagcagagaaggaagatgggtcctggaagtacaggcggtctgggcttacatcctccctgtgccactcccggctgagggacctcgagcaagcttgacctccgtcagtcttcatttctttacctgtagagtggaggtctggaagccggcctcctgggatgctttgaggatgaccaggagctgagaggtagtgccaggggtcagccatgtcagtggctccacctgag

SEQ ID NO: 200465 - DNA, 601 bp, Human
ttttcaaagttttgtcttttctaatattgtatcagtgcttaaaatgcaattttccccgccactgtagtgcctcatgtcatatgtgctgcgctgcatgcggggatggcccagaacagcttcctgcagtctgtgttcttcagaacagtggcttcaaacaggaaatcaaacagggaattgctttagttgttcatgaaatcaagtgggctcctgctggcattttaaaaacaaaatcatatagaatagagaatacccaggggcattgcctgtaggaaaggctttgggaggcttttgtatcctggtrtggggatgggtgtgcactcgcgtgcctgggatgtcaggcactgtagatggaacaaaagttcatgcccagatgaactgataagcagatcgtggcctgtacattccatggaataccactcagcctttgaaaggaaggaaattccttcacatactgctacatggatgaaccacgaagacatgacgctaagaggagagagtcagacacaaaggagaaacactgcaattccatttaaatgagtccctggagtagtcccattcagagaacagaaagtagaacgggggtgcgagagcctgacgtctt

SEQ ID NO: 200466 - DNA, 601 bp, Human
actgataagcagatcgtggcctgtacattccatggaataccactcagcctttgaaaggaaggaaattccttcacatactgctacatggatgaaccacgaagacatgacgctaagaggagagagtcagacacaaaggagaaacactgcaattccatttaaatgagtccctggagtagtcccattcagagaacagaaagtagaacgggggtgcgagagcctgacgtctttctcactgacagccacagtaacaaagaacagaaagcccgacagacactgtcgtggatgctcttagaccacaccrcacagtggagacttcacagaccccgagtcctgcacttggtgggtgggtctcacgaccgcccttcccccttgcggtgcaaagaaagttcaccgccctattgctgtctctcccagaggatctttctgacctactcaaggaacatttattaataatctattgagagaaagacaatctagtaggtcttatgcattttctatcttctcccatttttccatgaacgatatctgttatagcagccctgttaaactaactccccgacccagcccccagcccctgacacctgttactctaccatctgtg

SEQ ID NO: 200467 - DNA, 601 bp, Human
actgacagccacagtaacaaagaacagaaagcccgacagacactgtcgtggatgctcttagaccacaccgcacagtggagacttcacagaccccgagtcctgcacttggtgggtgggtctcacgaccgcccttcccccttgcggtgcaaagaaagttcaccgccctattgctgtctctcccagaggatctttctgacctactcaaggaacatttattaataatctattgagagaaagacaatctagtaggtcttatgcattttctatcttctcccatttttccatgaacgatatctgttakagcagccctgttaaactaactccccgacccagcccccagcccctgacacctgttactctaccatctgtgtcgatgaattgggctactttagggacttcatttaggtggaatcatacagtgtttgtccttttgtgtctggccaatttcacttagcacaatgccttcaaggctcacccatgttgtagcatgtgccagaatttccttcctttgtaagactggattccattgtacatatagcccacactgggcttatccatccatctgtccatggacactggctgctgccacattttagccact

SEQ ID NO: 200468 - DNA, 601 bp, Human
acagacactgtcgtggatgctcttagaccacaccgcacagtggagacttcacagaccccgagtcctgcacttggtgggtgggtctcacgaccgcccttcccccttgcggtgcaaagaaagttcaccgccctattgctgtctctcccagaggatctttctgacctactcaaggaacatttattaataatctattgagagaaagacaatctagtaggtcttatgcattttctatcttctcccatttttccatgaacgatatctgttatagcagccctgttaaactaactccccgacccagccyccagcccctgacacctgttactctaccatctgtgtcgatgaattgggctactttagggacttcatttaggtggaatcatacagtgtttgtccttttgtgtctggccaatttcacttagcacaatgccttcaaggctcacccatgttgtagcatgtgccagaatttccttcctttgtaagactggattccattgtacatatagcccacactgggcttatccatccatctgtccatggacactggctgctgccacattttagccactgagcaacactgctgtggacacaagtgtacaaatac

SEQ ID NO: 200469 - DNA, 601 bp, Human
aatattcacagagattgcctctgggtattggggttctgggaaacgttttctttataatttcctgtatttaaatatttttctgtaaagagcacacatcattttcatgtaaagttttgaattttatcaaaagattagtagtcacacacaaaccacagataactttggctaattaatatagagtcaaaaatacttctataaaacaagctatttcaatcaaacatgatgtttaatatgattaaggagggctcattccactgtgaaaagacaacttagcattaagaaccacatagccaggcacggyggctcacaagtgtaatcccagcactttgggaggctaaggtaggaggatcgcttgagcccaggacttcgagaccagtgtggtcaacatggtgaaaacctccctctataaaatttacaagaactagccaggtgtggtggtgcatgcctgtagtcccagctacttgggaggttgaggtgggaggatcacttgtgcccagaagattgaggctgcagtgagccgtgatcatgccacacacttccagcctgggcaatggagcaagaccttgtctcaaaaaaaaaaaaaaaaaaaaaaaggaagaaa

SEQ ID NO: 200470 - DNA, 601 bp, Human
aataaaaatgaatgcaggaattcatagcttgtcaaaattatagccttaagttaaatcagaaaaatgaatgagaaagaataatgaagaaaatcttttaaaaaagaactgaaactgtatcattaaactggagtaattaatttatgtggttctatgcaggaaaagacagagtccagaaataggcccatgattatgtgggaattgagtaagtgataaggaaggcaattcaaatcagtaagaaaaatggcttttaaaaaatttattatctaatatttgatttgtcaagtcattaaataattatctrtaccctaaagatatcctgtattttttctaaaagatttaattttcacctttgatttacaattaataaaattttttcttgagacagagcctcactctgtcaccaaggctggagtgcaatggcaccattatggctcactgcagccttgacttcccaggctcaagcaatcctcccatctaagcctcccgagtagctgggactacaggcgtacatcaccatatccagctaattcttctaatttttgtagaggtgaggtcccactctgttgctcaggctggtctcgaattcctgggcttaagtggt

SEQ ID NO: 200471 - DNA, 601 bp, Human
accccgtctctactaaaaagacaaaaattagcgagcatggtggtgggcgcctgtagtcccagttactagggaggctgaggcaggagaatcacttgaaccccggagaaggagattgcagtgagctgcgatggcgccactatacaccagcctggatggcagagcaagactccatctcaaaacaaacaaaaaaaattagtaagttaaaaagcataacctaaattaagaaaaatatttacatttatgacattaatgtaaaaattaaacatatttatcacataaagaggtcttccatatcattgasaaaatgataaataccttaatgtaaaaagtggtagaagacgtggatgatcaaatcataataagagaaacacaagtggctaataagtacatgataaaatcaatagaaaagtaaattaatactatgttgttcatcacttttcactgagcagattgacaaagttgtttttttttttttaatttgttataaaccattgtccagggactggagaaatggcttccttcatcacggtgagaatgtaaaccagtcttacctttataaacattaatttagcttcatagatcaagatctttaaaaatgtgc

SEQ ID NO: 200472 - DNA, 601 bp, Human
caaaatatatcggaagacttagaaaggttatgtatgctcttgagcgtgggaatcccacttgtgggatttttaacctcaacaaaaattaagggaagatatgaggaaagagaaagggcatgagcaaaggacatttttgcagcatgtttatgatcttgagaaaatggaaacagctggggtgtgcggcagaagaagtggggaaaatgacaacggttcattaaacctcacgatcagatgctgacagcccctcacaggttgctgcagacaaaacagggaacgacaggaaaaagatgaccgtgatacrctctgctaaaagcaggtcgcaaaacaggatgtagataatgatcccattttgcttttttacaaaaaaaaaaaaaggccatggaaaattacatatcacgaatgttcagagtggctgtctctggatgatggcattggagttaattttatctttcactctattttctgaatttcctatatcaaaagcaaattgatggtgtgaaggggaaagcatatttaatgtgattcctaaaaggctcagccctccctgcatggattgagcactgaaagaagagggttctgtcacctctttcgtcctgaccct

SEQ ID NO: 200473 - DNA, 601 bp, Human
gttcagtgcttatataattttactgtgtttcatcagtaggttagtactcaaaactttttcagttgaaaatcaggcactacaataatataactatgtaaattttgttctgtagaattaagtgggataattgaatacatagagaaggccatctgatactatgtcattaaaatttgccatttgagggagaatttcccaaatatcaaggttttatgaagcctctttcgttttcttttatgtgcttgggggtcacactcggctatccttatttcttataactcatgtcattcttatttgcagtttygttagaggacgtcctagtgtcgcttattctttcctgtacgtgcatgctcgcaaggggtctttcactgtccttaaggcttaatgtggacgtctagacagcaataagctttttctaccagcttacaaaactcaacacaccaaagactatacaaaactcaatacccttcaatggcttgcaatgctctttttaaaagtcacctctaagggggtgtaaataacattccacaaaattcacccatttggggcacaattatgcatttttgcaaatatatactcttgtataaagtccaccacaatcaaa

SEQ ID NO: 200474 - DNA, 601 bp, Human
ctgtcataattttgcaaaggtagtttcaatccccctcacacacacttgggcttcagcacccctcaatcctgaggtgttagctacggagatgagaaaaggctaatgattgctctaacttcttcctgctgacagggggcatatttgggggaggggttgaccccagggtaaaaggagtggaagtgtcttgcagttgcctgtatgtattcaagtgcaacttgttggggtccaacatgtgtataacgaaaacattggtgctcttatccacagatttagtacagcatttaagaagaaaaataatgasccgtaaaaaggaacgagattatgtcctttgcatggaagtggatggaggtggaaggcattatcctcagcaaactaacgcaggaacataaaaccaaacactgtatgttctcaattataagtgggagctgaacggtgagaacatatggacacacagaggggaataacacacactggggcctattggggagcgggaaggagagcatcaggaaaaatagctaatggatgctggaccgaatacttaggtgatgggttgataggtgcagcaaaccaccatagcacacgtttacatatgtaacaaacc

SEQ ID NO: 200475 - DNA, 601 bp, Human
aagaccaatttatttgcaaaataagcttgccttattatactttgcctaattatttacataaagtgcagcaagaataattattggccatataggctctttttttctaactggctttgctggaatttttttcataaggaatctcagattagaccttttaaaagtctcttgagcccagccaaggatttatttgtgcctgcagatacttgtatgaattgggtgaattcctttcttcttgaggtcccaacaaagcttggagttcctgggcctgtcagaaagtgacattctttatttgccacaggtygggaatcctgtacaggacaaggtaggaggccagttcctccaaggggctttcatcagctctgtaggtcagcctcgatttcttaaagcagtctgaaaatatgtcatttcagtcaaagccttggtaaaataagcagtgtctccaactgtgtcttgctacaaaagaaaacacattcttattgaacttactcaagtaactatattgccttatgttaaaaatagtcacagataatttccaaattctggagaaggcaggtaaagagaaagaaatatgctctaaattttgtttacaggagtatatttt

SEQ ID NO: 200476 - DNA, 601 bp, Human
ggtaggaggccagttcctccaaggggctttcatcagctctgtaggtcagcctcgatttcttaaagcagtctgaaaatatgtcatttcagtcaaagccttggtaaaataagcagtgtctccaactgtgtcttgctacaaaagaaaacacattcttattgaacttactcaagtaactatattgccttatgttaaaaatagtcacagataatttccaaattctggagaaggcaggtaaagagaaagaaatatgctctaaattttgtttacaggagtatattttgctcaattgttaaaagttgtattctcagtagaagttttctttactctgaaaaacaaaacaaaaagaatcagcaacattttaagtgaaaagtcgaaaagatttttccagttactgaacgttttggttgtttccagctgggagctaattaatatgagtaacaatgctaagaacatatatgtcaagtctttctgtggtcatatgtttttatttctcttggataagcaacaagaagtgaaatatctgggtcacaggttaagaagctcccaaattgtttcctaaagttgtttcgtttcaccttaccatcagcctcaggtgagcatt

SEQ ID NO: 200477 - DNA, 601 bp, Human
gtaggaggccagttcctccaaggggctttcatcagctctgtaggtcagcctcgatttcttaaagcagtctgaaaatatgtcatttcagtcaaagccttggtaaaataagcagtgtctccaactgtgtcttgctacaaaagaaaacacattcttattgaacttactcaagtaactatattgccttatgttaaaaatagtcacagataatttccaaattctggagaaggcaggtaaagagaaagaaatatgctctaaattttgtttacaggagtatattttgctcaattgttaaaagttgtaatctcagtagaagttttctttactctgaaaaacaaaacaaaaagaatcagcaacattttaagtgaaaagtcgaaaagatttttccagttactgaacgttttggttgtttccagctgggagctaattaatatgagtaacaatgctaagaacatatatgtcaagtctttctgtggtcatatgtttttatttctcttggataagcaacaagaagtgaaatatctgggtcacaggttaagaagctcccaaattgtttcctaaagttgtttcgtttcaccttaccatcagcctcaggtgagcattc

SEQ ID NO: 200478 - DNA, 601 bp, Human
taggaggccagttcctccaaggggctttcatcagctctgtaggtcagcctcgatttcttaaagcagtctgaaaatatgtcatttcagtcaaagccttggtaaaataagcagtgtctccaactgtgtcttgctacaaaagaaaacacattcttattgaacttactcaagtaactatattgccttatgttaaaaatagtcacagataatttccaaattctggagaaggcaggtaaagagaaagaaatatgctctaaattttgtttacaggagtatattttgctcaattgttaaaagttgtatkctcagtagaagttttctttactctgaaaaacaaaacaaaaagaatcagcaacattttaagtgaaaagtcgaaaagatttttccagttactgaacgttttggttgtttccagctgggagctaattaatatgagtaacaatgctaagaacatatatgtcaagtctttctgtggtcatatgtttttatttctcttggataagcaacaagaagtgaaatatctgggtcacaggttaagaagctcccaaattgtttcctaaagttgtttcgtttcaccttaccatcagcctcaggtgagcattct

SEQ ID NO: 200479 - DNA, 601 bp, Human
gttttctttactctgaaaaacaaaacaaaaagaatcagcaacattttaagtgaaaagtcgaaaagatttttccagttactgaacgttttggttgtttccagctgggagctaattaatatgagtaacaatgctaagaacatatatgtcaagtctttctgtggtcatatgtttttatttctcttggataagcaacaagaagtgaaatatctgggtcacaggttaagaagctcccaaattgtttcctaaagttgtttcgtttcaccttaccatcagcctcaggtgagcattctagtttctccayatgcttgccaacacttggtatgatcggtcatctaattttagcatctgggtggttgtgtggtggcatttcactgtggttttagttgccattcccctaatgactgacgacaccgaacacctgttcatgggtttgtgtgctgctcagctgtcttctctgttcaactgtttgttaaattgaatttttggcttcttttatagagtttaaaagttaattatatattctcatatagatacatgtttttcaaaaatgtcctgcctgtctctggtttagctatttcttttcttaatggtgtttttaaag

SEQ ID NO: 200480 - DNA, 601 bp, Human
tctgtggtcatatgtttttatttctcttggataagcaacaagaagtgaaatatctgggtcacaggttaagaagctcccaaattgtttcctaaagttgtttcgtttcaccttaccatcagcctcaggtgagcattctagtttctccatatgcttgccaacacttggtatgatcggtcatctaattttagcatctgggtggttgtgtggtggcatttcactgtggttttagttgccattcccctaatgactgacgacaccgaacacctgttcatgggtttgtgtgctgctcagctgtcttctytgttcaactgtttgttaaattgaatttttggcttcttttatagagtttaaaagttaattatatattctcatatagatacatgtttttcaaaaatgtcctgcctgtctctggtttagctatttcttttcttaatggtgtttttaaagtgcagaagttcttaattttgaaaagtctaatttatcaatttttcttgtatactttatgatcttctattctaagggaataatctattctaagggaatagaaggtcacgtttgtatgcttctgactcatattctttatatcctttgtgacaccaag

SEQ ID NO: 200481 - DNA, 601 bp, Human
caggttaagaagctcccaaattgtttcctaaagttgtttcgtttcaccttaccatcagcctcaggtgagcattctagtttctccatatgcttgccaacacttggtatgatcggtcatctaattttagcatctgggtggttgtgtggtggcatttcactgtggttttagttgccattcccctaatgactgacgacaccgaacacctgttcatgggtttgtgtgctgctcagctgtcttctctgttcaactgtttgttaaattgaatttttggcttcttttatagagtttaaaagttaattayatattctcatatagatacatgtttttcaaaaatgtcctgcctgtctctggtttagctatttcttttcttaatggtgtttttaaagtgcagaagttcttaattttgaaaagtctaatttatcaatttttcttgtatactttatgatcttctattctaagggaataatctattctaagggaatagaaggtcacgtttgtatgcttctgactcatattctttatatcctttgtgacaccaaggtcacaaagatttccttctaggttttcttctaagaatataatgtacctctttaaagcagct

SEQ ID NO: 200482 - DNA, 601 bp, Human
catattctttatatcctttgtgacaccaaggtcacaaagatttccttctaggttttcttctaagaatataatgtacctctttaaagcagcttttaagattgtttttatttatcattggttttcaacaatacgattataatgtaccttggtgtggttttcttcatacttggggttgatattcttgagtcttcgggtctatagcttctatcaaatttggaatttccatttttggtttctttaagtttcatagtctttctggtagcccagttacgtgtcttctgactgcgtgctaatttctccscagtcactgatgctctgttgtttatgttcacctttttctccctgtgcttcactgtgggtactttcaattgcagtgtctccaagccctctgaccttccttctgcagcacccaatgtactattcatcccatctagagttttggttgtttgtttgtttgtttttgagacagagtctcgccctgttgcccaggctggagtgcagtggcaccatctcggctcactgcaaccacagcctctcgagttcaagtgattcttctgcatcagcctcccaagtagctgtgattacaggcacctgccaccaa

SEQ ID NO: 200483 - DNA, 601 bp, Human
ttcatctgtaaaatgggaaggtatatgtctgctgtcagggctacatataatacatgaaaagcatgcagtaaaatgcccagccttgagtcagaaggtgtactaggcactgtgccagcatcattagtattcatgtttttatgtgataggcaaatcctgcaaccgttttatgagttaattttaaatctctgcctctctagcaggacatctgtgtctctagatccactcagtaattacaatcaacccaagcatgttaaaggcctgagaccttttcttttctttttctttctttaacattttccawtctcatgtttgaaagcataaaagagaacctttcagtctaaatgttctcctgcaccctcaaacccgatggaggtgcttctcactgcacgctcccttcttacacattccacctctgggttctgccaaggaaacattggagaaacagctccaaaggattgaatgatgtccagggccttttaagagaggttcaagtcgtgaccagatgtgtatctgggtaagatacgtgtgaacctccgtgggaaagaccaagggtttgaagtcagagatgtggctcaaatctctcttctgtgcttcagtttct

SEQ ID NO: 200484 - DNA, 601 bp, Human
ttgtatggaggacagaaataattcatttcatggagagacaagaggatcactggcagtaaaactgcaggcattatttatgggagactcaaaggagggaatgccccgtgttggcgggcctgcctttcaatccttgtcacaagtcatgatccagaagctcggccaattgaagaaagggtctccatgaagtggagctcatgacctgcctgcatcagcatcactgggggcattttttaaaaatgcagataccagcactgctggggctggggttgggagtctgcaaactcccctgctggttaaaatrcaaactgaggtttcagaactattgtgccaaagaatcataactgactccattgggaagtaatgacccatgatttgatttctcatttaatttttcaaaatgcaaacaatgcaaaaagttaaaaattgaaaaataggttaaggcccatagtctcatcaatacaagacacaactgtagttggattaacattttggcatattgctaacatattttaataatcactactgtgagagttttttaaaacataaatttacatggtgttccccccccaaaaaaattcactcacataaaggaattttatcc

SEQ ID NO: 200485 - DNA, 601 bp, Human
catagtctcatcaatacaagacacaactgtagttggattaacattttggcatattgctaacatattttaataatcactactgtgagagttttttaaaacataaatttacatggtgttccccccccaaaaaaattcactcacataaaggaattttatccgtccccagaattacctaatgaatttcaagcttctctgttagcagaatcaaatgtaggtgactcgataaacaagtgtctgtctttgacttaacacagctttataaaaatgccttcttccttccttcctgaaggtctgctcagcmccctcaaactttttaccacctgaaaatcttttctatcaattttaccacaatggggggaggtgaatttccacaaaagatcttttcactttaaaaaattgaaatggccacataatttctcctcctaactgtgccgaagtacctaaaagtcacaggttggcattgctaggtcagccttttgcaggggccacacgtgcccaaggcccttacacacccagccaggtgttacagagcagcctctcaccatcaggctctgtgctagtgctgggaaaagattctgctggcatttaaaagtattgcaca

SEQ ID NO: 200486 - DNA, 601 bp, Human
tcaaaggcttgaaactaaccaaagtcagagcagaagggactcctgtttaaaggaaacctaagacgttgagttatatacgaaccttgtttgaatcctgagtaggacaaactaagcaagaagctatttttaagtcaattgttaaaatgtgattatgaattgggttcaatggctggatggttagatgataccatggaaatattgctagttttgttagatgtgatgaagtaacattggggttatgtgagcaaatgtctccatgctttagaaacaaatgcaaaatatggggtggtgaaatgacttrcttcactacattgatttcatgttgtttccaagtttcattcatttagaggaaataaaacgatatgatgtaaaatactgcaacccagaaaacaattttaaagataattattgaatgtgggtgatgagtgtagaagagttctattattattaatattattattttatttatttttttgagacagtctcactctgtcaactaggctggagtgcagtggcaggatcttggctcactgcaacctccacctcctggtttcaagcgattctcccacctcaacctcccaagtagctgggattacaggca

SEQ ID NO: 200487 - DNA, 601 bp, Human
caaagtcagagcagaagggactcctgtttaaaggaaacctaagacgttgagttatatacgaaccttgtttgaatcctgagtaggacaaactaagcaagaagctatttttaagtcaattgttaaaatgtgattatgaattgggttcaatggctggatggttagatgataccatggaaatattgctagttttgttagatgtgatgaagtaacattggggttatgtgagcaaatgtctccatgctttagaaacaaatgcaaaatatggggtggtgaaatgacttgcttcactacattgatttcrtgttgtttccaagtttcattcatttagaggaaataaaacgatatgatgtaaaatactgcaacccagaaaacaattttaaagataattattgaatgtgggtgatgagtgtagaagagttctattattattaatattattattttatttatttttttgagacagtctcactctgtcaactaggctggagtgcagtggcaggatcttggctcactgcaacctccacctcctggtttcaagcgattctcccacctcaacctcccaagtagctgggattacaggcatgcgcctggctaattttta

SEQ ID NO: 200488 - DNA, 601 bp, Human
taagacgttgagttatatacgaaccttgtttgaatcctgagtaggacaaactaagcaagaagctatttttaagtcaattgttaaaatgtgattatgaattgggttcaatggctggatggttagatgataccatggaaatattgctagttttgttagatgtgatgaagtaacattggggttatgtgagcaaatgtctccatgctttagaaacaaatgcaaaatatggggtggtgaaatgacttgcttcactacattgatttcatgttgtttccaagtttcattcatttagaggaaataaaaygatatgatgtaaaatactgcaacccagaaaacaattttaaagataattattgaatgtgggtgatgagtgtagaagagttctattattattaatattattattttatttatttttttgagacagtctcactctgtcaactaggctggagtgcagtggcaggatcttggctcactgcaacctccacctcctggtttcaagcgattctcccacctcaacctcccaagtagctgggattacaggcatgcgcctggctaatttttataggcacgtgcctggctaatttttgtatttgtggtagag

SEQ ID NO: 200489 - DNA, 601 bp, Human
gaatttggaattctggatgttggtgagatgctccatatgggatctcatgccggcagctagcatggcattgtgatcgcgacacccagggtgagtcccagctttgccagtaggtacccctgttctacctggatgctacccacctatgtctggcaggtcaaatcagaaaggcaaagcctccagcacataacatggcaaggcttccagatacaaaatagcaaaactattttgccacaggggagatgatagggaatctgaactgtcccctccaagggacacagagcctcaggcagggccacaggtrcacctgttttgtgcagagggctcaagcagccctggagacagtaacaccctccagctgccagctctgccaccttcagcatgaccttaccaagccacctcgcctcgccttcttcagtggtaaaatgaggataactgtaaccaatttatcaaggctaacatgtattagaaaaaaagaaaaactcgttatccgtcaagtgcttttcaaccatgtcatgctagccaagtgcaaataaggggtttctagtttctctatttttagttgatgcctccaccacaccccttgtttgactgaagctgtgtt

SEQ ID NO: 200490 - DNA, 601 bp, Human
gtcaaatcagaaaggcaaagcctccagcacataacatggcaaggcttccagatacaaaatagcaaaactattttgccacaggggagatgatagggaatctgaactgtcccctccaagggacacagagcctcaggcagggccacaggtgcacctgttttgtgcagagggctcaagcagccctggagacagtaacaccctccagctgccagctctgccaccttcagcatgaccttaccaagccacctcgcctcgccttcttcagtggtaaaatgaggataactgtaaccaatttatcaaggcwaacatgtattagaaaaaaagaaaaactcgttatccgtcaagtgcttttcaaccatgtcatgctagccaagtgcaaataaggggtttctagtttctctatttttagttgatgcctccaccacaccccttgtttgactgaagctgtgtttcaggctttgagcatctcccaaagcaaacattgactgccctgctctggtgaaagtctgcattagagggcctagctggtttcaaataaacaaacaactcccctttcccacttcccctcctcttgctgactcccccgactagacacacatgcaca

SEQ ID NO: 200491 - DNA, 601 bp, Human
gcacacacaccgttttttaagtccgctggttttttttttgttttgttttgccttacaccacacctctgttttgtactctcccttcctctaacaataaccacagtaaacaacttggtgttcatcctccccagcctctttctgtgtaatatgcaaacatatctacacgcctgaatagaggtttcttttcatttggtgtttgcaaatatgggattccctcatgcacctctttgggtcttacttttctcgtgtaacaacatggtaccgaaattcctcttgacctcactggtgaagatccagcacmttttttttagtagttgtgtgagagatttatagagtgtagatttattcaacaagtctttaattgctgggcagttacattgttgttttctgtttgggattttttttcgggggaggggattgtttttccaactattactacaacaaacattttcatctctcacatgtgtctatataatgatgttttattaacctgagatagtccagagtgggactgaaaatcaaaaggtatgtgtgcttttttattttaacagaatttaaaagattgccctttaaaagaatttaaaagattgcttcttccaat

SEQ ID NO: 200492 - DNA, 601 bp, Human
aagtccgctggttttttttttgttttgttttgccttacaccacacctctgttttgtactctcccttcctctaacaataaccacagtaaacaacttggtgttcatcctccccagcctctttctgtgtaatatgcaaacatatctacacgcctgaatagaggtttcttttcatttggtgtttgcaaatatgggattccctcatgcacctctttgggtcttacttttctcgtgtaacaacatggtaccgaaattcctcttgacctcactggtgaagatccagcacattttttttagtagttgtrtgagagatttatagagtgtagatttattcaacaagtctttaattgctgggcagttacattgttgttttctgtttgggattttttttcgggggaggggattgtttttccaactattactacaacaaacattttcatctctcacatgtgtctatataatgatgttttattaacctgagatagtccagagtgggactgaaaatcaaaaggtatgtgtgcttttttattttaacagaatttaaaagattgccctttaaaagaatttaaaagattgcttcttccaataatatttcatgttttgtc

SEQ ID NO: 200493 - DNA, 601 bp, Human
atgcacctctttgggtcttacttttctcgtgtaacaacatggtaccgaaattcctcttgacctcactggtgaagatccagcacattttttttagtagttgtgtgagagatttatagagtgtagatttattcaacaagtctttaattgctgggcagttacattgttgttttctgtttgggattttttttcgggggaggggattgtttttccaactattactacaacaaacattttcatctctcacatgtgtctatataatgatgttttattaacctgagatagtccagagtgggactgaaamtcaaaaggtatgtgtgcttttttattttaacagaatttaaaagattgccctttaaaagaatttaaaagattgcttcttccaataatatttcatgttttgtctaataaatatttattaagcccacactctgtgccagacattggtttagcaatttggattcagcaatgaataaaacaaagattccagctctcacagaagattaatcctagaaatggagcgtgaaggaacaaatgaaacaataattataacaaacattttactatttgggtttgtgttgcactaacttcctatttcttatct

SEQ ID NO: 200494 - DNA, 601 bp, Human
ggtcttacttttctcgtgtaacaacatggtaccgaaattcctcttgacctcactggtgaagatccagcacattttttttagtagttgtgtgagagatttatagagtgtagatttattcaacaagtctttaattgctgggcagttacattgttgttttctgtttgggattttttttcgggggaggggattgtttttccaactattactacaacaaacattttcatctctcacatgtgtctatataatgatgttttattaacctgagatagtccagagtgggactgaaaatcaaaaggtatgwgtgcttttttattttaacagaatttaaaagattgccctttaaaagaatttaaaagattgcttcttccaataatatttcatgttttgtctaataaatatttattaagcccacactctgtgccagacattggtttagcaatttggattcagcaatgaataaaacaaagattccagctctcacagaagattaatcctagaaatggagcgtgaaggaacaaatgaaacaataattataacaaacattttactatttgggtttgtgttgcactaacttcctatttcttatctttacacatttttc

SEQ ID NO: 200495 - DNA, 601 bp, Human
gtttttccaactattactacaacaaacattttcatctctcacatgtgtctatataatgatgttttattaacctgagatagtccagagtgggactgaaaatcaaaaggtatgtgtgcttttttattttaacagaatttaaaagattgccctttaaaagaatttaaaagattgcttcttccaataatatttcatgttttgtctaataaatatttattaagcccacactctgtgccagacattggtttagcaatttggattcagcaatgaataaaacaaagattccagctctcacagaagattratcctagaaatggagcgtgaaggaacaaatgaaacaataattataacaaacattttactatttgggtttgtgttgcactaacttcctatttcttatctttacacatttttctattgaatgaattatatgctgcaatatacttcctgtcaaaagtttatgagctttgtatatattatgaatagacatttatctgatgctttgcaatctcttacccaatctattgcttatctacgaacttcatgagtagtttcttataccatctaatatttttaatgtttatgaatttgtactttttttgtt

SEQ ID NO: 200496 - DNA, 601 bp, Human
aggagaaaaaatgggaatagatcattcctatagaagaaattggaaatgtctttaaagatttactatttgaaagggccccagacacagatggcttcacaactgagttctatttagcctgtgaggaacagataaccccactgttatgaaaccactcaagaagatagaaaaaaaaaaaaagagagctcctcaatatctgttacaaagccagcgcaccttaatgctaatgcctcatagacaaatctcccttgggaatatagattctcattctaaataaaatattagcaaatagggccgagtgtgrtggctgacacctgcaatcccagtactttgggaggctgagatgggcaggtcacttgagctctggagtttgagaccagcctgcatgacatggcaaaaccctgtctctaccaaaaaataaaaaatttagtagggcatggtagcacatgcctgtcatcccagctactcgagaggctgaggtgggaggatcaccttagcctgggaggcagaggttgcagtgagccaagattaggtcgtgggactccagcgtaggcaacagagtgagacactgtctcaaaacaaaataattagcaaataagaatcc

SEQ ID NO: 200497 - DNA, 601 bp, Human
tttactagagatggagattcactgtgttagccaggctggtctcgaactcctgacctcaagggatctgcccgcctcggccttccaaagtgctgggattacaggtgtgagccaccgtgcccagccaaacccataatctcttatccaaacttctgaaaccctaaatctctgaaaactgaagtgatacttgtaaccctggcactataattcacttagtggtaaagctgatctgagctcacataaagaaatacttagatataaaaagtgttggtctttaaaactgtgaattattatgtgttctgtwtgtaaggcatacttgaaaaaacatacttgtgaatttttcgcttctgtggcttgctgtcctatatcgaaatttgttatagtgttttctttttcaaggtgggtttgaggagcaatgacatgaggaatgtgctttcagctctctggaagaaatgcatgactgtgtttcacttaatcgaagacgccactgataggaaggctagcatttaattatgtatcactaaaagagaaaaaaaatgctgctactagttatactgcaaagcatcctccattgtgagacacctcccagttcagagatattgaa

SEQ ID NO: 200498 - DNA, 601 bp, Human
gaaatacttagatataaaaagtgttggtctttaaaactgtgaattattatgtgttctgtatgtaaggcatacttgaaaaaacatacttgtgaatttttcgcttctgtggcttgctgtcctatatcgaaatttgttatagtgttttctttttcaaggtgggtttgaggagcaatgacatgaggaatgtgctttcagctctctggaagaaatgcatgactgtgtttcacttaatcgaagacgccactgataggaaggctagcatttaattatgtatcactaaaagagaaaaaaaatgctgctmctagttatactgcaaagcatcctccattgtgagacacctcccagttcagagatattgaaaagtgaaaaaaggtccatcttagaattgatgaaatatggtgtgtacatccaaaggaaatcaccactaacaacacgcccttctgacacgcgtggggacttgggtgcttcctctctatgatgtctgcatctcgaggaagagcccgatgtaagtgcaggagtgcagtggtctcaggtcagactggactccagagctggctctcacgggccagttgtttgaccctgagcaaactccttaacatat

SEQ ID NO: 200499 - DNA, 601 bp, Human; identical to SEQ ID NO: 23027

SEQ ID NO: 200500 - DNA, 601 bp, Human; identical to SEQ ID NO: 23028

SEQ ID NO: 200501 - DNA, 601 bp, Human; identical to SEQ ID NO: 23029

SEQ ID NO: 200502 - DNA, 601 bp, Human; identical to SEQ ID NO: 23030

SEQ ID NO: 200503 - DNA, 601 bp, Human; identical to SEQ ID NO: 23031

SEQ ID NO: 200504 - DNA, 601 bp, Human; identical to SEQ ID NO: 23032

SEQ ID NO: 200505 - DNA, 601 bp, Human; identical to SEQ ID NO: 23033

SEQ ID NO: 200506 - DNA, 601 bp, Human; identical to SEQ ID NO: 23034

SEQ ID NO: 200507 - DNA, 601 bp, Human; identical to SEQ ID NO: 23035

SEQ ID NO: 200508 - DNA, 601 bp, Human; identical to SEQ ID NO: 23036

SEQ ID NO: 200509 - DNA, 601 bp, Human; identical to SEQ ID NO: 23037

SEQ ID NO: 200510 - DNA, 601 bp, Human; identical to SEQ ID NO: 23038

SEQ ID NO: 200511 - DNA, 601 bp, Human; identical to SEQ ID NO: 23039

SEQ ID NO: 200512 - DNA, 601 bp, Human; identical to SEQ ID NO: 23040

SEQ ID NO: 200513 - DNA, 601 bp, Human; identical to SEQ ID NO: 23041

SEQ ID NO: 200514 - DNA, 601 bp, Human; identical to SEQ ID NO: 23042

SEQ ID NO: 200515 - DNA, 601 bp, Human; identical to SEQ ID NO: 23043

SEQ ID NO: 200516 - DNA, 601 bp, Human; identical to SEQ ID NO: 23044

SEQ ID NO: 200517 - DNA, 601 bp, Human; identical to SEQ ID NO: 23045

SEQ ID NO: 200518 - DNA, 601 bp, Human; identical to SEQ ID NO: 23046

SEQ ID NO: 200519 - DNA, 601 bp, Human; identical to SEQ ID NO: 23047

SEQ ID NO: 200520 - DNA, 601 bp, Human; identical to SEQ ID NO: 23048

SEQ ID NO: 200521 - DNA, 601 bp, Human; identical to SEQ ID NO: 23049

SEQ ID NO: 200522 - DNA, 601 bp, Human; identical to SEQ ID NO: 23050

SEQ ID NO: 200523 - DNA, 601 bp, Human; identical to SEQ ID NO: 23051

SEQ ID NO: 200524 - DNA, 601 bp, Human; identical to SEQ ID NO: 23052

SEQ ID NO: 200525 - DNA, 601 bp, Human
cggggtgctgagactggcattttgtaaagtggaaggcactcggcagcagtaggtagatccttcctgatgcaccgagagatctgagggtgcaaactcccacttcccgcgcccatggggagccactcacaccagagagaggctggcaccaccaggggcgggtcactttgcagaagggcacttgcaacttctcttttcttaggatgcctgctggatttcctgaagacagatgaagggagcagattgtcactcccaaggctgattgacatgtcggcgcaggttggtgaagtaccaggtgcagagraagggcggcatgtgccacctgctgcccacaatggctgctcgtgccttaccaccccatcctctcagccagcaggagaagtcagggggtactgaaggccaccttcctctaggcagatatccccaaggtcacccactgcacttggacttgcaaaccctggccactgtgcctcctgccccacgcagctgtgagggagcccagggaatggagccttagacccgggctgctgtgttggaatgaggctattctgttccgaaggaagagagggcgaatgaatgtcatgggaaacacacagagttagca

SEQ ID NO: 200526 - DNA, 601 bp, Human
aaagtggaaggcactcggcagcagtaggtagatccttcctgatgcaccgagagatctgagggtgcaaactcccacttcccgcgcccatggggagccactcacaccagagagaggctggcaccaccaggggcgggtcactttgcagaagggcacttgcaacttctcttttcttaggatgcctgctggatttcctgaagacagatgaagggagcagattgtcactcccaaggctgattgacatgtcggcgcaggttggtgaagtaccaggtgcagagaaagggcggcatgtgccacctgctgyccacaatggctgctcgtgccttaccaccccatcctctcagccagcaggagaagtcagggggtactgaaggccaccttcctctaggcagatatccccaaggtcacccactgcacttggacttgcaaaccctggccactgtgcctcctgccccacgcagctgtgagggagcccagggaatggagccttagacccgggctgctgtgttggaatgaggctattctgttccgaaggaagagagggcgaatgaatgtcatgggaaacacacagagttagcaagagttccattgaacccggcaggca

SEQ ID NO: 200527 - DNA, 601 bp, Human
caagagttccattgaacccggcaggcaagtgtgttctgttgtgacctcatctcttccttagatggtgcccacaaacatctcctgtaggacttcccatcccaggggccctcagcctttgcacagccctggcgtcgaccccaggctgatgggcaggcctgagctacacacagatgccagggacatgacttctctgagccctggaggacagccccaccttctgccaccagggaattgcgagtgctggacctcctcggctacccaggactggtcctcagtgtccctcacgttcacatgcagaacyttctggactccatggggtgaagagcagagtggagaggagggttttagccgagagctctagctggcaggaagcacatctggtggccctgttaaaactggaactctcagcagaaaagttttggtctgtggtcagcctgtgaggcacacacgtgcgtacacatacacacacacatacagctgccaccgagaggaaacgctcccacccaccgcccacatcagccctcccacctcgcccctcgcccagccttacccagtagcgccgctgcaggaactgatgccacaacgcctttttccgctgagg

SEQ ID NO: 200528 - DNA, 601 bp, Human
cccaggactggtcctcagtgtccctcacgttcacatgcagaactttctggactccatggggtgaagagcagagtggagaggagggttttagccgagagctctagctggcaggaagcacatctggtggccctgttaaaactggaactctcagcagaaaagttttggtctgtggtcagcctgtgaggcacacacgtgcgtacacatacacacacacatacagctgccaccgagaggaaacgctcccacccaccgcccacatcagccctcccacctcgcccctcgcccagccttacccagtagygccgctgcaggaactgatgccacaacgcctttttccgctgaggtgggcagacagccatctgggcaggctggttttggaaaatgagtgctggtaaccggcttcaaaccccagggcagtgataagcctgcccactgctgctgcttcctttccccttccttctctcaccctccgctgtctcctattcaatccccactacacccccttgggaaatctcgtgtgacccaggggcaaaggatgtgaaaagccatcggagtttaatacctggatgtagccacagaatcgggggtgaggagccagaaa

SEQ ID NO: 200529 - DNA, 601 bp, Human
cacacacatacagctgccaccgagaggaaacgctcccacccaccgcccacatcagccctcccacctcgcccctcgcccagccttacccagtagcgccgctgcaggaactgatgccacaacgcctttttccgctgaggtgggcagacagccatctgggcaggctggttttggaaaatgagtgctggtaaccggcttcaaaccccagggcagtgataagcctgcccactgctgctgcttcctttccccttccttctctcaccctccgctgtctcctattcaatccccactacacccccttggraaatctcgtgtgacccaggggcaaaggatgtgaaaagccatcggagtttaatacctggatgtagccacagaatcgggggtgaggagccagaaaatcagaacttcccagaagggcagcctctaaccacatgctgaccatgccaatggctctctaagcacacatgtacacacacacactctcacacacataaaaacacagactcacacacacacggacaaacacaaacacatacacagactcacacagacacgcaaactcacacacagacagacacacacacacacacagacacacagactc

SEQ ID NO: 200530 - DNA, 601 bp, Human
tacagctgccaccgagaggaaacgctcccacccaccgcccacatcagccctcccacctcgcccctcgcccagccttacccagtagcgccgctgcaggaactgatgccacaacgcctttttccgctgaggtgggcagacagccatctgggcaggctggttttggaaaatgagtgctggtaaccggcttcaaaccccagggcagtgataagcctgcccactgctgctgcttcctttccccttccttctctcaccctccgctgtctcctattcaatccccactacacccccttgggaaatctcrtgtgacccaggggcaaaggatgtgaaaagccatcggagtttaatacctggatgtagccacagaatcgggggtgaggagccagaaaatcagaacttcccagaagggcagcctctaaccacatgctgaccatgccaatggctctctaagcacacatgtacacacacacactctcacacacataaaaacacagactcacacacacacggacaaacacaaacacatacacagactcacacagacacgcaaactcacacacagacagacacacacacacacacagacacacagactcacacacac

SEQ ID NO: 200531 - DNA, 601 bp, Human
ttctctcaccctccgctgtctcctattcaatccccactacacccccttgggaaatctcgtgtgacccaggggcaaaggatgtgaaaagccatcggagtttaatacctggatgtagccacagaatcgggggtgaggagccagaaaatcagaacttcccagaagggcagcctctaaccacatgctgaccatgccaatggctctctaagcacacatgtacacacacacactctcacacacataaaaacacagactcacacacacacggacaaacacaaacacatacacagactcacacagacaygcaaactcacacacagacagacacacacacacacacagacacacagactcacacacacaaactcacacagacacacaaatacacagactcagactcaaacacaaactcacacaaacacatttacacaaactcacaaactcacacacacaaacacacacacaaacacgcaaacttacacacacatgagcagacacacacccggcccttctgggctcttcttttcttactccataggaagccatgcaaagtctcgccagacctttcttccaaggccagatctggccaaccccacaggaaccc

SEQ ID NO: 200532 - DNA, 601 bp, Human
ggatgtgaaaagccatcggagtttaatacctggatgtagccacagaatcgggggtgaggagccagaaaatcagaacttcccagaagggcagcctctaaccacatgctgaccatgccaatggctctctaagcacacatgtacacacacacactctcacacacataaaaacacagactcacacacacacggacaaacacaaacacatacacagactcacacagacacgcaaactcacacacagacagacacacacacacacacagacacacagactcacacacacaaactcacacagacacamaaatacacagactcagactcaaacacaaactcacacaaacacatttacacaaactcacaaactcacacacacaaacacacacacaaacacgcaaacttacacacacatgagcagacacacacccggcccttctgggctcttcttttcttactccataggaagccatgcaaagtctcgccagacctttcttccaaggccagatctggccaaccccacaggaaccctgcaatcacaatccctcgggccccactttgcagccagatgccaccggttcccatgccccatgcctcgccacccctc

SEQ ID NO: 200533 - DNA, 601 bp, Human
acaaacacaaacacatacacagactcacacagacacgcaaactcacacacagacagacacacacacacacacagacacacagactcacacacacaaactcacacagacacacaaatacacagactcagactcaaacacaaactcacacaaacacatttacacaaactcacaaactcacacacacaaacacacacacaaacacgcaaacttacacacacatgagcagacacacacccggcccttctgggctcttcttttcttactccataggaagccatgcaaagtctcgccagacctttcytccaaggccagatctggccaaccccacaggaaccctgcaatcacaatccctcgggccccactttgcagccagatgccaccggttcccatgccccatgcctcgccacccctctacctcctctgcccaggaagccttgaacacttcccacctggcagaatccttatcatcatccatggctcaagcgtaatgtcatttctatgaaggtttccctggacaagaaactgccagagagcccttagctcaggtgttcccggaagcactgttcttgctcagcagatctgggcagcttcttcttgaaag

SEQ ID NO: 200534 - DNA, 601 bp, Human
acaaacacatacacagactcacacagacacgcaaactcacacacagacagacacacacacacacacagacacacagactcacacacacaaactcacacagacacacaaatacacagactcagactcaaacacaaactcacacaaacacatttacacaaactcacaaactcacacacacaaacacacacacaaacacgcaaacttacacacacatgagcagacacacacccggcccttctgggctcttcttttcttactccataggaagccatgcaaagtctcgccagacctttcttccaakgccagatctggccaaccccacaggaaccctgcaatcacaatccctcgggccccactttgcagccagatgccaccggttcccatgccccatgcctcgccacccctctacctcctctgcccaggaagccttgaacacttcccacctggcagaatccttatcatcatccatggctcaagcgtaatgtcatttctatgaaggtttccctggacaagaaactgccagagagcccttagctcaggtgttcccggaagcactgttcttgctcagcagatctgggcagcttcttcttgaaagcagatc

SEQ ID NO: 200535 - DNA, 601 bp, Human
aatacacagactcagactcaaacacaaactcacacaaacacatttacacaaactcacaaactcacacacacaaacacacacacaaacacgcaaacttacacacacatgagcagacacacacccggcccttctgggctcttcttttcttactccataggaagccatgcaaagtctcgccagacctttcttccaaggccagatctggccaaccccacaggaaccctgcaatcacaatccctcgggccccactttgcagccagatgccaccggttcccatgccccatgcctcgccacccctctrcctcctctgcccaggaagccttgaacacttcccacctggcagaatccttatcatcatccatggctcaagcgtaatgtcatttctatgaaggtttccctggacaagaaactgccagagagcccttagctcaggtgttcccggaagcactgttcttgctcagcagatctgggcagcttcttcttgaaagcagatctgggccctactcaacattttttaaaatatatttctggtactgctcaataaatattagttatcagaacgagtactgttagatgctgcccagatatatttagtactcag

SEQ ID NO: 200536 - DNA, 601 bp, Human
tagtttcctcagctaaaaggtgccaagtagcaccagctgctatccctggcccaggctggtgatcaggggaggagagacaagtctcttcttcttcacagcctctgtccacctggatctgccagtgctccctgggtgcccccacggggcaggcgctgggtgaggttcttggtcacaaatcaacctcgtctaatgcttgcctcaaccccctgccctggagaccacatccctcatgttccatgtcaggactgtggcccctcggggaggttaagcagcttgctagaggtcagcgacttcccgaggrcctccagctccaggagctgtgcttccagccagccagtgagagctgcctgtccttgcctcctgctccccctccccctccttccttaccatttcttctcttctccctccctctccttttctcctgcctgtgttcttctatcttccatctctgcagacccttggacacagctgtgtggagcgagaacgaggagggggaggggcacaggtagcccctgtgtctctgatgcccacgttgctgcgttgctgttctgggcttctaggagaggagtttattcggctgaggagcaacacagtcaccttt

SEQ ID NO: 200537 - DNA, 601 bp, Human
atttcttctcttctccctccctctccttttctcctgcctgtgttcttctatcttccatctctgcagacccttggacacagctgtgtggagcgagaacgaggagggggaggggcacaggtagcccctgtgtctctgatgcccacgttgctgcgttgctgttctgggcttctaggagaggagtttattcggctgaggagcaacacagtcacctttctactccatccaagaaacagctccttccccagcagcccacaggggctgtgcgggggacacagtgtgggctcggtcttggcgtggaggyccccaggctgtccttcaccatgtgcctgttccctcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggtaagcacagcccctaaccacaagggaaacctagggccttatctttcccagctcctcaaagccgcctttaacttctcccagcacagccctgagggaagacacctgagggcta

SEQ ID NO: 200538 - DNA, 601 bp, Human; identical to SEQ ID NO: 23053

SEQ ID NO: 200539 - DNA, 601 bp, Human; identical to SEQ ID NO: 23054

SEQ ID NO: 200540 - DNA, 601 bp, Human; identical to SEQ ID NO: 23055

SEQ ID NO: 200541 - DNA, 601 bp, Human; identical to SEQ ID NO: 23056

SEQ ID NO: 200542 - DNA, 601 bp, Human; identical to SEQ ID NO: 23057

SEQ ID NO: 200543 - DNA, 601 bp, Human
ctccccgcccgccctcgggcctccgcagggaactgattacaatggtttggaccgcagaccttctgggccatttggcggcccagctggaggatccctcggggtagctgatgattttcccgtcgggggtctcacaccgagaacaaaggagggatggacaaaggagacgccggggagatgcgcggaacaggagccggcactgtgcgggtgccacccggccgagcgcgtgggcgcatcatgcgggcagcgggggggggggcgcacacgcccggtcagtgtccgggaacatagggacctcaaacgsgcttgttcatgacacccgagttaaatggagactttgcagtcgcttgcacgcgtggagcctcctcttctcgcgtgggccagggttggaaataaccgttgtggtaggttccatgcagtgtttccatcggatgtcagacggggagggacggcaaacctgtctcaacctccactgattcacaaataaacgcagcgggatctgagaaggggcctgagtacacgggccgggggagaaagggaagtggcaacccctagttcaaaatgcaaacgacctctggaatttcgggaagagacggaggagtga

SEQ ID NO: 200544 - DNA, 601 bp, Human
aactgaaattaaaagcagtgcatgtggccaggcgcagaggctcatgcctgtaatcccagcactttgggaggctgaggcaggaggatcatttgaggccaggagttcgaggtcagcctgggcaacatagtgagaccccatccctacaaatcattttaaaaaattagccaggcttggggtggcatgcctgtagtcccagctttggaagctgaggtaggaggctcacatgagcccgaggccactgcactccagcctgggtgacagagtgagaccctctctcaaaaaaaaaaaaaaaaaaaaaaaaccagtgcatgtgaatgtgctttttatatgttcttcccattacttgggctctcctacctgcctggcagctttagtgaggaccagcatcacatagtagctgaccctgagtcatggagggaagatgagaactgaccccagctttctgaggagttgccactgagccctaagatggccagacagtgtggtgggaggagcacagggttttaaagttgggcaaacctagattcagttccaggagcctcgtgtcatcttgggcaagttacttacctctctcggtctcacctctttttctgtaaaatgg

SEQ ID NO: 200545 - DNA, 601 bp, Human
ctcatgcctgtaatcccagcactttgggaggctgaggcaggaggatcatttgaggccaggagttcgaggtcagcctgggcaacatagtgagaccccatccctacaaatcattttaaaaaattagccaggcttggggtggcatgcctgtagtcccagctttggaagctgaggtaggaggctcacatgagcccgaggccactgcactccagcctgggtgacagagtgagaccctctctcaaaaaaaaaaaaaaaaaaaaaaaaccagtgcatgtgaatgtgctttttatatgttcttcccatyacttgggctctcctacctgcctggcagctttagtgaggaccagcatcacatagtagctgaccctgagtcatggagggaagatgagaactgaccccagctttctgaggagttgccactgagccctaagatggccagacagtgtggtgggaggagcacagggttttaaagttgggcaaacctagattcagttccaggagcctcgtgtcatcttgggcaagttacttacctctctcggtctcacctctttttctgtaaaatgggatcatcataacaatttttagtgttgccttaaattagaaa

SEQ ID NO: 200546 - DNA, 601 bp, Human
ctgagggttttcccagaatgtgggattgttcgtggtaaacctgggacagtccccagtgaacgcagattgttggacactcaatgtgaaaatgggtgcattacccatcgttgtggtttggtaatgagctgagaacaaagaagaaacagcagaggagaagcagctgagagcaaaggagaagcagcatcattcttccctctgctgagattctggaagtagtcatttaagtgctgccagcttcatttggtcttgaagggtgagtaggagtttgtcaggaaaagaaccagcaattttttaaaaaaakaaatattgaccattttataggaaaaaaaagaaagacaaagaaaaagaggccaggtgcagtggctcacacctgtaatcccaccctttgggaggctgaggtgggaggattgcttgagctcgggagtttgagaccaacctggacaacatagtgagaccacatctctaaaaaaaaaaaaaaaaaaaaattaactgggcatggtaatgcatgcctataactccagcaactcaggaggctgaggtgggaggatcgcttgagtcagggaggttgaggctgcagtgagccgtgattgcaccactgtac

SEQ ID NO: 200547 - DNA, 601 bp, Human
tgtgagactggagaatgatttgtcgatcttcaggaaaaccaaagttgtttaactttccggttaccaccctgagcaggtcagtcagagttggggttggtctgtggtgctaagctgagaacgaattaaataagaaaggtgtgttggggtggccaggggtgtgtcactacctctagtgagccctgtcacttgcccagttgtgtcccatcaaaaggtcaggccacatttgctaggcactttctaagcactcaggtggaatgatgcccgggagacagttctagataacgctttattctgtatccckccccatttcttttctaacttaaatgcactaagaaaacaaacacactgaggtgtggggaaacaggaactctgatacctgtgggtgggagtgtaaatcgctctgacctttatggagagtcttaggtgtagtagccataaaattgcaaagtagacagcctggactccggaattttcacttctagggatttgttccacaagcacaccggcacatattaatttcagcattgctcgtaataacaaaattggaaataatctaaatgtgcatccttaggggaatgtttttatgcacgtggcacataca

SEQ ID NO: 200548 - DNA, 601 bp, Human
tctgaaactatttgtcttttgggaacttatttgtcctagcctgcctgcagaaccagctgttaaggctctgttgggaaggagtatcgctctgctatattgacctctggtagaccatgacatggccccatatgccatacaacataaactggttactaagagtaatttaatggctatctctagagctactcttttgttaccttctaaagaaggcagggaagaaaatataaatggggttataataggaataatcttgaatctgttttaatttatacaaaatacatttataagttttggcacattsacgtttggatactggctaacaactttttagcgagagtagcctgtatcttgcatgtcattccattgaacagtaaggtggatccctgtcaatgaagaaatcatctgatgccagggactttgaagtctttctccaagaggtagatacgatgatctctgttttgctggaaagaaagctgatacccagaaagagcctgtaatctcaggtccccgtgggtagtaaacagccctggtttggaacccaggtaagtccaacctgcaggattgtactttccccctttccccacactttgtatttgccaaa

SEQ ID NO: 200549 - DNA, 601 bp, Human
catgtaagtctgtgatgggaaagataggcacactcagattcaagtttgtgatggcagcagccctggatgctcattgcctagaccctttactttgttaggcattgctaatggtaatattctactgccaccattccttcttcatttgttagctggaattcttctatagcaacaagcacatttttagcttattgaatatttggttacttggaggtacagtttgtctaggaaaggcaggatacatgcctgctacagtcgctttacttttcattgttcaaaagaacaaattagttctctagcatcyttcaacaattaccaatgaaatgaaattgttttcagcatgattaagaactcatggacttcagctgagtatagaggctcatgcttgtaatcccagcactttgggaggctgaggttggaggatcatttgaacctaggagtttgaagccagcatgagcaacatagtgagagcctgtctctacaaaataaataaataaataaataaattaggcaggggtggtggcatgtgcctgtagtcccagatacttgggaggctgaagagggaggattgcttgacctgggagttcgaggctgcagtgactca

SEQ ID NO: 200550 - DNA, 601 bp, Human
ggcatgtgcctgtagtcccagatacttgggaggctgaagagggaggattgcttgacctgggagttcgaggctgcagtgactcatggtccaaccactgcaatcagcaagaccctgtgttaaaaaaaaaaaacaaaaaaacctcatgggtttaaacaagcatgatgtgtttctatccgtatatcctgattgatgttcagattgtcctatctttgctagagggaacttgcttaaactgagctcttttgacaaaatcttagtttaatagtttcttgctttccatcctataaaatgtcctaatctytttttatgagttttctcttgccaggcctggatttggccatttgccccaagaaacctggctcctgttagtgaggaatggcgtttggagatcaatctcagagctagctctgccagctgggcttattgctattgggttagtcattcaacatgcagagtcaggaaatacgtacccctcctaccccaaagataagataaaatacagcatgtcttcatactgatgctttcaattcaaatttagggctaaaaggcttttacttgcttcattcatctttttaaaaaaattatcttaaactatacataa

SEQ ID NO: 200551 - DNA, 601 bp, Human
gggcttattgctattgggttagtcattcaacatgcagagtcaggaaatacgtacccctcctaccccaaagataagataaaatacagcatgtcttcatactgatgctttcaattcaaatttagggctaaaaggcttttacttgcttcattcatctttttaaaaaaattatcttaaactatacataagataaaatgtaccgttttagccattattaagtgtacagttgggtggcattaagtacatccacagtattgtacaaccatcacccccagcagtctccggaactcttgcatcttcccargtgaaactctgtacccattaaataacgtctccgtatccccttccctccagcctcaggcagcccccattgtgctttctgtctctctgaatgtaactactttagttacatggaaggacacagtattctcttgtgacgggctcgtttcctttggcatagtgtcttcaaggtttctccattttgtagcatgtcagaatgcagcatgtcttttttttttaaggctgaataatattccattgtatggatcgatactgtattttgtttatccattcatccctccatagacaattgggttgcgtctgc

SEQ ID NO: 200552 - DNA, 601 bp, Human
gcttcattcatctttttaaaaaaattatcttaaactatacataagataaaatgtaccgttttagccattattaagtgtacagttgggtggcattaagtacatccacagtattgtacaaccatcacccccagcagtctccggaactcttgcatcttcccaggtgaaactctgtacccattaaataacgtctccgtatccccttccctccagcctcaggcagcccccattgtgctttctgtctctctgaatgtaactactttagttacatggaaggacacagtattctcttgtgacgggctcrtttcctttggcatagtgtcttcaaggtttctccattttgtagcatgtcagaatgcagcatgtcttttttttttaaggctgaataatattccattgtatggatcgatactgtattttgtttatccattcatccctccatagacaattgggttgcgtctgcccattgaccattgtgaataatgccgccatttttacatgggtgaacaaatatctattcacctccctgcttttacttctttatggtatatgcccaaaagcggcattgctggatcctagggtaatgctatgtggtttttaggga

SEQ ID NO: 200553 - DNA, 601 bp, Human
ttttcagggcaagaattatgccacatttccttctggggtccggaataccatcacctggtacatacaggacacatgcacgtattccttcacagaaaagatgcagcccggaatccatcctgaagcatttggcagctttggctcacatattcagacctctgtgaaaggctctgctgagacatcttcggcgggagcggagccatccttgtaaaaggaacctgagaaacagaagcccagggatgagcccatgtggatccctggccagttttacagggagaaggaccctgagagacgccagggagaytgaggtagcaaaggcgcccaaaacctagaaggccaggaagcgagagaagagcgcagaaagttctaacattatgttctcaaaggtagtaacacgggaacagggcagtgaggtgtggccaacaccggggacctcttgggtctgaggcagggagaaaggtgcaggtggagatgtcccagggacagggggacaggtggcagtggctggactctgagggctaagggctggtgcacatgtgggatactccagtctctgtttgaacccttgagagcaggagagagcccccaggggagtgggggcggt

SEQ ID NO: 200554 - DNA, 601 bp, Human
ggcccagagccaggcaagggagatgaggaagtggataggcgtgtgcccccgtgtttgcctgtagacaccccttgcatcctcacttgatcccttgatgctctgctgggccctgatggtgccctcctggcttccaaaggccccctgccatctttacattccatcagtgttctggacctggagcagatgactcacaatctttccctgccagcttgcagagacttccggagttttcactcatctagtttgtcctttcccatcttgggtgcctcagcccactgtttttccctccaactcactttgwgtagattctccatgatccttcctggagagccccttgaggcaccaggagagctgtgcgtgccagccatgcctctcagcctcatcataacaaacgtcacagggaaacaagctcccttcagaccctgtttaaaggcgtttaaaggcggtaagtgcctgtcagtcttggaggatagtgactcactgcctgaaaaccttcacagaagtgacaagacacttttcttcggggaatgttgatattgagtttcctcccctgtgtaaacacatctccaggagtggcattaataatggggaccctttcccc

SEQ ID NO: 200555 - DNA, 601 bp, Human
ccccgtgtttgcctgtagacaccccttgcatcctcacttgatcccttgatgctctgctgggccctgatggtgccctcctggcttccaaaggccccctgccatctttacattccatcagtgttctggacctggagcagatgactcacaatctttccctgccagcttgcagagacttccggagttttcactcatctagtttgtcctttcccatcttgggtgcctcagcccactgtttttccctccaactcactttgtgtagattctccatgatccttcctggagagccccttgaggcaccagragagctgtgcgtgccagccatgcctctcagcctcatcataacaaacgtcacagggaaacaagctcccttcagaccctgtttaaaggcgtttaaaggcggtaagtgcctgtcagtcttggaggatagtgactcactgcctgaaaaccttcacagaagtgacaagacacttttcttcggggaatgttgatattgagtttcctcccctgtgtaaacacatctccaggagtggcattaataatggggaccctttccccaggacaaagcagaggatggggggagaaggaagaggagaatggaccc

SEQ ID NO: 200556 - DNA, 601 bp, Human
catgtagtaagtgtctataaatgttagtctgcatttacttatttatttatttagagatggagtttcacgcttgttgcccaggctggagtgcagtggtgcaatctcagctcactgcaacctctacctcccaggttcaagcgattctcctgcctcagcctcccgagcagctgggattacaggcgcctaccaccacaccagctaatcttgtattttcagtagagatggggtttcatcatgttggccaagctggtctcaaattccttatgtcaggtgatccaccgcccttgacctcccaaagtgytgggattacaggcgtgagcctctgcacccagccaaatattagtcattaagccaaccattaataaatgctattatcattaaaggaaatattgaaaatagtatcttttttgttttatttttggttttgtttttgaaacagggttttgctctgatgctcaggctggagtgcggtgctgtgatcatagctcactgcagccttgaacttctgggctcaagcactccgccttcctcagccttctaagtagctgggactacaggtgtgcaccaccatacccagcttttttttttttaattatcattt

SEQ ID NO: 200557 - DNA, 601 bp, Human
gccactgtgcccagccctggattcaataccataaagggttagattgcacaggaggctgccaagttgaattaagtggggttttatattagtgagaatttgccttccttctcagtattaatctacatttaggtcatagaccccatatccaacttactgtctataatttctcttacataggggggcacatttagataagcacagactaattggggttatagtcatagctttagaatagtttaaagacctagctgacggccaggcgtggtggctcacgcctgtaatcccagtacttcgggaggtygaggtgggaggatcacttgaggtcaggaattcgagaccagccgggccaacatggtgaaaccccttctctactaaaaatagaaaaattagccatgtgtggtgacaggtgcctataatcccaactactcaggaggctgaagcaggagaatcacttgaacctggttgcagtgagccatgatcgtgccactgcactccagcctgggtgacagagcaagaaaaaaaagatctagctgagggagttgggaccagatgattttctccagtgatgtttgaacaaaaagaaaaaatgcagctgggcgcg

SEQ ID NO: 200558 - DNA, 601 bp, Human
ttagccatgtgtggtgacaggtgcctataatcccaactactcaggaggctgaagcaggagaatcacttgaacctggttgcagtgagccatgatcgtgccactgcactccagcctgggtgacagagcaagaaaaaaaagatctagctgagggagttgggaccagatgattttctccagtgatgtttgaacaaaaagaaaaaatgcagctgggcgcggtggctcatgcctgtaatcccagcactttgggaggccagggtgaacggatcacgaggtcaggagttcaagactagcctggccaacrtagtgaaaccccatctctattaaaaatacaaaaaattagccaggcgtggtggcatgcacctataatcccagctacttgggaggctgaggcaggagaatcatttgaacccaggacacagaggttgctgtgccactgcactccagcctgggcaacagtgcgagactgtgtctcaaaaaaaaaaaaaatgcagaagctacttaggttgaacacagaaaggaagaaggactgtgtagttcagtagtgtgtgttctgagaaagccctcacagcgttggtctctagtaatctctggaaataagtga

SEQ ID NO: 200559 - DNA, 601 bp, Human
gaacaaaaagaaaaaatgcagctgggcgcggtggctcatgcctgtaatcccagcactttgggaggccagggtgaacggatcacgaggtcaggagttcaagactagcctggccaacatagtgaaaccccatctctattaaaaatacaaaaaattagccaggcgtggtggcatgcacctataatcccagctacttgggaggctgaggcaggagaatcatttgaacccaggacacagaggttgctgtgccactgcactccagcctgggcaacagtgcgagactgtgtctcaaaaaaaaaaaaaatgcagaagctacttaggttgaacacagaaaggaagaaggactgtgtagttcagtagtgtgtgttctgagaaagccctcacagcgttggtctctagtaatctctggaaataagtgaatcattccagcttgaattatcatgatgcaaaattgtgttcgctgaaaagcaggggttaagtccgctgccttgtgaatttccgcctggaaatgcatctgacccatggtggttgctcaattctgagtgagtttggagaaggaaggaaaatgaggagttacttattagttagtcgttatacatttttg

SEQ ID NO: 200560 - DNA, 601 bp, Human
caggcgtggtggcatgcacctataatcccagctacttgggaggctgaggcaggagaatcatttgaacccaggacacagaggttgctgtgccactgcactccagcctgggcaacagtgcgagactgtgtctcaaaaaaaaaaaaaatgcagaagctacttaggttgaacacagaaaggaagaaggactgtgtagttcagtagtgtgtgttctgagaaagccctcacagcgttggtctctagtaatctctggaaataagtgaatcattccagcttgaattatcatgatgcaaaattgtgttckctgaaaagcaggggttaagtccgctgccttgtgaatttccgcctggaaatgcatctgacccatggtggttgctcaattctgagtgagtttggagaaggaaggaaaatgaggagttacttattagttagtcgttatacatttttggtttttaaacccaatatataattcctggatattcctaccacttactatttgttgtcgttgtttctattgtttttgagagaaggtcttgctccattgcccaggctggagtgcagtggcgtgatcatggctcactgcagtctttacctccagggttca

SEQ ID NO: 200561 - DNA, 601 bp, Human
agcgttggtctctagtaatctctggaaataagtgaatcattccagcttgaattatcatgatgcaaaattgtgttcgctgaaaagcaggggttaagtccgctgccttgtgaatttccgcctggaaatgcatctgacccatggtggttgctcaattctgagtgagtttggagaaggaaggaaaatgaggagttacttattagttagtcgttatacatttttggtttttaaacccaatatataattcctggatattcctaccacttactatttgttgtcgttgtttctattgtttttgagagagggtcttgctccattgcccaggctggagtgcagtggcgtgatcatggctcactgcagtctttacctccagggttcaaggaatcctcacacctcagcctcctgagtagctggaattactaccatgcccagctaacgtctatattttttggaggtagggttttgccatgttgcccaggctggtcttgaactcatgagctcaagtgatactcctgcctcagcctcccaatgtgctgggattacaggcataagccatcgtgcctggcctcagtgagtggttttgtgggctggagtaaggatccag

SEQ ID NO: 200562 - DNA, 601 bp, Human
attgatgtattttgagtttacatttattcccaatgtttattttcttgtaaaaatgagcgcattattgattaaaagagagagacacaatatccaaaaggtggaagtagcctaggtgtccatccgtggatgaatgaatgaacaaatgtggtctgtgtgctcagtggagtattactcagccttaaaaaggaagtcttgcactgctacaacagatgaatcctgaagacattacgctaagtgaaacaagccagtcaccaaaggacaaacactctatgatcccacttctgtggggcccccagagccrtcaaattcatgacgacagaaagcagaagaggggttgccaggtggtggggccaggatcggggtgcgggaggatggggagttagagtttaatgggtgcagagtttcagttttgcacgatgaaaacagttgtagagattagtttcacaacagtgtgaacacatttactatcactgaactgtacacttaaaaatggttaagatggctaattttatatgtattttatcacaatttaaagaagagaaaaatggagaggcagtgtacaagcttagtaagtagaaagtaaattgtgaaaacctttttc

SEQ ID NO: 200563 - DNA, 601 bp, Human
ttttgagtttacatttattcccaatgtttattttcttgtaaaaatgagcgcattattgattaaaagagagagacacaatatccaaaaggtggaagtagcctaggtgtccatccgtggatgaatgaatgaacaaatgtggtctgtgtgctcagtggagtattactcagccttaaaaaggaagtcttgcactgctacaacagatgaatcctgaagacattacgctaagtgaaacaagccagtcaccaaaggacaaacactctatgatcccacttctgtggggcccccagagccgtcaaattcrtgacgacagaaagcagaagaggggttgccaggtggtggggccaggatcggggtgcgggaggatggggagttagagtttaatgggtgcagagtttcagttttgcacgatgaaaacagttgtagagattagtttcacaacagtgtgaacacatttactatcactgaactgtacacttaaaaatggttaagatggctaattttatatgtattttatcacaatttaaagaagagaaaaatggagaggcagtgtacaagcttagtaagtagaaagtaaattgtgaaaacctttttcctaacactt

SEQ ID NO: 200564 - DNA, 601 bp, Human
atgggaggaaggctgagagcagggtctgtggggcccctattgcagagaagctccgtttcatctactttatatttgatttgtaaatgtttgatttgcttggctaaagaattctgaggctagagcaacaaaacaaaacagaaggagagaggttgggaagaaaacgtgaagtaacaccaaaaaactaactgctattgcaaaacaaggataaaatagataattcaagatagatgtgattgattgccataaagattcatgaacacgtcaggtgaacccgagtctggaggctagaggaagaggagcygacggaatttgaggaggatgtgtgtctggtctgaagaggaggtagagacttcctgcgaaggctagcagagtaaaggtttgctttctccctttcctccccgaagaccagcacatcagatgaaaagaaccccccaaatcaagtaaaacttttatctgcagtgaaattaagagataactcatatccccaactatagaaaactgccgaatataatataaatccagaccacatggagggaaagacttcgagagctggtccatacctctcagctctcctgcctgttcgcctcccaaatgcccaacc

SEQ ID NO: 200565 - DNA, 601 bp, Human
acaagaatagccaagataattttttaaaaggagacttaagaaaggggaacttgccttatcagaaatcaaaacaaactagagacacactggcacggaagctaaagcagtgatgttcattgcagccctgttgtgtgtagcagtgaaaaattacttgctgaaatgcagccaaggtattaggaatggggaggctgtggcataaaaagattggcattagcattgaatcctttcaaatatcatgtacagctaaacagctgtgagaattatggagtagaatgtaagtgttatgtgccttaacaatgcmaaactaataaatcctcttcgaagagagaagtagatctgtgctgatatggaaaaatgtctaaacagatatgcgtccctgcagaaacagctgcagaggagtatccatggtatgatcccacgtgtgttcagcacactgctctgttctttcctgtactgagggagcccatttctggtgaggattatttccaccaccccgatgacacaggcttggctatgagacttgctttgatcaagaatatgtgactcgaagtcactatgcaacttccacacagaggcattaagagccattacgtggttctgt

SEQ ID NO: 200566 - DNA, 601 bp, Human
actatttgtttgttacagcataacagcttaaacagcaccaaaccaagcataagtgttttatacatatacatttgaacatggctaaaatatatctcctatatcctagatacacttttctcatgtgtataaacagacatgtacaaggatgcctgatgaagcattgctattacagcaaaaaactgaaaacaatctgaatatatatcagtaagtgtcttagccagtttaggttgctgtaacagaataccatagaatgtgtggctttaacaacgcttatttctcaaagttctggaagccaggaagyccaagatcacggcactggcagattggtgtctggtgagagacccaagcctgctttgcagaagaccatcatctcactgcatccactcatggggtgggtgtagggagatatctattctgtcttttcttttcttttttttgaggcagagttttgctcttgttgcccaggctggaatgcaatggcgcaacctcggctcactgcaacctccgcctcctgggttcaggcaattctcctgcctcagcctcctgagttgctgggattacaggcatgcaccaccatgctcggctaatttttgtatcttta

SEQ ID NO: 200567 - DNA, 601 bp, Human
aaccaagcataagtgttttatacatatacatttgaacatggctaaaatatatctcctatatcctagatacacttttctcatgtgtataaacagacatgtacaaggatgcctgatgaagcattgctattacagcaaaaaactgaaaacaatctgaatatatatcagtaagtgtcttagccagtttaggttgctgtaacagaataccatagaatgtgtggctttaacaacgcttatttctcaaagttctggaagccaggaagcccaagatcacggcactggcagattggtgtctggtgagagwcccaagcctgctttgcagaagaccatcatctcactgcatccactcatggggtgggtgtagggagatatctattctgtcttttcttttcttttttttgaggcagagttttgctcttgttgcccaggctggaatgcaatggcgcaacctcggctcactgcaacctccgcctcctgggttcaggcaattctcctgcctcagcctcctgagttgctgggattacaggcatgcaccaccatgctcggctaatttttgtatctttagtagagatgggggggtttcaccatgttggtcagtctggtc

SEQ ID NO: 200568 - DNA, 601 bp, Human
aatgactgttggctaaggcgtccacctctacttgcgtctggaattgcccctgcctctgcctttaagtctggtctgcgtggcttctgatagcgaagccaggggcggaccccgttcactgcatcaggagagccctgagcagcgcttggcaggaactctgcagcccagggcgccctctagaggctggaggaccttcgtcaagaccccggggggtgtggatgtggacctggaggagtggtgggcagaaggcggagccaccctttcacccagtcaattgcattcctctgtctttaatgttgggctkcctcagattagattttctttgaagaaagagttctgcagcttaaaaaaaaagtgacagaagaatcactggtgcagagtaaggtatagcgttagcatttgatctgatattatctagattcttttcacactaggaagcacctaagtcatctggtctaacaccttccttttacaaagaagatctgaggcctatataggcaaaatgtgtgctgcccaggtccacgactgcagggcattgtctcctggccctggtaatgtggtcttcattcttattttttgttttgttttgtgttaactgaactta

SEQ ID NO: 200569 - DNA, 601 bp, Human
ggacctggaggagtggtgggcagaaggcggagccaccctttcacccagtcaattgcattcctctgtctttaatgttgggcttcctcagattagattttctttgaagaaagagttctgcagcttaaaaaaaaagtgacagaagaatcactggtgcagagtaaggtatagcgttagcatttgatctgatattatctagattcttttcacactaggaagcacctaagtcatctggtctaacaccttccttttacaaagaagatctgaggcctatataggcaaaatgtgtgctgcccaggtccaygactgcagggcattgtctcctggccctggtaatgtggtcttcattcttattttttgttttgttttgtgttaactgaacttagaactaaacagatcccttgcaacttggcttagactccatatttcatgcaaaaagctttcagggtagcagggtgactcggtggattagcaggagaagaagatgtaaagtgatggcgattggagcttaacctcggtttgattaagtaatcccccagacacccccgagaggggaaaacagtccccacgtataaatttctacacccttgctcgcctcctcttc

SEQ ID NO: 200570 - DNA, 601 bp, Human
ggaaaacagtccccacgtataaatttctacacccttgctcgcctcctcttctgaaaggcgtaaatctcccctgaaatgcctccctagcattcagggcaataaagaggtcacattatatctccataaatctcccagctggctgctgctgctgccattccagaggcgaaggggaagttgtttcctcctgacggcaggccatgggcctggaaggaaaagcctctccctgcagacccattgtctcggtccctgagggagctgccctggcaatttattcaatattccctttccgtcctgccagctmctaactggggttgcagagtcaaatggcccagactagcccagcttaagtctcctctggccaaagctccattgcaatcttcctaataaataaaagaaaccaggaccatatcacagcattagaagccaggccagggttccctggggctgaggctggggctcgctgggacaggagctagggtgctgtgaaagatgacagcgggtcaacagcttcaggagtgcagcaaagctgaggacccacttgggaaatgggttccattttcccattagggaattaagatgcttttgtaggaaaggaaggtgg

SEQ ID NO: 200571 - DNA, 601 bp, Human
aggacagctatggtggcgcacgcctgtaatcccagtgctttgggagcccgagcctggcggatcacctaggctcaggagttcaagaccaccctgaccaacatggtgaaaccctgtctctgctaaaaatacaaaaattagccaggcgtgatggtatatacctgtaatcccagcttttggggaggctgaggcaggagaattgcttgagcctgggaggtggaggttgcagtgagccaagatcatgccattgcactctagcctgggtgacagagcaagactctgtctcaaaaaaaaaaaaaaaaaatcactatcacaaataagaaatacattaacataaacatagttgagtatttaaaaggtacacaacagcaaacaatgagaagtccttccgtgagccaccaagacacctccctggaaacaaccagcatgatcagtttcttgtctgtcctcctaaaaatgttcattctgtatataaacaaatccatgtatagattcttctccccttctttttgtaagagaatatcaatgtaatgtccatgccttctaatatttcatagcatatactgcaagaattccatatcagtacatcaagatcattgtttat

SEQ ID NO: 200572 - DNA, 601 bp, Human
aaaatacaaaaattagccaggcgtgatggtatatacctgtaatcccagcttttggggaggctgaggcaggagaattgcttgagcctgggaggtggaggttgcagtgagccaagatcatgccattgcactctagcctgggtgacagagcaagactctgtctcaaaaaaaaaaaaaaaaaatcactatcacaaataagaaatacattaacataaacatagttgagtatttaaaaggtacacaacagcaaacaatgagaagtccttccgtgagccaccaagacacctccctggaaacaaccagyatgatcagtttcttgtctgtcctcctaaaaatgttcattctgtatataaacaaatccatgtatagattcttctccccttctttttgtaagagaatatcaatgtaatgtccatgccttctaatatttcatagcatatactgcaagaattccatatcagtacatcaagatcattgtttatggctacatagtgtgccttaattgaattaaccagtccggtattgatgaacgtaagagttgtttttccagtcctctgctatggaaggacatgccatagtgaatatccttgtatataaaccattt

SEQ ID NO: 200573 - DNA, 601 bp, Human
ttcattctgtatataaacaaatccatgtatagattcttctccccttctttttgtaagagaatatcaatgtaatgtccatgccttctaatatttcatagcatatactgcaagaattccatatcagtacatcaagatcattgtttatggctacatagtgtgccttaattgaattaaccagtccggtattgatgaacgtaagagttgtttttccagtcctctgctatggaaggacatgccatagtgaatatccttgtatataaaccattttacacagaagtacatctggaggataaattcctgraagtggagtttctggatcaagtgacacatgcatttatacttttgataagatattgccaaattgctttccccactggctgcggggctgtagcatgtcacacttcccatcaatgcccagggtgtctgctttcccacatcccccaaccccagggcacagtactatgactgaggcaagctgggaggagcctggagaggggcatcatcacaacacagtgacttggaggatccaggaccagtgccagactttgtccacagcgtgactggaaagctcttcatgtacattctaccctggctgggactg

SEQ ID NO: 200574 - DNA, 601 bp, Human
agagaatatcaatgtaatgtccatgccttctaatatttcatagcatatactgcaagaattccatatcagtacatcaagatcattgtttatggctacatagtgtgccttaattgaattaaccagtccggtattgatgaacgtaagagttgtttttccagtcctctgctatggaaggacatgccatagtgaatatccttgtatataaaccattttacacagaagtacatctggaggataaattcctggaagtggagtttctggatcaagtgacacatgcatttatacttttgataagatattrccaaattgctttccccactggctgcggggctgtagcatgtcacacttcccatcaatgcccagggtgtctgctttcccacatcccccaaccccagggcacagtactatgactgaggcaagctgggaggagcctggagaggggcatcatcacaacacagtgacttggaggatccaggaccagtgccagactttgtccacagcgtgactggaaagctcttcatgtacattctaccctggctgggactgtaccccgaagggagggcctctccctttctttctgtagagtgggaggaacagttgg

SEQ ID NO: 200575 - DNA, 601 bp, Human
aagtacatctggaggataaattcctggaagtggagtttctggatcaagtgacacatgcatttatacttttgataagatattgccaaattgctttccccactggctgcggggctgtagcatgtcacacttcccatcaatgcccagggtgtctgctttcccacatcccccaaccccagggcacagtactatgactgaggcaagctgggaggagcctggagaggggcatcatcacaacacagtgacttggaggatccaggaccagtgccagactttgtccacagcgtgactggaaagctcttcmtgtacattctaccctggctgggactgtaccccgaagggagggcctctccctttctttctgtagagtgggaggaacagttggtgccacagcgatgcctgagcccagatggggctgccactgtggtgggaggcagctgggaccgaggtggaaaaagtactttgtactttttctttccggccaggaggatcccaggaaattgaagaaaataaacatctccaatcctgcagtgcctaggcagagatgcttgcttaattaactgcatatttaactaatttaaaccatgttacaggaagagaaaat

SEQ ID NO: 200576 - DNA, 601 bp, Human
tgtagcatgtcacacttcccatcaatgcccagggtgtctgctttcccacatcccccaaccccagggcacagtactatgactgaggcaagctgggaggagcctggagaggggcatcatcacaacacagtgacttggaggatccaggaccagtgccagactttgtccacagcgtgactggaaagctcttcatgtacattctaccctggctgggactgtaccccgaagggagggcctctccctttctttctgtagagtgggaggaacagttggtgccacagcgatgcctgagcccagatggggmtgccactgtggtgggaggcagctgggaccgaggtggaaaaagtactttgtactttttctttccggccaggaggatcccaggaaattgaagaaaataaacatctccaatcctgcagtgcctaggcagagatgcttgcttaattaactgcatatttaactaatttaaaccatgttacaggaagagaaaatctgaagaacatagtctatccaattgtcatgtaataaaccaactccaatttccgtatggctttggtgaaactttgtttttgtactcattcctctaccattgggcgttttggtt

SEQ ID NO: 200577 - DNA, 601 bp, Human
gaaccttgtcccaggtttcggggtggggactgctgggcagggtccctgcaaacacagcagctgggaggcccaggcccctccactctgggactgatcgtagcttcccacatggaggcccccatgaaaactccatagttctttcacctgagggtgacagctggcaagacagtctttgtaaaaaatgtattggtataggggcaaaatgctgccattcgggagagttttcaaatagaaatgtagagctcactgcagtctttcagtattgccttcttttctttgttccttttccgtttttttttttggagacacggtctcactctgtcgcccagactgtagtacagtggcatgatcacggctcactgcaacctctgcctcctgggttcgagcaattctcctgcctcagcctcccgagtagctggaattacaggcgtgcaccaacatgcccacctactttttatatttttagtagagacaggctttcaccatgttggccaggctggccttgaactcctgacctcaagtgttccatccgcttcggcctcccaaagtgctgcgattacaggcatgagccaccacacctgaccctttgcctgtttttaaa

SEQ ID NO: 200578 - DNA, 601 bp, Human
caggcgtgcaccaacatgcccacctactttttatatttttagtagagacaggctttcaccatgttggccaggctggccttgaactcctgacctcaagtgttccatccgcttcggcctcccaaagtgctgcgattacaggcatgagccaccacacctgaccctttgcctgtttttaaaatggtatcccagcctgcggttctctggtgggaaggggccatggtgaccattttctgggagtctgcatgtttagtgtcgagatgcagcaaatgaagtcttattcaccaccatacttttgtttcamttgtttcaagaaagtgcttgtggccagaagtggtggctcatgcctgtaataccaatactttgggaggctgaggcgggaggattgcttgaactcaggagttcaagatcagcctgggcaacatagtgagaccccatctctacaaaatgctagaaaaattagctgagcgtggtggtgtgcaactgtagtcccagctactcaggaggttcaggcaggaggatcgcctggggccgcgaagtcaaggctgcaattagctatgactgagctgctggactccagcctgggtgacagagcaagacccca

SEQ ID NO: 200579 - DNA, 601 bp, Human
aaagtgcttgtggccagaagtggtggctcatgcctgtaataccaatactttgggaggctgaggcgggaggattgcttgaactcaggagttcaagatcagcctgggcaacatagtgagaccccatctctacaaaatgctagaaaaattagctgagcgtggtggtgtgcaactgtagtcccagctactcaggaggttcaggcaggaggatcgcctggggccgcgaagtcaaggctgcaattagctatgactgagctgctggactccagcctgggtgacagagcaagaccccattgaaaaaaamaaacaaacaaaaaaagtccctgtgagagcaatgcaacagtccacaagttcgcggacttagctctatggcattgtgattgcagaggctcagatttgaattcagaagcatcctacatttctcctggagccagcaactgatcctgcattttatggggaaatctttatgctgtaattataggcccacatggaggggttctcgaaggtctcaaaatctaatcttgacaatgatgaaggccaggaagcgtttcccaagtgggtgagctgagaagcattgagacagagatgttgggaagtttctgag

SEQ ID NO: 200580 - DNA, 601 bp, Human
cagagcaagaccccattgaaaaaaacaaacaaacaaaaaaagtccctgtgagagcaatgcaacagtccacaagttcgcggacttagctctatggcattgtgattgcagaggctcagatttgaattcagaagcatcctacatttctcctggagccagcaactgatcctgcattttatggggaaatctttatgctgtaattataggcccacatggaggggttctcgaaggtctcaaaatctaatcttgacaatgatgaaggccaggaagcgtttcccaagtgggtgagctgagaagcattgaracagagatgttgggaagtttctgagatcagacaagatgggaaaacagcatgcttgcgctctgaactcctgcagcccttgctgctctcaggccaaattgagactgattttccatctgctgccagcttttgccgctggggaaggggtcagggatggccaaggcatctgtgggcagcgctggtgggacgctggcctgcggttaagagactgactgcccagcctgggttcgatcccactttgctgttgattagctctgtggccctgggcaggatctgttctctaaagctcatgaactttcctcc

SEQ ID NO: 200581 - DNA, 601 bp, Human
ccccattgaaaaaaacaaacaaacaaaaaaagtccctgtgagagcaatgcaacagtccacaagttcgcggacttagctctatggcattgtgattgcagaggctcagatttgaattcagaagcatcctacatttctcctggagccagcaactgatcctgcattttatggggaaatctttatgctgtaattataggcccacatggaggggttctcgaaggtctcaaaatctaatcttgacaatgatgaaggccaggaagcgtttcccaagtgggtgagctgagaagcattgagacagagatgytgggaagtttctgagatcagacaagatgggaaaacagcatgcttgcgctctgaactcctgcagcccttgctgctctcaggccaaattgagactgattttccatctgctgccagcttttgccgctggggaaggggtcagggatggccaaggcatctgtgggcagcgctggtgggacgctggcctgcggttaagagactgactgcccagcctgggttcgatcccactttgctgttgattagctctgtggccctgggcaggatctgttctctaaagctcatgaactttcctccattgccatcc

SEQ ID NO: 200582 - DNA, 601 bp, Human
ttgcctgtttgtgatttaggaaaaacaaaacaaaacaaaactgagtcacattctgtcactccagccagctgacgtcctgggttcttgtcctttataagggtcagaagcagaggccttggactctgtggggtgactgcaaggtgggcggtaactggtaaccgcctctgttcagcagctgcaggagcttccaaaataggtgatttcatccccggccggagcgccgctggagctgtgtgggcctccccgtgacagcctcctgtcacaggcatctgccgagcctgacgaagcccagaagacccasggctcaagagctgccaggaaaacctcaggctttgtttgggcctcgtgccccacacccaggcgccagccgcagggacagatccgggcctgtcgggaaatccaggctccatctctggtgaactctggatgggacatgggcctggggttcagcaagggacatttgggtggggctgagactttgctctgaagcccctttggttcccagggaacggtttctgggcaggtccctcccctcctgcccagtctgggctggggtctggccctttccaagaaagccttctgtgttgtatctccttggccc

SEQ ID NO: 200583 - DNA, 601 bp, Human
gccaacatgttcgttacgtctagcacttggacaggggcgcgtatacagacgcatggcagatatttgagtttcaggcattgctgtgaaggggctgagacccatcaactctgcctccaggcatgagggtgagggtcttccaacacaggctggggctcaacaccagctctccccagcaggtggaagtctgaggggagcatctgcaggagagcagaccaggctctgtggcgccgatggggcggcagcagtggcctgagctgtctccccagcggccagcagtgcccaggggagggagtggagagcrgaaccgtgaccctggcctctgattcctctccctttcttcctcccgtgccttccctctccccgccctgactggcctccccttgttggggtgggtgggttccccaagatggatggagcaggtcagaggagaggagaggtcggtgtctttgcctctggctgcgtcagttctttgtagggaagtcaggggtgggatgtttcaacctcctggcctgcattcttctttcaggcactagggtgggagcagcttgtttaattgataggaatatccatactgcaccggctcgctgagaaatcagactat

SEQ ID NO: 200584 - DNA, 601 bp, Human
ccactcccgagctgggtcctgttggaaagagagctctttaccacctgtcctcccaactcaataaaagcacccctcttcactagagaaaaatctgcccttgcctctggcagcagcataggaagaatctggagaccaaggtagatgtgttttgggacagcaaattaggataacatgaagtcagagagacttctggagatggtgagccaggctttatagagactacggggagcaagaaaactggcccagcctgtctcacgagggtgaggagaatggacacaggtggaatctgtcaattgtaacrttctgtagacatggatgataaaggtgatggcggggaggggtgagcgagtgaagggagcggcagaccccggcagccttgtggtagctggggagatgctacgcttatgtgagcagctctaaagtgccattgcttataatatgcacctttattttatataccaataagcaagaaaaatgtccaactatgatatggcagcccatacaggtatattaaaacagaaaaaatgaatgaatgaagctttttttgcaggacagttagcaaattccaagaactgaaaaagaaatttagtgcctttgactc

SEQ ID NO: 200585 - DNA, 601 bp, Human
gactgcaccactgtactccagcctgggtgacagagtgaccctgtctctaataaaaagaataaaataaatacagtcttacaaaggatacaatagaaccaaatgctcaaaacattagtgacaatctggattttctttatatattttggcactaattttcctaaggtaaatatttattatatctttatgcaaaaggaaaagtaatcttactaactttgaaagggaaaaagagagagcaaggtttgcgtggacctcagtgtgaggtgagaggcctagggctggaggctctgaatgtgatacctgsactgaaatccaggtgtcccgcctcccagcccaggacgtgggtgatcactgcaactttttcctcttctcgtgctcaggggaactctcagtgtctgggattagggagcaggggctgaagtcagagtgaggaagagcaagagcagcccgaggtggtcttctccttccaaggaaagggcattgtttctgtgcgctctagattctcagatgtgagagctgggcataaacaaagaattaatcctctgtgtcttttcttgtctgttccccccaactcagtagatatgtttgacgacttctcagaagg

SEQ ID NO: 200586 - DNA, 601 bp, Human
atgcggagggcgagcctgtgtgcaatgcctgcggcctctacatgaagctccacggggtacgtgggtcctgcgcccatgcggcatccttgccttctgatgcccatctctcagtcctcccttgtcttcttcctttgtactagcattcatttttccttcttaacaaagagacttagatttggaaggggctttcaactactttgctggcctcttccgtcctttacattgtataagtgaattttccgttttacagatgagcaggctacatttatatgtagcagtttgatgtgtaacaaaggtgacrtttcgattcagtggataagaagcttaaggatagttgtattgacaaaattggctgttcatttggaaaacagaaggaaagcatgacctctacctcctaccttaaacaaaaataaacttgggtgaattaaggatattacatgtaaaacatctttgaaataaactaaaagtaaggccaggcatcatgactcatgcctgtaattgcagcactttgggaggctgaggcagaaggattgcatgagctcaggatttcaaaaccaacctggacaacatggtgaaactttgtctctactaaaaaaaaaaa

SEQ ID NO: 200587 - DNA, 601 bp, Human
ctagcattcatttttccttcttaacaaagagacttagatttggaaggggctttcaactactttgctggcctcttccgtcctttacattgtataagtgaattttccgttttacagatgagcaggctacatttatatgtagcagtttgatgtgtaacaaaggtgacgtttcgattcagtggataagaagcttaaggatagttgtattgacaaaattggctgttcatttggaaaacagaaggaaagcatgacctctacctcctaccttaaacaaaaataaacttgggtgaattaaggatattamatgtaaaacatctttgaaataaactaaaagtaaggccaggcatcatgactcatgcctgtaattgcagcactttgggaggctgaggcagaaggattgcatgagctcaggatttcaaaaccaacctggacaacatggtgaaactttgtctctactaaaaaaaaaaaaaaaaaaaaaaaaaatctagctgggcatggtggtgcatgcctctagtcccagctactcaggagtctgaggtaggaggatggcttgagctcaggagtttgaggctgcagtgagctctgattgtcccactgcactcca

SEQ ID NO: 200588 - DNA, 601 bp, Human
agaagcttaaggatagttgtattgacaaaattggctgttcatttggaaaacagaaggaaagcatgacctctacctcctaccttaaacaaaaataaacttgggtgaattaaggatattacatgtaaaacatctttgaaataaactaaaagtaaggccaggcatcatgactcatgcctgtaattgcagcactttgggaggctgaggcagaaggattgcatgagctcaggatttcaaaaccaacctggacaacatggtgaaactttgtctctactaaaaaaaaaaaaaaaaaaaaaaaaaatcyagctgggcatggtggtgcatgcctctagtcccagctactcaggagtctgaggtaggaggatggcttgagctcaggagtttgaggctgcagtgagctctgattgtcccactgcactccagcctgagtgacaaagtgagaccctgtctccaaaaaaataaaaatattagataataaaatactgcaaagaaaatcagacaataaaaacactggaagaaaatgtaagggaaagtatttatataactttggggatgggagaacttcttaaacaagattttaaaactttttagccatataagaata

SEQ ID NO: 200589 - DNA, 601 bp, Human
aattggctgttcatttggaaaacagaaggaaagcatgacctctacctcctaccttaaacaaaaataaacttgggtgaattaaggatattacatgtaaaacatctttgaaataaactaaaagtaaggccaggcatcatgactcatgcctgtaattgcagcactttgggaggctgaggcagaaggattgcatgagctcaggatttcaaaaccaacctggacaacatggtgaaactttgtctctactaaaaaaaaaaaaaaaaaaaaaaaaaatctagctgggcatggtggtgcatgcctctaktcccagctactcaggagtctgaggtaggaggatggcttgagctcaggagtttgaggctgcagtgagctctgattgtcccactgcactccagcctgagtgacaaagtgagaccctgtctccaaaaaaataaaaatattagataataaaatactgcaaagaaaatcagacaataaaaacactggaagaaaatgtaagggaaagtatttatataactttggggatgggagaacttcttaaacaagattttaaaactttttagccatataagaatagttagatatatttgattttgtaaatatt

SEQ ID NO: 200590 - DNA, 601 bp, Human
caggcatcatgactcatgcctgtaattgcagcactttgggaggctgaggcagaaggattgcatgagctcaggatttcaaaaccaacctggacaacatggtgaaactttgtctctactaaaaaaaaaaaaaaaaaaaaaaaaaatctagctgggcatggtggtgcatgcctctagtcccagctactcaggagtctgaggtaggaggatggcttgagctcaggagtttgaggctgcagtgagctctgattgtcccactgcactccagcctgagtgacaaagtgagaccctgtctccaaaaaaataaaaatattagataataaaatactgcaaagaaaatcagacaataaaaacactggaagaaaatgtaagggaaagtatttatataactttggggatgggagaacttcttaaacaagattttaaaactttttagccatataagaatagttagatatatttgattttgtaaatatttactgtttgtgcctggaaatgatacctagggaaagtaaagaccaatacacacagtatcagaaaaagggttaatatttccagaattacaaggagcttctacaaagctctttaatttttattggaacat

SEQ ID NO: 200591 - DNA, 601 bp, Human
tcatgcctgtaattgcagcactttgggaggctgaggcagaaggattgcatgagctcaggatttcaaaaccaacctggacaacatggtgaaactttgtctctactaaaaaaaaaaaaaaaaaaaaaaaaaatctagctgggcatggtggtgcatgcctctagtcccagctactcaggagtctgaggtaggaggatggcttgagctcaggagtttgaggctgcagtgagctctgattgtcccactgcactccagcctgagtgacaaagtgagaccctgtctccaaaaaaataaaaatattagrtaataaaatactgcaaagaaaatcagacaataaaaacactggaagaaaatgtaagggaaagtatttatataactttggggatgggagaacttcttaaacaagattttaaaactttttagccatataagaatagttagatatatttgattttgtaaatatttactgtttgtgcctggaaatgatacctagggaaagtaaagaccaatacacacagtatcagaaaaagggttaatatttccagaattacaaggagcttctacaaagctctttaatttttattggaacattctccattataca

SEQ ID NO: 200592 - DNA, 601 bp, Human
aatagttagatatatttgattttgtaaatatttactgtttgtgcctggaaatgatacctagggaaagtaaagaccaatacacacagtatcagaaaaagggttaatatttccagaattacaaggagcttctacaaagctctttaatttttattggaacattctccattatacaatattaacaaaaaggcaaggtgcccaacactacctactatggcactatttttataaatatgaggaagaatataatttataggtggttgcttccacatatacagaacacctctggtaggatatgtagagrttggtcacatggtcacatgtatgcatatatacgtacatggggtgcctccaggagaaaaactggggtcccggggagaagggattggaaggacactctttttgctgtgtacccccttggtaccttagacgggacatatgcaagtcttaattgttcaaatacaagttaaattaaaaccaaaccaaaccagaaacagataggtcttgtagcctaataagaaaagaacaattgatctttccccacttcccccaaatgggcaaaagatacggactgacatctcacagaagctgcccagatagccat

SEQ ID NO: 200593 - DNA, 601 bp, Human
cttggcaaaaattaaagtgtttgctgctatggatttggggaattagatactctcatatattattgatctgtatttgaattactgcatctattaacttagtggtattttttaaggttgaaaccatgaacaccattatatctggcaggtctactgttgggaaactagcctataaaaaataaccagtacatgatgacctttgaaccatttattgctgcattgtttgtggtggcaaaaactagaaacaaccttaaaaccccataaaggaatggttgaaaaaattctgctatatcccaaaatgtgraatattgagaagaaacttaaaaataataatctagggccatgtatcttgatctagaaaatgaaaaagcacattgcaaagaaatatatgtagcatgaccccatactatgagtgtcgaaggtgcattaaacagacatacatatggatgggtggacagaccagtggatgggtgaacacacacacacaaatatacacgtataggtgtattagtctgttttcacactgctgataaagacatacccaaaattaaaaagtggcttaatggactcacagttccacatcgctggggaggcctcacaatca

SEQ ID NO: 200594 - DNA, 601 bp, Human
actatgagtgtcgaaggtgcattaaacagacatacatatggatgggtggacagaccagtggatgggtgaacacacacacacaaatatacacgtataggtgtattagtctgttttcacactgctgataaagacatacccaaaattaaaaagtggcttaatggactcacagttccacatcgctggggaggcctcacaatcatggcggaaggtgaaaggcacgtcttacatggcagcaggcaagagagaatgagagccaagcaaaaggggtttccccttataaaaccatcagctctcatgagayttactcactatagtgagaacagtatgggagaaaccgcccctgtgactcagttatctcccatcaggtcggtcccacaacatgtgggaattatgggagctacaattcaagatgagattttggtggggacacagccaaaccaagtcaatagatatatatgtgtacagatgtttgagaatttttttaaatgtaagaatatataacaggctgttaaatccatttgcctcactgggataggattgacggtagtagagtgagagggctgttgttaacttagtctcatgtatcttttcatgatttctt

SEQ ID NO: 200595 - DNA, 601 bp, Human
tttgttaatcactgtaatagcaaaaatggaggaaagaaaacctttggaaggaaaatggttaaactattgttcttcaatatgggaatggtacaagaaacttattgggaaatattatataggtattaaaaagattatattctcagaaaataaaaaaatagaattaccacatgatccagcgtaccatttctggatatatacccaaaataattaaaggcagggcctcaaagagctatttgtacactgctgtttatagcagcatgattcacaattgcagaaagatgtaaacaacccaagtgtccayggagaaatgaacggataaacacagtgtgatatacatacacgtaggatattactcagcctttaaaaggaagggaattctggcccctgacaccacatgtcaaatccatagagacagaaagtagaatggaggctgtcgggggctagggaaagggggaatgaggagtgatgtttaatgggtatggagtttgagttttgcaagacgagaagagttctggggatggtggtcaggcttgcagaacggtgtgaatgcgcttaacactacagagcaatatacttcagaatggttcagatggtaaatttt

SEQ ID NO: 200596 - DNA, 601 bp, Human
tgtaatagcaaaaatggaggaaagaaaacctttggaaggaaaatggttaaactattgttcttcaatatgggaatggtacaagaaacttattgggaaatattatataggtattaaaaagattatattctcagaaaataaaaaaatagaattaccacatgatccagcgtaccatttctggatatatacccaaaataattaaaggcagggcctcaaagagctatttgtacactgctgtttatagcagcatgattcacaattgcagaaagatgtaaacaacccaagtgtccacggagaaatgaayggataaacacagtgtgatatacatacacgtaggatattactcagcctttaaaaggaagggaattctggcccctgacaccacatgtcaaatccatagagacagaaagtagaatggaggctgtcgggggctagggaaagggggaatgaggagtgatgtttaatgggtatggagtttgagttttgcaagacgagaagagttctggggatggtggtcaggcttgcagaacggtgtgaatgcgcttaacactacagagcaatatacttcagaatggttcagatggtaaattttaagttaggtgtg

SEQ ID NO: 200597 - DNA, 601 bp, Human
aaaataattaaaggcagggcctcaaagagctatttgtacactgctgtttatagcagcatgattcacaattgcagaaagatgtaaacaacccaagtgtccacggagaaatgaacggataaacacagtgtgatatacatacacgtaggatattactcagcctttaaaaggaagggaattctggcccctgacaccacatgtcaaatccatagagacagaaagtagaatggaggctgtcgggggctagggaaagggggaatgaggagtgatgtttaatgggtatggagtttgagttttgcaagaygagaagagttctggggatggtggtcaggcttgcagaacggtgtgaatgcgcttaacactacagagcaatatacttcagaatggttcagatggtaaattttaagttaggtgtgtttcattttactgcaactgaaaaaaaaaaagcatacctaagtgaatggagattaacgtgagggggagattcttctgaggccagaatgggtttgaacatttgaggcatagctagggggatggggtgggggaggacacccttccacaaggtgggaaataggggtctgggtgtagagtcacagagagatgt

SEQ ID NO: 200598 - DNA, 601 bp, Human
tcccacatggtagacaagcacagcatagaaaaggggctaaaagatttggctcagcctaagagaaaccagatgtggggaaggcaccctgcagtcctgctccccaggactggcttaggcatctgtgaatggctctggggcctgcctcccaacagaactgtggtcaaagtgttgtccagggacattttatctcagaacctggtcacagggcagtctctagcatagtctcttactgctccccaccattcacagaagcaccaatggctccagccagacccaatgcagtacagagctgcaataagtrgagtgatgttacatctcaactcactgggactgttgctgttgaggccaattttcccagcacaataattgatagcaccgctgcaccctcacaccttttgaagatagggccttgctccaccacccaggctggagtgcagtggcacgatcacggcttgctggagcctcgacttcctgggttcaagggatcctcctatctcagccttctgagtagctgggactacaggcatgcagcaccgtgcccagctaattttaaaacttttttgtagagatggggtctcactatgttgccaaggatggtctc

SEQ ID NO: 200599 - DNA, 601 bp, Human
aaggcaccctgcagtcctgctccccaggactggcttaggcatctgtgaatggctctggggcctgcctcccaacagaactgtggtcaaagtgttgtccagggacattttatctcagaacctggtcacagggcagtctctagcatagtctcttactgctccccaccattcacagaagcaccaatggctccagccagacccaatgcagtacagagctgcaataagtagagtgatgttacatctcaactcactgggactgttgctgttgaggccaattttcccagcacaataattgatagcaccsctgcaccctcacaccttttgaagatagggccttgctccaccacccaggctggagtgcagtggcacgatcacggcttgctggagcctcgacttcctgggttcaagggatcctcctatctcagccttctgagtagctgggactacaggcatgcagcaccgtgcccagctaattttaaaacttttttgtagagatggggtctcactatgttgccaaggatggtctcgaactcctgggctcaagcagtcctcccacctcggccacccaaagtgctgggattacaggcatgagccactgtgcctg

SEQ ID NO: 200600 - DNA, 601 bp, Human
tagtctcttactgctccccaccattcacagaagcaccaatggctccagccagacccaatgcagtacagagctgcaataagtagagtgatgttacatctcaactcactgggactgttgctgttgaggccaattttcccagcacaataattgatagcaccgctgcaccctcacaccttttgaagatagggccttgctccaccacccaggctggagtgcagtggcacgatcacggcttgctggagcctcgacttcctgggttcaagggatcctcctatctcagccttctgagtagctgggactrcaggcatgcagcaccgtgcccagctaattttaaaacttttttgtagagatggggtctcactatgttgccaaggatggtctcgaactcctgggctcaagcagtcctcccacctcggccacccaaagtgctgggattacaggcatgagccactgtgcctggcctagcacccactttttgttttcagggtccttgtgtggatgataaaggcttttgaacagtctgtctctgctgcctgaaatgcctgcctctgtctactcaaaaccttttacaaactcaggtgtcacctccacactgaagcct

SEQ ID NO: 200601 - DNA, 601 bp, Human
ggccacccaaagtgctgggattacaggcatgagccactgtgcctggcctagcacccactttttgttttcagggtccttgtgtggatgataaaggcttttgaacagtctgtctctgctgcctgaaatgcctgcctctgtctactcaaaaccttttacaaactcaggtgtcacctccacactgaagccttccttgatatcctcacgtgcccctccttcccactcctcaccccaggacagagtttagtgtttctctgtctttttacatcaccgaccagagtctggttatttctccttgtctgtsaatttctgagggtaggagctgtgtgtctttagttccctattctccaggctctagtaaagtagccatcacatcacacaggtgctcgataagttttttaaaaatggaattgatttctttctcgctgagttccaggggcctgtgcagcccgtctgggccccaggctttgtggagagattgcttaggtgttgccttctcgcagcaggtgtgtgtctttcaatgctgtagcagactacgcagaaatggaaaaccctatatatttacttgtgaccctccaggtccccaggcctcttgcaatgcgga

SEQ ID NO: 200602 - DNA, 601 bp, Human
ctgtgcctggcctagcacccactttttgttttcagggtccttgtgtggatgataaaggcttttgaacagtctgtctctgctgcctgaaatgcctgcctctgtctactcaaaaccttttacaaactcaggtgtcacctccacactgaagccttccttgatatcctcacgtgcccctccttcccactcctcaccccaggacagagtttagtgtttctctgtctttttacatcaccgaccagagtctggttatttctccttgtctgtgaatttctgagggtaggagctgtgtgtctttagttcyctattctccaggctctagtaaagtagccatcacatcacacaggtgctcgataagttttttaaaaatggaattgatttctttctcgctgagttccaggggcctgtgcagcccgtctgggccccaggctttgtggagagattgcttaggtgttgccttctcgcagcaggtgtgtgtctttcaatgctgtagcagactacgcagaaatggaaaaccctatatatttacttgtgaccctccaggtccccaggcctcttgcaatgcggaaagaggggatccaaaccagaaaacggaagcccaaga

SEQ ID NO: 200603 - DNA, 601 bp, Human
cagtctgtctctgctgcctgaaatgcctgcctctgtctactcaaaaccttttacaaactcaggtgtcacctccacactgaagccttccttgatatcctcacgtgcccctccttcccactcctcaccccaggacagagtttagtgtttctctgtctttttacatcaccgaccagagtctggttatttctccttgtctgtgaatttctgagggtaggagctgtgtgtctttagttccctattctccaggctctagtaaagtagccatcacatcacacaggtgctcgataagttttttaaaaayggaattgatttctttctcgctgagttccaggggcctgtgcagcccgtctgggccccaggctttgtggagagattgcttaggtgttgccttctcgcagcaggtgtgtgtctttcaatgctgtagcagactacgcagaaatggaaaaccctatatatttacttgtgaccctccaggtccccaggcctcttgcaatgcggaaagaggggatccaaaccagaaaacggaagcccaagaacctgaataaatctaagacaccagcaggtgaggaaaagatctgtgagtgattatatgagtacatca

SEQ ID NO: 200604 - DNA, 601 bp, Human
tcgctgagttccaggggcctgtgcagcccgtctgggccccaggctttgtggagagattgcttaggtgttgccttctcgcagcaggtgtgtgtctttcaatgctgtagcagactacgcagaaatggaaaaccctatatatttacttgtgaccctccaggtccccaggcctcttgcaatgcggaaagaggggatccaaaccagaaaacggaagcccaagaacctgaataaatctaagacaccagcaggtgaggaaaagatctgtgagtgattatatgagtacatcaggagccctcagagtgcmtaagaatcatatcttccgggttaggcaggccagcccgggccgccagggggtggtgacagcatcggacatccctggcctttcaggacaggatgaagagcccagcaaaaaagtaacaattgccatggaacgtgttgggagctttcgaagcaggctcaactcaagctggggcctgatcattgccgactgcaaagacccagtgctcaggctggaccagccgaggtcctgcaggaaagaggaactttactcggtcctttcatctttggcgctgcagccacccaaaagctcagttcctttcaattc

SEQ ID NO: 200605 - DNA, 601 bp, Human
tgattatatgagtacatcaggagccctcagagtgcataagaatcatatcttccgggttaggcaggccagcccgggccgccagggggtggtgacagcatcggacatccctggcctttcaggacaggatgaagagcccagcaaaaaagtaacaattgccatggaacgtgttgggagctttcgaagcaggctcaactcaagctggggcctgatcattgccgactgcaaagacccagtgctcaggctggaccagccgaggtcctgcaggaaagaggaactttactcggtcctttcatctttggcrctgcagccacccaaaagctcagttcctttcaattctctttgggctaacggggatccaggagggcagggtccaattaatcatgtccctaacagattgatctctaagccaatgtataattaacatcatgcagtgctttgtgctttagaaagccccttcagaaatattatctccatgaaagtaagactccatgagaaccagtttatgaccccattttactaacaagcaaactgaggctcatagaggacaatgatttaacgagggtcatacagctgttaatgggtagagaattaaaacccaagt

SEQ ID NO: 200606 - DNA, 601 bp, Human
tatctccatgaaagtaagactccatgagaaccagtttatgaccccattttactaacaagcaaactgaggctcatagaggacaatgatttaacgagggtcatacagctgttaatgggtagagaattaaaacccaagtttttctgcttctgggtcaatgttctcttcaatataccactctgccttcttaatttctagattaagaataagggctgctcaaaagtttgaggctgcagtgacctatgatcgtgccactgcacttcagcctggagagcagagcaagaccctgtctttaaaaaaaaawaaaagaaatacatttaaaaagaacgagggctgttcttttttaaatttatttttaataaatatattaactatttattaaatttaaattagatttatttataaaattatatataaatttctgacagaacaacggctgttctttaatacgtttatgttccctaccaaaacattcctcactcagtactgctacccagttaaagatttgactggtcggtgctgcagtcacagagaaaatgaattggctgatctgacgaaaaatttatcttctaacctaaggcatgacagagtcagataaatgggc

SEQ ID NO: 200607 - DNA, 601 bp, Human
tccatgaaagtaagactccatgagaaccagtttatgaccccattttactaacaagcaaactgaggctcatagaggacaatgatttaacgagggtcatacagctgttaatgggtagagaattaaaacccaagtttttctgcttctgggtcaatgttctcttcaatataccactctgccttcttaatttctagattaagaataagggctgctcaaaagtttgaggctgcagtgacctatgatcgtgccactgcacttcagcctggagagcagagcaagaccctgtctttaaaaaaaaaaaaaagaaatacatttaaaaagaacgagggctgttcttttttaaatttatttttaataaatatattaactatttattaaatttaaattagatttatttataaaattatatataaatttctgacagaacaacggctgttctttaatacgtttatgttccctaccaaaacattcctcactcagtactgctacccagttaaagatttgactggtcggtgctgcagtcacagagaaaatgaattggctgatctgacgaaaaatttatcttctaacctaaggcatgacagagtcagataaatgggccctt

SEQ ID NO: 200608 - DNA, 601 bp, Human
aaacctattttgaacagacactaggctgttgatagtctctgtttactccattcagtatgatattcacgtgttttgctgtggggatattattgtatttcattacagaggattatctcaggccctgctggaggtattctgtaataatacacagtatttggatttttaaaaatgtgaatcttcaagttgaatgaggaagaatctttttttaaaaagttttgaagcctgaaacacacgtggcctcaagggtttgagatgagatagggggaagaagccatccctgtgagaactgtagccctccgcwgataaggacctctgctgctgtccccggcaaatgtagataaagccattagcttgcacccatcccggctgtctcgcaggctgccggctgttcgtttgtccctgccgctgatttgggtgtgctgactctgcttcattccagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccaggtacgcgccatgg

SEQ ID NO: 200609 - DNA, 601 bp, Human
tttgaacagacactaggctgttgatagtctctgtttactccattcagtatgatattcacgtgttttgctgtggggatattattgtatttcattacagaggattatctcaggccctgctggaggtattctgtaataatacacagtatttggatttttaaaaatgtgaatcttcaagttgaatgaggaagaatctttttttaaaaagttttgaagcctgaaacacacgtggcctcaagggtttgagatgagatagggggaagaagccatccctgtgagaactgtagccctccgcagataaggrcctctgctgctgtccccggcaaatgtagataaagccattagcttgcacccatcccggctgtctcgcaggctgccggctgttcgtttgtccctgccgctgatttgggtgtgctgactctgcttcattccagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccaggtacgcgccatggctggggcg

SEQ ID NO: 200610 - DNA, 601 bp, Human
gaacagacactaggctgttgatagtctctgtttactccattcagtatgatattcacgtgttttgctgtggggatattattgtatttcattacagaggattatctcaggccctgctggaggtattctgtaataatacacagtatttggatttttaaaaatgtgaatcttcaagttgaatgaggaagaatctttttttaaaaagttttgaagcctgaaacacacgtggcctcaagggtttgagatgagatagggggaagaagccatccctgtgagaactgtagccctccgcagataaggaccyctgctgctgtccccggcaaatgtagataaagccattagcttgcacccatcccggctgtctcgcaggctgccggctgttcgtttgtccctgccgctgatttgggtgtgctgactctgcttcattccagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccaggtacgcgccatggctggggcgcca

SEQ ID NO: 200611 - DNA, 601 bp, Human
gggtgagtggtggtgctcacccccaaaagtgggcaggtgggggtggtttggggagggctcagggacagggattggtgactgtttgagaagctttcctttccctgggtccttgttggatgtgctgggcctggggtcctcactggtggtgaatgcatccggagttgagcacgtggttgcacacgagttttcaaaataaacttttctttgaagcctttaattgaatctgaggcttatggcttttctccaatattcagggcaagatttctcatctgaaaatgtccttgttgttggacctatctgrgcaaaggtgttatgaaaattttttattgggtttgcccagctagatctgttaataatgcttccctgcatggcagcagggaagtaagagctgggccagaagagaggtggggacattgtgagctgaatcgaggtattaggaatggaaaatgccaggggtctattcatctgatccagtgaacatttttcctagaaaaaggaaatgtcatgaaaacacacggaaaacatgtaaatcagctgattctaaacaagggcattggtaagcctggcatgtggaggttataggaaggttgggcagtgccaa

SEQ ID NO: 200612 - DNA, 601 bp, Human
tgctgggcctggggtcctcactggtggtgaatgcatccggagttgagcacgtggttgcacacgagttttcaaaataaacttttctttgaagcctttaattgaatctgaggcttatggcttttctccaatattcagggcaagatttctcatctgaaaatgtccttgttgttggacctatctgggcaaaggtgttatgaaaattttttattgggtttgcccagctagatctgttaataatgcttccctgcatggcagcagggaagtaagagctgggccagaagagaggtggggacattgtgarctgaatcgaggtattaggaatggaaaatgccaggggtctattcatctgatccagtgaacatttttcctagaaaaaggaaatgtcatgaaaacacacggaaaacatgtaaatcagctgattctaaacaagggcattggtaagcctggcatgtggaggttataggaaggttgggcagtgccaagagaatgagttttggcattgacctgggttcaagtcctgcctctgctactttccagatgtgatataacctccctgaggctatagatgtgatataacgtaggtgatataacttccctgagg

SEQ ID NO: 200613 - DNA, 601 bp, Human
ataacaataataaaatcagaatgtgttaacaaactatatatgtataaaaaactatattttctggccaggtgcagtggctcatgcctgtaattccagtactttgggaggctgaggtggaaggatcacttgagcccaggagtttgagaccagtctgggcaacatagggataccttgtctctacaaaaataaaaaaatgaggccgtgcacagtggctcacacctgtaatcccagcactttgggaggctgaggtgggcagatcacttgaggtcaggagtttgagaccagcctggccaacatggtraaaaactgtctctactaaaaatacaaaaattagcctggtttggtggtgtgcacctgtaatcccagctactccggaggctgaggcaggagaatcacttgaacccgggaggcggaggttgcagtgagccgagatcacaccactgcacttcagcctgggtgacaagagtgaaactgtctcaaaaaaaaaaaagaaagaaaaaaaaaaattagccgggtgtggtggtacacacctatagtcccagctaattgaaatgcttaggctgcaggatcacttgagccccagaggtcgaggctgcatgag

SEQ ID NO: 200614 - DNA, 601 bp, Human
tctgactgtgctgtacccagaaccctttggacttggattcttccccttgaccagccttatcagtggcacccatccccttccacactcctcgctaggccctcctcaagggggcgctaactggaaggcatgctgccccactgctaatggccgcctgcttcgtttgtgcacactttttctctttgttaccccactttcctatgaggaggtggacctgtctccagaacaaccagtggggtatatcagcctttttggaaaccttaaccctccttgcccaaactcccagagtattcttatttatttmtttatttatttatttatttatttatttatgatagagtcttgctgtgtcaccaggctggagtgcagtggtgggatctcggctcactgcaacctccgcctcccaggttcaagtgattctcctgcctcagcctccagagtagctgggattacaggtgcctgccaccacgcccggttaatttttgtatttttagtagagacagggtttcaccatgttggccgcctgcctcggcctcccaaagtgctgggattactggcgtgagccgccgcacccggcccccagtgtattcttgattccctccac

SEQ ID NO: 200615 - DNA, 601 bp, Human
gacttggattcttccccttgaccagccttatcagtggcacccatccccttccacactcctcgctaggccctcctcaagggggcgctaactggaaggcatgctgccccactgctaatggccgcctgcttcgtttgtgcacactttttctctttgttaccccactttcctatgaggaggtggacctgtctccagaacaaccagtggggtatatcagcctttttggaaaccttaaccctccttgcccaaactcccagagtattcttatttatttatttatttatttatttatttatttatttatgatagagtcttgctgtgtcaccaggctggagtgcagtggtgggatctcggctcactgcaacctccgcctcccaggttcaagtgattctcctgcctcagcctccagagtagctgggattacaggtgcctgccaccacgcccggttaatttttgtatttttagtagagacagggtttcaccatgttggccgcctgcctcggcctcccaaagtgctgggattactggcgtgagccgccgcacccggcccccagtgtattcttgattccctccactccacaaactactctacagtcagccagct

SEQ ID NO: 200616 - DNA, 601 bp, Human
actgaatatttttcatttctcatagcacctatgaaaggcaactctcatttactgagcccctgctgtgggttgggacgtgttatctcacctaatccatagcaggagcaaacactgtaaggtaattcttgttatattctattttcagacaaggaagctgaggctcagataggttaagcagttttggcaaatttgtcaagacttctgcaaacctagacagaaaaggtgctcaacccccagcccctttatggaaaggatgcatggcttaggggcagatatgcgttggagcaaagagaaagacacrcgtactcttgaatgtactattttagcccctgcttgctccttgacccagagtttttgtgtagaccatagaatgccctgcccatctgtatttggaggtgctgctgcagccggtcacacctgggttctactgacctccagccctggctgtggtcctgcccagggctcagtgtgtattgaacaagtaagtgaatgagacatgcagaaggctgatttcattcttatttgaatgatttcaatcttgattaaccttcttagcaagaggttattttcttctcctggacctcagttcattcatctctaa

SEQ ID NO: 200617 - DNA, 601 bp, Human
cccttctgaagctttacaaataagctgctagcattgtccagccttatagggaattggcaaaaggtgagtttcaggcctacatgggagccagcctcttacagcacagcagttagcaatacacatctaaagaactaagtagctggcatgtgtctttatcatcagaatagattatacaaatgaaggtcgatgcattgagcttatcaaattgttttaaatatagcaacgtttgttttaaaatttttttttaaacctttgaagtaaaactgcctctttttcagtgctcagctgcagtgcatcacgkgcagtacaatgacagctggaaacatggaccccatggaggcgctgtcatggccgccctcagcacagacctgctgttccctatcaaattcatcctctgtgcctatgctctgtttaatatagatttttataaactgtatgaagtaaaattcttcattcctatcttgtgattaacgctggaagaatccaaaaagcacagcgtctgacctccaataagccataaagttaaaagcttttctaggcaatgaatatataacctgatttttttctcctacagatcctctctctccccttctttctccct

SEQ ID NO: 200618 - DNA, 601 bp, Human
ccctatcaaattcatcctctgtgcctatgctctgtttaatatagatttttataaactgtatgaagtaaaattcttcattcctatcttgtgattaacgctggaagaatccaaaaagcacagcgtctgacctccaataagccataaagttaaaagcttttctaggcaatgaatatataacctgatttttttctcctacagatcctctctctccccttctttctccctttctcctttgtgtgaaactctttctttatccctttccttttctataaacttccttgatctttccctctccagtacyccccttcctcattcccttcttcagttccaggatgttctctcctcagcttgcccatatattttgcacctgcaactcatgtgtgtgtcagggagtagaggtgagggattatcccttccgtgagtgacagtcacctttcttttctttgctggctggtgcttttaggagacaaggtgtacaaccttacccctaaggagccagtcctgtccttcgtctctctatctaatgctaataatgataacaatagtagtgatgacggccgggtgcggtggctcatgcctgtaatcccagcacttggggagg

SEQ ID NO: 200619 - DNA, 601 bp, Human
attttagtaattgatattttccttgaatgttagccatttgtctacattttcaaatctgttggcataaatgacagttcataatactgagctgtgttttaataggggacatgtgattctttaaccaaaggtgcccagtgctttgtttctgtaggtcacaaagttcttaggaaaaattctaaagaaacattgagacctgggggatgggtgtgtgtgctgcagggaggggagtctggattgactcttgagtttctctgataatatctcgcatatgtgaaaaagccgtacagtttttcaacacacstattgcttgccttatctcttttgtcttctcaaagtccttgaaatgtagattttataatcagtctcaatttgtagataaggaaaggccaatcagacataccagtttatctataatatagatgagatcagaagccactcctagatcacaccattttaattagaagagagtttagagatcatctcattgagaaactcttaacctgggatccatgtccctcaaagtgctcttgggtagacttcagtggctccataatttggatgagaacaaaattacattatttttcactaaactctaagtgca

SEQ ID NO: 200620 - DNA, 601 bp, Human
cagtgacaggatgaggcaccagaataatgttgcaggcagagagaacagcaggcaggagtatgcttgaattgttcagtacagcagggaggccagtgtggctcttgccgagtgagtgaggggcccacggtaggagatgagatcagagaagtaacaagggggcctttagtggggccattgaaacagcttaggattttctctgagagagatgggagccattggtaagggaattacatgatttcactttttttttttttttgagacggagtctcgctctgtcgccccggctggagtacagtggcgygatcttggctcactgcaagctccgcctcccgggttcaggccattctcctgcctcagcctcctgagtagctgggactacaggtgcctgcaaccatgcctggctaattttttgtatttttagtagagacggggtttcaccgtgttagccaggacggtcttgatctcctgacctcgtgatccgctcacctcggcctcccaaagtgctgggattacaggcgacttttttttttttttgagatggggtcttgctctgttgcccaggctggagtgcagtggtgcaatctcagctcactgcaacctc

SEQ ID NO: 200621 - DNA, 601 bp, Human
tcacctcggcctcccaaagtgctgggattacaggcgacttttttttttttttgagatggggtcttgctctgttgcccaggctggagtgcagtggtgcaatctcagctcactgcaacctccgcctcccaggttcaagcgattttcccacctcagcctccccagtagctgggactacaggggcgtgccaccacacctggctaatttttgtattttttggtagagacggggttttgccatgttggctggtctcgaactcctgacctcaggtgatccacctgccttggcctcccaaagtgctggrattacaggtatgagccaccatgcctggccgatttggtttttaaagaatcacttcttctgctggattgggaatagtctgcagagaggcgaaggcaagcagtgcttaggaggctaatgccatcatccaggggagggatgatggtagggttgagtaatccctggagtgtaacaaacactaaggattattttattttgtggcaaatgtcctaaagctttcttgaacagtaccaggttgctgggaatgtatagagacagcttacagagcaccctacagttttagcaagggaactttcacgtaata

SEQ ID NO: 200622 - DNA, 601 bp, Human
gcaggttgtactcttgtatagttgtgtgtacattggttgtttcctgtagcaaaatcatgaagagtatgaattctagagttagagtccctacattcaaatcatggctccaccagttactaactgtgtgaccttgggcaaataaattaccctaacttctctgagccttcagttttccctctagtaaaatggggacagtgggttgctatgaggagtaatgagttagtgcgtgtacaacatttagcattatactgatatataaccatggctcaataacatagtagctatcattatggatatgaawataaccatttgtaaaggtcaaggaacatctctatttaacttagtttatttatttattttttattttttgagacgtagtctagctctcttgcccatgctggagtgcaagggagtgaccttggctcactgcaacctccacctcccgccttcaagcgtttctcctgcctcagcctccagagtagctggcattacaggcatgcgccaccaggcccagctaatttttttttgtattttcggtagagacggggtctcaccatattggccaggctgctctcgaactcctgacctccagtgatccgcc

SEQ ID NO: 200623 - DNA, 601 bp, Human
acaccccagcttgttgcctggtcaacacctgctcaccttataataacatcatcctattataatactcatcaccttgtccagggatcttcccccaccccctatcttgggactggtgatctactccaggctctagtcactcgtccttttttgttgttgctttgttttttgtttttagagacagagtctctctctgttgcccaggataaagtgcagtggtgtaatcatagctcacggcaaccttgacctcttgggctcaagcgatcctcccgcctcagcctcccaagtaactgggactacaggygcacgccatcatgcttggcttgtgaaaaaacttttttttttgtagtgatgtggtatcaccatgttgcccaggctggtctctaactgctgggctcaggcagtcctcctgccttagccacccaaagtgctgggactataggtgtgagccatcgtgcctggcctgctcatattttttatgaatcttaatgaatctgtcttctctacagggttgtaagctcctcccaggctgagactggttctcatactctatccctagcacccagcacaaagaggggattcctgcaatgtttgtacaactcaa

SEQ ID NO: 200624 - DNA, 601 bp, Human
acaaaaaattagtcgggtgtggtgggtgtgcctgtagtctcagctactctggaggctacgttgggaggatcacttgagcctgggaggcggaggttgtagtgagctgagactgcaccactgcactctagcctgggtgaggctttgtttgagacccagtctcaaaaaaaggaaaaagtttttagaaagttttagaaatactaatttttaaaaaagaagaatctctagcgaccgttcagtgtgatctggagttaggctgttctggttaaacgtagattgtgcctatcgaataataatttctctyaccctgcctagctctacagtcgcctctatacttgtctcaatgacccctgcactgtgagcttcttgaggccaggacctgacgatacagcactaaccattgtattttgcctgtggtgccttcagtacagtgccttctatgtgccggccctgagccaggcatcgatgaaagatgaataagtccaagtcatgacctcaaaggtggcttatagattgatgggacttgcaggccagtaaataccataagtatttgtggggtgacatcactgcacattaagttactcattgggcttactgtcatcac

SEQ ID NO: 200625 - DNA, 601 bp, Human
aagggatctaggttgcacactccttatgaaaatctaactaatgcctgatgatctgaggtgaaacagtccccctcttccccactctgtccctggaacatttgtcttccattaaaccagtgcctggtaccaaaaaggttggggactgctggcttatcggatgcaatttccttgtattctgatgtgctagttttatattcttatagtggaggatccataccgctttcacggttttatgagaaatatctcttacaatctttctatttgttttgctctgaccccatgcccacctggcagccctccstcatgagtgcagttttacctggaagctcatgtgctgacccttcacatagccagccttgtctgcctgcccttatttctcactgaaaaagaatgttagcctttatagtcagacggtgtctcatatgattagctagtttacctttattcattttttcagacgtgggtaaaattgagtacttcaatctttgtcgcagagcaccaggctctaagaccaggttggtagaaggattctatttcatgtgccagttctgacaaattgtttattggtactcaaagtgccatgttgaaaggatccaggctg

SEQ ID NO: 200626 - DNA, 601 bp, Human
ttatattcttatagtggaggatccataccgctttcacggttttatgagaaatatctcttacaatctttctatttgttttgctctgaccccatgcccacctggcagccctccgtcatgagtgcagttttacctggaagctcatgtgctgacccttcacatagccagccttgtctgcctgcccttatttctcactgaaaaagaatgttagcctttatagtcagacggtgtctcatatgattagctagtttacctttattcattttttcagacgtgggtaaaattgagtacttcaatctttgtygcagagcaccaggctctaagaccaggttggtagaaggattctatttcatgtgccagttctgacaaattgtttattggtactcaaagtgccatgttgaaaggatccaggctgagggggacagggccagaattgattaacaatgtctgccagggactgaaaaaaatggcattgttaagcttgccttagagcctgagacagtcaaccattccctctctcctctaccaaaaggtagtcaaccactccctcactgtccttctctctctcagcatgtatcattagagacctccttccagactggct

SEQ ID NO: 200627 - DNA, 601 bp, Human
tgtctgccagggactgaaaaaaatggcattgttaagcttgccttagagcctgagacagtcaaccattccctctctcctctaccaaaaggtagtcaaccactccctcactgtccttctctctctcagcatgtatcattagagacctccttccagactggcttgatctgtttatatttatcaacaacagcacactgtatctttttggtctgcctgcttcattgtatcccgttattgtgtccttttcacagtcaggagtcttttccttcctctgtatccccaggccctggcatacaataggtaygttgaatgactggctcacaacctaagagttctacctaattgttctgcatgcagggaatctgccttattagggtcagtcgtttgccttgctgagatccatactacagagttccgtggatcctcttggtctgttccatctaggaataaaacgtacattttgcatgcccttttttttttctttcttaaactcctgctagctcattacgatcatggcttgctgtctctctctctctgttcttctctcatcataaaacagcttcaacttttctccccagtgtccctttgaaactgttggtgagct

SEQ ID NO: 200628 - DNA, 601 bp, Human
ctactctgtccagcattacccttgtcataattgttggtgatttcaagatccacatgaatcatgaatcatcctttaatagctttgagattcttttctccaatattcttgtcttccaccagatctcagccactcacttctctctctctctctctctctgtctctctttttttttgagacggagccttgctttgttgcccagattggagtatagtggcacaatctcggctcactgctatgtctagcctcccaggttcaagcgattctcctgcctcagcctcccaagtagctgggataacaggcrcctgccaccacggccggctaatatttgtatttttagtagagacggggtttcaccatattggccaggctgatctcaaactcctaacctcaggtgatccaaccgccttggcctcccaaagtgcggggattacaggcatgagctactgttcccagctagatttcagccaccttcttctcttatcttgaccctataattacagtaactttaatcctgccataatctcagtttaaacctcctatcttcccagcttacctgtactagtattccaactccaacaattctgtgaccttatctggactt

SEQ ID NO: 200629 - DNA, 601 bp, Human
ttttctccaatattcttgtcttccaccagatctcagccactcacttctctctctctctctctctctgtctctctttttttttgagacggagccttgctttgttgcccagattggagtatagtggcacaatctcggctcactgctatgtctagcctcccaggttcaagcgattctcctgcctcagcctcccaagtagctgggataacaggcacctgccaccacggccggctaatatttgtatttttagtagagacggggtttcaccatattggccaggctgatctcaaactcctaacctcargtgatccaaccgccttggcctcccaaagtgcggggattacaggcatgagctactgttcccagctagatttcagccaccttcttctcttatcttgaccctataattacagtaactttaatcctgccataatctcagtttaaacctcctatcttcccagcttacctgtactagtattccaactccaacaattctgtgaccttatctggacttccagttaattgatcctgctattttttcactgtctttcacctcaattcctctatttcctgcttccccagctttaattctatagggaatcac

SEQ ID NO: 200630 - DNA, 601 bp, Human
tagtggcacaatctcggctcactgctatgtctagcctcccaggttcaagcgattctcctgcctcagcctcccaagtagctgggataacaggcacctgccaccacggccggctaatatttgtatttttagtagagacggggtttcaccatattggccaggctgatctcaaactcctaacctcaggtgatccaaccgccttggcctcccaaagtgcggggattacaggcatgagctactgttcccagctagatttcagccaccttcttctcttatcttgaccctataattacagtaactttawtcctgccataatctcagtttaaacctcctatcttcccagcttacctgtactagtattccaactccaacaattctgtgaccttatctggacttccagttaattgatcctgctattttttcactgtctttcacctcaattcctctatttcctgcttccccagctttaattctatagggaatcactatagtcactgtcaactacctttgcccctttcctgattcatcgttctcgtttggccacatgataacccttgttaaattcaacttttaccagccttccccccatatctgtgtagctgaa

SEQ ID NO: 200631 - DNA, 601 bp, Human
tcggctcactgctatgtctagcctcccaggttcaagcgattctcctgcctcagcctcccaagtagctgggataacaggcacctgccaccacggccggctaatatttgtatttttagtagagacggggtttcaccatattggccaggctgatctcaaactcctaacctcaggtgatccaaccgccttggcctcccaaagtgcggggattacaggcatgagctactgttcccagctagatttcagccaccttcttctcttatcttgaccctataattacagtaactttaatcctgccataatytcagtttaaacctcctatcttcccagcttacctgtactagtattccaactccaacaattctgtgaccttatctggacttccagttaattgatcctgctattttttcactgtctttcacctcaattcctctatttcctgcttccccagctttaattctatagggaatcactatagtcactgtcaactacctttgcccctttcctgattcatcgttctcgtttggccacatgataacccttgttaaattcaacttttaccagccttccccccatatctgtgtagctgaatgtggctgtagca

SEQ ID NO: 200632 - DNA, 601 bp, Human
aaacatctctcaacagttcccatgtggagaaactgtgaagcttttcacagcaaatgttttagagtgttcccaggtatttgcaaagctcctatcataatgctggctgtactgataatttcctaagggtgcctgccatgagacgatggaaagggcatcaggtctgaccatggtgagccatgagggccttgcagagatagagtcaactctctgggcctcagttttcctttctataaaatgagtgacttggactctgttgggacccctctgcctctaagattctactagtctgtgattccatgartcaaacttcagaagtggttatggtccctcataaaatggcaaagatttgggtcctagaatctatgactccattagcaggaccacatctcctctagaacattttggcttcgtgcttgtcatcatctttttgtactaactgctctgattcaatctctttccctgaagacttgcttccaccagaattccatttaattccacagatgttgaatgaagactttctgtgtttccaactgcatgcctacaaagataaatgagactagtttcctaaccttggggaattcccagtgagatagcaaggtca

SEQ ID NO: 200633 - DNA, 601 bp, Human
tattgacttcaccagggagcttgttagaaatggaaacctacagaatcagaagctctggggttgtggtgcactggtcttagttttgttctgttttgttttgtttttgtttttgtttttgttttcgtttttgagatggagttccactcttgttgcccaggctgcagtgcaatggcatgatcttggctcacagcaacctccagctcccaggttcaagcgattctcctgcctcagcctcctgaatagctgagattatgggcatgcaccaccacacccagctaattttgtattattattattattwttttttttagtagagatggggtttctccatgttgatcaggctggtcttgaactcccaacctcaggtgatctgcctgcctcggcctcccaaagtgctgggattacaggcatgagccactgtgcatttggcctggtcttagtttttaacaagtcctctagagagttgagatgcacacttgagtttgagaaccattgaactagccctttcagggacaagctatgagactgtggttctgagccctcaagggacccaaggacacattttgaagaaaattcagttacttgggctgccaggacttgg

SEQ ID NO: 200634 - DNA, 601 bp, Human
catgaagggtcgggcaggtgtggctcttggagagggcctgcctgggtcttgggaatgctcccccttgtcctccttcctgggatctgcagatccatcatctactgccccaacccagggctatatgctaaaccacaggagccttcatgaaaattagaaaagcactcctgcctttttttttttttttttttttctgagatggagtcttgcactgtcacctgggctggagtgcagtggcgccatctcagctcactgcaacctccgcctcctgggttcaagtgattctcccgcctcagcctcccargtagctgggactacaggtgcgtgccaccatgcctgactaattttttgtatttttagtagatttggcgcttcaccatgttagccaagatggtctcaatctcctgaccttgtgatcctcccgcctcggcctcccaaagtgctgggattacaggcgtgagccactgcacctggctgaaaagcaccccccttaaggtgcctcttagggtggctcagcccctggggctcagggcttggctggattccagttcctctcacctccttgagcaggtgcctgtgtgcagcaccaaccacatagccatag

SEQ ID NO: 200635 - DNA, 601 bp, Human
agccctcagcgttatgcatgggtatgtcagaacgttggtttcttgccaggctactggtatttgtgggtgcctcctcccctaaaatcattagacttgtgaggcggcaaggatgagttgtgtgtgcaggcactcagggacgagtcacagcctggcaagctggcctggacaggatgacttcacgggcctttcccacttctcatttttatgactagctttactgtttcattttggctttctctctctttcttgcagctgtggtgattaggatttagggcaagcatttgggatcccttttctaatmcctttcaaatcctgattcagctgcaaagtccgggaagggagtagagaatgggggaggagggactcaccctggtgaaaggcagtagctcagaatatccgagaaactcccaacaggaatgcccagcctccacccactaaagctggagacctctcatctcatccaatatcaccctcgtactagaaacgcaaaagggatgagtttgtctatggactcaaacctttacagtcttcttgcttagaagcttaaggcataattatggtagtcatggtggtaagggacttaacatttgcctttttccaa

SEQ ID NO: 200636 - DNA, 601 bp, Human
gcctggcaagctggcctggacaggatgacttcacgggcctttcccacttctcatttttatgactagctttactgtttcattttggctttctctctctttcttgcagctgtggtgattaggatttagggcaagcatttgggatcccttttctaatccctttcaaatcctgattcagctgcaaagtccgggaagggagtagagaatgggggaggagggactcaccctggtgaaaggcagtagctcagaatatccgagaaactcccaacaggaatgcccagcctccacccactaaagctggagrcctctcatctcatccaatatcaccctcgtactagaaacgcaaaagggatgagtttgtctatggactcaaacctttacagtcttcttgcttagaagcttaaggcataattatggtagtcatggtggtaagggacttaacatttgcctttttccaatttaactgtgtcctttgttgaaatatttcttagtcaggtccccttttctctatttccactactgtcctaggattagatctgagtccccctctcaatgagattagtccagaaattatgtataccatccatcttgcaaaccactgcca

SEQ ID NO: 200637 - DNA, 601 bp, Human
ctctttcttgcagctgtggtgattaggatttagggcaagcatttgggatcccttttctaatccctttcaaatcctgattcagctgcaaagtccgggaagggagtagagaatgggggaggagggactcaccctggtgaaaggcagtagctcagaatatccgagaaactcccaacaggaatgcccagcctccacccactaaagctggagacctctcatctcatccaatatcaccctcgtactagaaacgcaaaagggatgagtttgtctatggactcaaacctttacagtcttcttgcttagmagcttaaggcataattatggtagtcatggtggtaagggacttaacatttgcctttttccaatttaactgtgtcctttgttgaaatatttcttagtcaggtccccttttctctatttccactactgtcctaggattagatctgagtccccctctcaatgagattagtccagaaattatgtataccatccatcttgcaaaccactgccagactctgttgacttttcattatgtaacttccctatgggagaggtgagttacataatatgatgctaagatgcccctcactggtggcatcatgta

SEQ ID NO: 200638 - DNA, 601 bp, Human
ggtcctggcagctccccacctgttaagattgtaggggccactcctcacctgccaactctttctgcaggaagatgcctctcggagcccctgagctgcattcttctatgttggaagctttctttcctcttttgctttctaaccctcttttcacagggcttctctctcccttccttcccacgcactttccagttatctctacccctgctgctgcccccactcttctcagcaggtcagcctgcattctccccagtttcctgcctctgcggctgcctttttgttccttcctcctccgggagggcasggggccagccgcccaatccaggaaactcgcatcctgatttggtaaacaatgtcccaccctgacttgtccattcccagtggtccctgtcccctccagctaccatgaatctttggtggggaaataaagggaaataatctatttttaaatatctatttgtaaattatctatatgtaaatatctatttgtaaaatgtaaaatatcttcctagagcagagtggagaatgagctttagagccagactcagcaccaactccccaggagagggcacccaggagggggttctcagaatgtgacatattc

SEQ ID NO: 200639 - DNA, 601 bp, Human
caatgtaaaagtttattttgccaaggttaaggacatgcctggagaaaaggaacacaaaatcacaggaacaatctgtggtctgtgcctttttccaaagatgattttgagagcttcagtatttaaaagggagagagggagggcatggtcacattactgaatccacatgttgcaagagaaaaggagcaggtaggggaacagtcaattatgtattcctctagtgctcagtaaatcaacactttacataagataaggtgaacatagagtagctacttatgcagatatttaaccttttatctgtagmtatctgcttaggaacaaaagcaaaggcagtttcttgcattactcagcttttagcttaatttttttccttttggcatagtgatttgggatcctgagattttattttcctttcacaaactgtaccccaataatagctaatcttgtcctgtgctaggtactttcaaatacagtattccacttaatacttaaaatagccgtttgagataggtactatcattatcttttttttttctttctaagagataaggtctcactatgttgtccaggctggcctcgaactcctgggctcaagcaaccctct

SEQ ID NO: 200640 - DNA, 601 bp, Human
ccttggctgagtgtaaacccagagggccttctgagaaatgaggctcataggactgtttccagcaggccggtggaggaggcaaggctgtggtctccccttggctctcaccgcaaaggcccatcccacagagggcaaggcatgaggcctggatgctctgaaagtcactcagcactcacccacagcattctacagatgggaaagttttattctagtttagtgaaggtgtttgagattcttttggttgaaagtgtcaggaattccatttttttctaaaaggaggggggagtgcattatattatcyatggaaataaggatggcagttgtgagagtcctgctttcactgcatctcccctccactcctctccttctccagtccacagtcaggaagcatggccccaccagcccctgaggctcacttgttctcagtttgagcctccttttattcagttctggttcctaaatgccagtaaaggactctgattgtcaaaccctgtaccaaccaacagtggccaggagtgagactacctcagaccaccacggcagctccccgatgcaaggtgtctggagtgagaaggaagggcagtttctagaaaaaccaggt

SEQ ID NO: 200641 - DNA, 601 bp, Human
gttctcagtttgagcctccttttattcagttctggttcctaaatgccagtaaaggactctgattgtcaaaccctgtaccaaccaacagtggccaggagtgagactacctcagaccaccacggcagctccccgatgcaaggtgtctggagtgagaaggaagggcagtttctagaaaaaccaggtaccagattaaataataggtgtctgtactgaggtccctagaggctgtccatgcctttactctacaggtaaagaaatagcctacaagagctacctgatttcccagaacttccctcacttkttcgaggtagaggggaactagagcacagtcttctagctcccaatccagtgccttttccattacaccaagttataatcttttttagttccagtttctcttatggcacatggccaaaataagccttagtaacaagctgtcattctgaaacccaatgcaatagttcttttaattccccctccccactaacttttttttttttttttttttttttgagatggagtcactctctgtcacccaggctggagtgcagtggcacgacctcagctcactgcaacctctgcctcccggtttcaagcaatt

SEQ ID NO: 200642 - DNA, 601 bp, Human
cctacagatgtaaaataagacaaaatgccaccataattctcctttgctataaaatggttagcaggtatcttcagcattccccaggcactattctcaacactctaccatctccattaatttaacctttttgaggttcttatgaggtaggtgctatttttattctcatgtcttataaagaagttaagaaaattgcacaaagggctgggtgtggtggctcatgtctgtgatcctaacactttgggaggctgatgtaggagaatcgcttcagctcaggagtttgagaccagcctgggcaacatartaagacatcatctctatttttaaaaatgagaaaacttctattttatttaaaaataatgataacaataaaagaaacttgtacaaggtcacaaaaaaagctgtttgtttcaccctgaagtaaaaatgactgattggatctacaaactttcctagtgatatttgtatcctaacaggaaccaaaacacagacaatcaaactcagaacagtacattctaaattgtattgttgtgaaatgaaacagctttacttccctagttcatttattgcccaccatatttcttactccaatgtaaagagacat

SEQ ID NO: 200643 - DNA, 601 bp, Human
ccttttcatccactgtctttattaactgtaccctaaggaactgtttccatattttattatcttctataaagtgtggatttaggaagagttgttaacctcggctgggagtgattattcaagttctgttttagaggggtgcagggacccagttgctttggtgtgggacactttataggtgtcctagattttaaaaagggggtaaacagatgtaagatattagaactcgcattctcttttttggctaagtgccaaagactagacagtatactgatatttgagccagcacgaggtagtctacccyttaaaggacagaattactcatacactgagtaccgtgtccttactttttaaagttatggataaagccactgagttaacctacagatgaccaggctaccaaaaacaagtcatgaggaagaccagcccacatggaagcaaataaaactcagctaatctgacacttagttcgtgcagtgcataactgttgccatgtgtaattgttgcagtgtgtcattgttgcaatgtataattgttgttatacctcatggcaagcaattaagcattaatggaaagcagtttgcacaaatggctgtaattagtg

SEQ ID NO: 200644 - DNA, 601 bp, Human
ccctctggactctgaatcgcaggggtggggtgggcggtatgtgttcttaggctcctctaagaccccaggatcccaagttgagtgcagcctgaatcatcctcatcttccggttgaagatctgacgcttcctcaaaatccataacaaaaactcactcccaccgaatactcatgggtttcatagagtttcctaaagaactgggggagcctgggaaaggtcatctcacacactgctcagcaaacaacctagagatctctttagacacccccctctagacacctccacctcttcaggtgttctacytccccacaaccatcctctggaggcacccttcctcctcttcaggcatcctcccctctgcccggatgcttctctgtcccatctcagcttcccaccatcttgcccactcccttcctgccctttctccttctccttctctgtctccttctccttctccttctccttctcctcctcctccacctcctcctcctcctccttcttcttcttttcctttgtttttttaagacagggtcttgctctgtcgtccaggctgtagtgcagtggcacaattatggctcactgtaccctcaaccttccgggttc

SEQ ID NO: 200645 - DNA, 601 bp, Human
aaaaattaccctggtgtggtggtgcatgcctgtaatcccaattactcaggaggctgaggcaggagaatcacttgaacctgggaggtgtaggttgtgagccaagattgcaccactgcactccagcaacagagcgagactccgtctcaaaacaacaacaacaacaaaaagccactaaaactaataaatgagtttagcaatgttgcaagataaaaagtcaatatacttaaaaaattacttcattgtatttctgtacactggcaacaaaagtcagaaattgagattttaaaataccaggtataayggcatcaaaaatatgtaaattagggataaattttaaagatgtgtatgatttacacattgaaaaatataaaagatttctgagattaatttaaaaaaaacctaaataaatggagagatataccctatcatggattggaagacttaatatggccaagatgtcaattctttccaaattgatccatagattcaaagcaatccccttcaaaatcctagcagacctatttttttagaaatcgacaactgattttaaaatatacatgaacatgcaaaaaaactagaatagtcaaacccagtcagttct

SEQ ID NO: 200646 - DNA, 601 bp, Human
aattctgaatcattgctcctagatgaaatacagagttgggttcctgagagcttccaatcacaacattcatcaatcaatacataaacttgtttgatgttctgtttaaacacacgtttttgagtatatactgttaattcattaacattgaaagctatcgttcatattttgaatgaagtacttaggaacaatagacagcagatcagcattactcttgggggccattttcaacagcaaaatctccaacaagaagtacaaaaaggcaaaaaatgtggcactgcatagaccacagaaaggatgcttkttcatgggatgagagctgaaataagaagacagaacgttgccttgtttgaccttacctgggaatatgtgtcctgggtgactcaaattttttgccactctgtgtatgtccatgaatggctgagaaagtgtcatgggtattgacttggggttacaagcaaattttagcaagtaggcagattcacaaatatggaatctgtgaatcatgcacattaaacaaagctttgaaaaagataaagttcatctttaaattttgtttaaactacctgatttcaagactaagtataaaacaacagtaatcaag

SEQ ID NO: 200647 - DNA, 601 bp, Human
atcacaatgaaaacatttgctcttcagtactctgctactaaaatgaaagggcaagccacagattggaataaaacatttgcaaaacatatgtccaacaaaggactttagaatataaggaattcttagctcagtaccaagtaccaagtattcagtaccaagaagacaaacaccaccataaaaatgggcaaaatatttgaacagacactaaaccatggaagacatatgggtagtgaagaagcacatgaagagatgctcaatgttatcagacaggagatatcactatacctccactagaatggatttttttttttttttttgagacagagtcttgctctgtcgcccaggctggagtgcagtggcgtgatctcagctcactgcaacctctgcctcctgggccaagcaattcccctgcctcaacctccaagtagctggatctacaggcacgcaccaccaagcctggctaattttttttttgtatttactagtagagatggggtttcaccatgttggccaggctggtcttgaacttctgaactcagatcatctgtccacctcagcctcccaaagtgctgggattacagtcttgagccactgtgcctga

SEQ ID NO: 200648 - DNA, 601 bp, Human
gccagttgtcactcaataaagctgacattcattaatcagaacaaggtttcggaagtaagtagtggcgctggaccagactgcctttctggaatagtttgtttgtggcatcagtggaggatgagagaaggaatgtaagcagggataaagtatggagcaatttgattctcaagctaagttccaacagtgtcctttgttgagtaggggaattgaacacagggtgtcaagggcaaaaccaggtcattttagtaaattggggctggcaataatgtatgtgctgtattagaggtagagagtggggcagggatgccttcactcatccgctcattcattcaatacctgtggattcccctctatgggcctgatactcttatggggtatttttcttacatattagggacccaagaaacattcagatcttggcttcccttttaccccccacacagagagcagaatataaaagatggaatcagagaacaattctaatcagtccagtcaattcagtgtatgtttcttacgcccgcagaattaagtaggagaccacggcaaccatcccagccccagggaggagtttatgacatcagataggtgatggctggtgggt

SEQ ID NO: 200649 - DNA, 601 bp, Human
cagggaggagtttatgacatcagataggtgatggctggtgggttcagagtaattaagactgatggataactgcagagaggaaatctagttttcagggcaaacagatgcgtccaagagagagcccacacacgtggttggatgcagctggagatggagaattccagttcaaggaaaaggcctgggcagtatgtgtttggtggtggtcgttgaccctgaaaatagatggaatcttggagggagaaagcgagtgtggaaagtgaaggtcaggttgtgagctctggggcagcccacagtcagaggrtgggtcaaagctagaagggcgagcaggccgcacgcacacacacgcaaagcagctgccttcactgacaatcaatggcagccacctgagctgtggctgagctgctgtgagccgaagcagtgggcttgctaaatgccgtcatccagcttccccttgaccctggctgtcaggcctgggtctgggagcttagggatcattttgtgcagtctgctcaccctctggctgtgccagggcacaggattttctacaaaagaaggaatctggggtgagtagagccccatgggagaactgagctgactaaat

SEQ ID NO: 200650 - DNA, 601 bp, Human
ccatgggagaactgagctgactaaatgtgagtggagaaatgccaattatgaaaaaaatgtacatatcaggggaacatgagcttgaaccttgcacagcttttcctccgcttggctgtttttatgaggacccaggcaagtggttctcaaagtgtggtccccccggaaaacaatatcagctttgcccggaacttactagaaatgcaggttcccaggcttaccctagacccactgaatcaggacctctggaactggggcccaggaatgtgggttttcccaagccctccaggggatgtcgatgtaygctgcagtttaaggactactgacttagatgttttaaataagatctctccctggcagcatccactcaaaagggggtttatattaagaacataatgtgacaacggtttggaaattgaaaagcactctacaggagtaggacattatttttgtttgtttattatttttgtcaacctcattcactcagatttcactgtattttagaacttgtttcagagattccccccttcctccttttcccttccccgaggaaaaccaaaatcttgttagtgaacaggagaattgattgaaaaaaaattcaact

SEQ ID NO: 200651 - DNA, 601 bp, Human
gataaacaatttctgatttctacatctcagattaaataacagcaagagctataaaaagtagagggtgtctcctaaaggtgttcatttgctttaactccaaagatgagattaaactgtcattggtgtcaacagcgtgcagtgcagcttgtctaaaattctgaaacgttggtgaaaccctttgatttagccctggatgatggccatagcctttgccccatgctccgtgctcccccctcagttctgcctccttccggtgtaagcagatgaaagtttccaagttctctggactgagatgcaggcrccagggtttctaaaggaaggcacttacatctagggtgcatgggagtctctggggaaactgtggttgggtttgagcacagctttggggctcttggcagcaaatcttcactaattagtttcacctgggaagactgagttatccctcttaaaattctccaggcactgaaacaagcgagcagattttgctgactgtcagatacatgctaatggtagctccctggcaaggtgtatctcaaatttggccaggtctttttgttatgaaattccaaattacctactttgctgtatcacttcaatttag

SEQ ID NO: 200652 - DNA, 601 bp, Human
gcctcccaaagtgctgggattataggtgtgacccatcgtgccggcccatgtttgcagcttttataggtacccaataaagtgaaactattagaattgggatgtgagcaaaatttggttgaagttcaactctctgccatgcttaaataggtatgtgccactgacacttttcttttcccccttgatttaggaaaggagaaggatgctaacatttgttgaatacttactgtcagccctgcacttcgggaggccagggcgggtagatcgcttgagctcatgagttcaagaccagcctgtccaacayggtgaaaccctgtctctacaaataatacaaaagttagctggtattttgctgagcgtggtggctcacgcctgtaatcccagcactttgggaggccaaggcgggcagatcacctgaggtcaggagttcgagatcagcctgggcaacacggtgaaaccctgtctctacttaaaatacaaaattaggtgggcatggtggcacatgcctgtaatcccagctactcagcatgagtactgaggcatgagaatcgcttgaacctaggaggcggagaatgcggtgagccaagatagcgccattgcactc

SEQ ID NO: 200653 - DNA, 601 bp, Human
taggaaaggagaaggatgctaacatttgttgaatacttactgtcagccctgcacttcgggaggccagggcgggtagatcgcttgagctcatgagttcaagaccagcctgtccaacatggtgaaaccctgtctctacaaataatacaaaagttagctggtattttgctgagcgtggtggctcacgcctgtaatcccagcactttgggaggccaaggcgggcagatcacctgaggtcaggagttcgagatcagcctgggcaacacggtgaaaccctgtctctacttaaaatacaaaattaggygggcatggtggcacatgcctgtaatcccagctactcagcatgagtactgaggcatgagaatcgcttgaacctaggaggcggagaatgcggtgagccaagatagcgccattgcactccagcctgggcaacaagagtaaatctccatctcaccaaaaaaaaaaaaaaaaaaagttagctgggtatggtggtgcgtacctttagtcccagctactcgggaggctgaggtggaaggattgcttgagctcgggaagcagaggttgcagtgagcctagattgtgccattgcactctagcctgggtg

SEQ ID NO: 200654 - DNA, 601 bp, Human
ctaggcagaaggaatgacctttgcaaaggtcccaagacatgaagaagcttgatttgaaaatggagagggccatgtaaatggagcagagaaaataagaggaggcttgagataagactggagaggtgaaggggtgggtcttgtagcccccttgaccatcacattagagtttttggactccatcctaaagcagtgataagccattaagggttttaagcagaagagaggcaggagcagattactctggctacaggaggatgctaggctgggatgaatacaggaaaaccagttaagaggttgccayggctgttcagccaacagatgatagtggctccatggtggcaggggagatgaagagaagtaaatccaggattgactgggtctgaggggtacaggagagggaggaatcccatgactttcaagtttctgttcccatcttcgaccccagggtaaaagttagctattctaaaaattcatctttgctaaagagaaattaaagaatacttcagaatcatccccagctgtcccatttctgcccagtgacatttattaattgagacagagctctaggctgcccagcaagggaggctgtcaagtcaacaat

SEQ ID NO: 200655 - DNA, 601 bp, Human
atcacattagagtttttggactccatcctaaagcagtgataagccattaagggttttaagcagaagagaggcaggagcagattactctggctacaggaggatgctaggctgggatgaatacaggaaaaccagttaagaggttgccatggctgttcagccaacagatgatagtggctccatggtggcaggggagatgaagagaagtaaatccaggattgactgggtctgaggggtacaggagagggaggaatcccatgactttcaagtttctgttcccatcttcgaccccagggtaaaagtwagctattctaaaaattcatctttgctaaagagaaattaaagaatacttcagaatcatccccagctgtcccatttctgcccagtgacatttattaattgagacagagctctaggctgcccagcaagggaggctgtcaagtcaacaatagatggctactaagcaccaactgtgtgaagtgcatggcattatacaggcaccgtaaggaacaccaagacttagagacatggctctgtccttcacagagcttacaagagtaggtaagagagatgagttaggaacacctgacaaccctgtgcttgt

SEQ ID NO: 200656 - DNA, 601 bp, Human
tgatagtggctccatggtggcaggggagatgaagagaagtaaatccaggattgactgggtctgaggggtacaggagagggaggaatcccatgactttcaagtttctgttcccatcttcgaccccagggtaaaagttagctattctaaaaattcatctttgctaaagagaaattaaagaatacttcagaatcatccccagctgtcccatttctgcccagtgacatttattaattgagacagagctctaggctgcccagcaagggaggctgtcaagtcaacaatagatggctactaagcaccractgtgtgaagtgcatggcattatacaggcaccgtaaggaacaccaagacttagagacatggctctgtccttcacagagcttacaagagtaggtaagagagatgagttaggaacacctgacaaccctgtgcttgtgtcacatgagcatgagttcattcatccattcaacaagtacttgttgagcaaggacaaagtgccaggcactgtgctagataccgggatgcagtggatagcagggcacacaggttccctaactgtcatgacagcttttctggtgtccatagctgggggctggctctg

SEQ ID NO: 200657 - DNA, 601 bp, Human
tctgagatgtcattgtgttcttgatgcaggacaagtgagccccaaagtggggcttagcccatgagggttcttggctttatccaggagagaattcaagggcaagcagaggtagatgtaaacagctttattgaagagacggtgttacagccctggcagtgttacgcctccgtgactgctcctgcagagcagggctatccttataggcagagagtaggtagtagctcagggcagttttacagtcatatttatacccacttttttttttttgagatggagtttcccaggctggagtgcagtggcrcgatctcagctcactgcaacatctgcctcctaggttcaagtgattctcctgcctcagcctcccaagtaactgggattacaggcacctgccaccacatctggctaattttgtatttttaatagagatggggtttcaccatgttggccaggctgctcttgaactcttgacctcacatgatccacctgcctcggtctccgaaaatgctgggattatgggtgtgatcccagtggcctatacccacttttaactgcatgcagattaagaggcagtttatgcaggaatttctagggaagggatagt

SEQ ID NO: 200658 - DNA, 601 bp, Human
ggggttcttttagcctcttggagaggggagcaaggacaacaatcactcagatttgtttagaagaggaaagctgaaccgtagggtctcatcattaaagggggagactgactcctggatctgggcaccttccccagggaggattgtggggactttttatctgttaggttcaatgacattcagcctggctgcacactggggctacctgggagctttgacaaacaccactgcccaaatcccaccccctgccagtctgatttaattgtggtggggagtaccttggcatcaagattttcaaaggtcsctgctgcttctgtagatgggagcttgcagttactcacagactcttctgcggatatcccagtctgtcctgaaaggaacaagcatatccttgcctttctctacctaccctgtgcagggaagccttttagaaaaaaagattgttccttcaaggtcctggttccttgcttttgaaatggtactttcaaaagggttcttttgtaacaggttgatttttttgtcttcctccattattataaaagttcctgttagaaaatttgaaatcagacaattataaataaaagaatgaaaaatcacctgtatt

SEQ ID NO: 200659 - DNA, 601 bp, Human
actcacagactcttctgcggatatcccagtctgtcctgaaaggaacaagcatatccttgcctttctctacctaccctgtgcagggaagccttttagaaaaaaagattgttccttcaaggtcctggttccttgcttttgaaatggtactttcaaaagggttcttttgtaacaggttgatttttttgtcttcctccattattataaaagttcctgttagaaaatttgaaatcagacaattataaataaaagaatgaaaaatcacctgtattcacaccactacttggtaaccatggtaggtagrgttcctgccagacccctgatggggcaaggcagcatctgcagtagagattgggaggacccaggtggagaagctgctgccacccttccagagctggttccagcatgctggagcgtcacctcccagccatcaggacttcatgcagggacactgcccacccacttagggagcttagagtctagtaagagagacacagtacatccatcgctctataaatacatacgtagttaacattatgattcatgccaggagggaaaagtgcaggggtgggctgacagctgatgggtgaggccaaaagtgtaa

SEQ ID NO: 200660 - DNA, 601 bp, Human
tagaaaatttgaaatcagacaattataaataaaagaatgaaaaatcacctgtattcacaccactacttggtaaccatggtaggtagagttcctgccagacccctgatggggcaaggcagcatctgcagtagagattgggaggacccaggtggagaagctgctgccacccttccagagctggttccagcatgctggagcgtcacctcccagccatcaggacttcatgcagggacactgcccacccacttagggagcttagagtctagtaagagagacacagtacatccatcgctctataaayacatacgtagttaacattatgattcatgccaggagggaaaagtgcaggggtgggctgacagctgatgggtgaggccaaaagtgtaaagaatgtttaaaggtcctcatagcaagaggttaattttctcatcaccattcaggcaacccaaagctacttcagcccggaactcagaaacctactgctgttcccaagaaagcaatgcttttcattgaactttgctagaggtgcttaaattttcccaggcctgagaggatctgtggtgctgccagacttatccttccgaagcacaacttgggtgaa

SEQ ID NO: 200661 - DNA, 601 bp, Human
tacttggtaaccatggtaggtagagttcctgccagacccctgatggggcaaggcagcatctgcagtagagattgggaggacccaggtggagaagctgctgccacccttccagagctggttccagcatgctggagcgtcacctcccagccatcaggacttcatgcagggacactgcccacccacttagggagcttagagtctagtaagagagacacagtacatccatcgctctataaatacatacgtagttaacattatgattcatgccaggagggaaaagtgcaggggtgggctgacagcygatgggtgaggccaaaagtgtaaagaatgtttaaaggtcctcatagcaagaggttaattttctcatcaccattcaggcaacccaaagctacttcagcccggaactcagaaacctactgctgttcccaagaaagcaatgcttttcattgaactttgctagaggtgcttaaattttcccaggcctgagaggatctgtggtgctgccagacttatccttccgaagcacaacttgggtgaaattgctggtctccctttttaaagtttttcccttgagtggtccccattgcccgctgattggagt

SEQ ID NO: 200662 - DNA, 601 bp, Human
agtgcaatggtgtgatctcggctcactgcaacctccatctcccgggttcaagccattctcctgcctcagcctcccatcttctgagtagctgggattacaggcgcgtgccaccacgccaagctaatttttgtatttttagtagagacggggtttcaccatgttggtcaggctgatctcgaacttctgacctcagatgatcctcccgccttggcctcccaaagtgttgggattacaggtgtgagctaccacgcccggccagtgatagcttttaaccagagaaaattctctttaatatattcamcccctttaatgctctctgattatctccagttttaatggcaaaatcaatggtacagctagctgtttcatggtatccaagctgttctccttgctgggaaatagtgttagagactgagtcagtgatggatggaagatgcctttaatcttttcatccaccaacatattcttagttctgttgcagtagatgcatactgcaagtccattcctacgttgcatgtgaataaacaggcagagcttagcacttagtggacatgtaataaatatttgaccaaaataagaccacgaatagacatgtatctat

SEQ ID NO: 200663 - DNA, 601 bp, Human
gtgccaccacgccaagctaatttttgtatttttagtagagacggggtttcaccatgttggtcaggctgatctcgaacttctgacctcagatgatcctcccgccttggcctcccaaagtgttgggattacaggtgtgagctaccacgcccggccagtgatagcttttaaccagagaaaattctctttaatatattcaacccctttaatgctctctgattatctccagttttaatggcaaaatcaatggtacagctagctgtttcatggtatccaagctgttctccttgctgggaaatagtgttagagactgagtcagtgatggatggaagatgcctttaatcttttcatccaccaacatattcttagttctgttgcagtagatgcatactgcaagtccattcctacgttgcatgtgaataaacaggcagagcttagcacttagtggacatgtaataaatatttgaccaaaataagaccacgaatagacatgtatctatttctccctggcaatgtttgttacctctacctaacctcttttggcttctccattttcctcgtttgttattagaatgaatacatagagcacaaagagggttttcaa

SEQ ID NO: 200664 - DNA, 601 bp, Human
taataaatatttgaccaaaataagaccacgaatagacatgtatctatttctccctggcaatgtttgttacctctacctaacctcttttggcttctccattttcctcgtttgttattagaatgaatacatagagcacaaagagggttttcaaagagctttgtctcattccttcttataccagcaacagagtgagattctgtctcaaaaaaattatttaatgtatttcaaagtaattccaactttgaaaaatgtggtttttttatgttatttatttattttgagacagagactcgctctgtcrtccaggctggagtgcaatggcacgatcttggctcactgcaacctccgcctcctgagttcaagcgattctcctgcctcggcctcctgagtagctgggattacaagcacacaccaccacactcagctaatttttatatttttagtagagatgaggtttcaccatgttggccaggctggtctccaactcctgacctcaagtgatcggcccacctcggcctcccatagtgctggaattacaggcgtgagccaccgcatggctgaaaaatgtgtttttatatacatgcagaaactcacctggaaa

SEQ ID NO: 200665 - DNA, 601 bp, Human
aaaaaaattatttaatgtatttcaaagtaattccaactttgaaaaatgtggtttttttatgttatttatttattttgagacagagactcgctctgtcgtccaggctggagtgcaatggcacgatcttggctcactgcaacctccgcctcctgagttcaagcgattctcctgcctcggcctcctgagtagctgggattacaagcacacaccaccacactcagctaatttttatatttttagtagagatgaggtttcaccatgttggccaggctggtctccaactcctgacctcaagtgatcsgcccacctcggcctcccatagtgctggaattacaggcgtgagccaccgcatggctgaaaaatgtgtttttatatacatgcagaaactcacctggaaagaaaactcaccaaaatgttaacagtggttgcctctgggtagtaggattacagatggggggattacaggtgaattttcttttatctatttttttatgttttccaaattttctactatgatcacgtatcaaaccttacaatgtttttaaaagttactttggtgagggctctggagttccctgttgcctcaccctgggctgggagc

SEQ ID NO: 200666 - DNA, 601 bp, Human
gaggaggggagactcacgtgtacctcccacatatttgtttcctcacctttgggtttccacaaagtgctcagttgtttggtgtagttgttaggcagaatttgaactttaaaggcttcatttatggctgaggtcagcgttttcttattctgggtctccagtaaaaggaacacttatgataatccatgcaaatataactgtgtgttactgcatctcttgaaaaggatcgggtggattttcttcaactttggaggatatgtttggaatggcctgacttatatatagctcaggtgttatacatgamatttacttgggtgggttgctgagtgacacctcaaagacaacgggcagccttcctccctaatgtcacctatagctcagtgacaggccaaagtgactgccaggtgaaagagcccagccatatgggctcagcgtaattagacggcgtggtcagaggaaactagcagtagcctcaaaccctcaaacacaagcccaggtaatgaggctcaagggcagtgcttgatgctgcagacatcccccctgtttatctacaaagcctttgcaacttaacatggtctcattcctccttataccaacaaacagt

SEQ ID NO: 200667 - DNA, 601 bp, Human
gtaatgggttgattaggacaaggggagggacagtagaacacagggcttgcattggtcacagggagtagatggggcaggaagcccaccttggcccatgggaaactggaggcccctgaaaaacccatttctctgagtgtttccaaataattacctgcttgtccgtgtgtagtagagaacctttgtatctctgaggattttgctgtaacttttgggatttgacatttattgaagagctacaagcgtgggagggtagatgctgtcattgccagagagctttggcgtgctgtttatcggagatggkcgtttctctgcggctgcttgactgcatataagaatgtctgcattttctcagtggggatccaatccaaagagtgggaaaatgggagagactgcatcccattgcaacccaggtctcctccgtcagatgatcctagcatcaccagccttaccaccttttccccaatgccctttacagcggttcactaagcactcgatctgttagaggctgggagtgagatgattaagcaggcagtacttttgttgccagtagcctttcttagggactccagacaaaatcctacaaggttagttgctgctcaat

SEQ ID NO: 200668 - DNA, 601 bp, Human
aaagataaggccaagcgtggtggctcatgcctgtaaacctaggactttgtgaggccaaggtgggaggattgcttgagaccaggagttctagacaggcctgggcaacaaagcaagaccctatatctacaaaaaaattaagaaattagctgggtatggtggtgcacacctgaagtcccagctactccagaggctgaggtgggaggggtgggaggattgcttgagcccaggatgttgagactatagtgagccatgatagtgccgctgcactctagcctgggcaacagagtaagaccttgtctcaaaaaaaaaaaaaatgttggggtgataattagtagtcattgacaaggtgaattttgaattcaggttagacaccacaaggacacgtcaagaggaagcagaaaactcggcattaacatgacagagagagtagaatcaatgctgtagtcaggaagcagcatagtttatttcttaacttccagttattttctattttaaatatttatgtgtcagttggtttgttttgagggcatctagacctttaaaacagtgctacctgagctgaaatcccaactctgctacttgctaggtgtgttaggccatt

SEQ ID NO: 200669 - DNA, 601 bp, Human
atatttcatgtccttctcacatttcaaaatacaatcgtgcctttgcaatagttccccaaagtcttaacttgttccaggcttaactcaaaagtctcaaactccaaagtctgaagtgtcatctggagatgagttccttccacctatgagcctgtgagatttaaaaaaaaaaaaagaaaaagtttttacttccaaggtacaaggtgttataggcactgggtaaatattctcatttcaaaagggagaaattggccaaaacaaagggcaataggaccatacaactttgaaacccagcagggcagcyattacattttaaaactccaaaacaatctcctttgactccatgtcctgcatccaaggcacacaggtgcaaggggtgggcccccaaggccttggttggctccgcccctgtggttgcagggtatagcccccaaggctgccctcacaggttgttgggtgcccatggctcttgcatgctaaggttgcaaactgccagtggctctaccattctcaggtctggagggtggtggcccccttctcacagctccactaggcagtgccccagtagggactctgtatgagagttccaaccctacatttccct

SEQ ID NO: 200670 - DNA, 601 bp, Human
ccatgtcctgcatccaaggcacacaggtgcaaggggtgggcccccaaggccttggttggctccgcccctgtggttgcagggtatagcccccaaggctgccctcacaggttgttgggtgcccatggctcttgcatgctaaggttgcaaactgccagtggctctaccattctcaggtctggagggtggtggcccccttctcacagctccactaggcagtgccccagtagggactctgtatgagagttccaaccctacatttccctttggcactgacctagtagagtctctctatgaggcttcmcccctgcagcaggcttctgcctggacatccaggctttccaagacatactctgaagtctagggagaagctgccaagcctctttcatgcctgcattctgtgtgcctgcagacttaacaccacatcgtagccactaaggtttatggtggcttgtactctctggagcagcagcccaagctgtacctgtggccctgtgagccatggctggagctggagcagcctggatgtgaggagcagtgtgctgaggctacacagggcagtagtgccctggacctggccccccaaatcatttttttcccctag

SEQ ID NO: 200671 - DNA, 601 bp, Human
agcctggatgtgaggagcagtgtgctgaggctacacagggcagtagtgccctggacctggccccccaaatcatttttttcccctaggcctctgggcctttgatggggagtgggtgctgcctagaagatctctgaaatgcctttgaggcctttttcccatgtcttggatatttgcacttggctcccttttagttacactaatctctctagcaagtggttgctccacagcctgcttgtattcctgtcctgaaaatgccttttctttctctgccacatggctaggctgcaaattttccaaactygtacattctgcttcccttttacatataagttccaactttatttctttgctccagtatctgatcataggcttgaatgctttgctgtttagaaattttttccatcagatagctaccttaggtcatccctcttaaattcaaacttccacagatccctagggcatgaacacaacccagctaagatctttgctaaggcatagaattggtgacctttactccagttcccaataaattcttcatttctatctgagatctcatcagcctggcctttactgtccatatctattagcattttggtcacaa

SEQ ID NO: 200672 - DNA, 601 bp, Human
catataagttccaactttatttctttgctccagtatctgatcataggcttgaatgctttgctgtttagaaattttttccatcagatagctaccttaggtcatccctcttaaattcaaacttccacagatccctagggcatgaacacaacccagctaagatctttgctaaggcatagaattggtgacctttactccagttcccaataaattcttcatttctatctgagatctcatcagcctggcctttactgtccatatctattagcattttggtcacaaccacttaacaagtctctaaggrgttccaaactttccctcatcttcctgtcttcttctaagccctccaaactcatctgacctctgcccattgcccagttccaaagctgcttccatactttcaagtgtgttaatagcaacaccccactctcagtaccggttttctgtgttaggctgcttgcattgctctaaaggagtacctgagactgggtaatttatttgaaaaagaaagagtttaattggctcacagttctgcaggctgtacaagaagcatggcattggcctctgcttctggtgagggcctcagaaagtttacaatcaaggc

SEQ ID NO: 200673 - DNA, 601 bp, Human
ttgcccagttccaaagctgcttccatactttcaagtgtgttaatagcaacaccccactctcagtaccggttttctgtgttaggctgcttgcattgctctaaaggagtacctgagactgggtaatttatttgaaaaagaaagagtttaattggctcacagttctgcaggctgtacaagaagcatggcattggcctctgcttctggtgagggcctcagaaagtttacaatcaaggcaaaagccaaagggggagcaagtatgtcacatgacaaggacaagagtgagagttgggaggtggggagrtgccacacttttaaacaaccaggtctcatgtgaactaactgagcaagaactcactcatcacctaggggtggtgctaagccatttatgggggatctgtccctgtgatccaatacttcccaccagggtccacctgtaacacgggggatcacatttcagtgtgagatttggagggcacaaacatccagaccgtatcactaagcacatatctttaagtctaatttctgagcttattttcctcacccataatgtagaatagtaatatatacattgtaaggttttatgggattaaataagatagtg

SEQ ID NO: 200674 - DNA, 601 bp, Human
aagcatggcattggcctctgcttctggtgagggcctcagaaagtttacaatcaaggcaaaagccaaagggggagcaagtatgtcacatgacaaggacaagagtgagagttgggaggtggggagatgccacacttttaaacaaccaggtctcatgtgaactaactgagcaagaactcactcatcacctaggggtggtgctaagccatttatgggggatctgtccctgtgatccaatacttcccaccagggtccacctgtaacacgggggatcacatttcagtgtgagatttggagggcacaracatccagaccgtatcactaagcacatatctttaagtctaatttctgagcttattttcctcacccataatgtagaatagtaatatatacattgtaaggttttatgggattaaataagatagtgagtgacattcccaatatactctaagaacttagcattattattacaacacctactattatcgtaatttcctgtatatagtgaagtatggagtgagaagagagtgaaggactgagccttggattgcagtcacatgtagggagcaggaagtaggggcaggaaaaatattcatgaagaagt

SEQ ID NO: 200675 - DNA, 601 bp, Human
caaagaccatttatctagatttctgaacatgaattttctgctgtacttactcacctggtgtttacaaactgtcttttattttggggtaactttggtcctgtttgcatcttatctacccaggcagattgtaaacccttgagggcaaaaccacttgtacttttcatctttcacagagtggacttgaaatacattttcttgaagcactgactgaggttgattgcaatctcatgcattcatgttttgtaaaaaatatttcccccattgactggtttttaaattataaagtcatttttgcttattaaaaaaaaaaagtcaggccaggcatggtggctcaagcctgtaatcccagcacttcgggaggccaaggcgggcggatctcttgagctcaggagttcgagaccagcctggtcaacatggtgaaaacctgtcactacaaaaataacaaaaattagctgggggtggtagcacacacctgtagtcccagctattcaggaggctgaggtgggagaattgattgagcccaaggagatatgtgccaccacccccagctaatggaccaacaccgtctctaccaaaaatatataaagaaattagccaggca

SEQ ID NO: 200676 - DNA, 601 bp, Human
cttttattttggggtaactttggtcctgtttgcatcttatctacccaggcagattgtaaacccttgagggcaaaaccacttgtacttttcatctttcacagagtggacttgaaatacattttcttgaagcactgactgaggttgattgcaatctcatgcattcatgttttgtaaaaaatatttcccccattgactggtttttaaattataaagtcatttttgcttattaaaaaaaaaaagtcaggccaggcatggtggctcaagcctgtaatcccagcacttcgggaggccaaggcgggcrgatctcttgagctcaggagttcgagaccagcctggtcaacatggtgaaaacctgtcactacaaaaataacaaaaattagctgggggtggtagcacacacctgtagtcccagctattcaggaggctgaggtgggagaattgattgagcccaaggagatatgtgccaccacccccagctaatggaccaacaccgtctctaccaaaaatatataaagaaattagccaggcatggtggcacgtgcatgtagtcccagctacttgggaggctgaggtgggaggatggcttgagtctgggagggct

SEQ ID NO: 200677 - DNA, 601 bp, Human
gagttcgagaccagcctggtcaacatggtgaaaacctgtcactacaaaaataacaaaaattagctgggggtggtagcacacacctgtagtcccagctattcaggaggctgaggtgggagaattgattgagcccaaggagatatgtgccaccacccccagctaatggaccaacaccgtctctaccaaaaatatataaagaaattagccaggcatggtggcacgtgcatgtagtcccagctacttgggaggctgaggtgggaggatggcttgagtctgggagggctgaggttgcagtgagccrtgatcatgccactgcattagagcctgggcgacagaatgagaccctgtctcaaaaaaaaaaaaaaagaaaagaaaagaaaagaaattttctctgggttttaaatcctgcatttggaattccagttatgccttggagaagagaggttttgtgagtctgactctgtgtgtgtgtgtctaatgtatgctcagcaagtaaattggttctaccatttctctaaatgacaaatttggtttttcttactttgttatcagcaaactttaaactccaaatgctcctctttaaaatatactatttctgcta

SEQ ID NO: 200678 - DNA, 601 bp, Human
aacaaaaattagctgggggtggtagcacacacctgtagtcccagctattcaggaggctgaggtgggagaattgattgagcccaaggagatatgtgccaccacccccagctaatggaccaacaccgtctctaccaaaaatatataaagaaattagccaggcatggtggcacgtgcatgtagtcccagctacttgggaggctgaggtgggaggatggcttgagtctgggagggctgaggttgcagtgagccgtgatcatgccactgcattagagcctgggcgacagaatgagaccctgtctcaaaaaaaaaaaaaaagaaaagaaaagaaaagaaattttctctgggttttaaatcctgcatttggaattccagttatgccttggagaagagaggttttgtgagtctgactctgtgtgtgtgtgtctaatgtatgctcagcaagtaaattggttctaccatttctctaaatgacaaatttggtttttcttactttgttatcagcaaactttaaactccaaatgctcctctttaaaatatactatttctgctaatgccattcccttgcagacggagtcctgctgagaaaacgttagaattggac

SEQ ID NO: 200679 - DNA, 601 bp, Human
ccagccaatgtgaggcgtgtacaggtgttttaaaacacaggtgttctaactgccttgagtgtgtagcatgccctgggttatcaggattcatatggtcagagggaatgaaagcgttgcttgatcaggagttgcttaaggagtgatcagttaaaagagcatcttagtacaacttttttcttgaaacacccgagccaatttggatactctattctataacattctggaaaaggggaaagtttggagtatgtggcttagattcaaagcctaagccaagccttcaacacctctctaaattattacmttagtctaaattacggggccagcataattatgggatatccctctgagagacagaaatggccgggctcagattataccccatggtgtaagagaggacattcaagagaaaaggtagagtgtgagtttctgacttttaggtatagagacctgaccactcattgttgcagcaccatcaatgtcctacaatttggaagtcagatcagcagctcctctctttgtaggggatactaagaagtgggtggccatagataggactggctgactgatggcaggcacccatatccaggattgggagattttc

SEQ ID NO: 200680 - DNA, 601 bp, Human
cttcaacacctctctaaattattacattagtctaaattacggggccagcataattatgggatatccctctgagagacagaaatggccgggctcagattataccccatggtgtaagagaggacattcaagagaaaaggtagagtgtgagtttctgacttttaggtatagagacctgaccactcattgttgcagcaccatcaatgtcctacaatttggaagtcagatcagcagctcctctctttgtaggggatactaagaagtgggtggccatagataggactggctgactgatggcaggcayccatatccaggattgggagattttcatcatggtgaatcaagcccagcatgaggaagttgaagctggggattgttgactgctaacacgggcccaagcaggctctggcatggccaactcctgtgacaaacagactggaccgtgtgccagggtttagccttcctcgatctcagtgttcccagtgtcaccattgattcttttgatgatcccttggttcttgagaaatgagaaatgaactattagaaggatgtggtgctagctcagtctttatgttatgactcaactctagcaaccagctgatat

SEQ ID NO: 200681 - DNA, 601 bp, Human
gtgtgccagggtttagccttcctcgatctcagtgttcccagtgtcaccattgattcttttgatgatcccttggttcttgagaaatgagaaatgaactattagaaggatgtggtgctagctcagtctttatgttatgactcaactctagcaaccagctgatatccaatgacgttgagatcctgagatgacatgaatgccctatccccaacataatggcttgtgaattaaacctgcaaatactaggttctactagaactctttagggagctgaagttacaaaaacaatatttagactgaaacttttttttttttttgagacagagtcttgctctgttgcctgggctggaatgtagtggtgcaatctcggctcccgggttcaagcagttctccctgcctcagccttccgagtagctgggattacaggcacctgccaccatgcccagctattttttgtatttttagtagagacagggtttcgccatattggcaaggctggtctcaaactcctgacctccggtgatccaccctcctcagcctcccaaagtgctgggattacaggcgtgagccaccatgcctggcctagactgaaacttaatgaaac

SEQ ID NO: 200682 - DNA, 601 bp, Human
gaggtccttgcatggcccatgggtccctcctgactgcccccttctcatctcccacctctctccctcctccagccaccctggcctctttgctgatcctccagcccaccaggcagagtcccacctcctggccttcgcacttgctgtttgttttgcccaagataccctctcccagatatcctcacggctcgtattttagtcaacactcttcctaaccacccaccttctcagagaggcctctcctgaccacctctattacatcccacctgctacccactcccccactgaccctactcctattcaytgttttgcttttctccagaattttctttatctcctaatagactatgctatttacttattttacttcttatctgctccccactcccagcatcattatccaaatatacgctccttgggggctggaattttggattattttcttacttgttctatccctagcacctaaaacaggacctggcccatagtaggtactcaggaactaatgaatacatttttgttcattacacatatttgtgtaatgaacacatatttgtggaactaatgaaacaaatgaaatatttgtggaacacaggaacacatt

SEQ ID NO: 200683 - DNA, 601 bp, Human
cggctcgtattttagtcaacactcttcctaaccacccaccttctcagagaggcctctcctgaccacctctattacatcccacctgctacccactcccccactgaccctactcctattcattgttttgcttttctccagaattttctttatctcctaatagactatgctatttacttattttacttcttatctgctccccactcccagcatcattatccaaatatacgctccttgggggctggaattttggattattttcttacttgttctatccctagcacctaaaacaggacctggcccrtagtaggtactcaggaactaatgaatacatttttgttcattacacatatttgtgtaatgaacacatatttgtggaactaatgaaacaaatgaaatatttgtggaacacaggaacacatttgtggaactaatgaaaaatcagccagtgtattttctcatacattgttaaatcatttacccttattcaatgttcatcttattttctaggattttttgttgttgttgtaaacaatgctattaatagtttattgtatataatttcacccttttcctggctatttctttgggtttcacgtccagg

SEQ ID NO: 200684 - DNA, 601 bp, Human
acatgcacacacagagaaatatttgctgttactgctgtggtgactgtgaccatggaactctctcaagtatagattagcaatataattatgtcatgggggtctaataccttttgccccattcctcctctgtcaggactttcatgacttggcttaagaccatagaccactgtatctcaacatcactattcaaggaatatgatgaaggcaccatgtgtaggactgttccttcagcatctgctgagcatgctgacaatccgagcaacttacttcctgctaactcagcctgactgtgcccatcagyactaacagggcttgagatgttttcattgaagctttgtggcttgtgggctttagctctgactccacgcgagaaaatcgctgagccaaaaagaatcataagtgatttcttctggtggaccgcagtttgcaaagaactgctcatgttttgtttgagctatttagttcaattggattttaactgtatacataaaaatcagaattaatttcagctcccaaaatttgaacataaaattcgataaactaaagatgatcattagttttgcaaaaaagataataactagttacaaaaagattccaaaag

SEQ ID NO: 200685 - DNA, 601 bp, Human
atagattagcaatataattatgtcatgggggtctaataccttttgccccattcctcctctgtcaggactttcatgacttggcttaagaccatagaccactgtatctcaacatcactattcaaggaatatgatgaaggcaccatgtgtaggactgttccttcagcatctgctgagcatgctgacaatccgagcaacttacttcctgctaactcagcctgactgtgcccatcagtactaacagggcttgagatgttttcattgaagctttgtggcttgtgggctttagctctgactccacgcragaaaatcgctgagccaaaaagaatcataagtgatttcttctggtggaccgcagtttgcaaagaactgctcatgttttgtttgagctatttagttcaattggattttaactgtatacataaaaatcagaattaatttcagctcccaaaatttgaacataaaattcgataaactaaagatgatcattagttttgcaaaaaagataataactagttacaaaaagattccaaaagtgttctattaaatataaaggtacatcaggagacttaagggattgtgtatggattattatccttctata

SEQ ID NO: 200686 - DNA, 601 bp, Human
tatctcaacatcactattcaaggaatatgatgaaggcaccatgtgtaggactgttccttcagcatctgctgagcatgctgacaatccgagcaacttacttcctgctaactcagcctgactgtgcccatcagtactaacagggcttgagatgttttcattgaagctttgtggcttgtgggctttagctctgactccacgcgagaaaatcgctgagccaaaaagaatcataagtgatttcttctggtggaccgcagtttgcaaagaactgctcatgttttgtttgagctatttagttcaattkgattttaactgtatacataaaaatcagaattaatttcagctcccaaaatttgaacataaaattcgataaactaaagatgatcattagttttgcaaaaaagataataactagttacaaaaagattccaaaagtgttctattaaatataaaggtacatcaggagacttaagggattgtgtatggattattatccttctatagggaggatcacttgagaaaagcttgcttgttaagtattagggccaagcatttataaaaagtggactttaataacaatctagaatagggtaaggcacctcag

SEQ ID NO: 200687 - DNA, 601 bp, Human
tactaaatgaggctgggcacagtggctcacgcctgtaatcccagcactttgggaagagaagcaggaggattacttgagcccaggagtttgagaccagccctggtaatatggagggaccctatttctacaaaaactgttttttttttaattagccaggtatggtgacaagtgtctgtactcccagctacttgggaggctcaggtgggaagatcactagttgggcctgggaggttggggctgtagtgagccatgatggcaccactgcactccagcctggaggacacagtaagaccttgtcttaaaaaaaaaaaaaggctaaaaagggatgatgtgggtttcaaagactttatttattatcattatgtttttttagaaataggatcttactctgtcacccatgctggaatgcagtggtgcaatcctagctcattgcagcttccaactcctgggctcaagcaatcctcccacctcagcctcccaaagtgctggaattatggtcatcatgagccaccacacctggcctccaaaactctaaaaaaatgagtatttaactgtgcatataccacgtgcctgggctacatttaaaggtgcaaaaaacatt

SEQ ID NO: 200688 - DNA, 601 bp, Human
atgatggcaccactgcactccagcctggaggacacagtaagaccttgtcttaaaaaaaaaaaaaggctaaaaagggatgatgtgggtttcaaagactttatttattatcattatgtttttttagaaataggatcttactctgtcacccatgctggaatgcagtggtgcaatcctagctcattgcagcttccaactcctgggctcaagcaatcctcccacctcagcctcccaaagtgctggaattatggtcatcatgagccaccacacctggcctccaaaactctaaaaaaatgagtatttaactgtgcatataccacgtgcctgggctacatttaaaggtgcaaaaaacattcaagatttccactgcaagctggtgagggaccttagccatagccacactgagtagctgagtcatggtgccaggagttatgtgaccaagggcctacagtgtgatgcagccaggaccacagcaggagttagaggaaggagaccagttagaccagaacaggtgagatgctgccttgcagggatgaggactggagaaaaacacatatcctagccagtctcctacctgcctctccagactgcacacactggctgg

SEQ ID NO: 200689 - DNA, 601 bp, Human
gaggaagaaaggagacagagtacttggaaagctaagagtagaaaataaggcaaaagcccagtcgtaagaatgaaacactcaggagtgctccagatctgtggcagggacaagaactgagaaatagagactagttaaaattacagaaacaggatagaggcagaagctcagaaccgaagcagccaccctgttttagtgagtaccaaggcctcccaccagcttccagccaagtcggcctggttactgctgtgatgttgaaagatttttttttaaaattctacttcttatacacttgcaaaaaatraaagaaactcagtttctcaaatttcagcctatatttttaaccaaaagtatatttgaaagcgaatacaattagtaagtgtgcaactattatctcaaaaaggtagactagtcaatgtaataaaccaagcatggttaatttatgattaagcaaaaatgtacataatagggctttatgttcatgaaccagtactataatttgaaatatgtaagtggtgttcaaaaaagcaccacctttatatcaatttcttaccctagagcagcccatccaaatctagacgggagaaaggtggaaacacacagg

SEQ ID NO: 200690 - DNA, 601 bp, Human
agctactataaagatgagtgttcaagtccttgctttcagttcttctgggtttttatacccagaagtggaattgctggtcctatggtagcaagactttttgagatctagattgaaacccttattcttgagccaagcatgagaaagaacactctcagatatccagggtcttttcaccagaaagatctatagaggacttcagtctgctggacagggattcatgtctttggtagcaaggagactgtgggctttgagtctaatgcttaatcatctaatgcctgtaaggatgaataaaggcaattgyggacaccatcttttgcatgttgccatttattattttcgtgcttggaggtcattatactcattgtttttcagtctccagtaataacttggttgacatttccatccttatttttcaaataagaatgctttgcacagagtaaggcactgaatgaatatttttgtgtttgcactagaaacaaaacacagaaggaagtaaactttttaaagtagagatggggtctgctatgttgctcaggttggactagacctcctgacctcaagtgattctcccagcttggcctcccaaagtgctgagattaca

SEQ ID NO: 200691 - DNA, 601 bp, Human
accagaaagatctatagaggacttcagtctgctggacagggattcatgtctttggtagcaaggagactgtgggctttgagtctaatgcttaatcatctaatgcctgtaaggatgaataaaggcaattgtggacaccatcttttgcatgttgccatttattattttcgtgcttggaggtcattatactcattgtttttcagtctccagtaataacttggttgacatttccatccttatttttcaaataagaatgctttgcacagagtaaggcactgaatgaatatttttgtgtttgcactaraaacaaaacacagaaggaagtaaactttttaaagtagagatggggtctgctatgttgctcaggttggactagacctcctgacctcaagtgattctcccagcttggcctcccaaagtgctgagattacaggatgagccaccattccggaaataattttatactgaatcagcaatagaagaactacaaagtatcggttgtcaggtttcttggccagagcatagttaacatactgagtgccactaccttcctacagcctgtaatatgccacttttgtgactccctatgtggataaatcaaaca

SEQ ID NO: 200692 - DNA, 601 bp, Human
caggcatggaaaatgtagtagtgaccatctaaattttaataggcatttgaccaatttgtgtgtggaggaatttgtgctcaatgaatgattggttggtttgtaactggccgaatgtctgtaaccacaggatgctaattgttgaactgagatcctcctagaaggaggtttttaaacagcttgctgggaagaagccttatggagggatgagagctatcttccattcatagggtcccccgtgtttcttcatggtgtgcaatgtgtatgtatctaaactctcaaaaacacactccagtaagagtartaccaataaccttttattcattccacaaatatttgttgagtatctactatgtgtcagatatgattgtagacactgggcatgcagtaataaattaaacagaccaaaaagaaaccccaccaatatctgtccttatggagcctacattctattggagcaggataagagaatactacaggtctcaacagcaaagtaatactagtctttgattaaagatttgaaggcagtgagagaaggaggaaacctttgaggcagaggtagaaatgaaattctatgaaataaaatgatctgtgatactatcac

SEQ ID NO: 200693 - DNA, 601 bp, Human
cgaatgtctgtaaccacaggatgctaattgttgaactgagatcctcctagaaggaggtttttaaacagcttgctgggaagaagccttatggagggatgagagctatcttccattcatagggtcccccgtgtttcttcatggtgtgcaatgtgtatgtatctaaactctcaaaaacacactccagtaagagtaataccaataaccttttattcattccacaaatatttgttgagtatctactatgtgtcagatatgattgtagacactgggcatgcagtaataaattaaacagaccaaaaaraaaccccaccaatatctgtccttatggagcctacattctattggagcaggataagagaatactacaggtctcaacagcaaagtaatactagtctttgattaaagatttgaaggcagtgagagaaggaggaaacctttgaggcagaggtagaaatgaaattctatgaaataaaatgatctgtgatactatcacacagcaccagtacaaaatggatatgttttagtccatttgtgttgctataaaggaacacctgagactgggtaatttataaagaaaataaggtttatttggctcatgatt

SEQ ID NO: 200694 - DNA, 601 bp, Human
ttgattaaagatttgaaggcagtgagagaaggaggaaacctttgaggcagaggtagaaatgaaattctatgaaataaaatgatctgtgatactatcacacagcaccagtacaaaatggatatgttttagtccatttgtgttgctataaaggaacacctgagactgggtaatttataaagaaaataaggtttatttggctcatgattctgctggcgggaagactgggcatctagtgaaagcctaaggctgcttccactcacagcgggaggtgatgtggagccgacctgtgcagagatcacayggtgagagaggaagcaagagagaaaggatgaggcggtgctctttttaacaaccagctctcatgagaactaacagagcaaacgtactcattactgtgaggacagcaccaagctattcattagggattccccaccatgacccaaacacctcccattaagccccgcctccaacactgtggattaaattttaacatgaagtttatgggatcaaacatccaaactgtagcagatatgcacacctgaagctatatatatttattgtttttagcaatgttccctgattatgttcttctccaaatcac

SEQ ID NO: 200695 - DNA, 601 bp, Human
ataaaggaacacctgagactgggtaatttataaagaaaataaggtttatttggctcatgattctgctggcgggaagactgggcatctagtgaaagcctaaggctgcttccactcacagcgggaggtgatgtggagccgacctgtgcagagatcacacggtgagagaggaagcaagagagaaaggatgaggcggtgctctttttaacaaccagctctcatgagaactaacagagcaaacgtactcattactgtgaggacagcaccaagctattcattagggattccccaccatgacccaaamacctcccattaagccccgcctccaacactgtggattaaattttaacatgaagtttatgggatcaaacatccaaactgtagcagatatgcacacctgaagctatatatatttattgtttttagcaatgttccctgattatgttcttctccaaatcacaggacacttcccacattgttcttttttgtatattatttgggccgttttccatggcaactagtttcacaaagtacaaatgtacaaatgtgtacatttatttttagtactttttctgattacaaaagtaatacaggttcattgagg

SEQ ID NO: 200696 - DNA, 601 bp, Human
tatatttattgtttttagcaatgttccctgattatgttcttctccaaatcacaggacacttcccacattgttcttttttgtatattatttgggccgttttccatggcaactagtttcacaaagtacaaatgtacaaatgtgtacatttatttttagtactttttctgattacaaaagtaatacaggttcattgagggaaactggttcctatagaagtgaaattctatgaaataaaatgatctgtgatactaccgcccagaaaaaaccactgtttttgtgtttgttttgctttttgagatgrgtttctcaccatgttgcccaggctggtcttgatctcctgagctcaagcagtccttctgccttggtctcccaagttttgagattataggcgcacactactgcacctagctgataaccattgtttatgccaatttggaacatttctctccagtctttttttaatgtatgtgtatggatttatttttatagagttgagatcatgcagtataataataaatcataagcattttgacatgtcacttaaacgttatcaaaaacattttaatgtctgtgtaaaattctattatatgtatatgtcaga

SEQ ID NO: 200697 - DNA, 601 bp, Human
ttttgtatattatttgggccgttttccatggcaactagtttcacaaagtacaaatgtacaaatgtgtacatttatttttagtactttttctgattacaaaagtaatacaggttcattgagggaaactggttcctatagaagtgaaattctatgaaataaaatgatctgtgatactaccgcccagaaaaaaccactgtttttgtgtttgttttgctttttgagatgggtttctcaccatgttgcccaggctggtcttgatctcctgagctcaagcagtccttctgccttggtctcccaagtkttgagattataggcgcacactactgcacctagctgataaccattgtttatgccaatttggaacatttctctccagtctttttttaatgtatgtgtatggatttatttttatagagttgagatcatgcagtataataataaatcataagcattttgacatgtcacttaaacgttatcaaaaacattttaatgtctgtgtaaaattctattatatgtatatgtcagaatgtgttcaggtttttttggctgctcaaataatattgtgataaacattcttatgcttgaatctttttttctgatc

SEQ ID NO: 200698 - DNA, 601 bp, Human
acttttagttatttttttttgagacggagtctcgctctgtggcccaggctggagtgcagtggcgcgatctcggctcactgcaagctccacctccagggttcacgccattctcctgcctcagcctcccgagtggctgggactacaggtgcccgccaccacgcccagctaatttttttttttttttgtatttttagtagagacagggtttcatcgtgttagccagggtggtctcgaactcctgaacttgtgatccgcctgccttggcctctcaaagtgctgggattacaggcgtgagccaccrcacctggcctacttttagttctttaaggaatctctacattgctttccatagttgttgtactagtttacattcccaccagcagtgtaaacggaatttgtccatttcatcttaacacatggacacgtgatagggagcaacacacaccggggcctgtagcaaggagtggggagagggaaagcatccagaagaacagctaatggatgctgggcttaatacctgggtgatgcgctgatctgtgcagcaaaccaacatggcacacatttacctaacaaacctgcacatcctgcacatacaccctag

SEQ ID NO: 200699 - DNA, 601 bp, Human
cgcctgccttggcctctcaaagtgctgggattacaggcgtgagccaccgcacctggcctacttttagttctttaaggaatctctacattgctttccatagttgttgtactagtttacattcccaccagcagtgtaaacggaatttgtccatttcatcttaacacatggacacgtgatagggagcaacacacaccggggcctgtagcaaggagtggggagagggaaagcatccagaagaacagctaatggatgctgggcttaatacctgggtgatgcgctgatctgtgcagcaaaccaacayggcacacatttacctaacaaacctgcacatcctgcacatacaccctagaacttaaaataaaagttgaaggaaaaaaaagtgtttcttaagggagcaatttttaaaaatgttgctgattttctaggagaaaatttcttcttcttgcttttttatcatgtctttaatacctgttcttcataaaattatccaattatatatatctaatttataaatgtatgtttattggtgttattatttgattaatgaatattttccagtataagtgattgtaagggactcttacaaatttcatgaagcaag

SEQ ID NO: 200700 - DNA, 601 bp, Human
aggtggccaggcgtggtggctcacgcctgtaatcccagtactttgggaggccgaggcgggcggatcatgaggtcaggagattgagaccatcctggctaacacggtgaaaccccgtctctcctaaaaatagaagaaattagctgggcatggtggcaggcacctgtagtcccagctactcgggaggctgaggcaggagaatggcgtgaacctgggaggcagagcttgcagtgagccgagatcgtgccactgcactccagcctgggcaacagagcaagactccatctcaaaaaaaaaaaaaaayggaatgaaggtaactgcctcaatctgataaagtgcatcagtgaaaaaactatcagctaacatcatacttaatagtgaaagacaatgctttctttatcagatcaggaataaaacagaatgtccactcacaccactgctatttaatattgtactggaagttctagccagtgcaataagacagagaaagatcaataaatggtacctagattgttaaaaaaaaacaccatctttattaacagataacatgatcacctgtgtagaaaatccaatggaatctattaaaaagctactagaactatta

SEQ ID NO: 200701 - DNA, 601 bp, Human
cactgcactccagcctgggcaacagagcaagactccatctcaaaaaaaaaaaaaaacggaatgaaggtaactgcctcaatctgataaagtgcatcagtgaaaaaactatcagctaacatcatacttaatagtgaaagacaatgctttctttatcagatcaggaataaaacagaatgtccactcacaccactgctatttaatattgtactggaagttctagccagtgcaataagacagagaaagatcaataaatggtacctagattgttaaaaaaaaacaccatctttattaacagataacmtgatcacctgtgtagaaaatccaatggaatctattaaaaagctactagaactattaatagcaagtgaatttatcaaggttgcaggacacaagatcaatatacaaaaataagttagttttatatacttacaatggaccatcaaaatatgaaatttaaaaaaataccttttcaggctgggcacggtggctcatgcttgtaatcccagcacaatgggagaccaaagcaggtggatcacttgaggtcaggagtttgagacaagcctggccaacatggtgaaagcttgtctctactaaaaatatg

SEQ ID NO: 200702 - DNA, 601 bp, Human
ccctggctgaattttaattgttatttcattttaatcaattttaatttaaatagacatattaggcagcatggttctagattaagggagactaagcagatatgaaaacgagatacaatctctgaccctagactagatcctgtactggaaggtgaaaaatgctatgaagaacataattaagtcaactgacaaaattagaatatggatggtagattaaatataagtattgtatcaatgtaaacttatgaaatttataaccatactgcagttatgtaagagaatatccctcctcttaggaaacacrgactgtttttaagggaaaggaccagaatgtatgtaatgtaccctcacataggtcagagagatgaccaagtaatcacaggaatggggtaaaatgttaacaaaggtgaatctgggtaaagagtatttaagtgtttcttgttttatttttatgtttgtaactttttgtaagcttgaaattgttttcaaagaaaaagattttttaaatgcctttatatatgactatggtattacaattatattgtttataaagactcccagtgttttaaagctacattatgaagcatttatggacaaaataata

SEQ ID NO: 200703 - DNA, 601 bp, Human
acaaaaattagctgggcacagtggcaggcgcctgtaatcccaactacttgggaggctgaggcaggaggattgcctgaacctgggcggcagaggttgcagtgagccaagattgcgccactgcactccagcctgggtgttagagtgagactccatctcaaaaaaaaaaaaaaaaaaaaaaaaattactcaggcatggtggcatgcactggtaattccagctactcaggaggctgaagcaggagaattgcttgaacctgggaggtggaggttgcagtgagcctagattgcgacattgcgcttcmgcctgggcgatggagcgagactctgtctcaaaacaaacaataataataataataataataataataataataacaacaatacaatgtctggggtttgcttcaaagtaatgtgggatcttactatagagagtggggacatagctgaaagccaagcagccatagattgattctcctgaagctgggtgatatgtacatggatttattatactactcagtccatttttgaaattggacattattgtatattttgcttaacatttccataagtttaaattgggaaaaattggcatctcactcaac

SEQ ID NO: 200704 - DNA, 601 bp, Human
aagaatattgtatatctttcccttactcagtttgtttcctctggtatggactgggaactctcatttataccaaattatttgttaggaagattatttatgcagttcaaatgttccttaaaataataaaaaccctcatcaaaacaaagactccttttaagattccatcagtggtcatttatttcaagcaattttaaacaatgtgtccaagttccactatgggaaaatattttgctcagattctgcaataaaagtttctttccatatttaaaaatacttatacaaaaaatacaaaaaaaagaataagaacaaaaacaaaaaaataaaaatacacaagtaaaatttcattatgaaaaatttcatgaaatacttttaaaaaaatattttggtttaaattaatgtatccctagagatcacattctctgtgaatcttgaggtaaaaatcctatttatgtgcagctgagcccaatgaggtaaccaggaggtgttttgaactcagagtatttatgcctttcactcctaggccttatttttcccaggatatgattttgtgtcttattgtttggctcattgtttgatgggtttaagtggtttggagtttggc

SEQ ID NO: 200705 - DNA, 601 bp, Human
tatgcagttcaaatgttccttaaaataataaaaaccctcatcaaaacaaagactccttttaagattccatcagtggtcatttatttcaagcaattttaaacaatgtgtccaagttccactatgggaaaatattttgctcagattctgcaataaaagtttctttccatatttaaaaatacttatacaaaaaatacaaaaaaaagaaaaagaacaaaaacaaaaaaataaaaatacacaagtaaaatttcattatgaaaaatttcatgaaatacttttaaaaaaatattttggtttaaattartgtatccctagagatcacattctctgtgaatcttgaggtaaaaatcctatttatgtgcagctgagcccaatgaggtaaccaggaggtgttttgaactcagagtatttatgcctttcactcctaggccttatttttcccaggatatgattttgtgtcttattgtttggctcattgtttgatgggtttaagtggtttggagtttggctttgggaacgtttaattgttttaattgcttaaattcgataaaacactcagctaaaccattctcagcctgcagtctggcaaataccccatcttcat

SEQ ID NO: 200706 - DNA, 601 bp, Human; identical to SEQ ID NO: 24858

SEQ ID NO: 200707 - DNA, 601 bp, Human; identical to SEQ ID NO: 24859

SEQ ID NO: 200708 - DNA, 601 bp, Human; identical to SEQ ID NO: 24860

SEQ ID NO: 200709 - DNA, 601 bp, Human; identical to SEQ ID NO: 24861

SEQ ID NO: 200710 - DNA, 601 bp, Human; identical to SEQ ID NO: 24862

SEQ ID NO: 200711 - DNA, 601 bp, Human; identical to SEQ ID NO: 24863

SEQ ID NO: 200712 - DNA, 601 bp, Human; identical to SEQ ID NO: 24864

SEQ ID NO: 200713 - DNA, 601 bp, Human; identical to SEQ ID NO: 24865

SEQ ID NO: 200714 - DNA, 601 bp, Human; identical to SEQ ID NO: 24866

SEQ ID NO: 200715 - DNA, 601 bp, Human; identical to SEQ ID NO: 24867

SEQ ID NO: 200716 - DNA, 601 bp, Human; identical to SEQ ID NO: 24868

SEQ ID NO: 200717 - DNA, 601 bp, Human; identical to SEQ ID NO: 24869

SEQ ID NO: 200718 - DNA, 601 bp, Human; identical to SEQ ID NO: 24870

SEQ ID NO: 200719 - DNA, 601 bp, Human; identical to SEQ ID NO: 24871

SEQ ID NO: 200720 - DNA, 601 bp, Human; identical to SEQ ID NO: 24872

SEQ ID NO: 200721 - DNA, 601 bp, Human; identical to SEQ ID NO: 24873

SEQ ID NO: 200722 - DNA, 601 bp, Human; identical to SEQ ID NO: 24874

SEQ ID NO: 200723 - DNA, 601 bp, Human; identical to SEQ ID NO: 24875

SEQ ID NO: 200724 - DNA, 601 bp, Human; identical to SEQ ID NO: 24876

SEQ ID NO: 200725 - DNA, 601 bp, Human; identical to SEQ ID NO: 24877

SEQ ID NO: 200726 - DNA, 601 bp, Human; identical to SEQ ID NO: 24878

SEQ ID NO: 200727 - DNA, 601 bp, Human; identical to SEQ ID NO: 24879

SEQ ID NO: 200728 - DNA, 601 bp, Human; identical to SEQ ID NO: 24880

SEQ ID NO: 200729 - DNA, 601 bp, Human; identical to SEQ ID NO: 24881

SEQ ID NO: 200730 - DNA, 601 bp, Human; identical to SEQ ID NO: 24882

SEQ ID NO: 200731 - DNA, 601 bp, Human; identical to SEQ ID NO: 24883

SEQ ID NO: 200732 - DNA, 601 bp, Human; identical to SEQ ID NO: 24884

SEQ ID NO: 200733 - DNA, 601 bp, Human; identical to SEQ ID NO: 24885

SEQ ID NO: 200734 - DNA, 601 bp, Human; identical to SEQ ID NO: 24886

SEQ ID NO: 200735 - DNA, 601 bp, Human; identical to SEQ ID NO: 24887

SEQ ID NO: 200736 - DNA, 601 bp, Human; identical to SEQ ID NO: 24888

SEQ ID NO: 200737 - DNA, 601 bp, Human
tttttggagtattttcaggcaacaaatccctcacctctgcttctcccataaatataaatgcatatgcacaaatacagaatggggaagagagggcttaactgcagcacctgtgaaaacactttcggttttaattgacagtaaattcattatcagccaagaggctagggtgatcgtaggctgaacagcaatgtctgcatgagggaggtggagagagctgtgctctgctctgtgctggagaattacattcagttctgggcatggtactttaggaaaaaagagatggatcaacagtttaaacataaaaaaaaaaaaaacacaaaagagcaaaaggagtcttgagagaattattttttaatctgagagtagagaagatctttctaaacatgacatgaaatttaaaagccataaaagaaaaacaaaggaaaatatctagtaagagagtaaagctgtgatacctttttttaacctattagttaacctattagttaccagagatcaaaaagtttgattccttatgttggcaaaggtatattgtagtagggaattataaatggatcagtgagtgtctgaattggtataacctttcagagggcaatttggc

SEQ ID NO: 200738 - DNA, 601 bp, Human
agctactagggaggctgaggtgggaggatcacctgagtgcaggaggttgaggctacagtgagttgtgattgtgccacttcactctagcctgggtgacacagcaagaccttgtctcaaaaaaaatttttttaataaaaaataaataaaggtgttgagcccagtgctcacacacactaagtgctcaaaaaatgatcactattacgattcacaatagtaaagacatggaatcaacccaaaatgcccatcaatgatagactggataaagaaaatgtgatacatatacaccatggaatactatgcrgccataaaaagaaatgaggtcatgtcctttgcagggacatggatggaactggaagccattatcctcagcaaactaacacagaaacagaaaaccaaacactgcatgttctcagttataagtgggagctgaacaatgagaacacatggacacagggaggggaacaacacacaccggggcctgttgggggtagtcgggagtgagaacatcaagataaaaagctaatgcatgtggggcttaatacctaagtgatgggctgataggtgcggcaaaccaccatggcacacatttgcctatgtaaca

SEQ ID NO: 200739 - DNA, 601 bp, Human
tttgcctatgtaacaaacctgcacgtcctgcagatgtatcctagagcttaaaataaaattaaatttaaaaaacaacagacaggccaggtgtggtggctcatgcctttaatcccggcaccttgagaggccgaagcgggcggatcacctgaggtcaggagttcaagaccagcctggccaacatggagaaaccctgtctctactaaaaatacaaaaagtgtccaggtatggtagcgtgtgcctgtggctctagctacttgggaggctgagacaggagaatcacttgaacccaggaggtggaggsagcagtgagccaagatcgcaccactgcactccagcctgggcgagagagcgagatgccatctcaaacaacaacaacaacaacaacaaacaaacaaaatgatcactattgtaatcatcaacagcagaggtgtccaaagatggggctttcgtggtaaggtgacaaattcctcatcaggagaggcattgaggcccaggccgaatggtcactgggtgaggatgctgtaaagaggatgtaagcaacagcagggctggagtagatgatctttaaagggcttatccatgcctgaagttctagaacttt

SEQ ID NO: 200740 - DNA, 601 bp, Human
aaaaaacaacagacaggccaggtgtggtggctcatgcctttaatcccggcaccttgagaggccgaagcgggcggatcacctgaggtcaggagttcaagaccagcctggccaacatggagaaaccctgtctctactaaaaatacaaaaagtgtccaggtatggtagcgtgtgcctgtggctctagctacttgggaggctgagacaggagaatcacttgaacccaggaggtggaggcagcagtgagccaagatcgcaccactgcactccagcctgggcgagagagcgagatgccatctcaaaaaacaacaacaacaacaacaaacaaacaaaatgatcactattgtaatcatcaacagcagaggtgtccaaagatggggctttcgtggtaaggtgacaaattcctcatcaggagaggcattgaggcccaggccgaatggtcactgggtgaggatgctgtaaagaggatgtaagcaacagcagggctggagtagatgatctttaaagggcttatccatgcctgaagttctagaactttctgaaaattacgttctgaaagcaagtcacagctccattccagtcttatcaacttaactaccaaaaa

SEQ ID NO: 200741 - DNA, 601 bp, Human
ggcatgtgcctgtaatcccagctacttgggaggctgaggcaggagaatcgcttgaacctgggaggcagaagttgcagtaagccaagatcgcgccattgtactccagcctgggcgacacagcaagactctgtctcaaaaaagaagaagaaatgagataatccattttggatctgtccatttttcttttgcagtcctaaataacaaaaagcctctccacacccaaattgcttaacataaagcttttatttctgcttactatcgaccatctattaatagttgcctgagaccaggtacagtggcycatgcctgtaatcccagcactttggaaggccaaggcaggtgaatcgcctgaggtcaggagttcaagaccagcctagccaacatggcaaaaccccgtctctactaaaaatacaaaaaactagccaggcatggtagcgtgtgcctgtaatcccggctacttgggaggctgaggcaggagaatcacttgaacccaggaagtggaggttgcagtgagccaagatcacaccattgcacttcagcctgggtaacagagcaagactcaatctcaaaaaaaaaaaaaaaaaatgcctgaaaagcttcc

SEQ ID NO: 200742 - DNA, 601 bp, Human
ggatctgtccatttttcttttgcagtcctaaataacaaaaagcctctccacacccaaattgcttaacataaagcttttatttctgcttactatcgaccatctattaatagttgcctgagaccaggtacagtggctcatgcctgtaatcccagcactttggaaggccaaggcaggtgaatcgcctgaggtcaggagttcaagaccagcctagccaacatggcaaaaccccgtctctactaaaaatacaaaaaactagccaggcatggtagcgtgtgcctgtaatcccggctacttgggaggytgaggcaggagaatcacttgaacccaggaagtggaggttgcagtgagccaagatcacaccattgcacttcagcctgggtaacagagcaagactcaatctcaaaaaaaaaaaaaaaaaatgcctgaaaagcttccatgtaaagaatttatggtgataactttttttttaattttgttttttttttttttacggagagatgcagggtcttgctctgtcacccagactgaagtgcagcggcacaatcatagcttactgcaacctgtaattcttgggctccggtaatctttctgcctcagcctc

SEQ ID NO: 200743 - DNA, 601 bp, Human
cagactggaggaggaaacacatcattaaataattattgtacaatgtggaacactatatagagtacattagattgtatgcagcttggtgttagggattgtgtcttggtcactattgcaatcctgctatgcccatggccttgtacaaagcaggtcctcaataaatttttggttgaataaattagtagtgtttggggtatatagaaagcaatacaagctgagttactaggaaggctccccagcagaggtgatggctgagctgaagaaatctctttctccattgactgtcagaatgccagcactrgggtgatgtcaccctcctaaagttctaggagtcttttgggtattgttagacccttcagtgtactctacacccagctcctcccagacctgtcagtgttccagggtacaatgtagacttggtttcctagacaattgtatatctgccgttttgcttgtgaaaaatactatttttatcaatatgacaagccaaccataaaagtatacgtgaaaattattgttgcttgtggccctcccaacaactcatctatcctgtgtattatctaaagaacaaaactggttccccaaagtggttatgcctcca

SEQ ID NO: 200744 - DNA, 601 bp, Human; identical to SEQ ID NO: 24889

SEQ ID NO: 200745 - DNA, 601 bp, Human; identical to SEQ ID NO: 24890

SEQ ID NO: 200746 - DNA, 601 bp, Human; identical to SEQ ID NO: 24891

SEQ ID NO: 200747 - DNA, 601 bp, Human; identical to SEQ ID NO: 24892

SEQ ID NO: 200748 - DNA, 601 bp, Human; identical to SEQ ID NO: 24893

SEQ ID NO: 200749 - DNA, 601 bp, Human; identical to SEQ ID NO: 24894

SEQ ID NO: 200750 - DNA, 601 bp, Human; identical to SEQ ID NO: 24895

SEQ ID NO: 200751 - DNA, 601 bp, Human; identical to SEQ ID NO: 24896

SEQ ID NO: 200752 - DNA, 601 bp, Human; identical to SEQ ID NO: 24897

SEQ ID NO: 200753 - DNA, 601 bp, Human; identical to SEQ ID NO: 24898

SEQ ID NO: 200754 - DNA, 601 bp, Human; identical to SEQ ID NO: 24899

SEQ ID NO: 200755 - DNA, 601 bp, Human; identical to SEQ ID NO: 24900

SEQ ID NO: 200756 - DNA, 601 bp, Human; identical to SEQ ID NO: 24901

SEQ ID NO: 200757 - DNA, 601 bp, Human; identical to SEQ ID NO: 200611

SEQ ID NO: 200758 - DNA, 601 bp, Human; identical to SEQ ID NO: 200612

SEQ ID NO: 200759 - DNA, 601 bp, Human; identical to SEQ ID NO: 200613

SEQ ID NO: 200760 - DNA, 601 bp, Human; identical to SEQ ID NO: 200614

SEQ ID NO: 200761 - DNA, 601 bp, Human; identical to SEQ ID NO: 200615

SEQ ID NO: 200762 - DNA, 601 bp, Human; identical to SEQ ID NO: 200616

SEQ ID NO: 200763 - DNA, 601 bp, Human; identical to SEQ ID NO: 200617

SEQ ID NO: 200764 - DNA, 601 bp, Human; identical to SEQ ID NO: 200618

SEQ ID NO: 200765 - DNA, 601 bp, Human; identical to SEQ ID NO: 200619

SEQ ID NO: 200766 - DNA, 601 bp, Human; identical to SEQ ID NO: 200620

SEQ ID NO: 200767 - DNA, 601 bp, Human; identical to SEQ ID NO: 200621

SEQ ID NO: 200768 - DNA, 601 bp, Human; identical to SEQ ID NO: 200622

SEQ ID NO: 200769 - DNA, 601 bp, Human; identical to SEQ ID NO: 200623

SEQ ID NO: 200770 - DNA, 601 bp, Human; identical to SEQ ID NO: 200624

SEQ ID NO: 200771 - DNA, 601 bp, Human; identical to SEQ ID NO: 200625

SEQ ID NO: 200772 - DNA, 601 bp, Human; identical to SEQ ID NO: 200626

SEQ ID NO: 200773 - DNA, 601 bp, Human; identical to SEQ ID NO: 200627

SEQ ID NO: 200774 - DNA, 601 bp, Human; identical to SEQ ID NO: 200628

SEQ ID NO: 200775 - DNA, 601 bp, Human; identical to SEQ ID NO: 200629

SEQ ID NO: 200776 - DNA, 601 bp, Human; identical to SEQ ID NO: 200630

SEQ ID NO: 200777 - DNA, 601 bp, Human; identical to SEQ ID NO: 200631

SEQ ID NO: 200778 - DNA, 601 bp, Human; identical to SEQ ID NO: 200632

SEQ ID NO: 200779 - DNA, 601 bp, Human; identical to SEQ ID NO: 200633

SEQ ID NO: 200780 - DNA, 601 bp, Human; identical to SEQ ID NO: 200634

SEQ ID NO: 200781 - DNA, 601 bp, Human; identical to SEQ ID NO: 200635

SEQ ID NO: 200782 - DNA, 601 bp, Human; identical to SEQ ID NO: 200636

SEQ ID NO: 200783 - DNA, 601 bp, Human; identical to SEQ ID NO: 200637

SEQ ID NO: 200784 - DNA, 601 bp, Human; identical to SEQ ID NO: 200638

SEQ ID NO: 200785 - DNA, 601 bp, Human; identical to SEQ ID NO: 200639

SEQ ID NO: 200786 - DNA, 601 bp, Human; identical to SEQ ID NO: 200640

SEQ ID NO: 200787 - DNA, 601 bp, Human; identical to SEQ ID NO: 200641

SEQ ID NO: 200788 - DNA, 601 bp, Human; identical to SEQ ID NO: 200642

SEQ ID NO: 200789 - DNA, 601 bp, Human; identical to SEQ ID NO: 200643

SEQ ID NO: 200790 - DNA, 601 bp, Human; identical to SEQ ID NO: 200644

SEQ ID NO: 200791 - DNA, 601 bp, Human; identical to SEQ ID NO: 200645

SEQ ID NO: 200792 - DNA, 601 bp, Human; identical to SEQ ID NO: 200646

SEQ ID NO: 200793 - DNA, 601 bp, Human; identical to SEQ ID NO: 200647

SEQ ID NO: 200794 - DNA, 601 bp, Human; identical to SEQ ID NO: 200648

SEQ ID NO: 200795 - DNA, 601 bp, Human; identical to SEQ ID NO: 200649

SEQ ID NO: 200796 - DNA, 601 bp, Human; identical to SEQ ID NO: 200650

SEQ ID NO: 200797 - DNA, 601 bp, Human; identical to SEQ ID NO: 200651

SEQ ID NO: 200798 - DNA, 601 bp, Human; identical to SEQ ID NO: 200652

SEQ ID NO: 200799 - DNA, 601 bp, Human; identical to SEQ ID NO: 200653

SEQ ID NO: 200800 - DNA, 601 bp, Human; identical to SEQ ID NO: 200654

SEQ ID NO: 200801 - DNA, 601 bp, Human; identical to SEQ ID NO: 200655

SEQ ID NO: 200802 - DNA, 601 bp, Human; identical to SEQ ID NO: 200656

SEQ ID NO: 200803 - DNA, 601 bp, Human; identical to SEQ ID NO: 200657

SEQ ID NO: 200804 - DNA, 601 bp, Human; identical to SEQ ID NO: 200658

SEQ ID NO: 200805 - DNA, 601 bp, Human; identical to SEQ ID NO: 200659

SEQ ID NO: 200806 - DNA, 601 bp, Human; identical to SEQ ID NO: 200660

SEQ ID NO: 200807 - DNA, 601 bp, Human; identical to SEQ ID NO: 200661

SEQ ID NO: 200808 - DNA, 601 bp, Human; identical to SEQ ID NO: 200662

SEQ ID NO: 200809 - DNA, 601 bp, Human; identical to SEQ ID NO: 200663

SEQ ID NO: 200810 - DNA, 601 bp, Human; identical to SEQ ID NO: 200664

SEQ ID NO: 200811 - DNA, 601 bp, Human; identical to SEQ ID NO: 200665

SEQ ID NO: 200812 - DNA, 601 bp, Human; identical to SEQ ID NO: 200666

SEQ ID NO: 200813 - DNA, 601 bp, Human; identical to SEQ ID NO: 200667

SEQ ID NO: 200814 - DNA, 601 bp, Human; identical to SEQ ID NO: 200668

SEQ ID NO: 200815 - DNA, 601 bp, Human; identical to SEQ ID NO: 200669

SEQ ID NO: 200816 - DNA, 601 bp, Human; identical to SEQ ID NO: 200670

SEQ ID NO: 200817 - DNA, 601 bp, Human; identical to SEQ ID NO: 200671

SEQ ID NO: 200818 - DNA, 601 bp, Human; identical to SEQ ID NO: 200672

SEQ ID NO: 200819 - DNA, 601 bp, Human; identical to SEQ ID NO: 200673

SEQ ID NO: 200820 - DNA, 601 bp, Human; identical to SEQ ID NO: 200674

SEQ ID NO: 200821 - DNA, 601 bp, Human; identical to SEQ ID NO: 200675

SEQ ID NO: 200822 - DNA, 601 bp, Human; identical to SEQ ID NO: 200676

SEQ ID NO: 200823 - DNA, 601 bp, Human; identical to SEQ ID NO: 200677

SEQ ID NO: 200824 - DNA, 601 bp, Human; identical to SEQ ID NO: 200678

SEQ ID NO: 200825 - DNA, 601 bp, Human; identical to SEQ ID NO: 200679

SEQ ID NO: 200826 - DNA, 601 bp, Human; identical to SEQ ID NO: 200680

SEQ ID NO: 200827 - DNA, 601 bp, Human; identical to SEQ ID NO: 200681

SEQ ID NO: 200828 - DNA, 601 bp, Human; identical to SEQ ID NO: 200682

SEQ ID NO: 200829 - DNA, 601 bp, Human; identical to SEQ ID NO: 200683

SEQ ID NO: 200830 - DNA, 601 bp, Human; identical to SEQ ID NO: 200684

SEQ ID NO: 200831 - DNA, 601 bp, Human; identical to SEQ ID NO: 200685

SEQ ID NO: 200832 - DNA, 601 bp, Human; identical to SEQ ID NO: 200686

SEQ ID NO: 200833 - DNA, 601 bp, Human; identical to SEQ ID NO: 200687

SEQ ID NO: 200834 - DNA, 601 bp, Human; identical to SEQ ID NO: 200688

SEQ ID NO: 200835 - DNA, 601 bp, Human; identical to SEQ ID NO: 200689

SEQ ID NO: 200836 - DNA, 601 bp, Human; identical to SEQ ID NO: 200690

SEQ ID NO: 200837 - DNA, 601 bp, Human; identical to SEQ ID NO: 200691

SEQ ID NO: 200838 - DNA, 601 bp, Human; identical to SEQ ID NO: 200692

SEQ ID NO: 200839 - DNA, 601 bp, Human; identical to SEQ ID NO: 200693

SEQ ID NO: 200840 - DNA, 601 bp, Human; identical to SEQ ID NO: 200694

SEQ ID NO: 200841 - DNA, 601 bp, Human; identical to SEQ ID NO: 200695

SEQ ID NO: 200842 - DNA, 601 bp, Human; identical to SEQ ID NO: 200696

SEQ ID NO: 200843 - DNA, 601 bp, Human; identical to SEQ ID NO: 200697

SEQ ID NO: 200844 - DNA, 601 bp, Human; identical to SEQ ID NO: 200698

SEQ ID NO: 200845 - DNA, 601 bp, Human; identical to SEQ ID NO: 200699

SEQ ID NO: 200846 - DNA, 601 bp, Human; identical to SEQ ID NO: 200700

SEQ ID NO: 200847 - DNA, 601 bp, Human; identical to SEQ ID NO: 200701

SEQ ID NO: 200848 - DNA, 601 bp, Human; identical to SEQ ID NO: 200702

SEQ ID NO: 200849 - DNA, 601 bp, Human; identical to SEQ ID NO: 200703

SEQ ID NO: 200850 - DNA, 601 bp, Human; identical to SEQ ID NO: 200704

SEQ ID NO: 200851 - DNA, 601 bp, Human; identical to SEQ ID NO: 200705

SEQ ID NO: 200852 - DNA, 601 bp, Human; identical to SEQ ID NO: 24858

SEQ ID NO: 200853 - DNA, 601 bp, Human; identical to SEQ ID NO: 24859

SEQ ID NO: 200854 - DNA, 601 bp, Human; identical to SEQ ID NO: 24860

SEQ ID NO: 200855 - DNA, 601 bp, Human; identical to SEQ ID NO: 24861

SEQ ID NO: 200856 - DNA, 601 bp, Human; identical to SEQ ID NO: 24862

SEQ ID NO: 200857 - DNA, 601 bp, Human; identical to SEQ ID NO: 24863

SEQ ID NO: 200858 - DNA, 601 bp, Human; identical to SEQ ID NO: 24864

SEQ ID NO: 200859 - DNA, 601 bp, Human; identical to SEQ ID NO: 24865

SEQ ID NO: 200860 - DNA, 601 bp, Human; identical to SEQ ID NO: 24866

SEQ ID NO: 200861 - DNA, 601 bp, Human; identical to SEQ ID NO: 24867

SEQ ID NO: 200862 - DNA, 601 bp, Human; identical to SEQ ID NO: 24868

SEQ ID NO: 200863 - DNA, 601 bp, Human; identical to SEQ ID NO: 24869

SEQ ID NO: 200864 - DNA, 601 bp, Human; identical to SEQ ID NO: 24870

SEQ ID NO: 200865 - DNA, 601 bp, Human; identical to SEQ ID NO: 24871

SEQ ID NO: 200866 - DNA, 601 bp, Human; identical to SEQ ID NO: 24872

SEQ ID NO: 200867 - DNA, 601 bp, Human; identical to SEQ ID NO: 24873

SEQ ID NO: 200868 - DNA, 601 bp, Human; identical to SEQ ID NO: 24874

SEQ ID NO: 200869 - DNA, 601 bp, Human; identical to SEQ ID NO: 24875

SEQ ID NO: 200870 - DNA, 601 bp, Human; identical to SEQ ID NO: 24876

SEQ ID NO: 200871 - DNA, 601 bp, Human; identical to SEQ ID NO: 24877

SEQ ID NO: 200872 - DNA, 601 bp, Human; identical to SEQ ID NO: 24878

SEQ ID NO: 200873 - DNA, 601 bp, Human; identical to SEQ ID NO: 24879

SEQ ID NO: 200874 - DNA, 601 bp, Human; identical to SEQ ID NO: 24880

SEQ ID NO: 200875 - DNA, 601 bp, Human; identical to SEQ ID NO: 24881

SEQ ID NO: 200876 - DNA, 601 bp, Human; identical to SEQ ID NO: 24882

SEQ ID NO: 200877 - DNA, 601 bp, Human; identical to SEQ ID NO: 24883

SEQ ID NO: 200878 - DNA, 601 bp, Human; identical to SEQ ID NO: 24884

SEQ ID NO: 200879 - DNA, 601 bp, Human; identical to SEQ ID NO: 24885

SEQ ID NO: 200880 - DNA, 601 bp, Human; identical to SEQ ID NO: 24886

SEQ ID NO: 200881 - DNA, 601 bp, Human; identical to SEQ ID NO: 24887

SEQ ID NO: 200882 - DNA, 601 bp, Human; identical to SEQ ID NO: 24888

SEQ ID NO: 200883 - DNA, 601 bp, Human; identical to SEQ ID NO: 200737

SEQ ID NO: 200884 - DNA, 601 bp, Human; identical to SEQ ID NO: 200738

SEQ ID NO: 200885 - DNA, 601 bp, Human; identical to SEQ ID NO: 200739

SEQ ID NO: 200886 - DNA, 601 bp, Human; identical to SEQ ID NO: 200740

SEQ ID NO: 200887 - DNA, 601 bp, Human; identical to SEQ ID NO: 200741

SEQ ID NO: 200888 - DNA, 601 bp, Human; identical to SEQ ID NO: 200742

SEQ ID NO: 200889 - DNA, 601 bp, Human; identical to SEQ ID NO: 200743

SEQ ID NO: 200890 - DNA, 601 bp, Human; identical to SEQ ID NO: 24889

SEQ ID NO: 200891 - DNA, 601 bp, Human; identical to SEQ ID NO: 24890

SEQ ID NO: 200892 - DNA, 601 bp, Human; identical to SEQ ID NO: 24891

SEQ ID NO: 200893 - DNA, 601 bp, Human; identical to SEQ ID NO: 24892

SEQ ID NO: 200894 - DNA, 601 bp, Human; identical to SEQ ID NO: 24893

SEQ ID NO: 200895 - DNA, 601 bp, Human; identical to SEQ ID NO: 24894

SEQ ID NO: 200896 - DNA, 601 bp, Human; identical to SEQ ID NO: 24895

SEQ ID NO: 200897 - DNA, 601 bp, Human; identical to SEQ ID NO: 24896

SEQ ID NO: 200898 - DNA, 601 bp, Human; identical to SEQ ID NO: 24897

SEQ ID NO: 200899 - DNA, 601 bp, Human; identical to SEQ ID NO: 24898

SEQ ID NO: 200900 - DNA, 601 bp, Human; identical to SEQ ID NO: 24899

SEQ ID NO: 200901 - DNA, 601 bp, Human; identical to SEQ ID NO: 24900

SEQ ID NO: 200902 - DNA, 601 bp, Human; identical to SEQ ID NO: 24901

SEQ ID NO: 200903 - DNA, 601 bp, Human; identical to SEQ ID NO: 34388

SEQ ID NO: 200904 - DNA, 601 bp, Human; identical to SEQ ID NO: 34389

SEQ ID NO: 200905 - DNA, 601 bp, Human; identical to SEQ ID NO: 34390

SEQ ID NO: 200906 - DNA, 601 bp, Human
ctgatggaatttgtaaaaaggtacaaagacaaatccaccactgccaacaaacagattttcagaatatgttccaggtatattcactctaactttttacatctttgccagctactgagtgctacaataatcatgaacacttgcagagatcactcaagaatgtgacaagactgaataaaggttaaattaaccattctatcctccattttactaaatgcttaataaagaagatgactgtggtagggggcgggaagtaaggctgaataggcctggtggggccccaaaagcaggaagccatgatcarttctggagtaggacagttatgtaagagtaatccagatttggttttcttttcttcttcttcttcttcttattttttttgacacaaggtctcaaacttctgggctcaagagatcctcctgccttgacctcctcagtagctgggatgtgccactgcacccagctcaggcttggttttaaaatgataaaacttgcaacttactttttgttttaagaagataattgcctttggttattttatgagtcaagctaggaaaaatactcattacttatagtcatccaaagtagcatttctcagcagatc

SEQ ID NO: 200907 - DNA, 601 bp, Human
aggatttttttctaattttgtgaaaaatgatgttggtattttgataggaaatgcactgaatctgtagactgctttgggcagtaaggtctttttcataatattgattcttccaatccatgagcatgggatgtatttccatttgtgtcatgcatgatttctttcaacagtgttttgtagttctccctgtagggatcttttaccttcttggctaagtatattcctaggtaatttattgctattactattattattattaattattttacagctattgtaaaaggggttgagttcttgatttgaktctcagcttggtcactgttggtatataatagtgctactgatttgtacacactgattttgtaacctaagactttactgatatggtttggctgtgtccccacccaaatctcatcatgaattgtaatcctcataatccccatgtgtctagggagagacctggtgggaggtgattggatcatgggggcagtttccctccatgctgttctagtgatagtgagtgagttctcacaatatctgatggttttataaggggcccttccttcttcaatctcactctgctctcccctctcaccacgtgaga

SEQ ID NO: 200908 - DNA, 601 bp, Human
aaatgcactgaatctgtagactgctttgggcagtaaggtctttttcataatattgattcttccaatccatgagcatgggatgtatttccatttgtgtcatgcatgatttctttcaacagtgttttgtagttctccctgtagggatcttttaccttcttggctaagtatattcctaggtaatttattgctattactattattattattaattattttacagctattgtaaaaggggttgagttcttgatttgattctcagcttggtcactgttggtatataatagtgctactgatttgtacacactgattttgtaacctaagactttactgatatggtttggctgtgtccccacccaaatctcatcatgaattgtaatcctcataatccccatgtgtctagggagagacctggtgggaggtgattggatcatgggggcagtttccctccatgctgttctagtgatagtgagtgagttctcacaatatctgatggttttataaggggcccttccttcttcaatctcactctgctctcccctctcaccacgtgagaaggtccaggcttgcttcaccttcaccttccaccatgattgtaaatttc

SEQ ID NO: 200909 - DNA, 601 bp, Human
tcctgactcatctattttcccatctgctagcaattctaacaatatgaactatcaacagaatggctaacaacaagaattttctatggcagttttgatgctgaattgcctatagcatttttaagatttaccagtgcatgtctcagactgttttgagtttcttgtggcctggagcaacatactcttttttcccttaatattccattttagctgaaatttttactgtgttgaacagaatcttgtttggttttagaaaacactgttgatggaggctgccacacatttaactaacaatgagaacagraaacacaacaaagcactagtaaaaatccagtcaggtccactgattggtttagatatacataaacaggcaaggggccttttgcccataaggctgagccacagggataacaggtagtacttaaagttaaaaaaaaaaaaaaaaaaaaaaaagaaagaaagaaagaaaaaaaaagaaaagaaaacattcatatattaaggcattttcctgatttaattcctggcactgagaagcatacaaaaaaggagcattctagtcaatccaaactactatgaagcctgtttaaagaaaaccctacatata

SEQ ID NO: 200910 - DNA, 601 bp, Human
tgggattacaattggaaactaccatgaatcattctgttttggctgtttaacttcagagcacctagaagaaacttaggattctagattttcattcccaaagaaaaggaagaatacggtttctcatgaatatcaatgaaggagtaggagaaagtgccaattactgattatttacaatgtgctgaatactatcctaaggtcctgtacactaagtcattgaagcctagcaatcaccttagggggcagatattaccaaccccgtttgacaggtgaggatgcttagagagatcaaatgatccacccyaggtctctcagctagaggtgcttatgtaggccctcaaaggcaacatctaacccacataaatttgaactgcagtctactgatagctgtttcatgggtttcccatgaactacaaaagcactacaaaatccaatgatcatgtgaaacagttttttcacaaattgtttataggttaaaaatagaaaaaattacttaaaaatcccaactttcctgtcagattgtacctggtgaagcattttacttataagctattcatgtattttagccatcactggccatatgaaataagtgcatatgtgttaa

SEQ ID NO: 200911 - DNA, 601 bp, Human
tggatctctggaaggctccttatttgactttaggtaaggagagaactattttcttcccctcccaccaggttataaattccatttggatagggcctttgtctagtaaacagctacatctctagtgcctagaacactgcttgaaacatagtaggtgcttaatcaatatttattgaatgaatgaaaaatggtgggtctcttagtaatcgctggagggaggcggctggcttcagttgttggtggcatgctttagaatatcgggtacttaacacctgctgttttcagctgtggactctactaacarttttgtggtaacagaaagtcccttttgatgtcatagtacacatctattaactctatttaaaaaatgtgtgtgtgtgtgtgtgtgtgtgtgtgtgtggcatcaagttggtaaatttgcagttgaagtaaagcaaaaagagtatctgtgaagatgagggtattttttcagcatgtttaattaatattactacaggatagtttcatgctccactacatgtttattctgcatgtctgatgatacatttatttcaataataaggggctcatccttttcttagaataatggcttctctcaaaaaat

SEQ ID NO: 200912 - DNA, 601 bp, Human
tatgaatagtggcatccactgaacccgctcataagggcaagatttcaacctctaagagagggctaagtcgctggctatacagtaccctctggtggccagatttgacactgcagatttttctgccttttaagaaaagaggcctggtttttttccttttcttttttttttttttttaatgcatagacttaccattgggttacgtcttgataaagccatcataaactaaaaatatctgcatttagtacagctaacctaccaaacatcatggcttaacctagcctaccttaaacatgctcagaayaattaacattagccttcagttgggcaaaatcatctaacgcaaagcctattttataataaagtgttgaatatttcatgtaatttattgaatactgtactgaacgtgaaaaagagtggctatacgactactccaagtaccgtttctactgaatgtgtatcactttcatatcaccaaaaaactttaagtggaaccatcatatacctgggactgtctgtaattcaaaatctttctagacaaggaaggaatcaccagtagcactgctgggctatgggtaggtgggcaactacctactaggtgtaa

SEQ ID NO: 200913 - DNA, 601 bp, Human
atcatggcttaacctagcctaccttaaacatgctcagaacaattaacattagccttcagttgggcaaaatcatctaacgcaaagcctattttataataaagtgttgaatatttcatgtaatttattgaatactgtactgaacgtgaaaaagagtggctatacgactactccaagtaccgtttctactgaatgtgtatcactttcatatcaccaaaaaactttaagtggaaccatcatatacctgggactgtctgtaattcaaaatctttctagacaaggaaggaatcaccagtagcactgmtgggctatgggtaggtgggcaactacctactaggtgtaaatctgtcaaccaaaaaagtaaattatggtggctttaagggagaaaatgttcctctgaatgtgtttaaaatcccatgggtgtagctacttaaatgaagaaatctggtgagtacttagctatttaaaatttaattctttgcaggtacttactttacaagaagtattcttatatagagagattcatattgctataaatatgtacataatagctaacatgcgcttaccactggcagacactatgctgttatttaataggcaataa

SEQ ID NO: 200914 - DNA, 601 bp, Human
ctacaccccctgttgtaatgaattcgcatacctgcctccgattacaggctggattgccccaaagtagtcttctcagaaacctatctacacagttagcttctttctcttgtgcatcttcaaactctctttgtctttagcatcaacatgatatactttctgatatttcccatcttaaacttttattgttttttcttatctcaagaaaaccctgccttgactcacggccattcctccagttgtcacaattccatccctcttctcctttagaaagtcaaacttctcaaagtatggagaaaacaayaaccatattttaaattggcaatcaaacttcaacttgctccatactggcttctgatcccctaatgctctccaaattcctcttgttaggtcgccaaagttaaatgaattctttttagtttctatcttatttggcccctccagctgtacttgatactttgtccacacctttccttcttgaaacctccctctcttggctcctacaacaccatgctctcttttctcgtaaatttatggccatttctcaatctcctttattggcttcttctcaactactaaatgttagaactactcaggactctgg

SEQ ID NO: 200915 - DNA, 601 bp, Human
atctccccagtcaaagccctcttatcttgagcacactgtttcaatagcttcctaactagtttccttctatctttgctcccctccaattcactctccatacagcagccagaattattgtttaaaaatgtatactgggtcatgtcctgcccctaagatacggaaatggctctttcttgcatatgaaatccaaatgcggccttgcctgaatctaatcctgcctaggtctgcagcttcagcttgtgctactctagccattactcctatgtttccatcatgactgattctctttcagtttctcagmttcaccaagctctttgcatgtgaattgggagtaaaatcgtccaaaaattaagaggttaggattaaatgattacatgcctttcctttgcttagaatgttgttccacactccccactttggcttcaagactttgttaacacagttctgtctactgagagtgtcctttccctcatctctgcctgatgaagttctattcatctttaggactgatcttaaatgtcatcttcataaagtcttcctggtcaaattttccctgtaagcatactgagttacttttttctccatatacctaaagataatt

SEQ ID NO: 200916 - DNA, 601 bp, Human
tttcaatagcttcctaactagtttccttctatctttgctcccctccaattcactctccatacagcagccagaattattgtttaaaaatgtatactgggtcatgtcctgcccctaagatacggaaatggctctttcttgcatatgaaatccaaatgcggccttgcctgaatctaatcctgcctaggtctgcagcttcagcttgtgctactctagccattactcctatgtttccatcatgactgattctctttcagtttctcagcttcaccaagctctttgcatgtgaattgggagtaaaatsgtccaaaaattaagaggttaggattaaatgattacatgcctttcctttgcttagaatgttgttccacactccccactttggcttcaagactttgttaacacagttctgtctactgagagtgtcctttccctcatctctgcctgatgaagttctattcatctttaggactgatcttaaatgtcatcttcataaagtcttcctggtcaaattttccctgtaagcatactgagttacttttttctccatatacctaaagataattttgcatatgtctctgttataacatttatcaccgtactg

SEQ ID NO: 200917 - DNA, 601 bp, Human
tccaagccagatgcctggagttctcactgaggaagctggcagaacctagaaaaatccttattactccctcaaatttgcagagggacttcagatgactaaaactagctgcaggaaagaaaaaagacattttcttttctgcctagccatttataaagttttttaacttgcagaaaatcactgaagttctttcagtttcggagcctctcaaataaagtggaaatactataaacacatgtcacagagatgttctgaagattacatgagaccacagatgttaaagggcctagcacaaaggtggcayaggtggctccctaccctctgtctctccttcatttttagttttctttgggctcatgcaccacatgcccacatctgtgccaccagagctttctctatctgctcttatacactatatttacgagcttctgtcgttatcttgttctgcgattttcctctctccctatgttcctgatgaggtggcagtggtacttgctgctaaatacatctaagtcctttcatcactggtgacaagagttcatgtgagaggtagcagtggagaagatgcaggaaaaagaatgccatagtgaggatgacatacttc

SEQ ID NO: 200918 - DNA, 601 bp, Human
caaagaagcggccgggtgcggtggctcacacctgcaatcccagcactttgggaggccaaggtggggcggatcatgaggtcaggagttagagaccagcctggccaacatggtgaaaccctgtctctactaaaaatacaaaaattagctgggtgtggcagtgggtgcctgtaatcccagtgactcgggaggctgaggcagcagaattgcttgagtccgggaggtggaggttgccgtgagccaagatcctgccactgcactccagcctgggtgacagagcaacactccgtctcggggggggggsgggcgggaaaggtgaagaagcatatcaggagttcagcttttgctaggtcagagaaagttcttaacagactaactcttttgcagataataaactgtggacaaaacacaaaaaccaactactgaagtctctaaagaatgaacaaaaacacattcttccccctccacaagaaaacatttacaatgtctgggatgtaatccaaaattacttgacatatgaagaatctggaaaatgcaatccacccccaatggaaaagacaatcaacagaagccaaccttgatacgacccagatatcagaaataa

SEQ ID NO: 200919 - DNA, 601 bp, Human
ttagaaaatatgaagtccagaagacacctggaacaatattttaaactttctgagataggagaagcacacttcactttaaatataaaggcacagacaggttaaagtaaatggatgtaaaaagagcatgcaaacagtgaatgattatcgtactaatattggagggggaagcatatcacctgcctagctgccacagtatgatttcaaaaaaaacaagaacattcaccaagaacaaacaaaaaaacctcttcaaatagaccatggaactgaattcaaacttgtatctgataacagcgatgacaayatctctctataacaatcctgaccagcatatatcacaattactacagaggctactgacaagaaatccaaccttggtatgctgtacacgactgtcctcccaccctcccagtgaaatcaaacaaaattaataatagtctactacatcagagggactccatttgggggaaagtttcaggctatgctcttgcctcaaaattggtggggaaaacacatagacatatacatacacacaaagcaaatacagcaaaatgttcaaaattgttgaatctaagtagtaaatgttaagtgtttattgtactat

SEQ ID NO: 200920 - DNA, 601 bp, Human
tgtagcaacttggatggaactggaggccattatcctaagtgaagtaactcaggaaaggaaaaccaaatactgcatgtttttacttataagtgggagctaagctacggatatgcaaaggcatgcagagtggtataatggacattggagactcagaatggggatgtgggactgaaaaaatcacctactgggtacactattcgggtgatgggtacactagcagcccagcttcactattatacaacttgcccatgcaaccaaaaaccactagtatccctaaagctattgaaaaaaaaaaaaaaaacttagtaagcctcctagactttataatctcaagacacgactttttaacataaattctgaacattatctggaaaaactgttgactggaatacgtttgtttggtattttttcaaggatagaatgatgttttgataatcagacttctcctttacttgtcacttagtaaccttctatactaaaaaaatttagtcattgaagtgtaacatgtattcaactgaagctagttgaattctcacgtttctcacactccccttgagctggcatcaaagattaacttaaaaggtcatgaaggaattcaaat

SEQ ID NO: 200921 - DNA, 601 bp, Human
ccagatcagttatatgctttaaaagcattatttctccctgaataaaaatgaatccaaaggctgtgattcctaagaacaactgaagttaaagctaaatgttctcaaaacaattttacatagctcattctaaatgttctttaccaacttttaaataagaatgacaaataagagacagtcaaatgtttttatggatcttctgaataaactacgtaaagataaaaaatacatgtaagtataaaatacaatttgtaaatgagggccgggattagcaatgccaggatggataaagacatgttttctygcatttaggtaactttgtcccctatgagatgaccctcagaagttgtctcgacgtttgctcagcagtgatttgattcaatgaccaatattcaaacagcactcccttagagactctacgcatgacctctgactgcttggtgcctaactctccacatatgtcaaacagagggaagaataattgctagctacctcccagcaattctagaagatttaatgaggcagggagccagacctccatggtgagtcaattattccctgggtagaagttatgttatttgtgaggtgccgtatttctaaggat

SEQ ID NO: 200922 - DNA, 601 bp, Human
ttctgattctgggccaagcataatcaggtggctcacccctgtaatctcagcactttgggaggctgaggtgggccgatcacctgagatcaggagttcaagatcagcctagccaacatggtgaaaccccatctctactaaaaatacaaaaaattagccaggcgtggtggcacacacctataatcccagccacttgggaggctgaggcaggagaatcacttgaacccaggaggcagaggttgcagtgagccgagattgtgccattgcactccagcctgggcaaaatgagggaaactgcgtctcaaaaaaaaaaaatgtatttataaatctaatgctttagtggcagaccaggagacaacccacatacaagtggtcaatttgaattttatctagaaccattactgttgccctgaaagccagattcactttagtcagctaaattttatggagtgtgttttataaacaaagcattgtatgaagctctagaaaatagtcagcagaagacagtccttcttctcaaaggctttccaacacattatcaagaacatacacagtcacaagcaattacaatttgaaagtagcacacagataaagaaattaatta

SEQ ID NO: 200923 - DNA, 601 bp, Human
aggcaggagaatcacttgaacccaggaggcagaggttgcagtgagccgagattgtgccattgcactccagcctgggcaaaatgagggaaactgcgtctcaaaaaaaaaaaatgtatttataaatctaatgctttagtggcagaccaggagacaacccacatacaagtggtcaatttgaattttatctagaaccattactgttgccctgaaagccagattcactttagtcagctaaattttatggagtgtgttttataaacaaagcattgtatgaagctctagaaaatagtcagcagaagayagtccttcttctcaaaggctttccaacacattatcaagaacatacacagtcacaagcaattacaatttgaaagtagcacacagataaagaaattaattaccactggtggggctggagaccgtttaacagaacagataggtttaagctgggtaagatttcaactagcaacacaggaatgaagggtgcttgaaaacagcacagaaaggcacaaggaaatagtacagacaattgtacaagtaaagacaaagaagtaggaggctgccatgtacatgtgaaggataatgaagtggcagggcaaga

SEQ ID NO: 200924 - DNA, 601 bp, Human
tcatcaaatgacctgtgctaatagagctgctggcaaaagtgcagtcattttattgagataaaacattgaaaataattttcataaaataaggcacagatgctttaattagaaaaaaatgtccttgagggtgggattcagatgcagttttataacttgtacggtgccttaaatgcattaaaagatagacaatggtacaaggactattctccctagtggtaacaaaactgtttcctagttactagggtagggtagggaggaaatgaaaggaagaagagaaaatctagagtttattcttttcctrcttctaatgttataagccaatgctaatgtttagtagtcacaacctcgtctgctaggcactgcaactaatttcccgtatttgggtagaaaaaaatgcatcatgtctcaaagaatgaactactgacagaaatttagtgactgatactaaaggtagatatgtagctgcagggtatgagaaagaggagacacagtcctaaaaataacagcaaaactaagatgaaaatgcagagaagtggtatggtacattggtagctatcccctaatatctattctacctttcttccatagaaatatcgtttta

SEQ ID NO: 200925 - DNA, 601 bp, Human
acggtgccttaaatgcattaaaagatagacaatggtacaaggactattctccctagtggtaacaaaactgtttcctagttactagggtagggtagggaggaaatgaaaggaagaagagaaaatctagagtttattcttttcctgcttctaatgttataagccaatgctaatgtttagtagtcacaacctcgtctgctaggcactgcaactaatttcccgtatttgggtagaaaaaaatgcatcatgtctcaaagaatgaactactgacagaaatttagtgactgatactaaaggtagataygtagctgcagggtatgagaaagaggagacacagtcctaaaaataacagcaaaactaagatgaaaatgcagagaagtggtatggtacattggtagctatcccctaatatctattctacctttcttccatagaaatatcgttttagccaggcatacagtcattcggaataaaagcaacactttcggtctctattgcaactacatgtagccctatgaccaagtactgacccgcattatatggacgtttctgggcacctttctcaaaagatggctggggcatgcccatttcacccctttctcca

SEQ ID NO: 200926 - DNA, 601 bp, Human
tttctctcaggtgaactttggtgttccttatatattcctaactgtagttttgaagactcttccattaaacaatgatcttattgcattataattgtttgcatgggcatcttaacttcttaactggcttagattagggaattaaaatagacattggctgggcacagtggctcacacctgtaatcccagcactttgggaggctaaggtgggtggatcacttaagaccaggagttcaaggctgcagtgagctataatggtgccactgcacactagtctaggtgacagagtgagaccctgtctcaraaaaaaaaaaaaaaaaaaaaaaaaagagagagagagattatgaaaacatttactgggagacctaacccattttttgcttcaggaaaccaatcttaaacagtgccaagaaaggcaagccaaagacagtggatgaagacagtggtggtgatgctggaaaagcccaggcaaactgaagcacagctactgtggaagagagaacagcaggaaaaaactggagagacaccaggagcccaactgtgaagggactgctaagagaaggttcagctttgtgcttccagtcactgattcaaactttcttca

SEQ ID NO: 200927 - DNA, 601 bp, Human
atgaagacagtggtggtgatgctggaaaagcccaggcaaactgaagcacagctactgtggaagagagaacagcaggaaaaaactggagagacaccaggagcccaactgtgaagggactgctaagagaaggttcagctttgtgcttccagtcactgattcaaactttcttcatgaatccaaccactaaattaaacaccagctttctaaaagctgcacattctcatactataaaagaaaatatatttcaaataaaatactttccaggctttccagaagaaaaaatccatcccatgtcacccaytgtgactaagcacggaggaaacagattaaattagggatattttgcccgtacatctccaggctgcatgaaatgaaaacaaatgagagtcaggactctcaaaagtttcacagttctaaccatcaacgcaatgtgccaagcaacatagtaaatgttcacgtttcaaacaggaggaatacattttaccttttctatctgggatagaagattagattctaatcttttttggttttccactcagatgagcaccttaagtgggatcatatttctatattacaggtacttttttttttcctgaaagtc

SEQ ID NO: 200928 - DNA, 601 bp, Human
tttgtcacactacaatattgatgaaccttgaggatattatgctaagtagaataaaccagtcacaaaagataatactgtattactccatttatatgaggtatctaaaatggttaaattcatagaaacagaaagtataatggtggttgccaggggctgatgggaaaggggagctgttatttagtgggtttaaagtttcagatttgtaagatgaaaaagttctggagatctgtctcataacaatgtgaatatacttactatttaactgtacacttaaaaatgatgaaaatggcaaattttatgkttttttttaaccaaaataaaaaaaatttttaaagccaaaacagtcttgaaaaagaacaaagttggtggacacacacttttcaacttcaaaacttactacggagctacagcaatcaagacagtgtggtagtggcatgaagatagacatatagatcagtggaacacaattgagggtccaaaaataaatcttcatatttagagtcaattgattttctagcagggtaccaagataactcaatgagggaaagaataatcttcaacaaatggtgttggaacaactgaatattgacatgcaacagaa

SEQ ID NO: 200929 - DNA, 601 bp, Human
gtggtagtggcatgaagatagacatatagatcagtggaacacaattgagggtccaaaaataaatcttcatatttagagtcaattgattttctagcagggtaccaagataactcaatgagggaaagaataatcttcaacaaatggtgttggaacaactgaatattgacatgcaacagaacaaagttacttctatctaacaccatatacaaatattaactcaaaatagatcaaagacctatatgtaacagctaaaactataagactcttggacgaacatgtaagtgtaaagctttgtgacctkgagctacacaataattttcttagctatgataccaaaagcactagtaaaaaaaaagaaaaaaggaaactggactttatcaaaatttaaaaatgtgcttcaaaggacaccatcaagacagtgaaaatacagcccacagaatgggagaaaatagttgcaaataaaatatctgataaggaacttgtatgtagagtatatacagagctcttacaactcaataataaaaagactaataaccaatttaaaaatgagcaaagggtctgaatagacatttctccaaagacaatgtgcaaatggacaata

SEQ ID NO: 200930 - DNA, 601 bp, Human
ataccaaaagcactagtaaaaaaaaagaaaaaaggaaactggactttatcaaaatttaaaaatgtgcttcaaaggacaccatcaagacagtgaaaatacagcccacagaatgggagaaaatagttgcaaataaaatatctgataaggaacttgtatgtagagtatatacagagctcttacaactcaataataaaaagactaataaccaatttaaaaatgagcaaagggtctgaatagacatttctccaaagacaatgtgcaaatggacaataagcacacaaaaagatgctcaacatcatcrgctattaggtaaatgcaaatcaaaaccagaacgagataccacttcatactcactaggatgactataatcaagaagatagacaatagcaagtgttgcgaggatgtagagaaattggaaccctcatacactgctgacaggaatgtaaaatggtgcagtcactttgaaaaacaacctgacagttcctcaacagagcatttccatattattcagcaattcttctcctaggtatactcaagaaaaaggaaaacgatgtccacacaaaaacttgtacaaaattgttcacaacagcattattcataa

SEQ ID NO: 200931 - DNA, 601 bp, Human
ggagcatggtagagaaatcctaattcatcttggagaacacatatatcatcataagcagaatgttggtagaaatataaacacagtaaagatggtactggtgagggctcagaaggagatgagcaacattttattagaaactgtaggaaaggagatttgtcatatagtggcagaaagcttagctgatgtgtgtcctacaattatatacaatgatgaacttagatttagatgatttggatgagatcttggacttttgagctgattatatttaggtgagattttgggttgaaactgaaatgggttraggcttctggagatactgggatggggtgaatattttgcatgtgagatagatgtaaatccttggagacaagagggcagactgtggtaagctcctcaagatattcatgccctgatgcctggaacctgaaaatgctacctcatatggcaaagactttgcaagtgtgattaacttaagcatcttgagatatggagattatcttggattatctcagtgggccctcaatacagtcacaagtgtccttagaagaggggaggcagagaggttttacacaaaagaaaaaggtcatgtgaccaaaaaaaa

SEQ ID NO: 200932 - DNA, 601 bp, Human
attttcagctttctgctctggtttctccttatctttgtggtttttatctaccttttgtctttgatgctggtgacctaccgatggggttttggtgtagatgacctttatgttgatgttgatgctattcctttctgtttgttagttttccttctaagaatcaggtccctcagctgcaggtctgttggagtctgctggaggaccactccagactctgtttgcctgggtatcaccagtggaggctgcagaacagcaaatattgctgcctgatccttcctctagaagcttcatcccagaggggcakctggctgtgtgaggtgtcagttggcccctactgggaggtgtctcccagttaggctacacaggggtcagggacccacttgaggaggcagtctgtctgttctcagagctcgaacaccatgctgggagaaccactactctcttcagagctgtcagacaaggacgtttaagtctgcagaagtttctgctgccttttgttcagctatgccctgcccccagaggtggggtctatagagtcagcaggccttgcagagctgcagtgggctccacccagtttgagcttcccaggctgctttgtttacct

SEQ ID NO: 200933 - DNA, 601 bp, Human
gtaatggatttctgtaaagaagaattactagagacaatagatgccccttttgttatgctgctattaagtattattgaacagtcacatttagtttaatgcctaatccagaggcatgccacaaatatgcaagtcctatttttgtctatgtctgaagacggttatgtgtgttctttttctccttccaatttcctaatcagttttgcaaatagttacaaaatttttaccaggccaaacagccccctgctccctaccctcacccatatatttgccttcattttcagcccctgtaacatcagagggttttttttttaaaactgtaaataaatcctgactaattatgatttattcacagctgctctcaatgatattatgaactagtatccttttccactattaataatttctataaaatatttaaatgcagtttttttttacaactagaattctcatttgaacaaacaagaaaatgtcatactgaaggtaaatacatcaatttaaaaatttctcttataaataagtatgttttaagtttaataaagtagctagcacagctgggaacaggaaaaatgctgtttgcttcaattttgcaagcatttgattt

SEQ ID NO: 200934 - DNA, 601 bp, Human
cccctgaattgtgagactaaggctcacaacaaagacaaaaataatgtacaagcaccacctatcttgaagacagccaccaaccaaatggggccaaatcgccaaccttgagtttactcagaggttgaatgagccccaccactcccaaatcatcacccagcctacataagagggcaagggtacatcaggagcactggggtgcagtttttgtcataggagcttcctcactcaagccaagttgcacagcaccaagatattacatcaaagacacgttgtggtttcctgcaagaagaggagactggcrtctcactttccagctggactgaatactgaataaagaacctgcaaacttgccctggtgctgccagtggagtagaatttagcctgctgaagtgttcatagatgacctggcatatgtccctagaagttggggaaaatatattggcctagaaacttgtctacttcttatctagagatttctgaagatgggaggcttgggtagagcagcctgcagcagcagacctaatagggccacagaaatagtatacctgggtggggcgggggagaagtggagagtacctctcacatttcccctatctaccca

SEQ ID NO: 200935 - DNA, 601 bp, Human
aaaactatagccaatatctcttttaaaaccagaaacattacctgcatttaaacaaagcagataacatgctgctatactggtaaaacaaacaaacaaacaaacaaacaaaaaactggtagatgctgctggcttaagtttttaccttaagctgtctacagggtctgtgttgctgagggcttactaaaggggtggccctgctcctctttttcggggctactctagtttctttatcactccttcacagttgctggctatagaggagggtgaaaagaccctgagaaagaaacatttctccagaacaagattcctaaaatgtccatgggcagctccagcagcagggttggtactttctctgccaaccctttactgttttctgcattttgcaacagtgacttttgttttgtttccctgtaatcatactcacttgctaatgcaggcaacaaaggtaggactgcggaaaaactaggaaagccccaggcaactttatacttggggagcaaagttagtttttttcccttctctgccacaatttttgggactttttcttcagtgtggccctggaggattcttgtgtcccttagctcaaaagaacaccaccaac

SEQ ID NO: 200936 - DNA, 601 bp, Human
ttctgcaaaacattatctacatgctctctatttaacactaaacaatctggatgttaaggctgtttggaaataattctaacaaaaactgaaacattagactagtgctataataaacagacttgccttttacatttgttttagaaatcttcataagcacatcctaaacataacttttttccggtagggttaaaaataattcaattagcccaaatatattttatctcctatctttttatgataatccccaatttggtgacatcataaattcttttatcatctccttacattcaggaacataacrtaagaaaatccatagaaaatcccaaagacaaatgctaacgatttaaaaggaagtacacaaattctattgcatacaggctttaagacaaggaatgcttcctaccctgcacatctgtctagcaggtgcctttccgaataagttttgtcctttaggaatctgctctgagtacctcaaaagacaataaagtgttctctttcatttttttttcttagaacccattttcctcaaggcagaaggatgaagccttctctgtcctgaaaatatggtcaaaacaactttggcttattttaagcaacttct

SEQ ID NO: 200937 - DNA, 601 bp, Human
cagtgacactgtgcaaattctttcccctcttctcttatgcattttttatgcaaaaaaatgcataacacaaaattaaccattttcaagtgttcagttaagtggcattatttacattcacactctcatacaagcatcactaccatccacttctggaacgtttttcatcttgcaaaacggaaactctgtacccatcaaacaataactccctatttctcacccgtgagaaccaacattttattttccatctcgatgaatttgactattataggtaactcatataagtagaatcatatagcatttrtccttttgtgacctggcttatttcacttagcataatgtcttcagtgcttatccatgttgtagcatattgcacaatttctttcctaaggctgaacaatattccattttatgtattacaacatttttttaatccattcatccatcaatggacacttgggttgcttctacctttttgtcattgtgaataatgctgccatgaaaaagggtgtacaactacctctttgagaccctgctttcacttctttggtacatacccagaggtagaattgctggattatatgataatgctatgttagttttt

SEQ ID NO: 200938 - DNA, 601 bp, Human
aaacatttcagaagtttagtaaaatcattatcagaattttattaaaaatcatttcagctttatttcaaatttctcaaagaaagtaaattttaaaaactcaggtgtttttggtgggctttttttctttgcatttaagcctgcattgctattgttattgtacattttcagctgtaagaaattatgaggacttggctaggcatggtggcctgtaacctcagaactttgggaggctaaggtggaagggatgcttgagcccaggagttcaagaccagcctaagcaacatagtgaaactctgtctcyataaaaaatacaaaaaattagccaggtgtggtggcacctatctgtagtcccagctactttggggacagaggcgggaggatcacttgagcctgggaggtcaaggctgcagtgagctatgattgtgccactgcactccagcctgggcaacagagcaagaccctgttcaaattaaaaaatatatatatatgaaatacataaactttaaaaaaattaaaaaaaatcataagaacttactcagtttcctcttatatttatcaaactgcttcctcagtctttctgattccctctgtccctggactt

SEQ ID NO: 200939 - DNA, 601 bp, Human
gtggtgacctttctaaatacaaaccaaaagatgtcattctgctcagaatctttcaatggctcttcattttttatactgaatgactaaataggaaataaatatttggaataactagatttttaatctggctatattggtcttgatcagtggttttcaaattggatccttaaagccccagggctccaaataaatgtcccagagaccaccaagaaggcatttcccatataattctccaaatagaaagtaagctactttcctttttcttttctttttttttgagatggagtttcgctcttgttgygcaggctggagtgcaatggcacgaactcagctcattgcaacctccgcctcctgagttcaagcaattctcctgcctcagcctcccaagtagctgggattacaggcatgcgccaccatgcccggctaattttgtatttttagtagagatggggtttctccatgttggtcaggcagtaagctactttcttaagaattttttgtggggagtacacctccccacaagggaccctgatgggcaactgcaagttacaaaaagtatttttaaaacgtaaaattgaaatctttccttccgtaatttaca

SEQ ID NO: 200940 - DNA, 601 bp, Human
agtaagctactttcctttttcttttctttttttttgagatggagtttcgctcttgttgtgcaggctggagtgcaatggcacgaactcagctcattgcaacctccgcctcctgagttcaagcaattctcctgcctcagcctcccaagtagctgggattacaggcatgcgccaccatgcccggctaattttgtatttttagtagagatggggtttctccatgttggtcaggcagtaagctactttcttaagaattttttgtggggagtacacctccccacaagggaccctgatgggcaactgyaagttacaaaaagtatttttaaaacgtaaaattgaaatctttccttccgtaatttacactcatgttccaaataaattactctttcgtataattgtccctcaaatatctgaagacagaggtaatggctcctgtcttggctgtctatttttaatataaaacatccccagttcctttcataggatatatgtttcagattcatcatcaacttgtttacttgcctatggagacattctagtctcactgttcctctaaaaagaaacataatattcataacagttatctgaccaacctagattgcat

SEQ ID NO: 200941 - DNA, 601 bp, Human
ctttcttaagaattttttgtggggagtacacctccccacaagggaccctgatgggcaactgcaagttacaaaaagtatttttaaaacgtaaaattgaaatctttccttccgtaatttacactcatgttccaaataaattactctttcgtataattgtccctcaaatatctgaagacagaggtaatggctcctgtcttggctgtctatttttaatataaaacatccccagttcctttcataggatatatgtttcagattcatcatcaacttgtttacttgcctatggagacattctagtctcactgttcctctaaaaagaaacataatattcataacagttatctgaccaacctagattgcatttgtaatagtcctagcacagttgaaaactacagttactactatgacaactaagtaacaatgttagttgggaagagctttaaggtcattttggtcaaaagaaagcatgttaagacttatttttagtctttaaaaatatgagggaagcctaaatcgatgcctactttatgtggcaaatcagagagtccggaattcttaatcaaacttcaaaaaacaaaagcgggggggacggagattgaac

SEQ ID NO: 200942 - DNA, 601 bp, Human
taaattactctttcgtataattgtccctcaaatatctgaagacagaggtaatggctcctgtcttggctgtctatttttaatataaaacatccccagttcctttcataggatatatgtttcagattcatcatcaacttgtttacttgcctatggagacattctagtctcactgttcctctaaaaagaaacataatattcataacagttatctgaccaacctagattgcatttgtaatagtcctagcacagttgaaaactacagttactactatgacaactaagtaacaatgttagttgggamgagctttaaggtcattttggtcaaaagaaagcatgttaagacttatttttagtctttaaaaatatgagggaagcctaaatcgatgcctactttatgtggcaaatcagagagtccggaattcttaatcaaacttcaaaaaacaaaagcgggggggacggagattgaactgacaggtaaacgtcctatctcctctttcctttctccctacttttggatctctatgtgtgttatttgacagattggaagcctaggtgaggcggcttaggtgaggttataagagagagtggtaatggtgatatt

SEQ ID NO: 200943 - DNA, 601 bp, Human
ctatggagacattctagtctcactgttcctctaaaaagaaacataatattcataacagttatctgaccaacctagattgcatttgtaatagtcctagcacagttgaaaactacagttactactatgacaactaagtaacaatgttagttgggaagagctttaaggtcattttggtcaaaagaaagcatgttaagacttatttttagtctttaaaaatatgagggaagcctaaatcgatgcctactttatgtggcaaatcagagagtccggaattcttaatcaaacttcaaaaaacaaaagsgggggggacggagattgaactgacaggtaaacgtcctatctcctctttcctttctccctacttttggatctctatgtgtgttatttgacagattggaagcctaggtgaggcggcttaggtgaggttataagagagagtggtaatggtgatatttattcattaaaaaaattctgtctcattgccttaaaataaaatggtttgccatatcaaaacagaggttttattgacttcaccttatgtgttttaaaaaaatttttataagataaaatttaccatcttacttctgggtatatatccgga

SEQ ID NO: 200944 - DNA, 601 bp, Human
ggggggacggagattgaactgacaggtaaacgtcctatctcctctttcctttctccctacttttggatctctatgtgtgttatttgacagattggaagcctaggtgaggcggcttaggtgaggttataagagagagtggtaatggtgatatttattcattaaaaaaattctgtctcattgccttaaaataaaatggtttgccatatcaaaacagaggttttattgacttcaccttatgtgttttaaaaaaatttttataagataaaatttaccatcttacttctgggtatatatccggaaytgaaagccaggtcttgaagagataactgtaaccccatgtctattgcagcattattcataacagctaaaacatggaagcaagccaagtgcccattagcaaaatgtgaggaaggaaattctgacacatgctacaacatggatgaaccttgaggacattatgctatgtgaaataagctagtaacaaaagaacaaaatactgtatgattccacttatgtcaggtatttagagtagtcaacatcatagagacagaaaacagaatggtggttgctagggactaagaggagtgggaaatggggagtc

SEQ ID NO: 200945 - DNA, 601 bp, Human
gtaaacgtcctatctcctctttcctttctccctacttttggatctctatgtgtgttatttgacagattggaagcctaggtgaggcggcttaggtgaggttataagagagagtggtaatggtgatatttattcattaaaaaaattctgtctcattgccttaaaataaaatggtttgccatatcaaaacagaggttttattgacttcaccttatgtgttttaaaaaaatttttataagataaaatttaccatcttacttctgggtatatatccggaactgaaagccaggtcttgaagagatawctgtaaccccatgtctattgcagcattattcataacagctaaaacatggaagcaagccaagtgcccattagcaaaatgtgaggaaggaaattctgacacatgctacaacatggatgaaccttgaggacattatgctatgtgaaataagctagtaacaaaagaacaaaatactgtatgattccacttatgtcaggtatttagagtagtcaacatcatagagacagaaaacagaatggtggttgctagggactaagaggagtgggaaatggggagtcggcgtttaacaggtacagcagttga

SEQ ID NO: 200946 - DNA, 601 bp, Human
cggtatttggttttctaaaagttatgtttaggagtgacatcagaaagatggctgacaagagaggcctggtgctagtccactctcaacaaaaaaagaccgaggcaacagataaatagctaagatttgactggagtgtcagtgggagaaccctggagaataacgagagagtgcagaggcacctgtgctgcttagaagtccagtttggggtggctgtagtgtttcttaaataataccgcagtgaagtttgctgtatcagttaactcttcctttcacaaaatgtttctctgtagcatgagatgcwgtttcgtaacattttacccacagcacagtgtctctcaaaattgtagtcaatcctctcaaactctaccactgctttatcaactgagtttatggaaaattctaagtcctttgttgtcatttcaacaatgttcacagcatcttcacaaggagtagattccatcgcaagaaaccactttctttgctcatccataagaagcaactcttcatctgttcaagtttaatcatgagattgcagcaatgcaggcacatcttcaggctgtacttccaagtctagttctttcgctattaccatcacacttgc

SEQ ID NO: 200947 - DNA, 601 bp, Human
tgaagtttgctgtatcagttaactcttcctttcacaaaatgtttctctgtagcatgagatgcagtttcgtaacattttacccacagcacagtgtctctcaaaattgtagtcaatcctctcaaactctaccactgctttatcaactgagtttatggaaaattctaagtcctttgttgtcatttcaacaatgttcacagcatcttcacaaggagtagattccatcgcaagaaaccactttctttgctcatccataagaagcaactcttcatctgttcaagtttaatcatgagattgcagcaaygcaggcacatcttcaggctgtacttccaagtctagttctttcgctattaccatcacacttgcagttacttcctccactgaagtctttaaccccttaaagtcatccatgagggttggaatggacttcttccaacctcctgttaatgctgatctttttacttcctcctatgaatcacaaatgttcttaataacatgaagaatgatgaatcctttccagaaggttttcaacttacttgatccagatccatcaaagcaatcattatttacggcagatattgccttataaaatgtatttcttaat

SEQ ID NO: 200948 - DNA, 601 bp, Human
catctgttcaagtttaatcatgagattgcagcaatgcaggcacatcttcaggctgtacttccaagtctagttctttcgctattaccatcacacttgcagttacttcctccactgaagtctttaaccccttaaagtcatccatgagggttggaatggacttcttccaacctcctgttaatgctgatctttttacttcctcctatgaatcacaaatgttcttaataacatgaagaatgatgaatcctttccagaaggttttcaacttacttgatccagatccatcaaagcaatcattatttayggcagatattgccttataaaatgtatttcttaataataagacttgaaagtctaaaatactcctggatctatgggctacaaaatggatgttgtgttagcaggcatgaaaacaacattaatttccttgcatatttccatcagaccccttgggtgaccaggtgcattctcactgagcagtaacagtccaaagataatctttttttctcagcagtaggtctcaacagtgggcttaaaatattcagcaaaccatagtgcaaacaaatgtgctgccatccaggcttcattattccatttatagagc

SEQ ID NO: 200949 - DNA, 601 bp, Human
aagtctagttctttcgctattaccatcacacttgcagttacttcctccactgaagtctttaaccccttaaagtcatccatgagggttggaatggacttcttccaacctcctgttaatgctgatctttttacttcctcctatgaatcacaaatgttcttaataacatgaagaatgatgaatcctttccagaaggttttcaacttacttgatccagatccatcaaagcaatcattatttacggcagatattgccttataaaatgtatttcttaataataagacttgaaagtctaaaatactcmtggatctatgggctacaaaatggatgttgtgttagcaggcatgaaaacaacattaatttccttgcatatttccatcagaccccttgggtgaccaggtgcattctcactgagcagtaacagtccaaagataatctttttttctcagcagtaggtctcaacagtgggcttaaaatattcagcaaaccatagtgcaaacaaatgtgctgccatccaggcttcattattccatttatagagcacaggcagagcagaatgagcataatttttaagggccctaggattttcaaaacagtaaatgaa

SEQ ID NO: 200950 - DNA, 601 bp, Human
agcacatagaggccattgcagggttatcaatgggcctaatttcaatattgtgatgtctcagagaaaagggaggcctgaggagagagacagagacaaggtaatggcctgctggtggggcagtcagaacacatactacatttatcaattaaattcgccatcttatataggcgcagtttgttgtaccccaaaacaattacaatagtagcaccaaagaccactgatcacagatcagtgtaacagacataataatgatgaaaaggtttgaaatattgtgaaaagtaccaaactatgacacagaaayacaaagtgagcacataacattggaaaaacagtgccaatagacttgcttgacacaaggttgccacaaaccttcaatctgtaaaacacagaatgtctgtgaagcacaaaaaagcaaattgcaataatgaggtatgcttatgtttaaaaatggttaagatggtgaattttaggttatatgtattttaccacaataaaaaaaatttttttaattaccatcaaaaatgtgccattcagtagcatgaagtattgtgtgaccaatcttcaccttgcaaaatggagactcttgtacccaatgaacaac

SEQ ID NO: 200951 - DNA, 601 bp, Human
ctatgaacatgagtatagaaatacatcttagagatcctgctaattatgtggctttgtgttatttattcttttttaaataagtttttctctatgtgcagatctttagttgcaagtaatcttattttttaatatctatccagaggccttttttgctttctaacgggtgttttgatggttgagcctaatctctgattaaatgaatgattacaatacaatgtaaacatgtgaataatataattattggtaaaagtaatttttatttttaccctatgagtatgttgtatgtatgtatgtatgtatrgatgggtgggtggactgactgatttgattgcctgacagggtctctccttctgtctcccatgctggagtgcagtggcatgatctccgcccactgaaggcttgaccttctgggctcaagcgattttcccatctcagcctcctgagtagctaggactacaggcatgcaccgccacactcggttaatttttgtttactttttgtagagatgaggtcttactatgttgcccaggctggtttcaaactcctggactcaagcaatcctcccattttggcctcccaaagtgctggcatcacaggtgtg

SEQ ID NO: 200952 - DNA, 601 bp, Human
cccagtagagtcagaaagaacctgattttcagaatatacatgtattagtggaaaaatagaaaaagactctcaacacaactgtttatctaaggaccaatcctctaattacagctgttccagctttagatggctagaaaatgtgacaagacatctgggacccaaatggtacccactgtaaagatattgagacattctatgaaatttaagatagtataaaacaccaatatttgtggtaaacctttagaacttagaacactctcatatctcacattcaaagctcatgaaaaagaaactccttagrgacagttcagcatgaaaacagccaaagctgcctttagatttcctgtcgtaacagactttacaagtatgttaaaaatgaacaaaatatatagaagagaaggtgtaatatttcaacgatcaataaatatgctaaaaataaagatatggtgtctatggtgttcatcttcaactttgttccctgaaatcaacaacaaaaatagaaattggttaatttgatgggttacattactgacatttagacaggacacatacattccattaacattttcagcagatttttagtacctttgatttgtctcta

SEQ ID NO: 200953 - DNA, 601 bp, Human
tgttttcatcaagaagtcttaaaatgtgtcacacacataaatacatctgaaaactttaacattcagtattatataataagggttatcaagtttgtcaaggaaagtcagaatcagggaggagagaaaaaatggtttctttagaaactaactgctggaaaagtaagaaactcctaaaccaccattatcaactgcatttgataatgaaaagaaaggtttcactgaagcgtatttctagatagcattctttaaaaagtaaatttagtatttgtaggtgctttggtaagaacaaaacaaaaacaayagaaactacaaaaagcatgcattgtggcactactaatccagtgaagacaacagcactctgtgacctatgttcctccccagatcatcttcctctctccacaccaagccaggaccacattgctttcattaatttttttttttttttttcatccagcactggcttcactgctgaggctctcgttatggtcttgttttctcctcaactgggagataagaaactcttcatcccagaatctttacaaactccccagtgctgtaataaacagtcagggttctcttgatataccactgactcttactt

SEQ ID NO: 200954 - DNA, 601 bp, Human
tgtcacacacataaatacatctgaaaactttaacattcagtattatataataagggttatcaagtttgtcaaggaaagtcagaatcagggaggagagaaaaaatggtttctttagaaactaactgctggaaaagtaagaaactcctaaaccaccattatcaactgcatttgataatgaaaagaaaggtttcactgaagcgtatttctagatagcattctttaaaaagtaaatttagtatttgtaggtgctttggtaagaacaaaacaaaaacaacagaaactacaaaaagcatgcattgtrgcactactaatccagtgaagacaacagcactctgtgacctatgttcctccccagatcatcttcctctctccacaccaagccaggaccacattgctttcattaatttttttttttttttttcatccagcactggcttcactgctgaggctctcgttatggtcttgttttctcctcaactgggagataagaaactcttcatcccagaatctttacaaactccccagtgctgtaataaacagtcagggttctcttgatataccactgactcttactttggacctctatctgagaaaattcacc

SEQ ID NO: 200955 - DNA, 601 bp, Human
ggtttctttagaaactaactgctggaaaagtaagaaactcctaaaccaccattatcaactgcatttgataatgaaaagaaaggtttcactgaagcgtatttctagatagcattctttaaaaagtaaatttagtatttgtaggtgctttggtaagaacaaaacaaaaacaacagaaactacaaaaagcatgcattgtggcactactaatccagtgaagacaacagcactctgtgacctatgttcctccccagatcatcttcctctctccacaccaagccaggaccacattgctttcattaatttttttttttttttttcatccagcactggcttcactgctgaggctctcgttatggtcttgttttctcctcaactgggagataagaaactcttcatcccagaatctttacaaactccccagtgctgtaataaacagtcagggttctcttgatataccactgactcttactttggacctctatctgagaaaattcacccaaaccattattggagtaaattaaaaactaatcttttcctaccagaaactaacatttatagagcacctattctaatatgacctacatattaagagtagcagcat

SEQ ID NO: 200956 - DNA, 601 bp, Human
aaaggttaatataagtaaataatatacaacctaaacataaccggttatttctccacccattcttttttgtttttctgagatagagtcttgctctgtcgcccaggctggagtgctgttgcgtgatctcagctcactgcagcctctgcctcctgggttccagcgattctcctgcctcagcctcctgggtagctgggattacaggtgcatgccaccatgcccagctaatttttgtatttttagtagagacggggtttcaccgtgttggccaggctggtctcgaactcctgaccttaggtgatcmccctgccttggcttcccaaagtgctgggattacaggcgtgagccactgcgcccggcctctccacccattcttaatacaacatggtctccacctacatcgccatccagctgcctctctgttcaatgtgctccagtgtatctccagccttcttaaatactccaggtaagttctaaacacaatactccaggtgagttctggctcctgagagcagagggaagctgtttatttccttgttctaaaaagtggttatctgtcctagctgcacctcagaagcacttgtagagtttttaaattttaaaa

SEQ ID NO: 200957 - DNA, 601 bp, Human
ctgccttggcttcccaaagtgctgggattacaggcgtgagccactgcgcccggcctctccacccattcttaatacaacatggtctccacctacatcgccatccagctgcctctctgttcaatgtgctccagtgtatctccagccttcttaaatactccaggtaagttctaaacacaatactccaggtgagttctggctcctgagagcagagggaagctgtttatttccttgttctaaaaagtggttatctgtcctagctgcacctcagaagcacttgtagagtttttaaattttaaaaaaygtattttaaaagcagagatgcccaagccctgctctagtcttcagaccagcatctctgaagagcgactgttacaatacatacttgtgaggctggttatttggacccaaaagcagggtttatcttgtaaatcaagcccactgctccagcctgtggtgatcttttaggatcctcgttctatcctataacatatttttattttgttccacttcatgttatttgcaattctgatggaccttcaccttatagcttcatccaagtttctatgaaaaattttgagctagccagggctggaggccgagg

SEQ ID NO: 200958 - DNA, 601 bp, Human
ctagagagctgaacaccacatttctcagaattccttgcaactagagttctgggtaagtgcactctttcgcaactggggtggtgggggcggtggggggaagcaaacagaagctatatgcctgctagtttagttatttccttcttacaagccctgtcatagaggcttgattatttacagcagcattctagcatctagtcaccagtttcacaggtactgaggagtggttgcagtaatatttagtagctttctaatccctaaatagcagtgagggttgatttcaatctgtattactgaactcagyggcgccagcggcagcctctggattgctattcctcgttgtggcagtagtagttgttccttatatgctcacttttgtggtgttgtgggagtcactcttgaagcctatgctacacagccttctcctctaggctttccattgattttcttaacttctacatctttaatatggcttggctctatgcccccacctaaatctcacgttgaattttaattcccagtgctggaggggggactggtgggagatgattggatcacgggggtagtttctaacggtttagcaccatccccctagtgctgtctc

SEQ ID NO: 200959 - DNA, 601 bp, Human
gtctcgtggctgagttctcacaggatctggttgtttaaaagtgtatagccccaccccctttgctctttctcccgttcagccatgtaggacgtgccagcttccccgtccccttccaccatgattgcaggtttcctgaggcctccctagccatgcttcctgtacagcctgcagaaccataagcaaattataccccttttctttatatattacccagtctcacatagttctttatagcaatatgagaacacattaatacaatctctgacttaaattgctttgtgtgtggaatacctggagtagwttctgtttcctccaataaactctcactgatataagcacatttgagtataactgttgcactctcataacaggaccaccagctaggtcacactacatagtgtctacaagggtatcatgaaagaccttgtcaaatactttcctaatatcctaagatacaatattcaaactctgcattttctctgaccttgaagtttagcaatgctgtcaaaaaaggaaattatattattctgatacgatttcttctcagtaatctatgctgacttataacgatcctgatctttcctaaaggactcttaaatgt

SEQ ID NO: 200960 - DNA, 601 bp, Human
ataccaactaatttaagaagttttaaagatttagatcacgagaaaaacaaaactacaataattatatggtttcagaaaaagtaagtcttccctcaataacttcttcacatactttactactgctatactacaatatgacaatccctaggggttatactaacatcacttgattagaattttggaaacactgaagtctcacattacagaatgatgtctaacttgtaaaaacaaaaaacacagaaagttggctcatgggatttaaaatttgctgaggtccataaaacaactgcagctataaaarccacttatctgttcaacttcaaaattggttttcactaaaatctctgtgacaaaaagtcatacctatacaatcagttataacaaaattataacatgtattgatttttgtggatgtcaaatctaaaagtcactatacaaaatgtcagaaatctgtggtataaagtatgatgtcggaaacatcatcattagtctctcttccttgaaatataatacactgcaatctaaatgaattagattctataaagactcatttttcttaactattatatatatgctgatgttcaactatatgactgcatga

SEQ ID NO: 200961 - DNA, 601 bp, Human
actgcagcacccccagcactgtgcctcacatatgataagcagcagtaaatattcatgcaactgaatcttctgtatgagcatccctgtctcttaatccttctttctagtgcttcttattttcccaccttatttcttcccatagctcgcactgctctttgtggtttaactgataatttggacaacataaaataatagtctgttgaatttactggaagataattttaggttcacttttttaattgggaaagtaaatgttaggaacactatctttttctctctaaaatactttgcaaattaagcygtgggttagcaaccttcaacagaaaaaagttccataactctaagttgaagatgtgttgttttctgctatattaaaatacaattttaaaaaggtgacttgtgccatactcttttttactgttacataaatctaagaaacaaaattttccacagttggctataaaaagtaacacagaactagcctggttcctataaaagtatcctttcgaattagaaaactaatatttaatgtaaaaaagccacatacttttcatagttccatcttcttcttcctcatcctcactgtttatcaccatggtcc

SEQ ID NO: 200962 - DNA, 601 bp, Human
cgaccactagaatgtaagtctgatgaagacaagagactgttttaacctctgaatcctcattattaaaacacctagcatacagtaggtacttgataaatatttatttaatgaataaatcaatttatattttcacttattaatcatccaacaagcatttattgtacatcaagtagtacaccagacattggagatgaataagatagtttaattccatttcagtttttagggagtttgagatctaagggaaatctactaccatgtgaacaataagttacaggacaatctattaagtgctacaagaaaagtgttgacagtaaaatgggaataccaagagtagagcctctaactctgcctttagaaagtgaagaaggtctcacagaggaggctgaacttgagtcagctcttaaaagatgagtagactatatatttaacatacaacagatacatttgggtggagtgttttacaactttttacattagaactacactcagacacattccttctcagctcagacaccccaagattgaattaggtgtcatgcctctgtattcccatagtactctgtgcttatgctgattttacagtactgtaattgtctat

SEQ ID NO: 200963 - DNA, 601 bp, Human
tagtttaattccatttcagtttttagggagtttgagatctaagggaaatctactaccatgtgaacaataagttacaggacaatctattaagtgctacaagaaaagtgttgacagtaaaatgggaataccaagagtagagcctctaactctgcctttagaaagtgaagaaggtctcacagaggaggctgaacttgagtcagctcttaaaagatgagtagactatatatttaacatacaacagatacatttgggtggagtgttttacaactttttacattagaactacactcagacacattcyttctcagctcagacaccccaagattgaattaggtgtcatgcctctgtattcccatagtactctgtgcttatgctgattttacagtactgtaattgtctattcacttaccttgtctaaatcccccattagactctcaaatctataagggcagtaaccacatcttgtttacagttgtattcctgatgtctggtaaaaagcaatgttcttattatgtaatttattgaatgaatgttaaatgcctcattatgaggtaatgccaaaacacagaatgaaggacaattttatgaggttctagtaaca

SEQ ID NO: 200964 - DNA, 601 bp, Human
ccatcatgtgccaggaatgcaaaacacagtactgatgataatccagtttatgaatcataaaatccacatggaatacaaatatttgaaaacattattaggaaatcctactccactgctaagacatgcttatgctaaaacagcctgagaaataatcagagattttgcattatctactagtagatatttgtaatatctactaccttaaagcattttctaaatactcagtaattgactgaattaaggataaaaagtatttatcacttgtgagactaatttgtcattagtgtcacaaaagacaaayactttagaatataaaattgtttctatattctcaaaatgtttagaatataaaaatagaatatttctcagttaggatacctgtttagtgagacagttagactactccttaaacaggtgtcctaaacggaaaatattctaattttatttttcttcttaaaatgacattaaacacttctttattgcacatgcaatcacataacagcatagtatcagtatcagagcagtgatcttaatggctttcattcaactggacaattctaacgagtatgcattctgctatagcatgaaaaaaatattcttc

SEQ ID NO: 200965 - DNA, 601 bp, Human
tttctaggcagtcaaatataatggatcaacaataactccaatattcagaacctaaagagatcaaactgaatctaaagagaaagttgagagagattttaatttgaataaaataggtaacaccagttatttgtaatcaaaaaatgacttactatactttgtcacttgaccatatgatcaaggaaatgaaatctaattattcattttcccatcaagtaagaaatcaacaaggcatgtccaatgcaactgcaagatgagcacaaaactggggaaaactagggtaagaatctttcacttctttccycatgcataactgaattcgggggctggtgactgcttgatgctaacatgttaacctaggtcgataaatatattttaatcactgagttagaaaggcaaaaatcaaagggtactatcgtacatttgcttgtatgtctcgaatcatgtaagattcctactaaactaaaaacactctttcctatagcaaggtgaaactactgatgtgaccaacagagcattaccttgaaactgtacttccaactctggtaaaggatagcagttatcccattgtccttgttattaatacacaaggttgtacctgttt

SEQ ID NO: 200966 - DNA, 601 bp, Human
tcaaatataatggatcaacaataactccaatattcagaacctaaagagatcaaactgaatctaaagagaaagttgagagagattttaatttgaataaaataggtaacaccagttatttgtaatcaaaaaatgacttactatactttgtcacttgaccatatgatcaaggaaatgaaatctaattattcattttcccatcaagtaagaaatcaacaaggcatgtccaatgcaactgcaagatgagcacaaaactggggaaaactagggtaagaatctttcacttctttccccatgcataackgaattcgggggctggtgactgcttgatgctaacatgttaacctaggtcgataaatatattttaatcactgagttagaaaggcaaaaatcaaagggtactatcgtacatttgcttgtatgtctcgaatcatgtaagattcctactaaactaaaaacactctttcctatagcaaggtgaaactactgatgtgaccaacagagcattaccttgaaactgtacttccaactctggtaaaggatagcagttatcccattgtccttgttattaatacacaaggttgtacctgtttgttgtttctgt

SEQ ID NO: 200967 - DNA, 601 bp, Human
tgctaacatgttaacctaggtcgataaatatattttaatcactgagttagaaaggcaaaaatcaaagggtactatcgtacatttgcttgtatgtctcgaatcatgtaagattcctactaaactaaaaacactctttcctatagcaaggtgaaactactgatgtgaccaacagagcattaccttgaaactgtacttccaactctggtaaaggatagcagttatcccattgtccttgttattaatacacaaggttgtacctgtttgttgtttctgtgttccaagtgaaattgcccacagtagrtcaactggtaactctgatccaactgagctaaaaattactgagaaaacatcaaaaatagtctctttcaaatagccgcccttaagtgccacttcaatgtctgacgggctgaaaaaagtaacaaattggtattcacccattaaaaactaagatttacagtatctgaaaatctataaaaagaattaattgtcttctcactgctgtaagtaggtggtctttccctttcactacgaaatcagcttaatagcttatacagctgctgtctttgacatacctgtctttagcaaacagaaacttcatgga

SEQ ID NO: 200968 - DNA, 601 bp, Human
ctcccatctccacaaaaaatgaaaaaaaaaaaaaaaaaaaaaaaaaaaagtcaggcctggtggtgcatgcctgtagtcccagctacttgggaggttgaggcaggaggatcgcttcagcccaaaagttcaagacagtgagctatgtttgtgccactgaactgtagcttgggtgaaagagagagacccagtctcaaaagcaacaacaacaacaataacaaaaagagtgaacccaatgtatgcaaaattaaaaaaaaaaatttaggaggtcaggggatcccagggtgaaatgtagaatgtggcaaaaaaaaaaaaaagtaactgtattaaaaatatattgaaacaaattcactgaaggaggtgagaagaaaaggtactaacctaagtaactttggagtaagtgaactgtgaattctgttagactaaagacaaaagaaatgatacataagcagtgtaactgataatgttgttttccatgttttccacatgggttaagaattctgaaaccactatacatgtatactggagttgagaaacttagtaaatgaatgataggagccaggtttctcaccattggagttgtaggttataaacaagcaagagg

SEQ ID NO: 200969 - DNA, 601 bp, Human
tccatcctcaagaaagtggagaataaccccccacttcttaaatgtgagctgtgtactgtgacttccttccaaagagtacagtatgaaaagaaagaaagaataattttactgtaaagaaacatgacatgctacctcagtcatgtgatcctggttaacatcaacagtggtaagtcatgttgacagaataatttactcttgatgtgatgagacttatatttatctctgggtcttttcaaaaaccaataagcctcgtctcatcattagaaaaaaaaatcccaattgaaggacattctacaaaatrtctaaccattattacccaaaactctcaaggtcaccaaaaacaaggacattccgagaggctgcgacatcatgaaccctttctgtgcctggcttatatcatttaacgtcctccaggtaaatacgtgcttgccacaaatgacaaaatttcattcatttttatggtatatacataccatgtgaaattagccaagcacagaaagactaaagaagctgatctcatggaagtagagagtagaaatggtggtttccagaggtaggggaggcttgtagaggctaggggtggtagggagagattggtcaa

SEQ ID NO: 200970 - DNA, 601 bp, Human
ataaatacaaaattacagttaggaggaataagttctggtgttctgttgcatagtacagtgactgtggtcaacaatactgtatatttcaaaatggcagaagattttgaatgttcttaccacaaagaaatgataaatgcatgaggtgatggaaatgctaaatattctgatttgatttttacacaatgtatacatgtatcaaaatatcacactttaccctgtaaatatgtataatcgttatatatcaattttttttaaaaaagagaagcctaaggagacatgatgactaaatgtaatatggtawcttgatgggtcctaaaacacaaaaagaacattaggtaaaaactaagtaaatctgaaaagaataggcactttagtttcaaatctgtattaatattggttcattatttagacaaatgtatcatacgaatataagatattaataacagggaagactgaatgtgggtggtatatggaaactctctaaactatttttctatttcttctataaacctaaaactattcaaaaataaaaagttaacttaaaaaattgagaaaatcctttgctttttaatttgagcaaatatttattatctgttttatc

SEQ ID NO: 200971 - DNA, 601 bp, Human
agaagctctaagacatagtctaagaccaattagacttcttttctttgagtcattaataagttaatatgaagtcaaataacacctttcttcagataaaagtaaaggacctgatacatgcataaaagtgaaaagatttcattcaagcttaacatcaaaaagtatcccattttttgctcaacatttcacttaaaattcttctacatccatttaactccttgtattttacttaacattgtgatccttaagaaacgtctgagctccagtgacaagcaattcttctaaactccttatcagtcttttmaagtgctttaaaaatagcatgtcaatgctacattctatgccttatcttataaattcaattaacatcattctgctttgaaaatcatcatccaatgtaccacatgtagaatatttgctttgctgttttacttaaaaacaagtactcttttactgtataaatatttaaaaactcattcaagtacctgtacaatattcaataagccataccagcaaacttacaaattagtattttaaaaatcatcaactaagttcaagaaatacataagaatgaatactgcttgttgtgtaactaccaaattac

SEQ ID NO: 200972 - DNA, 601 bp, Human
gaaacgtctgagctccagtgacaagcaattcttctaaactccttatcagtcttttaaagtgctttaaaaatagcatgtcaatgctacattctatgccttatcttataaattcaattaacatcattctgctttgaaaatcatcatccaatgtaccacatgtagaatatttgctttgctgttttacttaaaaacaagtactcttttactgtataaatatttaaaaactcattcaagtacctgtacaatattcaataagccataccagcaaacttacaaattagtattttaaaaatcatcaacyaagttcaagaaatacataagaatgaatactgcttgttgtgtaactaccaaattaccaaactgcatgcttacattttgaatactagagttaaactagtactaactgcacaaatcctgtatgcctgctttttatatacacaacctagattaaactttgtgttcatttagtcaaaaatgaatgtaaattttataaaaaatattttacttttatgaaaaagagtatcacttcaatgaaataaattgtcctactgaacatcaagagatgtgtagtctatgataaattagctgatttaaaactgta

SEQ ID NO: 200973 - DNA, 601 bp, Human
ccccagagaataaatgtttattcaggaaaaaaaaatcataaaaacctgacataatttttaagtgctcataatatttcccctcaccttgaatatggacaggaccaagtaacatatacctaaaacgacttggtatcattggatttgaaactaagcagtgggcagaagctagaagcactttgaagacagttttagtaagagcctgaagagtcattaaaaaactgtcagaagcctgacagcctttaagaaagtttcaggaaggtaagggaaatattagaaagctggagaaaaggagattcttatrtggtggcagaaaatttagaaactgttgtattagtccattctcacactgctatgaaggaatacctgggtaatttataaagaaaagaggtttaattgattcacagttccacatggctggggaggcctcagaaaatttacaatcatggcagaaagcacctcttcacagggcagcaggagagagaactgctgagcaaagtggggaaagccccttataaaaccatcagatctcctgagaactcattcactatcacaagaacggggtggttgttccctgattcagttacctcccaccaggtccctc

SEQ ID NO: 200974 - DNA, 601 bp, Human
aaactatcagaatagacctaggttttgaatttctttttattgagaaggagggacatgagagaaagtagagtgaaaggttataattttggatagataacctaaatttggggcagcaatcagtttcagtaattttcatagttacatgtcagtagatagcatcaggtaaaagtgacctgactgagtgagtgagttatttgtttatttgtttgtttgagacaggggcttgctctgttgcccagatgcgagcacaatggtgcaatcatggctcactatagtcttgacctcctgggctcaagtgatsctcccacctcagccttcctaagtgctgggaatagaggcatgagccactgcacccagccctgagttattttaataaacttcaagagaacacaaaaatatatttaaagacaaaaaaaattgtgctgaagaagaaatagatacttgaaagagggtttaaaatggcaaacatatcatttgggacaactataagaaagaactttttcagagtacagaaatactaaaatcaattgtaaagaaccaataaattattttagaacagttatagattaatcttaccaaacaaattaagtcctattaacat

SEQ ID NO: 200975 - DNA, 601 bp, Human
ggggtgggacaaggtcatgggaaatagcagcccaggaagcatcagcactgtcatcctcactgtggtttggatgaagtaccttttcaataagctcttctgtatctcttgataaacagttacatggtaatgaaacttttcaaggttatttccttgagaatacagctaaggcagcttcttgcgtctttccaagcagaatattctgatattattattaatctttatcttgtcttgttctgaaaacaatttgagctatcttatgaaattcatagtctatattagtttaagaagtagatgagaaaayaagctcaggaaaataaacctatgggtaagagagagagtgtatgtgtgtgtgtgtgtgtgtgtgtgtgtgtaagagagacagagagaagaaagagagagaaggtaacttagagattaataaatacttcttttaaaaataggagttatttgtattttagtttttaattcaacctaaaccttctctctgtagggtttcacaattttaaaaaagtatgtcttttaatttaacaaaatgcaaacatgtatctctgctagtggagaaggtagtgaaaatctttttttttttaaagtttttttttct

SEQ ID NO: 200976 - DNA, 601 bp, Human
tctgccccttctcagatctccagctgcatactgggagaaccactgctctcttcaaagctgtcagacagggacatttaagtctgcagaggttactgctgtctttttgtttgtctgtgccctgcccccagaggtggagcctacagatgcaggcaggccttcttgagctgtggtgggctccacccagttcgagcttcctggctgctttgtctacttaagcaagcctgggcaatggcgggcgcccctcccccagcctagctgctgccttgcagtttgatctcagactgctgtgctagcaatcagygagactccgtgggcataggaccctctgagccaggtgcgggatataatctcgtggtgcgccattttttaagcccgtcggaaaagtgcagtattagggtgggagtggcctgattttccaggtgccgtccgtcactcctttctttgactaggaaagggaaccccctgaccccttgcacttcccgagtgaggcaatgcctcgccctgcttcggctcgcacacggtgcacgcacccactgacctgcgcccactgtctggcactccctagtgagatgaaccgggtacctcagatggaaatgcagaa

SEQ ID NO: 200977 - DNA, 601 bp, Human
tcacatcagaagttcagcacttgtagaacttagtatcagccataaaagagtctgatttaactgatctggggtgacgacaaggcacaatattttcttacatctcccaagcaattccaatatgtgagtaacatggagaaccactattctaaaatataaaatacaagacaagtgctatcactgtttaatatctcaacttcagaactttccatattttaatattgtactctgattagttataaactcattctaaatgccctggataacatgaaaactacctgaaggcaagacagtgtcttctatygtctgaatgtttgtgtctcttgcaaaattcttatgttcaaagcaaatcaccaacgtgatggtattagaaggtggggcctttgggaggcgattaggtcataagggctccacctttgtgaatggaattaatgccctcataaacaagtccccacagaaccatctaatcccttctgccaaataaggacacatagaaggtgccttctatgaggaacaagccctaactagacaccaaatctgctagcacctagatcttgaacttccaagcctccagaactgtgagcaatacatatcttttgtacat

SEQ ID NO: 200978 - DNA, 601 bp, Human
accacaacccttccgcaagcattatgctcatactacatcactgattacctaaattcacaccctgacaaagaagagggctctgccaataacaaagcatattaagttatatatttcagaataacggaataagagtgaaactttactaagaatagtgaataaaataatattttaaatgttaaataagttttgagataaggccttttaatgtttaattttagaataattctaggcattttaacagcataataactcctcaaaaaaagaagtgtatggtttggatgtcactttaagccatgaaatwtttatctcagctatttaaataaagtatctcatctgaaatatggtacaatgtatactttacactgcattagctataacaataaataatggatcataaacatttacatataaaaagaacaaaatgaaaggtaagactatgcggaaaaaatactagaacaaccactagaagtttacaaaaaataagaagacagtacaaaaacatcaataaaatagattgaaaaataaagctgatgaactaattgccttgaatgtatcagaaaacttaagggaagacaaaatattagaaatcagtggccaggca

SEQ ID NO: 200979 - DNA, 601 bp, Human
tggtacaatgtatactttacactgcattagctataacaataaataatggatcataaacatttacatataaaaagaacaaaatgaaaggtaagactatgcggaaaaaatactagaacaaccactagaagtttacaaaaaataagaagacagtacaaaaacatcaataaaatagattgaaaaataaagctgatgaactaattgccttgaatgtatcagaaaacttaagggaagacaaaatattagaaatcagtggccaggcatggtggttccgcctgtaatcccagcactttgggaggctgasgcgggtggatcacgaggtcaggagatcgagaccatcctggctaacacagtgaaaccccgtctctactaaaaatacaaaaaattaactgggcgtggtggcgggcacctgtagtcccagctactcaggaggctgaggcaggagaatggcatgaatctgggaggtggagcttgcagtgagccgagatcagagatcgcaccaccgcactccagcctgggtgacacagtgagactccgtctcaaaaaaaaaaaaaaagaaataattgacatatatcagataaactaattgcatgtattatcaaaa

SEQ ID NO: 200980 - DNA, 601 bp, Human
ccctggatcttctttgtcccttatatattccacacttggggccagataagccaacaaccagaaaaagctaacaggtacaaacaaaaaagctccaacaaaaccctgcccaaaagatgaagagaagaacaccatggaaagaagaaaactttaggcaaatttcactctatgtcagccaaacaccacagaaaaaactgtagtcccactctaaccatgtcagaaaggcttagtggacagcctaaagttctatcctcatgagactataacaaggtcccacaatactcctgacatggtgagaaaagamcaagtagggagccaagaatttcacccctctggaaagtaaaaggacagccccccctagcagtgtcagtagacagcaagtagaacctgtacttcctctccaaactggcagcaatgaggtgatcctcccactacccactgaggaggactagaaaaaagttaaattaagactttcactaaccagtggaaattaggtaagcaccaatacaatagagactacacacggagagctagaatcaccactctgactcagcaataatgaggagccactcctgctacttgagtagggcaacagagactgaaa

SEQ ID NO: 200981 - DNA, 601 bp, Human
ttgagctcaggaggtcgcggctgcagtgagctgtgatcacaccatgacattccagactgggagacagagcaagaccctgcctcaaacaaaaacaaaaacccaaaggccatgtgagaacacacagagaaggcagccatctgcaagccagagggagacctcagaagaaaccagacctgccaacaccttgatcttggaagtccagactccagaactgtaagaaaataaactgttgttgtttaaatcacccagtctttagcattttgttatagcagcaggaacagactaatacattaagttagayggagggacagaaacagtgaactgctaatagtctccagtttttctttggaccagaaagcaagtctgacaaaaccaaggagagatggggtaaagaaattttgcaacagacccagaagagaatgaggtggtaggcgtaggggaacatgtgaaaggattgccaactgtccatttcagattagaaatcaatcttttgggggcatcagtcttcacagttacataattgcagttaagcagcctggttacgaggaacacagcaaaatgggaaaggtaaaaacctttgaggttttttaagtctgagtga

SEQ ID NO: 200982 - DNA, 601 bp, Human
gaaactgcagaattttggtaagtgattctagctccacactgctttctgtatcctcagttccaggtgcaatgcttagtatacaaaagataatgtttgttgagtaaaacaatttaagagtacagaatgtagagagaaaagattgagaagagagaaaaaaattctgtccccacttcatacctggaaaaacattccatgccacctctaatggctatgtggcttggactcaagtcttaagagtcatcataggccaggcgcagtggctcatgcttgtaatctcaacactttgggaggccaagcccarcagatcacttgaactcaggggttcaagaccagcctggccaacatggtaaaaccccgtctctactaaaaatataaaaattagccgggcacagcagtacatgcctataatcccagcactttgggagactgagacaggtgtatcacttgaggtcaggagttcaagatcagcctggccaacatggtgaaaccctgtctctactaaaaacataaaaattagccaagcgtggtggcatgtgcctgtaatcccagctacttgggaggctgagacaggaaaatcgcttgaacccaggaggcagaggtt

SEQ ID NO: 200983 - DNA, 601 bp, Human
ggcatggtggctcacacctgtaatcccagcactttggaaggcagaggtgggaggatcacttgaggccaagagttagaaactagcctgggcaaaatagcgcaaccctatctctacaaaagtaaaattttaaaaatcagccagtcctagtggtatgtgcctatgttcccagctactcaggaggctgaggcagaagaacagcttgaggccaggagttcaagacagcagtgagctatgatcacaccactgcactctatcccaggcaatagaggaatatcctgtctccactcccctccacactccaaaaaaaaaaaaaaaaaaaaaaggaatgtgcctataaatggaagacagtgacgaaggtaaaggaataaagtagacgaaggcaacaggtttggaaaacattaaatcatcttgtttggcaggaaaaattgtctatatagggggatgttgagagaagcctggaaacctggatgggacagcaagagtaaaggccaagtgaggaatttgtacagtgatagttttttagggtaacttgatggatttttagacacagattataccaattctcttttcccccaataagagatttgtgactttggctaaa

SEQ ID NO: 200984 - DNA, 601 bp, Human
gatgaaaaaacagtgaaaacaacttggagatattggatttgaattatctcaaaatagtaaagaaaattatataagcagattactagaaatatgtctagaattcaagacagagataaaagctggaggaaagccagggaatggagacagcagtgttctctactgctgtcttaaccctttctttcagagccacatataaaagcagttcactggcacctctgcttcctgggtccaagtgattctcccacctcagcctcccaagtagctgggactacaggcatgcgtttttatactattttgagakaattcaaatgcaatatccccaggttattttcactgttttttcattctcccaaaggaaaactgtttgtctcctaaatcaaggagcacgtgagcctgtaaagttccatagcagagaggaaataagtgatgggtaggagaaaaaaaaacaagaagaaagaggcatacccttctataatactacagccagaaaagggtaaaatgaggccccaaagttcaggcatatgtatatggccatttaactaggactttttaagcaataagcatgctgtgcttaggctgtctcagcactattgttaaatgc

SEQ ID NO: 200985 - DNA, 601 bp, Human
agagaattcaaatgcaatatccccaggttattttcactgttttttcattctcccaaaggaaaactgtttgtctcctaaatcaaggagcacgtgagcctgtaaagttccatagcagagaggaaataagtgatgggtaggagaaaaaaaaacaagaagaaagaggcatacccttctataatactacagccagaaaagggtaaaatgaggccccaaagttcaggcatatgtatatggccatttaactaggactttttaagcaataagcatgctgtgcttaggctgtctcagcactattgttaartgctttaattatgtaacttttgatacattcatgttatcatatgttgtaattattgttgttactattacattttctctatatagcacttattatgtatggggcaatgtactaagtagctttacaaaaattatttcttttaatcctcaccaaaaccctatgaggaagtatttctccattttatatatgagaaaactgagggatagaaaggttaaataacttgccctcaaatactcagcaaataaaggacagagttgaaaatggaacccaggcagtctagctccaaagtccatgatcttaatc

SEQ ID NO: 200986 - DNA, 601 bp, Human
taacttgtatacactttctaggttaaccgtgggcctcaataatccctaccattccaatacacaaatgtcacaagttctcattcatatgtgagagctcaaaccagtggatctcatgacatatggagtacacttgccatcaccagaggccaggaaggggagcggggagggaggagtgaaatggagggaaaagggaaataaatgtatttattggcactgagctgtacacttaacaatggtaaagatggttaatttttaaaatattttcaataataatattaataattatccttaccatccttaccttattcacatgaagacattagttaccatttattaagtgcctccagcaggagaggcactgtgtacaccctttatataacattatttctaaggcttaaacctttagaagattagtatttttattacccagtttttcacatgtgaagactgagagtgggagagattgtataatttgcccaaggttgtacaccatttggcctggaatgtaaaagaaatccatacgaacacaaagtcaaggatcttttcactctacctgatagctgcccactcccataaagaatctaatattgagggatattaa

SEQ ID NO: 200987 - DNA, 601 bp, Human
tttctctacaactccaggtgaccagcaatgacaacctaatatgtatcactccataccttcttctccatccttaaataaccacgtacaaacatatgtagagatttaaaattctattttgtttctttgggaatgaagttgtccccatatatgctccttcacatcttatttttctcatctcatagcaaacagtggaatataactacattaattggtatacacagaactccattctttttaatggccgcatgttacaaggccaaaatgtatcaaatgtattcaacttttcccaccttgtttccasttttttaccactaataaaaatactgcaaaaagatccttgctttgaaaaatgcatatatccttacatatttatgcttttatttttatgagataaattctaggggtaaaactgccaaaactgctttccaagaaaagaagtaaatgtcacatttctaccacaaatgccttttgctctaatttgccaccaatattgagtggagccataacatttttaattttggatatatgatgatatctcagccaggcacagtggctcaagcctgtaatccctgtacttcgggaagccaaggcagatgaatca

SEQ ID NO: 200988 - DNA, 601 bp, Human
ccacagcactccagcctgggtgacagagcaagactccgtctcaaaaaaaaaaaaaaaattagcccgggcatggtggcgggcacctgtaatcccagctacttgggaggctgaggaaggaaaatcacttgaagccaggaggcagatgttgcagtgagccaagattgtgcactgcactccagcctgggcaacaagagcaagactctgtctcaaaaaaaaaaaaaaaaactcaatgttactttaatctgcatatcctaaagtactattaatcatcttcctatgtgtcattagtctattgggattygcatttctgtcaactattcatctctctccctgttttttatactggattgtcttttgacactaatttgtagttttttttaatatcgtagatatcaaccatttatctgtaatttgaagtataaatatttttcccaacctaccgcttatctattgagtttgctgccaatgagatcccacatataagttacaaaaaaaatcattatatgattagatttatttttctttcatagctcctgcatttcctatgttggttagaaacttctcccaagtttctaattcatgcatatagtccagaattcat

SEQ ID NO: 200989 - DNA, 601 bp, Human
ccaagtaggggcagactgacacctcacacggccgggtactcctctgagacaaaacttccagaggaacgatcagacagcagcattcgcggtcacgaaaatctgctgttctgcagccaccgctgctggtacccaggcaaaccgagtctggagtggacctctagcaaactccaacacacctgcagctgagggtcctgtctgtaggaaggaaaactaacaaacagaaaggacatccacaccaaaaacccatctctacatcaccatcatcaaagaccaaaagtagataaaaccacaaagatggggraaaacagagcagaaaaactggaaactctaaaaagcagagtgcctatcctcctccaaaggaatgcagctcctcaccagcaacggaacaaagctggacggagaatgactttgacgagttgagagaagaaggcttcagacgatcaaactactctgagctacaggaggaaattcaaaccaaaggcaaagaagttgaaaactttcaaaaaaatttagacgaatgtataactagaataaccaatatagagaagtgcttaaaggagctgatggagctgaaagccaaggctcgagaactacgtgaaga

SEQ ID NO: 200990 - DNA, 601 bp, Human
acctcacacggccgggtactcctctgagacaaaacttccagaggaacgatcagacagcagcattcgcggtcacgaaaatctgctgttctgcagccaccgctgctggtacccaggcaaaccgagtctggagtggacctctagcaaactccaacacacctgcagctgagggtcctgtctgtaggaaggaaaactaacaaacagaaaggacatccacaccaaaaacccatctctacatcaccatcatcaaagaccaaaagtagataaaaccacaaagatggggaaaaacagagcagaaaaactrgaaactctaaaaagcagagtgcctatcctcctccaaaggaatgcagctcctcaccagcaacggaacaaagctggacggagaatgactttgacgagttgagagaagaaggcttcagacgatcaaactactctgagctacaggaggaaattcaaaccaaaggcaaagaagttgaaaactttcaaaaaaatttagacgaatgtataactagaataaccaatatagagaagtgcttaaaggagctgatggagctgaaagccaaggctcgagaactacgtgaagaatgcagaagcctcaggagct

SEQ ID NO: 200991 - DNA, 601 bp, Human
ccccatgaatgtgatatagcagctctctccatatcaattctgacaaacactatcaactttatttcttaaaactgtcccttagccatattcattcacccctctcccaccaatgttgtaggattccaagccaagactttctgctttgaagccctttaccaatgcaatcagtacccaacatacaactttccatccagtatttgtcagtcaagatatcacattaggttttcccttccctcttctcttcactttcccatcatcactgtagaagcctctgctacctgggacttcctctccctcctcraaaatgaagaagaaattaagacattcccagataaacaaaaactgagagaattcactgctagcagacctgccctgcaaaaaacaaaaaggaagttcttcaggtagaaatgaaaggacactagatactaacttaaatccacacaatgaaatcaagagtacagcaaaggtaactacagaggtaaatgtaaaagacagtataaatgtatttttttcttttctttgtaactctttagagcactcctaccataagtataaattacaatttttaaaatgtcacgctacaattcaataggtaaatact

SEQ ID NO: 200992 - DNA, 601 bp, Human
ttaaaatgtcacgctacaattcaataggtaaatactgaacctgttttaagaagtacgttttatatttcacttctagaatagagataactaaaggaaatacagcctctttgaaaataaggaaatgcttcaaaacaaatctgtggtagatgaactatccctcacatgtcataggcatatagtactcttataacttgattatttagctcaatgaagttttaaaatactaaccacatcttattttacctcttttatatctctgggacctgtccctttttctctatcaccgcagctaataccttattccagggtatcatcatttctcccctggattattggcagcctcctaatgggtattcctaatattagtcctgctccactttaatctgtttcctatactgatgccattagtgacataacaacaacaacaaaaatcagatcccaccattctgctcaaaattttcaagtggcctcccataatcttcggggaggaaaaatttaaattcccaaataatatacaggtcaggacatgaccactacctctgtctccagtattagaatcaccacatacataaataatctacacccacattctctgctacag

SEQ ID NO: 200993 - DNA, 601 bp, Human
taccacacatctacttttatacatgcttaccttctctgattagaaaaaccttactttgtctacccccatctctacttctttagtcttcaggactcagtgcctatacctaccacccaccctaactcccaataatgctgagttatatcatctcatagattctagtcacaattaccacagtacttaccaaaatgtactataaacacctgcttgctatgtatttatcccacagactgtaagcttcttaagcataaagattgtttccttactcctattttttgtccctagtatacgcaaaaaatgyctgccatggagtaagtgtttaatcaatgtttgaaaaaaatgaatgaaaggatgaagcaggttgtacattgagagacccatggagaagctgttcaatttttactatctataacaaagacaaacatcaaaattaataatctgataaaactgaaataccaaaattaatctttactttgtaatcagtaaaaataagtaaatcgatatactaatgtaattcttaatttttgtagttcattcttcaaaatattttattcaagcaagtgggatccagcaaaaaaatggagaccctccccaaaacttt

SEQ ID NO: 200994 - DNA, 601 bp, Human
tataaaagttaatcaatgcttaaaaatacattagagtattagacactttctcagttgtttaatacagtttcagtgacaaaatacacttacttttgttaaaagctttaattaagaaatgaacatataagaaatttttaaataggtaatattgcagattggttatgttcttcttaataaaactgtttaagattctttcagaatggattaaatacttacccagtgaggattctagatacaggtaagatgaggtgtacattcttcagtattattaatttaaacagaattaatttctctttgtatyagttttgacaggtgaaaacttcttaaacttttaggggcatttaatcttgcactgaggagagtccttttatcttgactgtgaataatcaaattccattgtcatttcaaatctttcagacagttcaaagttttatttttagcagtgcttcagggaggcacaagttggttcactagtgtggaatcataacttacagtcagctccaccagttggattatttccaatatttattagtttcatcaactagttttcaaaaaagcttaaagtttcagtattaatagataaatgtctttgaaactaata

SEQ ID NO: 200995 - DNA, 601 bp, Human
taaaaaaagacttggattttttattgttctagtgggtattgttctagaagcaagactcctctaattgatcataacaccaagcctaccccttagctgacagttcagatgtgtgtttttggttggttcaaatacaggaagacaccctttgtatacatttgactaattagtcaaagaataagaaggcaggggaaagaaatttatctaaaatattttttgactaatacatagcagtcttccaaaaattcaaagtggaatttttagagaaactacatgttctaacatgttctcttagggtgcttcrtacagatcgtcaaggaagtatcccaaaaaaaatcaatgaacacccggaatacagggtcttcaacagaatcaagcaacatgttacacaactgagggtaacaaagtatcagtccctacaacacttgtgtcaaacaaatctgtttctcctttcaccttacttacctcctttctcctaccctgttctatgtatggcctagcccttcgaagatacccaaacacaggaaagattaaagatccctttcaaacgatagaagatctctttcacacgatagatgataaaatgaagagatgttcagaaggc

SEQ ID NO: 200996 - DNA, 601 bp, Human
atgataagcaataatctagatgcaaataaaaatcattagatttaatataacatctttaggctcaaatggaagctcactaaatattaagtcaatcaacactgatagaggcaggaagcagaaaaatcctagtcagacagggtgaaaccccaccttcaagtcaaaaacagcctgaaacccatgacccagagagagaacttctatttctgtttgcctgctctttcccaactggttctttctgaataatgctttttaaccaatcaaatgttgccttttccaatactacctgtggcccatgggcccycccgatcctgtgcccataaaaaccccagatccagccacactgagggagatgacccaacttcgagtgagagaccaccttcctgtcccctctctagactgagagctgcttcatcactcaataaaattctctgtcctcatcacccttcaattgtcagtgatacctcattcttcttggacatgggacaagaactcgggacccactgaatgtgggggctgagtgtgcagttgtggcagctgtgggatccacactggagtgcaagccagatgcggcctggcaggctgagtaaatggggcacctgct

SEQ ID NO: 200997 - DNA, 601 bp, Human
caaaaacagcctgaaacccatgacccagagagagaacttctatttctgtttgcctgctctttcccaactggttctttctgaataatgctttttaaccaatcaaatgttgccttttccaatactacctgtggcccatgggcccccccgatcctgtgcccataaaaaccccagatccagccacactgagggagatgacccaacttcgagtgagagaccaccttcctgtcccctctctagactgagagctgcttcatcactcaataaaattctctgtcctcatcacccttcaattgtcagtgakacctcattcttcttggacatgggacaagaactcgggacccactgaatgtgggggctgagtgtgcagttgtggcagctgtgggatccacactggagtgcaagccagatgcggcctggcaggctgagtaaatggggcacctgctcctgcgagcccagcaaaggggccaagaaaaatcctgcatcaacactatttaaatgttaaaggaaaagtcaatataagtaacatgtataacacactaaaaatatattaatgataaggcaaaatgaaattagagaatgtataataaagctctgtgggata

SEQ ID NO: 200998 - DNA, 601 bp, Human
ttagaactagataagagttctgaaggccactgaactgttcactttagaatggttaattatatgttatatgaaattcatctcaataatttcaaattttaaaaaaagaaataaaaaacaatttattaacaccatccaaaaaaatacttagaacaatagcagtgatacaaaatgagttcagtaaatgtacactgtaataattatcaatgccacataaactggtaaatatgtagaatactatgctacattccaaagattaaaataaatatacataggtttggagtttatgttttcttttaagtaytcattttaacaatttatttctcctaaattcagcatgaaattatgtaattcatctacaaggaactctcgcttcctccaaaagagacactcagagagaaaatgcatatgaaaaatggaaactaaaaatttattttgtacatttactgctatatgtcatccaagttatgttattttaacatacagtgcttatgtgttaaactatctgggaaataaagagatgacatgcatgaagaaaatatacacaaaaggacaaccaaagaattattttgtaaatttaaccccacaaattataaatattata

SEQ ID NO: 200999 - DNA, 601 bp, Human
caaattttaaaaagacaaaatcatagggctagatttgtggatatgagaaatcaatgaattcatttttgaggcaaaaaaaggtcaaagtaaaaaagcattctatatatcaaacttaacacatttatactatagtttaaagaatatgtcaacaaatgaagagatcacagttcccaaataattatagcagccaaaaggtcaagtctaaaaacccttcacttcaaataaaaagctactaggagagactatgaggtactttctactaatatctcagaagaaaactcatgaaatattcaaaagcaaragaataattcgtatcttccgtttctttgcctcacatatttgttttactattagaagaaggctgtttttttgttttctttgtcatgactaatgtttatcttataaatttctattaaatgtgttaccaaaagttcctgtcgggaatggtaactacatttcacatacacatttataaacaacaaaagagaaaactgtcattaattttaatatggaattaaattattagaataaactttcaaacatatgttgacgcagtcaaagaattgtggcatgatgcatgtagccttcactgtttcaaaag

SEQ ID NO: 201000 - DNA, 601 bp, Human
gttttaacaggcatggagtttcagtttgggatgatgaaaagttctagagatgaatagtggtgatgttgcagagtaatacgaaagtatttaatgccacttaaaaacagttaaatggggcggggcgcggtggctcacgcctgtagtcccagcaccttgggatcacccgaggtcaggagttagagaccatccagcccaatcaacatggtgaaacccagtctctactacatatacaaaaattagccaggagtggtggcacatgactgtaatcccagctacctgggaggctgaggcaggagaatcrcttgaacctgagaggcagaggttgcagtgagctaagatcatgccattgcactccagcctggggaacaagagtgaaactctatctttaaaaaaaaaaaaaaagttaaacggtaaattttgttaagtgtattttgccacaataaaaaagtaaaaaaaaataagttctgtgtatggatggtagtgacggctgtacaacagtgtaaatgtgtatataacatctctgaattgtacacttaaaaatgttaaaatggtgaatttatgcttatttccacaatatttttaaaagctggttaaggtcttt

SEQ ID NO: 201001 - DNA, 601 bp, Human
gaccacaaagcagagaactcttaactttcaaatggagtaaaaatccatgtcttggaagcagtactgaaattccctgatgatcccatttctcccactcctctggatccttggatgatgtgaaagtacggttaatagaatcaaggtatcacctaaaataggcaaaaaaatagggaagagaaaggaaaggaaaccaaaggtagagaggggggtgaggggagagtattcacctacacaccctgtcaggaaacaaaaaaatgaaaagacaacagtaggaagaaaagaaaaaaaggaagataagggyaggttcaagggagaaatgcaagtaaagtatgtaatgacaaaataataaaatttttatctacaaccatatgatcttatgtaatttgagataatatatacatataactgaataaacgttttacagtgtatagcttcctattctaatcaacaaaactcttatctaccctttcctattaaataaaacagaaatctaaatgattctaacattaaaatgctagttatcactgaactataaattccaaaagaacagtgaacatgtctgctgtgcttactactacttcctaacagctcaagtggtacc

SEQ ID NO: 201002 - DNA, 601 bp, Human
gaaaggatgaatgaaactgacagactgctagctagattaaaaaaggaaagagagaagatccaaataggcacaatcagaaataacaaaggtgacatcacaacgaagcccacagaaatacagcagatgttcagaggctactatgaacatttcagtacatacaaagtagaaaatctagaggaaattgattaattcctgaaaacacaaaacctccaagattgaactaggaagaaacagaaatcctgaacagaccaacaagtaacaagattcaatcagaaattacacacctaccaatgaacaaaakcccccaaagagagagattcacagctgaattctaccagtcctaataaaactattacaaaaaatcgaagaggagggcctcctccctaactcattccacaaaaccagtatcatcctgatatcaaaatctggcaaagacataacaaaaaaagaaaattacaggccaatatccctaatgaacataagacccaaaattcctccacaaaatattagcacactgagctaggtggaatggctcacatctataatcccagcacttggggaggctgaggcagaaggatcactggagctcaggagtttgaca

SEQ ID NO: 201003 - DNA, 601 bp, Human
ctcttaccattcctatccattatgtcactggaagccctagccagagcaataaggcaagagaaagaagtaaaagacatataaataggaaaaaaagaagtcaaattatctctcttcactgacaatataattgtatactagaaaatcctaaagattctgtcaagactcctaggcctgataaatgatttcagcaaagtctcaggatataaagtcaatgtacaaaaatcagtagcacttctatacgctaataatgttcaagctgagagccaagtcaagaatgcaatgccatttacaattcctaccaaaaaaaaaaaaaaaaacaacctaggaatacacctaaccaaggaggtgaaggatctccacaaggagaactacaaaagactactaaaagatagcagagacgacacaaacaaatagaagagcattccacgttcccaggttggaagaatcaatattgttaaaatggtcatactgcccaaagcaatctacagattcaatgctattcctatcaaactaccatcatcatttttcacagaattagaaaaaaactattccaaaatttatatggaaccaaaaaggagcctaaatagccaaggcaattcta

SEQ ID NO: 201004 - DNA, 601 bp, Human
cggtttattccgaagcatctttgtgtgtgtttgtttagtatgctgggatactgaaaaaggaggtgacagccttaaggataacaatggacctattaaaaggcttcagtgctgtgattctctctaaatacgcacagacacacacataggtacttatttatacctgaatagtttggggtttggacagttcaggaaaataggggagggttttctggtttggaagctagtgggcagtgatgagtgaagggaactcttctcagaggggagggacttgctcttgctttgctgcacacgtaagacattaggttagaagagatcatttgcctgaagtacaaaaaagcctctcacctggtattgtccccttttataacttgtttttatgccttacctcaagaaaaatggccatgagattaacttctgataccattgtatgtgttttgactttgggaattctgaatgacctagactaaaagatgcatctttgaaccctgccgcttcaagtgtataacttaatccggcctctcgtaaatctgaaaagaacaggcgacatgaaacacagttaaatgcagtggaaactgctgtgttccaagaaggacttttgcag

SEQ ID NO: 201005 - DNA, 601 bp, Human
ggtttattccgaagcatctttgtgtgtgtttgtttagtatgctgggatactgaaaaaggaggtgacagccttaaggataacaatggacctattaaaaggcttcagtgctgtgattctctctaaatacgcacagacacacacataggtacttatttatacctgaatagtttggggtttggacagttcaggaaaataggggagggttttctggtttggaagctagtgggcagtgatgagtgaagggaactcttctcagaggggagggacttgctcttgctttgctgcacacgtaagacattgrgttagaagagatcatttgcctgaagtacaaaaaagcctctcacctggtattgtccccttttataacttgtttttatgccttacctcaagaaaaatggccatgagattaacttctgataccattgtatgtgttttgactttgggaattctgaatgacctagactaaaagatgcatctttgaaccctgccgcttcaagtgtataacttaatccggcctctcgtaaatctgaaaagaacaggcgacatgaaacacagttaaatgcagtggaaactgctgtgttccaagaaggacttttgcagg

SEQ ID NO: 201006 - DNA, 601 bp, Human
ctgatacctaaaagtttttcctactttctgtcagtctagaaagtgctttttggaacttaggagagtgcaggtctttttcctctttccattcgtctgctaagacctcctgttgctctttgcagcatcctaactggcctgttttcttggccaggctgcctgcctccaggaaaatcacctagaagccagagaaacaagtgtggatcctgaacccctgagaaagaaatctggatggaagacatctttggaggatcgaaggcagagtttagaaaaattaatgaagtgagattttctagaaagaagwttttgattggacagtgagaattatgttttgagctaaggggttgagagccatttcttctcccatgtgtcatagcgctttatgcttctataaggagtgaggcaaggtgagagagcatgaccagcctctctgggcagttaaagggcagatggtgacttgctttggcagtttgtacagacagagtgatgaggaaccaggtggagactacttgagtcactgttccgaggactctgttgtattagattcaggtgatagctagatcagataagcaccaatttttttcttggtgactatttactcagt

SEQ ID NO: 201007 - DNA, 601 bp, Human
gagattttctagaaagaagattttgattggacagtgagaattatgttttgagctaaggggttgagagccatttcttctcccatgtgtcatagcgctttatgcttctataaggagtgaggcaaggtgagagagcatgaccagcctctctgggcagttaaagggcagatggtgacttgctttggcagtttgtacagacagagtgatgaggaaccaggtggagactacttgagtcactgttccgaggactctgttgtattagattcaggtgatagctagatcagataagcaccaatttttttcytggtgactatttactcagtagcttcatattttggaacttagcattccatctttttcaccattgctatctaaaaacgacctctttcagaacgcaatcctccttttatttcccccaggaattttaactgttccttttacccatttttcattgggcagtgtgtaagagaactatgtatacatagtggggtacttacagcaaaaaacagaattttgtttcctgaaacttgccatgcaaagtttctttgcttatccctggaagacagtcagtgaagatgatggctgcttggaagaaaatgtatgc

SEQ ID NO: 201008 - DNA, 601 bp, Human
ttggcagtttgtacagacagagtgatgaggaaccaggtggagactacttgagtcactgttccgaggactctgttgtattagattcaggtgatagctagatcagataagcaccaatttttttcttggtgactatttactcagtagcttcatattttggaacttagcattccatctttttcaccattgctatctaaaaacgacctctttcagaacgcaatcctccttttatttcccccaggaattttaactgttccttttacccatttttcattgggcagtgtgtaagagaactatgtatacrtagtggggtacttacagcaaaaaacagaattttgtttcctgaaacttgccatgcaaagtttctttgcttatccctggaagacagtcagtgaagatgatggctgcttggaagaaaatgtatgcgggatctgctccagaaagcaggctgcaggaggccagataatgaacccaaacatttcattctgcacaagccgcatggaaactactctcaccactctgtagtagggcctgaagttaagagtccacgaattttaattcactcattaagtaacgggaggggggcaaaatatcagcttctata

SEQ ID NO: 201009 - DNA, 601 bp, Human
tagatcagataagcaccaatttttttcttggtgactatttactcagtagcttcatattttggaacttagcattccatctttttcaccattgctatctaaaaacgacctctttcagaacgcaatcctccttttatttcccccaggaattttaactgttccttttacccatttttcattgggcagtgtgtaagagaactatgtatacatagtggggtacttacagcaaaaaacagaattttgtttcctgaaacttgccatgcaaagtttctttgcttatccctggaagacagtcagtgaagaygatggctgcttggaagaaaatgtatgcgggatctgctccagaaagcaggctgcaggaggccagataatgaacccaaacatttcattctgcacaagccgcatggaaactactctcaccactctgtagtagggcctgaagttaagagtccacgaattttaattcactcattaagtaacgggaggggggcaaaatatcagcttctatagttagaaaaattaagctcttggctttgttttggaataatgggtttcatttttcctctcagaagtccttaggtagacagggagcccttagatccca

SEQ ID NO: 201010 - DNA, 601 bp, Human
atgtatgcgggatctgctccagaaagcaggctgcaggaggccagataatgaacccaaacatttcattctgcacaagccgcatggaaactactctcaccactctgtagtagggcctgaagttaagagtccacgaattttaattcactcattaagtaacgggaggggggcaaaatatcagcttctatagttagaaaaattaagctcttggctttgttttggaataatgggtttcatttttcctctcagaagtccttaggtagacagggagcccttagatcccagagaggaacaagcagagggyctataacattatgttaacagggaatgggaagagaaaccaacgaagtaaacaaggaaataattagttcctcccaaaagtaaatattggcaaaacatggagagaccaactattcactgcacttaaataaatgacaggactcagtgaccttcactttgattgccaggcttatagaatcttccctgttattgaggagtcctgtcacataaaacacttggcaaagggcagatggattgtgtattatcagaatggcaaaaatagcaagtctggagatatttgttgccattcacacatattgtacac

SEQ ID NO: 201011 - DNA, 601 bp, Human
gtgtccctttatcagcacctctcagcttcacccaccctgctgcttgccctgggcagtagcctggtcacatctttgaaaacctctgtttagtcaagacttcctaagtcaagacagaggaatggttgaatatacctctatgtaagaataccctcaaggtaaacactaaactcttacgtgttttatcttgggcccacatgaaaaaagtaaatgtttttaaagaacctattttcctttgttagttgcaaagtgaacaggtatcaattccttacctccctcctccagtcccagttaattccccacrtgaaaatacctacatgttggtggaaaagtgtaatgttcaagaacttggggccggccgtggtgtctcatgcctgtaatcccagcactttgtggggctgaggcagatggatcgcctgaggtcaggagttcaagactagtctggccaacatggtgaaaccttgtctctactaagaatacaaaaaaattagccaggcttggtggcaggcccctgtaatcccagctactagggaggctgaggtgggagaattgcttgaacccaggaagcagaggctgcagtgagctgaaatcgcaccactgcact

SEQ ID NO: 201012 - DNA, 601 bp, Human
tactagggaggctgaggtgggagaattgcttgaacccaggaagcagaggctgcagtgagctgaaatcgcaccactgcactccagcctgggcgacaaagcaagaccctgtctcaaaaaaaaaaaaaaaaaaagaacttggtttctggggtcaaatctgcactctgcttctgtgtgtctcagttttctcatctgtgtagtcaggttaatgatagggttgctataaggactcagtgcatccctaatgagcagttaaaagaatgactggcacatggaacatgcttactaacaaggctactaaccrgtataagtgaaacaattttacttgggctcagtctcttgttctcttaatccccatctacctcagtcattgatggtaagcagttaaggaggttgggctcttagaaagggagcaaattgttactgaattcagcagtcgtcgccgccccccccccccatgactatctttttataccttgtctaaatgatttctacaaagtttgtatattttgagtaatgttttaggtctgatattattttgcattgatttgtaggaattataaatgtaaccatttatctgtgaacaaataattaaaaatactta

SEQ ID NO: 201013 - DNA, 601 bp, Human
tctgcactctgcttctgtgtgtctcagttttctcatctgtgtagtcaggttaatgatagggttgctataaggactcagtgcatccctaatgagcagttaaaagaatgactggcacatggaacatgcttactaacaaggctactaaccagtataagtgaaacaattttacttgggctcagtctcttgttctcttaatccccatctacctcagtcattgatggtaagcagttaaggaggttgggctcttagaaagggagcaaattgttactgaattcagcagtcgtcgccgccccccccccccatgactatctttttataccttgtctaaatgatttctacaaagtttgtatattttgagtaatgttttaggtctgatattattttgcattgatttgtaggaattataaatgtaaccatttatctgtgaacaaataattaaaaatacttaatttggggaggaggcgggaacctagatgtgctataatcagcagtgtgcactttgcttcacattatcttctgggaggaaattttgctcctagctcctgagtgtgcacactgatgaccactgcaggatttggcctggcttgagcaaagaaacagc

SEQ ID NO: 201014 - DNA, 601 bp, Human
ataagtgaaacaattttacttgggctcagtctcttgttctcttaatccccatctacctcagtcattgatggtaagcagttaaggaggttgggctcttagaaagggagcaaattgttactgaattcagcagtcgtcgccgccccccccccccatgactatctttttataccttgtctaaatgatttctacaaagtttgtatattttgagtaatgttttaggtctgatattattttgcattgatttgtaggaattataaatgtaaccatttatctgtgaacaaataattaaaaatacttaatytggggaggaggcgggaacctagatgtgctataatcagcagtgtgcactttgcttcacattatcttctgggaggaaattttgctcctagctcctgagtgtgcacactgatgaccactgcaggatttggcctggcttgagcaaagaaacagctcgacgccatgggggctatggttccaacctgctgctgcagttggtataaactaggcaaaaccagaagtcagaggattatccattcctcttgttctttttctagctctacctgttcttctgccattcttctgcctgaaaatattcatgagc

SEQ ID NO: 201015 - DNA, 601 bp, Human
accgtggctgagtctggattcagggtagaactcaaacctctcttatgtgtttgctgccttccctttctccattttcttatgtacttcattaattattaagactatgaggtaggtaggtgacagagactgcaaagggagaagctagagcgaagacaggccaaaacttgcccaaattcacatgctcatttctgcctctgacactaggagagagttgagtaattgctcttcttcctaatactgcaggcagcagccaaattctccacattcttttacctttgctgctgttttcacttgccagggwgtttccttaaggagcagactgaatttaaagaaacatagcagtaatagtgcatgaaagggggtgtggggtcgctggccaaacgtggcatgttggtgcctcacgttgggaggatgaaaggatgattcctgcagagggacatgctgcacactgcgcaagctccctcacctctgtgtacagctgagccactgaccaggaagctctttgcttgtatgtgagacagcaaatattcactaaatatgtttcaagtacaagccaactgcgaagcttggaaagttgtccagaaacttcacccttcctttg

SEQ ID NO: 201016 - DNA, 601 bp, Human
tttgctgtagtgaagggtctatgttagaaggtgagttagagaccccacttgcccacatctgtgtgctgtggtttggccctcctcctctggtgaatccctaccacagcccagtgcctgctggatctcaagtgtcctgaaagccattggaaagatgctttccagcagtcttaacatttgcctccatgttctttccagcaaggatgagtgcacacagctttccagctactgggcaacccagccattgacagaaggtggtgcaagagtcaattcctctgtgaggatcccttccaataacagtgtstgcattaacgacaaaaagttctgtaaaaatgtttgcagggggagcttttgacctgcaaacatttctacagaactttttgccatataggaacatatgaaatgttatatgtaatataggtcagaaatgttgccatataggaacattcgagaagatgataaatgtgaggaaagtgataaaagtttatacaacaaggatctgtacaagattgtggtagatttgctggcctaaaaagatgtactcagggtagtgaactatttctgtagcatcagccactgggcccctgagtgggaatactctttg

SEQ ID NO: 201017 - DNA, 601 bp, Human
gaaagatgctttccagcagtcttaacatttgcctccatgttctttccagcaaggatgagtgcacacagctttccagctactgggcaacccagccattgacagaaggtggtgcaagagtcaattcctctgtgaggatcccttccaataacagtgtgtgcattaacgacaaaaagttctgtaaaaatgtttgcagggggagcttttgacctgcaaacatttctacagaactttttgccatataggaacatatgaaatgttatatgtaatataggtcagaaatgttgccatataggaacattcragaagatgataaatgtgaggaaagtgataaaagtttatacaacaaggatctgtacaagattgtggtagatttgctggcctaaaaagatgtactcagggtagtgaactatttctgtagcatcagccactgggcccctgagtgggaatactctttgagagacaggaagctaattccttctttgaatgtgtagttaactttgtgccattggatgtagggtgtgcacgtgcatgtgtattttttcagttgctgagggcacaacacagacaaagaataccgtgcattgtattatggatgtgctgg

SEQ ID NO: 201018 - DNA, 601 bp, Human
aaatgttgccatataggaacattcgagaagatgataaatgtgaggaaagtgataaaagtttatacaacaaggatctgtacaagattgtggtagatttgctggcctaaaaagatgtactcagggtagtgaactatttctgtagcatcagccactgggcccctgagtgggaatactctttgagagacaggaagctaattccttctttgaatgtgtagttaactttgtgccattggatgtagggtgtgcacgtgcatgtgtattttttcagttgctgagggcacaacacagacaaagaataccrtgcattgtattatggatgtgctggaaacaacgccccagcttgaagcaagttgactgtagtatctactctgtagatcagcaaactgaaaatgacttcttaataaaaggtcgcacattgttttacttactgcatttgaaaaaacagttctaattaagatgctttgggttttaaactgcctgttaattgggatatctataagtgggcaagtagagcttctgaatattgctgacttatttcttagtgattgggacaaaagctttttttttttttttttaaatagtatgccatcattaaacagtt

SEQ ID NO: 201019 - DNA, 601 bp, Human
agggcacaacacagacaaagaataccgtgcattgtattatggatgtgctggaaacaacgccccagcttgaagcaagttgactgtagtatctactctgtagatcagcaaactgaaaatgacttcttaataaaaggtcgcacattgttttacttactgcatttgaaaaaacagttctaattaagatgctttgggttttaaactgcctgttaattgggatatctataagtgggcaagtagagcttctgaatattgctgacttatttcttagtgattgggacaaaagctttttttttttttttttaaatagtatgccatcattaaacagtttttgaccttacgcagaaactttaaatgtgacagcagaaagaagcagcagaaatttacagtgagaaatggaagacctctgtaggtaaataagtaaaatgaaagaagccagaggtgttttttgttggcagtagatgaaattattttcaaacactgccctgggaaaaggtgagccctcagcaaccaagtttattgactgtctattcaggaaattgtattagttgctttggaaagagaaaggaaaaagaaaagactttctgccaactgagggctggaa

SEQ ID NO: 201020 - DNA, 601 bp, Human
aacattatatcaaatacattgtcctatgttgctaccttgtcttcattattatgatttgtcaagcaattgggttgtactgactgcagtgttactcctcatttcctttccccctttcttttccatactacttaaaaagcaagaaaggaaaaaaaattctatttaagagaaaatcctatgtagtcgtaatggaatttattttcctgagtgcctgggcgtgctccaaacagatagctgtgattgtgtcatctcttcttactaagcatctgaccactcactacctgtgcatctgatccctaggctsatggcatgagggctgtggctcttgatgttttttttttgatgtgcttagtatcaccagaactgtattgactctaagagtatggaagctttgtaaagttaactaacgatttgtaggttttgtgcaaatagccagctctccaggtagagacattttaattctgttgctttttttttttgtagcatattattatattgcagatgtttacttagtatgaaaaatggatataattaagttctaaatgggtactagatattaacttcaaaatgaatttgcaacttgtatgctttgcatatgccgtat

SEQ ID NO: 201021 - DNA, 601 bp, Human
gtaaagttaactaacgatttgtaggttttgtgcaaatagccagctctccaggtagagacattttaattctgttgctttttttttttgtagcatattattatattgcagatgtttacttagtatgaaaaatggatataattaagttctaaatgggtactagatattaacttcaaaatgaatttgcaacttgtatgctttgcatatgccgtatgctttgcatatgccatatgctgttgtttccaaggatgtaaagcagttttccacttccaccatcttataaattaaaaccagagggctagaygttatccagcaagggacctacaaaattcgaaaaaaaacttcggatcattatcaggattaagtttgttgaaattgtatcaggaaaatagacttttccttgtattattattgactcatataatgcaactcatactggtttcatattcagaaggtatatagcacctgttgtaatatttcaggttgatttctgcaatctttatttaaaaatacaaatccgcaaagcaaattgcataaacggtatacaaaatgaaatcaccaggcttcaaatatattttatgtaaatgttaagtgctctttagat

SEQ ID NO: 201022 - DNA, 601 bp, Human
caaggtaattttgaaaggacaaagccatcaggtgatttgttttcaataagcattattgggatatttcagactccaacatgtgcagtggagatattaacgagactttaccctttctaaacttaggggcttactctgcattgtaacgtatgtttgcttttaaggcgatagatgggtagatagatgctctgtaattgaatagcctactgggcttctgtgtagcacagcactgtgtaagtcgcaggtgttcagtaaatgtattttaaatcaatgagtaattgatgggatatttttcttcacattrcatcacattgaagatgcttgtgaggaagttttgttcatgattgtcctcctaggcaggcgccacctaacatgtttctctctagctgcggggtattgaatttgaggctgctctcagcattactgctcatctcaaagaggaacaaatggtcccccaaatggtccagatgcaacagtagggaaaggagtgccaccattcattctgaggtgcctgggccatactctggatgaagctcacagctctaacgtaaggcggtaagtcattttttttttaaacttaaggaagttaatttgaaagtttatg

SEQ ID NO: 201023 - DNA, 601 bp, Human
atgggtagatagatgctctgtaattgaatagcctactgggcttctgtgtagcacagcactgtgtaagtcgcaggtgttcagtaaatgtattttaaatcaatgagtaattgatgggatatttttcttcacattacatcacattgaagatgcttgtgaggaagttttgttcatgattgtcctcctaggcaggcgccacctaacatgtttctctctagctgcggggtattgaatttgaggctgctctcagcattactgctcatctcaaagaggaacaaatggtcccccaaatggtccagatgcracagtagggaaaggagtgccaccattcattctgaggtgcctgggccatactctggatgaagctcacagctctaacgtaaggcggtaagtcattttttttttaaacttaaggaagttaatttgaaagtttatgctgatgccatttcatatgacagagactaaagggtatacgtccttgtgttctcttggtggggactgctgtcctaaaggtaaaagattttgatccagaggttggattgttcctcgtgtggcaacagtcctctgacctcagtcattttcaaagtctaatgtctttttggct

SEQ ID NO: 201024 - DNA, 601 bp, Human
ggggtattgaatttgaggctgctctcagcattactgctcatctcaaagaggaacaaatggtcccccaaatggtccagatgcaacagtagggaaaggagtgccaccattcattctgaggtgcctgggccatactctggatgaagctcacagctctaacgtaaggcggtaagtcattttttttttaaacttaaggaagttaatttgaaagtttatgctgatgccatttcatatgacagagactaaagggtatacgtccttgtgttctcttggtggggactgctgtcctaaaggtaaaagattktgatccagaggttggattgttcctcgtgtggcaacagtcctctgacctcagtcattttcaaagtctaatgtctttttggctaacaaaagacatcaagctagagattaaaatttgcagaagatgggagtttttttgttgttttcggttttttttttttttttttttgagacggagtctcactctgtcacccaggctggagtgcaggtgatcatatctacaaaggtgacaagaacatgaacctgcagtcctgttatcagcattttgtaagtgcttcttctcattctaaaaatatgtattgat

SEQ ID NO: 201025 - DNA, 601 bp, Human
atgaagctcacagctctaacgtaaggcggtaagtcattttttttttaaacttaaggaagttaatttgaaagtttatgctgatgccatttcatatgacagagactaaagggtatacgtccttgtgttctcttggtggggactgctgtcctaaaggtaaaagattttgatccagaggttggattgttcctcgtgtggcaacagtcctctgacctcagtcattttcaaagtctaatgtctttttggctaacaaaagacatcaagctagagattaaaatttgcagaagatgggagtttttttgttgttttcggttttttttttttttttttttgagacggagtctcactctgtcacccaggctggagtgcaggtgatcatatctacaaaggtgacaagaacatgaacctgcagtcctgttatcagcattttgtaagtgcttcttctcattctaaaaatatgtattgattttaaaaatgaattctgtaacaggatagcaacagtagtaaaaatcctttttatggagaaatttagagctttcagctaacatacacacatactcattcaaatgaaacagcttgtcttgttttaaagaaatatttctgt

SEQ ID NO: 201026 - DNA, 601 bp, Human
cacagctctaacgtaaggcggtaagtcattttttttttaaacttaaggaagttaatttgaaagtttatgctgatgccatttcatatgacagagactaaagggtatacgtccttgtgttctcttggtggggactgctgtcctaaaggtaaaagattttgatccagaggttggattgttcctcgtgtggcaacagtcctctgacctcagtcattttcaaagtctaatgtctttttggctaacaaaagacatcaagctagagattaaaatttgcagaagatgggagtttttttgttgttttcggttttttttttttttttttttgagacggagtctcactctgtcacccaggctggagtgcaggtgatcatatctacaaaggtgacaagaacatgaacctgcagtcctgttatcagcattttgtaagtgcttcttctcattctaaaaatatgtattgattttaaaaatgaattctgtaacaggatagcaacagtagtaaaaatcctttttatggagaaatttagagctttcagctaacatacacacatactcattcaaatgaaacagcttgtcttgttttaaagaaatatttctgttgtccatt

SEQ ID NO: 201027 - DNA, 601 bp, Human
ttttgatccagaggttggattgttcctcgtgtggcaacagtcctctgacctcagtcattttcaaagtctaatgtctttttggctaacaaaagacatcaagctagagattaaaatttgcagaagatgggagtttttttgttgttttcggttttttttttttttttttttgagacggagtctcactctgtcacccaggctggagtgcaggtgatcatatctacaaaggtgacaagaacatgaacctgcagtcctgttatcagcattttgtaagtgcttcttctcattctaaaaatatgtattkattttaaaaatgaattctgtaacaggatagcaacagtagtaaaaatcctttttatggagaaatttagagctttcagctaacatacacacatactcattcaaatgaaacagcttgtcttgttttaaagaaatatttctgttgtccattgtacaaattttaataacttgtctttcctttttttaggtctctgtgttccagatttttttttgtaactatgaaatccttgccttgtagtcaacttaaaatgaaataaatttatcagtgcaaatgagtacactgtggttcttgtgtggcaaaatt

SEQ ID NO: 201028 - DNA, 601 bp, Human
ttcttgtgtggcaaaattatgcaggtggtttgaaggattcattgttttattaaaagactagaagaatgtacaaatgctttccttctttctcatgtttctctcacccaaactgaagtggtccatttaaaatctgatcttcataaaaggaagagttgtcacaggacatctgatttatgagccatctgatttgcttctgctgtagttccacactctgctggggtacaaaaatcaggcacttttatttcagccctgacaacagtgcggccttcccaaagtatgagaagagcagcgtgcagaggtwatgtgcagtcttccgaacagagcactgaactggtttttaatgaagggtaatatgtacttggggtccaaactctagttaattccggaaaacatatcccctcactagtgttgggtcttagtaaatgagtgttctgtgttgaatccttgcttgagaggaaggaggtcataattggtcagggattctatttctttctttctctcttttttttttttttttttttttaaagaaaagcaattgcttagaatgagatgaatctatatcagggtatgtttttgtaggatcatattaatcatcttaccc

SEQ ID NO: 201029 - DNA, 601 bp, Human
tgaacttttccctgccagcctccctgcccgccttcttgcccccgcccctaccccccacacaggaatctagagccctcccagtggtggtgtgaagcctctggaatgtggcactctgacccctggcagttgagtgtcctggatggacctggcctgggaaacaggaaggactcgggggagggggaaggagtgccccatggccttgaggtgggatggagggaaaggaaatgctgcccagcgcggccccacaggcagctcccgctagactcccacactgggggcggggctggcagggcagggagcyggcaggtttcctcagaccaggcctgtggccccggggcctctggcagagccaggctcaggaaggtgaactgccagagcagttggggtgaggaggaaaggatgtgaggggaaggaggaggagcaggccagaatgcagaagcaattgtagtaggagaggacaaaggtgatggatgagaaaaggaatgtccagtgactgtgtggactagacacacttctcactttagaaaccaagtatattagaaagcggaaaagaccctcctaaagaaacttccagccaggtgcagtggctcgtgcctgtaat

SEQ ID NO: 201030 - DNA, 601 bp, Human
aagcctctggaatgtggcactctgacccctggcagttgagtgtcctggatggacctggcctgggaaacaggaaggactcgggggagggggaaggagtgccccatggccttgaggtgggatggagggaaaggaaatgctgcccagcgcggccccacaggcagctcccgctagactcccacactgggggcggggctggcagggcagggagccggcaggtttcctcagaccaggcctgtggccccggggcctctggcagagccaggctcaggaaggtgaactgccagagcagttggggtgaggrggaaaggatgtgaggggaaggaggaggagcaggccagaatgcagaagcaattgtagtaggagaggacaaaggtgatggatgagaaaaggaatgtccagtgactgtgtggactagacacacttctcactttagaaaccaagtatattagaaagcggaaaagaccctcctaaagaaacttccagccaggtgcagtggctcgtgcctgtaatcccagctactcaggaggctgaggcaggagaattgcctgaaccggggaggcagaggttgcagtgagccgagattacgctactgtactccagc

SEQ ID NO: 201031 - DNA, 601 bp, Human
tcttgggaaaggaatagaaactataggcagagtctgtttctgaaacacctgttttaagtggaaagcgatcctaactgctgccatacctgaagggcttgtgtttcctgtgcagctggaatctctctgtgctgagtaaattaacttctgtgcccagggtagtcttgaatgataattagtgctccgtggccatgccacacatcctgtctgaagcaagggtgctaataatgtcctttcctctcttctcacaagacattatatgaagtcctaggaatagtggtcctggtgctaaatagaaatgtcrtggttatggcactaatttattgggcctgccagcccaggtgtgcagcatccctttcctccacccgattgataagacaccaggtgaggtccagtgtgatgctccaggcagtgctgcagctgagttggcctgtgtctcctggctcaaggggtgcatcttctggtctgccttgagaacttaccagtcttccataaattggaagttcaaagcaatggaatgaacaatggagagaacaagcacatacacataagttaaaagctgtgcatctctgtatattctaatcctttgaaacttggtgatcat

SEQ ID NO: 201032 - DNA, 601 bp, Human
gcaagggtgctaataatgtcctttcctctcttctcacaagacattatatgaagtcctaggaatagtggtcctggtgctaaatagaaatgtcgtggttatggcactaatttattgggcctgccagcccaggtgtgcagcatccctttcctccacccgattgataagacaccaggtgaggtccagtgtgatgctccaggcagtgctgcagctgagttggcctgtgtctcctggctcaaggggtgcatcttctggtctgccttgagaacttaccagtcttccataaattggaagttcaaagcartggaatgaacaatggagagaacaagcacatacacataagttaaaagctgtgcatctctgtatattctaatcctttgaaacttggtgatcattattgttcattacataggatatggatttgatcagagcatcctttgggagttgtctgcatttggtatttccttttatatcctgaaagctgttagttcttgaaaggtgtattgaacctaataaaatagtaattagaggtatttccacaaattgtgagctttgtcatttggatagtgtttttgagacttcttttccactctaaataccaact

SEQ ID NO: 201033 - DNA, 601 bp, Human
tttcctccacccgattgataagacaccaggtgaggtccagtgtgatgctccaggcagtgctgcagctgagttggcctgtgtctcctggctcaaggggtgcatcttctggtctgccttgagaacttaccagtcttccataaattggaagttcaaagcaatggaatgaacaatggagagaacaagcacatacacataagttaaaagctgtgcatctctgtatattctaatcctttgaaacttggtgatcattattgttcattacataggatatggatttgatcagagcatcctttgggagttrtctgcatttggtatttccttttatatcctgaaagctgttagttcttgaaaggtgtattgaacctaataaaatagtaattagaggtatttccacaaattgtgagctttgtcatttggatagtgtttttgagacttcttttccactctaaataccaactttaaatagaataatatgacagaattatgatcttgaaaaatttatctacttaactgcatgtgggaatacatatttctgtagcatgtggaaaaaggactgagtgatgcatacctgttatatttacattttcttttggaagcaaat

SEQ ID NO: 201034 - DNA, 601 bp, Human
tactcttggtgatttgactaacagattttaggttagagcatccattaatatttataaaatggtactgtgcattattcatgtcctcaagtcacattctggcaagaagcattaacgtgtgtcacattatctaattattgtcataatacacagaagtggcaggaagggagattaaaagtttattatttaagttattatttatttatctaacatggttgaggcatattatattcattcactcttttgacatgtcataaatattgatttgtggaagtgttgcttgatacagtattgaggttaaaakaaaacttgcgctaatattaatatttcacaagtaggaagactgagatccaaagatgtttctctgttatttctaaataattgactttcttcctctaccaacaaacttactttccagaaaaagtttgctgctcaaagattcacattgctttgattaaattcatgtgctcgtcctctctatccctatttattccttctgcaggtatttattttgctaagctactatttgctaagccctatgatagttcagtgatgaagagtaaaaagtagatcgttagtttcaaagaacccacttcgggtaaag

SEQ ID NO: 201035 - DNA, 601 bp, Human
atacacagaagtggcaggaagggagattaaaagtttattatttaagttattatttatttatctaacatggttgaggcatattatattcattcactcttttgacatgtcataaatattgatttgtggaagtgttgcttgatacagtattgaggttaaaagaaaacttgcgctaatattaatatttcacaagtaggaagactgagatccaaagatgtttctctgttatttctaaataattgactttcttcctctaccaacaaacttactttccagaaaaagtttgctgctcaaagattcacawtgctttgattaaattcatgtgctcgtcctctctatccctatttattccttctgcaggtatttattttgctaagctactatttgctaagccctatgatagttcagtgatgaagagtaaaaagtagatcgttagtttcaaagaacccacttcgggtaaaggagattagatgaacaatttcattgtgctgctgtaagtgaagtaattttaatagatatgcagtagaagtcctacactggaaatagtacttaattcagtccctatagagtggggaaacctaaaggaagtattaaccactgagga

SEQ ID NO: 201036 - DNA, 601 bp, Human
taggaagactgagatccaaagatgtttctctgttatttctaaataattgactttcttcctctaccaacaaacttactttccagaaaaagtttgctgctcaaagattcacattgctttgattaaattcatgtgctcgtcctctctatccctatttattccttctgcaggtatttattttgctaagctactatttgctaagccctatgatagttcagtgatgaagagtaaaaagtagatcgttagtttcaaagaacccacttcgggtaaaggagattagatgaacaatttcattgtgctgctrtaagtgaagtaattttaatagatatgcagtagaagtcctacactggaaatagtacttaattcagtccctatagagtggggaaacctaaaggaagtattaaccactgaggagaagtttccagtgcagatgaagagaagtagctttctaggcagagagaacagccatgaatgtcatgaaacaacatgggacattcaggcaattcatagtcactaagtcttactggaggaagaggaaggcatggcagagatgaggttgaagaagtttgctgggatcaagtctaaactggctttgtgttattcc

SEQ ID NO: 201037 - DNA, 601 bp, Human
gtaattttaatagatatgcagtagaagtcctacactggaaatagtacttaattcagtccctatagagtggggaaacctaaaggaagtattaaccactgaggagaagtttccagtgcagatgaagagaagtagctttctaggcagagagaacagccatgaatgtcatgaaacaacatgggacattcaggcaattcatagtcactaagtcttactggaggaagaggaaggcatggcagagatgaggttgaagaagtttgctgggatcaagtctaaactggctttgtgttattccatgccgggkactcaaatgactgcatgttggacttcattttgtagaccattgctttgcaactccatatccttaagaagtttggttaggctgttctcttaacactccttgctgggtgttacttacattaaagcacctctgtaggaggataaaacactgtgaaccaggtatgtaagagacagctaatgacctggcttaatccaaggatgtctttttagagtatcctgatgaagagatcaaataggaaataattagacatttctccaaaatacttttttcctcaaccaagatttattaatttttaagtaagag

SEQ ID NO: 201038 - DNA, 601 bp, Human
tagagacagttgtgtaatgacagagtgcttcagcagttgtcagttcatagccaatcctgttttattaaacgagatttactgagacctcagctagtaaatcctctaagaatggagatactggaaaggtcctggaaagtgatatttattacattaaaagacctttggcttgccttactctacatagtgactttgttttcaaaacaaagtctaattggtctgataatggaacattattttaaatttaaattatgactgccataggcatatgattctctggcactgtccccaataaattgttagyattgtacaatttcaataaagatgctagaatcaaacacaaggataaagtctaaaggggcctcatggattatccattctatgtcctttttgtaattaaaaaattggagcttagagagctaaatgccttgtttggggtcctgccgtgaatgagtgacagagctaaggttgtggtctcctgggccaaggtcctctccattacaccatccccctctgggctgtttcttcgtatgcagtttaagatggcccctaggttaggcagaactgtgaagtaggagagttgtgtcccgtagccccaatttct

SEQ ID NO: 201039 - DNA, 601 bp, Human
taaacgagatttactgagacctcagctagtaaatcctctaagaatggagatactggaaaggtcctggaaagtgatatttattacattaaaagacctttggcttgccttactctacatagtgactttgttttcaaaacaaagtctaattggtctgataatggaacattattttaaatttaaattatgactgccataggcatatgattctctggcactgtccccaataaattgttagcattgtacaatttcaataaagatgctagaatcaaacacaaggataaagtctaaaggggcctcatgrattatccattctatgtcctttttgtaattaaaaaattggagcttagagagctaaatgccttgtttggggtcctgccgtgaatgagtgacagagctaaggttgtggtctcctgggccaaggtcctctccattacaccatccccctctgggctgtttcttcgtatgcagtttaagatggcccctaggttaggcagaactgtgaagtaggagagttgtgtcccgtagccccaatttctcctgtccttatcatttcttgtttcatgaaacatgaaacatgaaactggtgcttctctgttagttg

SEQ ID NO: 201040 - DNA, 601 bp, Human
ccgtagccccaatttctcctgtccttatcatttcttgtttcatgaaacatgaaacatgaaactggtgcttctctgttagttgtattgctgaggtgtatgatgaaaagtacagcaatgggacatatacttaataacaaatattttgctgtaagttgatttattatattggatcagtactgcttgtttttcagtgatttcctcacttggacataatacaaatcagtgttcttgttgtttgttatacatttagacatttacatcagtttaaaagttagtcttcaacaaatatttgtgtccacaytttagtattccattgtttgaaagattcaggctttgtccactctggtttatagttacatatgcttaaaattttttcactttgtggaaatgtctgtaaaatacatttttgtaacatgaatcatttctactgataaccataaatttgcccttcctgctttgcactgattgcggcacaaggaagagaaagagaaggaagcaccagctttgggaacataggccttaagcttgaagcagagagaatgaaagcagactgtattagattcctcctcgagcagaacggaatgcctgataacagccagcc

SEQ ID NO: 201041 - DNA, 601 bp, Human
tagccccaatttctcctgtccttatcatttcttgtttcatgaaacatgaaacatgaaactggtgcttctctgttagttgtattgctgaggtgtatgatgaaaagtacagcaatgggacatatacttaataacaaatattttgctgtaagttgatttattatattggatcagtactgcttgtttttcagtgatttcctcacttggacataatacaaatcagtgttcttgttgtttgttatacatttagacatttacatcagtttaaaagttagtcttcaacaaatatttgtgtccacacttyagtattccattgtttgaaagattcaggctttgtccactctggtttatagttacatatgcttaaaattttttcactttgtggaaatgtctgtaaaatacatttttgtaacatgaatcatttctactgataaccataaatttgcccttcctgctttgcactgattgcggcacaaggaagagaaagagaaggaagcaccagctttgggaacataggccttaagcttgaagcagagagaatgaaagcagactgtattagattcctcctcgagcagaacggaatgcctgataacagccagccagg

SEQ ID NO: 201042 - DNA, 601 bp, Human
ctctccaactagcctttgcattgaaaatctttcatgtcaaatgtagaaggaaagaatttcaggcatcaccgagaatattgaaagatattcttagaggagaaagactaagtccaggacaagactgaatgtagctattggaagtacaggtgtttcctgccttggcaatataagttgttcactcttataaagcaaataaaaaaacctactcatattctgcaaaatcattcattacactaaaaataagagagctgttgggaaaaaatagggttggggaaggtcactcaagacctatgcatctgtrtgtatagaggataaatgcaaacaataagaactcaaataaaaatactggcccaggtgagctgtccctggcatttatttgcacctggatctctggtagcccatgctttgcagccctccacactccgaagctcattctgcctcctttcagggcacggggtgttgaagatacttacttttcatgtggaacggtgttaccagaattaaacataacatccagtagtttcttcatcattgtttttatgggggttttttgtttgtttgtttgttttgttttgtttttagtacaggggcaagtgtctcc

SEQ ID NO: 201043 - DNA, 601 bp, Human
tttcaggcatcaccgagaatattgaaagatattcttagaggagaaagactaagtccaggacaagactgaatgtagctattggaagtacaggtgtttcctgccttggcaatataagttgttcactcttataaagcaaataaaaaaacctactcatattctgcaaaatcattcattacactaaaaataagagagctgttgggaaaaaatagggttggggaaggtcactcaagacctatgcatctgtgtgtatagaggataaatgcaaacaataagaactcaaataaaaatactggcccaggtragctgtccctggcatttatttgcacctggatctctggtagcccatgctttgcagccctccacactccgaagctcattctgcctcctttcagggcacggggtgttgaagatacttacttttcatgtggaacggtgttaccagaattaaacataacatccagtagtttcttcatcattgtttttatgggggttttttgtttgtttgtttgttttgttttgtttttagtacaggggcaagtgtctccagccttctcatttctgcttgcagtttccccagatagtttaatacagaggacatttt

SEQ ID NO: 201044 - DNA, 601 bp, Human
tttcctgccttggcaatataagttgttcactcttataaagcaaataaaaaaacctactcatattctgcaaaatcattcattacactaaaaataagagagctgttgggaaaaaatagggttggggaaggtcactcaagacctatgcatctgtgtgtatagaggataaatgcaaacaataagaactcaaataaaaatactggcccaggtgagctgtccctggcatttatttgcacctggatctctggtagcccatgctttgcagccctccacactccgaagctcattctgcctcctttcaggrcacggggtgttgaagatacttacttttcatgtggaacggtgttaccagaattaaacataacatccagtagtttcttcatcattgtttttatgggggttttttgtttgtttgtttgttttgttttgtttttagtacaggggcaagtgtctccagccttctcatttctgcttgcagtttccccagatagtttaatacagaggacattttaaccacgagagcagtcatttcttgcactaaagaaaggaatttaagcaaaattttcagccttttcttcaggtcttccatatactggtaagactt

SEQ ID NO: 201045 - DNA, 601 bp, Human
aaaaaaacctactcatattctgcaaaatcattcattacactaaaaataagagagctgttgggaaaaaatagggttggggaaggtcactcaagacctatgcatctgtgtgtatagaggataaatgcaaacaataagaactcaaataaaaatactggcccaggtgagctgtccctggcatttatttgcacctggatctctggtagcccatgctttgcagccctccacactccgaagctcattctgcctcctttcagggcacggggtgttgaagatacttacttttcatgtggaacggtgttaycagaattaaacataacatccagtagtttcttcatcattgtttttatgggggttttttgtttgtttgtttgttttgttttgtttttagtacaggggcaagtgtctccagccttctcatttctgcttgcagtttccccagatagtttaatacagaggacattttaaccacgagagcagtcatttcttgcactaaagaaaggaatttaagcaaaattttcagccttttcttcaggtcttccatatactggtaagacttaactgtgagaaaacttgctcctgatacttatttttatttatttat

SEQ ID NO: 201046 - DNA, 601 bp, Human
gttcatgacattctcctgcctcagcctcccgagaagctgggactacaggcgcccgccaccacgccagctaatttttttgtatttttagtggagatggggtttcaccgtgttagccaggatggtctcgatctcctgacctcgtgatccgcccatctcggcttcccaaagtgctgagattacaagcgtgagccaccgcgcccggcccacttttgatttttttagaacattaatgtgctgggaaaaatcacatgagaaccagcagaaccgctgtattatactgacaccattttcctatttaccrgttacatattggctaaatcacattaaagaaacattcatttttatggttccacggtaactgttagaagaggtacccagcattcttttgttattccttggcctaggtgtacctgcaggacatgctctttagaacagcagttctcaaagtgtgggctacagaccgcttagaagcctgaagccctttttgggtggtaaatcaggtcaaaactaattccataatcctattaacattttatttgcttttttttctttttccactttgcactaatggtgcaaaaaaaaaaaaaaatggtacataaaa

SEQ ID NO: 201047 - DNA, 601 bp, Human
ggcctaggtgtacctgcaggacatgctctttagaacagcagttctcaaagtgtgggctacagaccgcttagaagcctgaagccctttttgggtggtaaatcaggtcaaaactaattccataatcctattaacattttatttgcttttttttctttttccactttgcactaatggtgcaaaaaaaaaaaaaaatggtacataaaactcctgatactttagtatgaatagaggttgtggcaccaaattgtgctagtaagttactgtattcaccgtgtactttcagtaaagcaaaatggtaagkaattaaaataataaaataaaaattagtttccttgaatgcccttgatcgaagcaatacaaattattaagtttattacatttcagccctcaattatacatcttattaatgttctgtgggatgaaatgggaaatacacataaagtaattctgctgcatactgaagtacagagcttgtcatgagaaaaagtgttatatttcaagatgtcttctgaacatccaagtggaagtgttggtttagcagtttaatatacctggcacttcactgtagtactcaatattggacatatttgaacatatatga

SEQ ID NO: 201048 - DNA, 601 bp, Human
agcggtggttgctagggaaaccatttcccaagaagaaaaacaaagtattgattaggagcgggcagagaattgaaagagtttactctcaaaaaaaagaaaataaaagtgtctacgatgttgttagctttagagtcagtgatgcttcctggctgaacatagtggcagcaatgtttctgaggggaatggtcacctttacctgagcatcttcaggtgagtctgctgctgctgccaggaaacttctgctgagaaagcagcagaaaacagcaaggggccagcggcctcatcaaaggccttttagctrtgattccagatttgagggaaatggtcttcctgtggggaggcagagaaaagcatctggcagtgaaaaccaattagctgtgagatgggctgcttggaaggactgttgatgccagccaggtgataagaagttgaagtcttagagctgaacggggggaagagagtaatgatagatgatgcctagtgagaaatgtgcccagtattccaagcatttctttgaaatgtgtgcctcatacagtgctgtaatgataagcttttaaaataggatttgtattgtttaaacatgttctttatattatcttga

SEQ ID NO: 201049 - DNA, 601 bp, Human
aagacaaatatcaccttcttttctatgttgaattttttcaatatggtgtttttcttctttttctgattttcctttcagagtactttactaatttcattgttgtcttgaagataggaatgtacctttatgtgtctatgttatatttgtgtgtgtgtgtatgttgcttctctctgtctatatatataaaacatatatatatatcttatatatgtatgttgtttctcagaaccaaatttaggctaaataggagaacagattttaaataaaacataaattgtgtgtcggtataaacttcaaatcygaaagataatcattttactaaaagctgaggctttgatcaaataagtgagcctgatctcctgaaatctaaaacaagagattttctattctcccttttcaaaggaccgccctgaagctctttatgtagtagatgacattcttgtaacgacctcttgatgagaaaattatttatttcagtcaggaagagcagacttttacttcacttacgtactgagcaatgatgccagcaataaaagcttaccctataaaaataagagccatttgtttgtactgtcttttttttttttttttttttttgagg

SEQ ID NO: 201050 - DNA, 601 bp, Human
tatatcttatatatgtatgttgtttctcagaaccaaatttaggctaaataggagaacagattttaaataaaacataaattgtgtgtcggtataaacttcaaatctgaaagataatcattttactaaaagctgaggctttgatcaaataagtgagcctgatctcctgaaatctaaaacaagagattttctattctcccttttcaaaggaccgccctgaagctctttatgtagtagatgacattcttgtaacgacctcttgatgagaaaattatttatttcagtcaggaagagcagacttttrcttcacttacgtactgagcaatgatgccagcaataaaagcttaccctataaaaataagagccatttgtttgtactgtcttttttttttttttttttttttgaggcggagtttcactttgttgcccaggctggagtgcagtggcatgatcttggctgacgacaacctctgcttctctgtttcaaacaattatcccccttcagcctcctgagtaactgggaccacaggcatgcgccaccatgtccagctaatttttgtatttttaatggagatggggtttcaccatgttggccaggctgatg

SEQ ID NO: 201051 - DNA, 601 bp, Human
gagccaccactcccagccaaaaacagatttttaagatggcatttatacctgccttagtttgagcaagaggtttaaggtttcttaaattcaggtactttaaaaaattctcttcagatatgcttatcagaaacatgtttactatgtaacagtcagttcccatttcaggtgggtaaagtatctgttaaagataatgttaagtgtgaaaaaaccccatataatggcccaaggattcacagagagaaatagtctaatttcctatgaggaatattatgaagaattgagcctgcatatgattctgtcrtattcattgcattttttggagctgagtcccatgatagctctttttaaaatcgaccttatttattgtgacctgctccattccatgatcagaacctgatttggtctcagcctttgtattcagttacctcagcctgtcactaagctgcaccactttagtttttttgttgtttctggctttgggttggcagtgatggatactatcagtctccccaaacgcattagaggggatcccctccattgtaactcttttggtggtgtctgatttttgatgttgattattagctgccttaatgtagtaagt

SEQ ID NO: 201052 - DNA, 601 bp, Human
gctgagtcccatgatagctctttttaaaatcgaccttatttattgtgacctgctccattccatgatcagaacctgatttggtctcagcctttgtattcagttacctcagcctgtcactaagctgcaccactttagtttttttgttgtttctggctttgggttggcagtgatggatactatcagtctccccaaacgcattagaggggatcccctccattgtaactcttttggtggtgtctgatttttgatgttgattattagctgccttaatgtagtaagttgaagagctgttttaaacctraagttggtctctatcaatagagtaaaaaattagctttttaaagagagtctcaccctgtttcccagaccggaatgcagtggcgtgatcaacctcgtgggctcaagtgatcctcccacctcaaactcctgagtgctgggaccacaggcatgcacaaccattcccagctaattttttgttttgtttttgtagagactgggtctcactgtgttgcccaggctggtcatgaactcctgggctcaagtaatccccgtgccttggtctctgaaagtgttgggattacaggcatgagccactgtgcct

SEQ ID NO: 201053 - DNA, 601 bp, Human
tccaagtcaggatatgtgcctttcagctttaaagagaattgaaggtaagcattaatttttgttaaccatccagtcgtaagccttagcattatgtaaccctgagtagtaatagtatttgagcttgaaaaggcaaagacaagtttacagagagtggtagtttgtataatcccaactaagatgcataaagtttaccaggtgcttatgtggtgggtgtgtttccgagacgctatggaatggcggtgctgtggtggtgtgagcagggccctctgtgccagccctcctaggccacctctgcataatrgatgatttcacaagcggtgtgcttgagatcagcatctgttgtcaccaggtccattctgtttgatttaccgtaggatggtgctccatgaggagtctgctaattagaaatgcggctcatctggcatgaaagagttatctctttagcagaaatgggagaattatgcagtgatgattgaaggcttaggttggttttgctggagggcaggaatcacatagggcgtggagggatcattaggctcttcacctctggagataagtcagaaattgcattcaagtaacaagaaaattatactgatatggc

SEQ ID NO: 201054 - DNA, 601 bp, Human
ataaagtttaccaggtgcttatgtggtgggtgtgtttccgagacgctatggaatggcggtgctgtggtggtgtgagcagggccctctgtgccagccctcctaggccacctctgcataatggatgatttcacaagcggtgtgcttgagatcagcatctgttgtcaccaggtccattctgtttgatttaccgtaggatggtgctccatgaggagtctgctaattagaaatgcggctcatctggcatgaaagagttatctctttagcagaaatgggagaattatgcagtgatgattgaaggctyaggttggttttgctggagggcaggaatcacatagggcgtggagggatcattaggctcttcacctctggagataagtcagaaattgcattcaagtaacaagaaaattatactgatatggctcataacttttgtacattcatacatacaaccaagaaaaaacttcaagaaattgaatatatgactcatcaccacagtaatcttgagtgaagtacccagagcttggtgccatggctcatagccaaaaggggtaaagcctgggtttgggtctcagctctgccgctaaccagcattaaactctcg

SEQ ID NO: 201055 - DNA, 601 bp, Human
taatcttgagtgaagtacccagagcttggtgccatggctcatagccaaaaggggtaaagcctgggtttgggtctcagctctgccgctaaccagcattaaactctcgtagccccagtttcttcttgagggaaaaaagtactgaaagaggcattcttaaatatacctcttatctctaaaatgatgtcgttgtaagatggagtgattggtaatataataccaaggattcttaaagtccaaaaatcaagcttataagggcagtaaagcaggactgaagttttggaaatgtacttagtttccaagytatattaaatggtaaggaagaagaaatttgcagtagcctacaaaataacatttctctttgtatttaccagtgctcctgaatcattagaaaagaatagagtagaaaacaatagaaataacatttgcgaattgcagaggatcctagagaacatttagtccagtccttgaacttgaacactgggaaactgagtttccacgcatttgatgagtatcagtgctagtactaatcacaccaagtattcttcctgtcacatcatgacttaaacaatgccatgggttacctaactcatttctgttgttc

SEQ ID NO: 201056 - DNA, 601 bp, Human
gggtaaagcctgggtttgggtctcagctctgccgctaaccagcattaaactctcgtagccccagtttcttcttgagggaaaaaagtactgaaagaggcattcttaaatatacctcttatctctaaaatgatgtcgttgtaagatggagtgattggtaatataataccaaggattcttaaagtccaaaaatcaagcttataagggcagtaaagcaggactgaagttttggaaatgtacttagtttccaagttatattaaatggtaaggaagaagaaatttgcagtagcctacaaaataacayttctctttgtatttaccagtgctcctgaatcattagaaaagaatagagtagaaaacaatagaaataacatttgcgaattgcagaggatcctagagaacatttagtccagtccttgaacttgaacactgggaaactgagtttccacgcatttgatgagtatcagtgctagtactaatcacaccaagtattcttcctgtcacatcatgacttaaacaatgccatgggttacctaactcatttctgttgttcggttgccctttgctccccacacccattgcctgccacaaaagggtattttgc

SEQ ID NO: 201057 - DNA, 601 bp, Human
aatcacaccaagtattcttcctgtcacatcatgacttaaacaatgccatgggttacctaactcatttctgttgttcggttgccctttgctccccacacccattgcctgccacaaaagggtattttgccaacttcagtatgtaaacatttagggatatagatgacgtgatcacatgtctgtttacatagttaataatttacgcatacacatttaaacttactcatataaagtcatacacaatttagaatcattactttttgctattcttacatttcaggaagctgtcctaaatggtgagtgygtcaccattgctgtcattgtctctactcaggcccccttccaggtcatttaatcccctgctcctgaacatgccctcttcactgccacctaagttgtttgagatgcagcagattttgaatctaaggatgatgctatcccaggaagttttgtcccaaaacccagtgtctcgtcacataaaattaggacaattgcatttgtaattagttaggcgtgtatttatgatctttgcaatgtggagattgacatgtggagattaactttattgatttttaaagtgattctaaaaaggctgtttgtgaga

SEQ ID NO: 201058 - DNA, 601 bp, Human
gttaataatttacgcatacacatttaaacttactcatataaagtcatacacaatttagaatcattactttttgctattcttacatttcaggaagctgtcctaaatggtgagtgcgtcaccattgctgtcattgtctctactcaggcccccttccaggtcatttaatcccctgctcctgaacatgccctcttcactgccacctaagttgtttgagatgcagcagattttgaatctaaggatgatgctatcccaggaagttttgtcccaaaacccagtgtctcgtcacataaaattaggacarttgcatttgtaattagttaggcgtgtatttatgatctttgcaatgtggagattgacatgtggagattaactttattgatttttaaagtgattctaaaaaggctgtttgtgagatccagcatttccaattttgagatcattcccacaggaataattaccgtatctgattgaatttctttacttgttattttccaacttattatttcagatggcttctatgtaatccaaatgtggaattagttgaggtcatttaaggttaatgtatcttctacaaacagtgctttgttattcaaaataaagt

SEQ ID NO: 201059 - DNA, 601 bp, Human
ggagattaactttattgatttttaaagtgattctaaaaaggctgtttgtgagatccagcatttccaattttgagatcattcccacaggaataattaccgtatctgattgaatttctttacttgttattttccaacttattatttcagatggcttctatgtaatccaaatgtggaattagttgaggtcatttaaggttaatgtatcttctacaaacagtgctttgttattcaaaataaagtaccaggcagtatgtgagatcttgtaagaagtcaggattaggggatttcccttttctgagarggaattttgaaggaaaaagcatacttatattcaggtatatattgtatatgaaagaattagtgatgaaatcatacttaataaatagtcacgtcgttaatagtgacagagacttggaatgctataggacctcaatgccaagaaagtatgatttggaattgtgtgataaggtatcatggagggtagactgaacgatttagaatagtgatgatgatagatttcagaagtgaggccaacatggacgaaagaagaaaatgtggaagtgggaatctgcatgacttacatggaatacacttgggaaac

SEQ ID NO: 201060 - DNA, 601 bp, Human
ttcagatggcttctatgtaatccaaatgtggaattagttgaggtcatttaaggttaatgtatcttctacaaacagtgctttgttattcaaaataaagtaccaggcagtatgtgagatcttgtaagaagtcaggattaggggatttcccttttctgagaaggaattttgaaggaaaaagcatacttatattcaggtatatattgtatatgaaagaattagtgatgaaatcatacttaataaatagtcacgtcgttaatagtgacagagacttggaatgctataggacctcaatgccaagaargtatgatttggaattgtgtgataaggtatcatggagggtagactgaacgatttagaatagtgatgatgatagatttcagaagtgaggccaacatggacgaaagaagaaaatgtggaagtgggaatctgcatgacttacatggaatacacttgggaaactggtctgaaagagcagagttttatgttggtggacaataggaaataaagattggagggaggataggaccagattatgaaatgtcttaaacattgtgcaacaagcttaagccgggtaatatgagcaatcagaaatcattatagg

SEQ ID NO: 201061 - DNA, 601 bp, Human
tacaaacagtgctttgttattcaaaataaagtaccaggcagtatgtgagatcttgtaagaagtcaggattaggggatttcccttttctgagaaggaattttgaaggaaaaagcatacttatattcaggtatatattgtatatgaaagaattagtgatgaaatcatacttaataaatagtcacgtcgttaatagtgacagagacttggaatgctataggacctcaatgccaagaaagtatgatttggaattgtgtgataaggtatcatggagggtagactgaacgatttagaatagtgatgrtgatagatttcagaagtgaggccaacatggacgaaagaagaaaatgtggaagtgggaatctgcatgacttacatggaatacacttgggaaactggtctgaaagagcagagttttatgttggtggacaataggaaataaagattggagggaggataggaccagattatgaaatgtcttaaacattgtgcaacaagcttaagccgggtaatatgagcaatcagaaatcattataggtttatgaacagacagaatcagaaagaagatggtgaagtcaacattaggcagactttggttgtggtg

SEQ ID NO: 201062 - DNA, 601 bp, Human
gaacgatttagaatagtgatgatgatagatttcagaagtgaggccaacatggacgaaagaagaaaatgtggaagtgggaatctgcatgacttacatggaatacacttgggaaactggtctgaaagagcagagttttatgttggtggacaataggaaataaagattggagggaggataggaccagattatgaaatgtcttaaacattgtgcaacaagcttaagccgggtaatatgagcaatcagaaatcattataggtttatgaacagacagaatcagaaagaagatggtgaagtcaacatyaggcagactttggttgtggtggaatgcaaactggattagcagagggagataatggcagtcaagaggctcgttggagagcttttcagctgtttagatgtgttaccacaagaaactggactagagtggcagcaggaaaacagcaaagaagagatggatatgcaccattttgatggaagaacctacggtatctgctagcaggaaagggaaggatgaaaattacacaaagatgattctagggtttctaacctgaaatagaatgatagtgcaagtaatagaagtaggaagacttttgaggagtct

SEQ ID NO: 201063 - DNA, 601 bp, Human
tcagaagtgaggccaacatggacgaaagaagaaaatgtggaagtgggaatctgcatgacttacatggaatacacttgggaaactggtctgaaagagcagagttttatgttggtggacaataggaaataaagattggagggaggataggaccagattatgaaatgtcttaaacattgtgcaacaagcttaagccgggtaatatgagcaatcagaaatcattataggtttatgaacagacagaatcagaaagaagatggtgaagtcaacattaggcagactttggttgtggtggaatgcaaaytggattagcagagggagataatggcagtcaagaggctcgttggagagcttttcagctgtttagatgtgttaccacaagaaactggactagagtggcagcaggaaaacagcaaagaagagatggatatgcaccattttgatggaagaacctacggtatctgctagcaggaaagggaaggatgaaaattacacaaagatgattctagggtttctaacctgaaatagaatgatagtgcaagtaatagaagtaggaagacttttgaggagtctcgtgataaaatggtactgaaaataggggtaa

SEQ ID NO: 201064 - DNA, 601 bp, Human
tctagtgggattgaagaattaatggagtgagatagctaaggaagcaagtagaaatgaatacttgaagagaaagttattattggttgtaatgagggttagaaattactatggatgatgtagttgattgaagaggggtgaagaacaacatcactgggggtgggaggtcagataggtgagtcaggatggagtgcctctaccaatgatgaagatgccaaggaatagtagcagggaagagacatggagccagaggttctgcaggtaaatgccacacctccgtgtggctggtgataacctaattgcwtatgcttcaagtggagaaagttttattttttaaaggggaaaaggaagaatgatctttaagtagcagtgagaacaaagaggatacctatgccccttccaggatttatggaatgtgggagataaagccattcccatttgagaagacttcaagggaaaaagagtaatcaggtactacctaggtttcaatttacacaagaaggtgaagggaacatccagatggaagaatgagggcagaaagaattttgttgataagctctagaaggcacagaatgggatttgggagggaggcttgtacagggca

SEQ ID NO: 201065 - DNA, 601 bp, Human
attattggttgtaatgagggttagaaattactatggatgatgtagttgattgaagaggggtgaagaacaacatcactgggggtgggaggtcagataggtgagtcaggatggagtgcctctaccaatgatgaagatgccaaggaatagtagcagggaagagacatggagccagaggttctgcaggtaaatgccacacctccgtgtggctggtgataacctaattgcttatgcttcaagtggagaaagttttattttttaaaggggaaaaggaagaatgatctttaagtagcagtgagaacaragaggatacctatgccccttccaggatttatggaatgtgggagataaagccattcccatttgagaagacttcaagggaaaaagagtaatcaggtactacctaggtttcaatttacacaagaaggtgaagggaacatccagatggaagaatgagggcagaaagaattttgttgataagctctagaaggcacagaatgggatttgggagggaggcttgtacagggcatgggtgattttgcaaagccaggaggggttaagagtgcagtgatgatggatgacctggcgaatttagacttgctct

SEQ ID NO: 201066 - DNA, 601 bp, Human
tttctgggcattgaaaaagttcctgtgtattacttatgtttgtttaaaaggagttggtcctcaattttactcagtgttttcttttctaaaatacttgaacatatcaccataaaatcagtttgttaaaaatataaaggaaataggatactggataacagtcagccgtggcttagtgcagaatagtttgtcagagtgatctgtattttctaaggaagaagtctgataaagggaatgacctgcaagttatcccaccttgatcttaacaaagtttatgcttccgtgccttactacttattcatcrgtgatttgggatatgttagactgagcaccacaaaagttaaattagtgcaccatgggcacatcagtttgatgcagtagtaaaagcagtgccagcctctatagcgccagcctctgcagctgccacaggtgtgttctaggggtctctctgggctcagtggtcataagtaatgtcaataccaaaggtttccatgatgcagtgaataagttgaacttttaagtttgcctataattccaagttgggtacatggcttttaaaaaaattattgtaattcagtggtcataattcaagaattaatcagaa

SEQ ID NO: 201067 - DNA, 601 bp, Human
tgtttaaaaggagttggtcctcaattttactcagtgttttcttttctaaaatacttgaacatatcaccataaaatcagtttgttaaaaatataaaggaaataggatactggataacagtcagccgtggcttagtgcagaatagtttgtcagagtgatctgtattttctaaggaagaagtctgataaagggaatgacctgcaagttatcccaccttgatcttaacaaagtttatgcttccgtgccttactacttattcatcagtgatttgggatatgttagactgagcaccacaaaagttarattagtgcaccatgggcacatcagtttgatgcagtagtaaaagcagtgccagcctctatagcgccagcctctgcagctgccacaggtgtgttctaggggtctctctgggctcagtggtcataagtaatgtcaataccaaaggtttccatgatgcagtgaataagttgaacttttaagtttgcctataattccaagttgggtacatggcttttaaaaaaattattgtaattcagtggtcataattcaagaattaatcagaaatgtgaaaccatgccacatttggtgaagaatataaaacac

SEQ ID NO: 201068 - DNA, 601 bp, Human
cgtggcttagtgcagaatagtttgtcagagtgatctgtattttctaaggaagaagtctgataaagggaatgacctgcaagttatcccaccttgatcttaacaaagtttatgcttccgtgccttactacttattcatcagtgatttgggatatgttagactgagcaccacaaaagttaaattagtgcaccatgggcacatcagtttgatgcagtagtaaaagcagtgccagcctctatagcgccagcctctgcagctgccacaggtgtgttctaggggtctctctgggctcagtggtcatargtaatgtcaataccaaaggtttccatgatgcagtgaataagttgaacttttaagtttgcctataattccaagttgggtacatggcttttaaaaaaattattgtaattcagtggtcataattcaagaattaatcagaaatgtgaaaccatgccacatttggtgaagaatataaaacaccctggaaatcattcatctgtttatttcatccagcaagtatttatgaaatgccagatacatacgtggcactgttgtagttgttgaggatacagctctcatggagcttaactccaaagggggact

SEQ ID NO: 201069 - DNA, 601 bp, Human
agcctctgcagctgccacaggtgtgttctaggggtctctctgggctcagtggtcataagtaatgtcaataccaaaggtttccatgatgcagtgaataagttgaacttttaagtttgcctataattccaagttgggtacatggcttttaaaaaaattattgtaattcagtggtcataattcaagaattaatcagaaatgtgaaaccatgccacatttggtgaagaatataaaacaccctggaaatcattcatctgtttatttcatccagcaagtatttatgaaatgccagatacatacgtgrcactgttgtagttgttgaggatacagctctcatggagcttaactccaaagggggacttggactgaagtcctgccaccggaactctagcatggagacactttcagctgtagcaagaaaccttctgccatcccctaagtacagggaagacagaggctcccagctctgtgcccacccacatttttatacagggctgaaggtccatggggagcctgggtgtcatgcaccaagggtgtctcctaggtttctcaaacttgagagagcctgatggtcacacaggcagtaaatacataaataaacaag

SEQ ID NO: 201070 - DNA, 601 bp, Human
catgccacatttggtgaagaatataaaacaccctggaaatcattcatctgtttatttcatccagcaagtatttatgaaatgccagatacatacgtggcactgttgtagttgttgaggatacagctctcatggagcttaactccaaagggggacttggactgaagtcctgccaccggaactctagcatggagacactttcagctgtagcaagaaaccttctgccatcccctaagtacagggaagacagaggctcccagctctgtgcccacccacatttttatacagggctgaaggtccatgrggagcctgggtgtcatgcaccaagggtgtctcctaggtttctcaaacttgagagagcctgatggtcacacaggcagtaaatacataaataaacaagaaaatagcatatggtatgataaaagctttggaaaacagtaaccagtatgctgtgatagagaattacttggaaaattgctgtattcagggacctcagggacatattctatgaaggaagggcagtccaaactgaaatctcaaagcccaaaggagtttgccttatgatgacctgaggagagagaattccatatggacggaacagcaa

SEQ ID NO: 201071 - DNA, 601 bp, Human
gaaatcattcatctgtttatttcatccagcaagtatttatgaaatgccagatacatacgtggcactgttgtagttgttgaggatacagctctcatggagcttaactccaaagggggacttggactgaagtcctgccaccggaactctagcatggagacactttcagctgtagcaagaaaccttctgccatcccctaagtacagggaagacagaggctcccagctctgtgcccacccacatttttatacagggctgaaggtccatggggagcctgggtgtcatgcaccaagggtgtctcctrggtttctcaaacttgagagagcctgatggtcacacaggcagtaaatacataaataaacaagaaaatagcatatggtatgataaaagctttggaaaacagtaaccagtatgctgtgatagagaattacttggaaaattgctgtattcagggacctcagggacatattctatgaaggaagggcagtccaaactgaaatctcaaagcccaaaggagtttgccttatgatgacctgaggagagagaattccatatggacggaacagcaactgcaaaagctctaaggagagaacaagcttggtgt

SEQ ID NO: 201072 - DNA, 601 bp, Human
ggctgaaggtccatggggagcctgggtgtcatgcaccaagggtgtctcctaggtttctcaaacttgagagagcctgatggtcacacaggcagtaaatacataaataaacaagaaaatagcatatggtatgataaaagctttggaaaacagtaaccagtatgctgtgatagagaattacttggaaaattgctgtattcagggacctcagggacatattctatgaaggaagggcagtccaaactgaaatctcaaagcccaaaggagtttgccttatgatgacctgaggagagagaattccatrtggacggaacagcaactgcaaaagctctaaggagagaacaagcttggtgtgttgaaggactagcaagaagaaacagcgtgaccagaatgggggggagggaggggtaagggccagaccacctgagcccttgtagaagatgatgagatgtatggattttgtgatgagtacacaggaaagccattaaaggattgtgagcaaaggtttgacatgatttgtcttttaaaagatgaatatggtggaaaaagagactggttggggtagggagatgtaagagtatgaacagagctggctggtaggggt

SEQ ID NO: 201073 - DNA, 601 bp, Human
cttttaaaagatgaatatggtggaaaaagagactggttggggtagggagatgtaagagtatgaacagagctggctggtaggggttcttttagtagttcatgtaagagataatggggactcgtacctgagagctggagatgaagagaattaggtgcattcgagataccattggaaatagaattagcaggagttgttaatatggatgttgagggaaagagaaatcaaagagtactcttcgatgtggagtttaagcaaattgtagtgccctttactagagggaggaccagatttaggaaggacycaggagttttgggcaaattaaatttgacatccacatagaactatttgtcacaagcaatttttaaatgtaattcagtaactcattaagtagaattcatacatacatgctctatggtgtataattacaaagagatatccctgagaaaagtcaaatctctccagaaaaagttataacctcatcaggagtttgtatagaaaaataagaataacctactttgcagtgatttatcaccaggcagaaactggctgaagaggtgtctgtgttatccataaaatgtgttttcatcattgctgcatcaca

SEQ ID NO: 201074 - DNA, 601 bp, Human
ctgagaaaagtcaaatctctccagaaaaagttataacctcatcaggagtttgtatagaaaaataagaataacctactttgcagtgatttatcaccaggcagaaactggctgaagaggtgtctgtgttatccataaaatgtgttttcatcattgctgcatcacacatcacatgggttagattggtgtagaatatgtggaacctagtgctgcttgcacagtgaacattttgcaaaaggaggaagacacttagggctttagataattctcctctgttttagctgaaaacgtttggagaacgttraatggtttatgatttttggctgttttgaattatttcctctatatagagaaaaaatagacaatcaaaaattggcgtgtgatactatacatcattgttttatattgagtggacaaataagaaccgtgttgcattcataagatggataaatcaaggaaggttttgtggaggaactaggaattgggtccaactctgagaaatttgttgattggctcagcagaagggaaggagagtttaagagcagccttggatagaaaagagaggacggacagagaggtacagataggaagatattaaggaggc

SEQ ID NO: 201075 - DNA, 601 bp, Human
gagaacgttgaatggtttatgatttttggctgttttgaattatttcctctatatagagaaaaaatagacaatcaaaaattggcgtgtgatactatacatcattgttttatattgagtggacaaataagaaccgtgttgcattcataagatggataaatcaaggaaggttttgtggaggaactaggaattgggtccaactctgagaaatttgttgattggctcagcagaagggaaggagagtttaagagcagccttggatagaaaagagaggacggacagagaggtacagataggaagataytaaggaggccaaatcagtgggcttcagtggctgattgactttcggggatgaagaaagggaagacttccagattgtgggaggactattatcaagataaatgctggagaggaggtggtcaggatagattttgggaggatgataggatatattgtggtgtcatttattagaatgtgaaatacaaggagagcagctttgtgggaggttggatgaggtaggtactctgtttggttatgtttgaggtatctatggagaatcaaggggaggatgagagttacaggtctggaactcagagagagatct

SEQ ID NO: 201076 - DNA, 601 bp, Human
tagaatgtgaaatacaaggagagcagctttgtgggaggttggatgaggtaggtactctgtttggttatgtttgaggtatctatggagaatcaaggggaggatgagagttacaggtctggaactcagagagagatctgagctggagataagaatttatgagtcaccctctgagggagactgtggtgtctaatgactttttgagtacataaatgatgtgaggagtatgagcatttttaggaagattaatgtgacagtaatgtgcataatggaggaaaaaagtgactggcaatgttaacacacsaagagtgataccaagtgtatcttatacaaaaggaccccgtgcagggaagctggcacaggaagtgactcctctgttagcatggtagaagaaaatccaagggttgctactgttagccaagtgaaagtctaaaacacaattgccagtgcccatgatattgagatgtataaaatggaatacattattttaattaattgttaattgattggttgactaatttatactcccttgttcaaaaaagcctttaaaagtatctgactatagtagagctggtcagacccacacctggaattagggctagtt

SEQ ID NO: 201077 - DNA, 601 bp, Human
aagtgtatcttatacaaaaggaccccgtgcagggaagctggcacaggaagtgactcctctgttagcatggtagaagaaaatccaagggttgctactgttagccaagtgaaagtctaaaacacaattgccagtgcccatgatattgagatgtataaaatggaatacattattttaattaattgttaattgattggttgactaatttatactcccttgttcaaaaaagcctttaaaagtatctgactatagtagagctggtcagacccacacctggaattagggctagttcagagtagaagcrctgaaatgattaagtaattggatagagaggtcaagaaataggattatagtcatagactctttcagtccagaaggtactcagcattctctacaagtaccttccgaggcgaccgctttcagtttagagctgctttaattgttgattcattcatgcatttattcatgtattcattcaaaaagaatgtattgagcacatgccatgtgccactacacctcagattcactagggcaaatttagtttgcttttacctgaggactattttctaaatgacctaaattgcaacacattttcaatatacta

SEQ ID NO: 201078 - DNA, 601 bp, Human
agaagcacacacacatatacatattcgtgtgtatgtatatgtatatctgtaaacacagatatgtaaagtgactttaaaatacaagtacatgtgtttcattttaaattctagcgatgtcattgggaaagaaagtgtagacaaagttacatatttttgtaagtagtgtacttttatttacgttgacagttaatatttaaaaattttttgttacagatacaaattttggggagaattgtccttagaaacatgttttaaatcgttgttctgatgtcttgataactggtaccaggaaaataaaagkgttaccaaaaggcagaaaccagtttcaaattatctgggaaataaaaacaggaaactcagggaacttggcctgagaccagttggagaggagcagttgttggttgaataattatacctgcattttaactgttggaagtcatacagcgaccttctggttgttgtgatttcttgtgcccgtcaaaaaaaaaaaaaaaaaaggaagtcacgattaaatatcttatgtccagttaccaacaggagtgtgagtgtaaaggagcctctttattcctacacattaggttacaaaaaggattggtataaa

SEQ ID NO: 201079 - DNA, 601 bp, Human
aaacagcataataatgttctataccattcattcatggattttttttcaccttcttctttgctttaactcttaactctgagctttgaagccatctcttctgtccaaagatgtgcctagttcaagcacttttctgtcctctttccatacctaatcccaggttggttaaaggagcaccagaagttgtaggtgagcaggttttgctacatctgggctttatttcaggattaaatagaatgtacttactatgtgtttttaaaagagacttattgttaatattgcaaggacaaaaacaacctgacasgttgagccagataaatggtgttcttgagggccgtgcctaaaacttcaccaacccaggatgcctaaaaaatgttggtctaatgactgaccttagcagggtgacatgttcactgctggggtagccctgagcactcctgcgcgtgtttgtggtttctgacttggctgtaggtgacctctcagtttttcccagggctcggcgtgtgctctgtaacacagagctgctgagttgctgctttgcccagctgtgtccggctaagccctggcccccacaaaggtttttcctgacatgagaaaggatctg

SEQ ID NO: 201080 - DNA, 601 bp, Human
aatcttaattgtgaaattcatattgaattcaatccagaaagaaggagcaaggatttctgcagtcaatgataccccttcctgactgagccctgctcacttggggaggattgtcctggggctggcccattgcataggggcatttgagatgaatatggaaaggacctcgccctaagaagtctagtgggagagatcatagacacaaggagttataatgagggtagagcagccatacccagtctgaatagtgttatgcccggtagacattctagaagacattgataaacaagaatcaaagctaacyttaatcagtttaaaagctactttgtgatttatagacacatatgtttacttctagaattggcacttctttgttctttgtgaaatgtgtaacttaagaaaggtatttaggagcactaaaattaaatatttgagtttttttaaagaagcattctaataataaaatttgactcattccctagttcatattgaccttcactaagcatactgttctggggcatttgaataatttgtttcaaaagctatgagaccattcttttaatggtgcatacgctctaagataagaataatggattcccattgg

SEQ ID NO: 201081 - DNA, 601 bp, Human
gaccttgcttgctgacttttttaaggcatgaaacaaattctcatattctcagtcgtgtctgacgcagatctgggtactagtcagggttctaaactgcctaaataaatatcttgcatataacatctaaagtgacatttatctctgtggtactaaaaagaaaatactattccacttacatgttcttggtgccctttggcattttgattgctaattacaataggaccttcagattgccttctgattgagacctaacttatttctgtttcatctggaatttttcaaatacaattattatgtggtrttaacacttcattgcagcatggaactcccaaaaatgttgtgtatatattctttcatgcctctcagcctggcttcatgtctgtctaggtacaggtcttattataatgttgcccttgggggtccttttgatatatcaagaactaaacctctttagtcaggagagtgtattctgtatggatttataataaatagtctgtgttcatatgcataggaaataatgcattttctgaaaaaaattatgcatgtcacttgtattttttgtactttatgtgccggaagaacattgtatacaaatatgtcc

SEQ ID NO: 201082 - DNA, 601 bp, Human
ttctaaactgcctaaataaatatcttgcatataacatctaaagtgacatttatctctgtggtactaaaaagaaaatactattccacttacatgttcttggtgccctttggcattttgattgctaattacaataggaccttcagattgccttctgattgagacctaacttatttctgtttcatctggaatttttcaaatacaattattatgtggtgttaacacttcattgcagcatggaactcccaaaaatgttgtgtatatattctttcatgcctctcagcctggcttcatgtctgtctargtacaggtcttattataatgttgcccttgggggtccttttgatatatcaagaactaaacctctttagtcaggagagtgtattctgtatggatttataataaatagtctgtgttcatatgcataggaaataatgcattttctgaaaaaaattatgcatgtcacttgtattttttgtactttatgtgccggaagaacattgtatacaaatatgtcccatgtgcatgtatgaatttatatagctacatgtatataagcacatatacatccatgatgatatcataggtaatatgtggaaataag

SEQ ID NO: 201083 - DNA, 601 bp, Human
aacctctttagtcaggagagtgtattctgtatggatttataataaatagtctgtgttcatatgcataggaaataatgcattttctgaaaaaaattatgcatgtcacttgtattttttgtactttatgtgccggaagaacattgtatacaaatatgtcccatgtgcatgtatgaatttatatagctacatgtatataagcacatatacatccatgatgatatcataggtaatatgtggaaataagtgcaaccatgtgattatttttatcttattctttgtgtgtgtgtgtgtgtgtgtgtggacagttacctgtgtgctattaaatgtgacagtgccgataatagtgttacattctctggttaagtgtttcctgagaattttggtcttccttaatggtgcacattagttatagactcttaacccgtgagatacattccagtggttcgtttctaagaatcgatgtaatattatgcactttgtaaatagcttatagaggataagctatgactcctgaaataaatattattcaaactgcttccattttcatttcccttatcactataacaaccacacccaactttgcaattaaattgtgttgtct

SEQ ID NO: 201084 - DNA, 601 bp, Human
aataaatgaatatccccaggaaaaaggttataaaattacaacacctagacacattgaggtaggtagtaaatgtgaaatgggcttacgaatgactttattcacttactggcatttgggagggactcaggctgtcaggaaaatgaaccaatctgtattaatataaagcgctagaaatataaataaatcatgtttgaaagcgataccaggattttccttgaatgctgctgaataaattctgcttgttaaatgtcagtgaaatgtatgtcacctgcatgcataaagtgagagggccacaaaaaayatccacttaccactttgaaatatgtaagccctttaatgttcctttgaccttcagttaaaggacatagtctcatagcagaggaaatgcctcaaattctagcatctgggtttgtttctttatacttttttggcatagttacaacagtagggcttttctgtcctttaatttttttcacagtacagtcaacacaggcttttcacacaagcgggaaaggacggttgtgaggccaaaagcaatatgtttcttctctgtgctccacggcagagcctaattgaatggcttgttgtttcagagagagcc

SEQ ID NO: 201085 - DNA, 601 bp, Human
gacacacaaaagcttgttttgtctgaagtttatatgtttattctgtagagttacattggatagggtagttatcagcccttagcaaatgcctacttagttttccttaatctgttattcattcattcattcaacaaatatttattgagcgcctgctctgttcagacactgtgctagattcagggcaaacaagacagataaggttctagtccccccccgagctttcagtcttaagtggcaaaaataaaattatgtgattgctgttgacgtacagggtactgagactgagataggatagcttgasaaagtctctcctctgaagagctgatgttttaagttggactgaaaggtaagaaggagctggctgtgcaaagagctcgtggaagaacattctagacagagtgaacttgcccatgttcagtgaccccagtatgggagaaagagttttgtgtcccgagggacttaaagttgtgatgtggctgtagtgtattgagtgagtgttggggagagtggcagaagaggaagctggagaggcagggaagggctcagttacacagacaacatggtaaggagtttggattttattctaagtataataggaatc

SEQ ID NO: 201086 - DNA, 601 bp, Human
ggatagcttgagaaagtctctcctctgaagagctgatgttttaagttggactgaaaggtaagaaggagctggctgtgcaaagagctcgtggaagaacattctagacagagtgaacttgcccatgttcagtgaccccagtatgggagaaagagttttgtgtcccgagggacttaaagttgtgatgtggctgtagtgtattgagtgagtgttggggagagtggcagaagaggaagctggagaggcagggaagggctcagttacacagacaacatggtaaggagtttggattttattctaagtrtaataggaatccatgaaagagtttgaagcttcagatggagatgagaggatgccctttttaagatcaactgtggctgccatgtggaaaatggattgtagcgggaagctagagtagaatcagaaacattatttaggccactgaagaagagcccagccaggagactgctatgtggctggaccagggtgctagcagaggagttggatagattctctgttccatttggaaatacagttaaaagggctcaattaggttggatttgggggtgaggttgggggtagacttcagagtgaccccagggtt

SEQ ID NO: 201087 - DNA, 601 bp, Human
acagaaggaaagtcatatttgctgtgtgcagttggaagaaaccctggcacagttcctccagaaaccaaagacagaaattattagccatatccagaccagtagctgactggctccaattcttcctcccatgagctttcctgattaatgggagaatctgttctgtagtcgaacagcctctttcctgagcccagtctgtcctggcttcagagcatgaccagctgtgcagctgaagccattgccagggctctgtttctgattctgctcctcagcatgttggaggtgttggacggggaagcagagrggtgggaagagcatccaggtcagtttagatgtttcagcaggtaacagacgtggcaccgtccacccagaatcccgccactcccattggactctgtcctcttcagaaggctgtcattctgcatggtgcagatgttgcagtccttcccttattcttttgtctttttgtccagaccacttagctcctgtgtctgtggtgattaaatgctttgtaactttttctgacatccttttcttcacccctcttctctcttcccctactgtctcgcccaccatacctcttctgttttctgtttgcctttct

SEQ ID NO: 201088 - DNA, 601 bp, Human
ccagtagctgactggctccaattcttcctcccatgagctttcctgattaatgggagaatctgttctgtagtcgaacagcctctttcctgagcccagtctgtcctggcttcagagcatgaccagctgtgcagctgaagccattgccagggctctgtttctgattctgctcctcagcatgttggaggtgttggacggggaagcagaggggtgggaagagcatccaggtcagtttagatgtttcagcaggtaacagacgtggcaccgtccacccagaatcccgccactcccattggactctgtsctcttcagaaggctgtcattctgcatggtgcagatgttgcagtccttcccttattcttttgtctttttgtccagaccacttagctcctgtgtctgtggtgattaaatgctttgtaactttttctgacatccttttcttcacccctcttctctcttcccctactgtctcgcccaccatacctcttctgttttctgtttgcctttctttcctctcagctattgcattttcccctttacactgaaatagctttgtttattggcctgtttccagcaatattaacatatttcaattttttactca

SEQ ID NO: 201089 - DNA, 601 bp, Human
agtagctgggaatatatgtgcacaccaccctgcctggcgaatttttgtattttttgtaaagatggcatttcactgtgttgcctgggctggtcttgaactcctgggctcaggcagtccacccacctcggcctcccaaagtgctggcattacaggggtgagccaccgtgcccagccacttgagctctttattctgccatgtccgggttccccttttctatgcaatgcagaggtggtataaagccactaaaccaaggaatcagcttcagaaacaaggtaaagctgccttcactcaatgggaaakcacatctatagatcaccgctctgttggcagggtcagatgactgaggtgtcttgtgtcttgatcaaaagttttgtttccactgggtctctgtcctgaggtctccatggatctgtgaccttggacaagtcatttaacccctaggcaccttccttgccctctctgttaaaatgagatgatggtcccagcgctgtcttaggcctctgtgtcaccaccactggagttgtttaaaatccaggctgtataggttctgtctcctcttctcctcccactgccttccccacttctccttcctctctcctg

SEQ ID NO: 201090 - DNA, 601 bp, Human
gctgtcttaggcctctgtgtcaccaccactggagttgtttaaaatccaggctgtataggttctgtctcctcttctcctcccactgccttccccacttctccttcctctctcctgctgtagtcattagcctgatgtatcctgacagtatccctgtaataaatataagtggaatttgctaattaaatgctagcatttttaaagaaagtttccagcaattggtagagtagctgagtggtttataggcttcctattcaagagggaggtgtcctaaggtttaaaattaaggttctagtcataaagraggcttttattattaggacaacatggtaatttggttgagagaggacttactctctgcaacattaaaacatacatatacttttgacagtttcagtagtagctttgtccttttgatttacttctttggacagttgtgattgacatcagattgaacacatggttcagtaaaaactacagctccttgaagtacttttgttaatattctaatctcctatttgcatcattaacaagagcacattttattgccgcttgaaatagactcattgacatcccagaataggtagttttgatattagctact

SEQ ID NO: 201091 - DNA, 601 bp, Human
ggatatacctgtaccagttaatagagtgtgtagttaataaaaggtggcagggtggtaaacctttctccccctgcataattgaatagttttaagtgccatttgaaatcctgaatatccaagattggattccaataactgtgtagcctgagaagctttgctgtcagcagctgctggtgtttgtaagagttatttcactacttatcgctcttcagattcaccatgaatttaggtagtaatttaccattgcagaaggggcaagctctgcttctgatagtgttatgatactatgtttttgcttccytaatgatacgattcttgaggtagaaaaattaaaaatatgtggtataaatcagcttcatgaattaaattccccagatttaatgatgacagttttattcctgggatgcttacgctataactccctaaatgcttcatttaatacttcggaaatggttgttctcataggagctgttattgcaaagtcagtaatggctctggggctgaaatttgctttcttaattctagtccattgtcttttgttgtcatgtttcctcagtttccttagatatgtcacaccaaggactggttacagaaatactgc

SEQ ID NO: 201092 - DNA, 601 bp, Human
gtaatttaccattgcagaaggggcaagctctgcttctgatagtgttatgatactatgtttttgcttccttaatgatacgattcttgaggtagaaaaattaaaaatatgtggtataaatcagcttcatgaattaaattccccagatttaatgatgacagttttattcctgggatgcttacgctataactccctaaatgcttcatttaatacttcggaaatggttgttctcataggagctgttattgcaaagtcagtaatggctctggggctgaaatttgctttcttaattctagtccattgycttttgttgtcatgtttcctcagtttccttagatatgtcacaccaaggactggttacagaaatactgcagtgcattatccaatctaagcctgctttactttctttcaaatgagcttttaagcatataagtagcgtatataatggaaacagaatttagggtgcttaggtaagaaaggaattacttccatactagagtattttacagctttgtttgatctcttaattgtctagatcagagattcttgggtactttcaaattcattttaatgtaccatagccctttaaaaatgacaaataaat

SEQ ID NO: 201093 - DNA, 601 bp, Human
aggtaagtagtcctatactggggatcctaagctagagtcagcttggactcgttgaaccacgtgaccacccagggtttcctatagagcacgtttttagctatttaaaataattaccatgctggacctggagacctgtgaatagtccataaagttaattacaccttgagacacaccctctgctcagctactcaagtaccgtatccactttacaatgttcctttgttaacaagatctatgtggttgaagtatgtattatagtaatgtgcaattcattgtgtacagacatttccaaagtaagatratggtaataattacacagtaaaagagttcaggccttttgcgattgttgtgtagctaggatcggaaggctttgtaaacttgatatgtttttgcatactttgggttggtgctacctgattatggtactaaagtatttgagtcctctgcccttgtatcatttgtttgttagactttacattgttgactgggttccatgatttataaaaagatcccagaatcttttgtaactatttaaaggtcagcagctaatgataatcagaactaataatagatgcttacttatgcgccaggtattagtcta

SEQ ID NO: 201094 - DNA, 601 bp, Human
ttcctttgttaacaagatctatgtggttgaagtatgtattatagtaatgtgcaattcattgtgtacagacatttccaaagtaagataatggtaataattacacagtaaaagagttcaggccttttgcgattgttgtgtagctaggatcggaaggctttgtaaacttgatatgtttttgcatactttgggttggtgctacctgattatggtactaaagtatttgagtcctctgcccttgtatcatttgtttgttagactttacattgttgactgggttccatgatttataaaaagatcccaraatcttttgtaactatttaaaggtcagcagctaatgataatcagaactaataatagatgcttacttatgcgccaggtattagtctaagccattgatgtgttagttaatacctctcaacaagtaagtgaggtagagacttttattattttatagatgaggaagctgaagctaggaaaggtgactgaggcccacagacttgtagtaagtggtagaacaaactaggcagacaggtacgtaggtaggtggatagaaagaaatagagaaaaaaagagatttaagaatagtagaaggtgtcagtaa

SEQ ID NO: 201095 - DNA, 601 bp, Human
gcccagtcctcatggaaatcacatttggtcatggattaccctgatataagtgtaaataattaatgatgcaatgtgaacattttataaagtaggttgtgcataaagtctacgaaaatagactgagagaaggaatccaacttgtaggggaggcagagatgaagagatattcacagaggagaaggcttttgcttaaagatgaccacagtgccctttgagagtgggaaccatgtattgttcaaccgtgtctctccagatctctagcaaagtgcccaggatgtcatggttgctcagtaaatgttgsgtggtaggtggtagcagtctggccagatgggtgaatgttggggaagagcattgtaggagatggacatatctgatgaaaagcacagaggcagataaggccatggtatgctcatccacagtagggctgtgtccttgggaagtaggacatatgggagcatggccactgtgctacttcacacatcactctccttttacttttagtctctactcccaacatcctcactttacctgctttaaatcgtatttgtatttcaaaaccctgataaaaatttctcacttcctccgtgaagttttttcagca

SEQ ID NO: 201096 - DNA, 601 bp, Human
tgctacttcacacatcactctccttttacttttagtctctactcccaacatcctcactttacctgctttaaatcgtatttgtatttcaaaaccctgataaaaatttctcacttcctccgtgaagttttttcagcagttgccatgcaccctagtctctcctttctctagtcacaatcctttttgttcctgccactcatgagcctcaatggatatctcacttacactgatttgatctttacaaattgtatgcatgtattaaattatcatatgtacccacccccaaaatataacagattgcctscagtcacctctttgattattgttttcttttgttaaattatttcctctattctctcttcttggagtgcagagaaccttaggattcatatgctacccttcctattggtacaagaggacacggaagcccattgagatgaaaataattgtccaaatcacgtaagcagttaaagtcaggcccgggactgagtccatggctgagaccaatccatgctagctaatgttcctcttgttcttccgagctcagtagtgagtttgtggaggtgagggactgggtatcatactcactgtgggtcaagtagct

SEQ ID NO: 201097 - DNA, 601 bp, Human
ttaaaactatttcactaggagtactggtacaggtcggtgttagactcattactgaaaactcacttgaagaactctattagctttacatatttctagcagattaaacttagattacttacttttaaattattattggaagttagtctaagttattttccaatatagaatcattgtcttaatttaataattcttgcttcacaataacataatttggaacggaaattagattccagagtgcccttgtaattacaaattgaaaaatccttttctgactcaaaagggggcttactggtgacaaatkccattatcagcaacattctcatcagaggctcagatgaggtggtgccttctgatgcattcttaagtgggtaatgggtagaagagttaggtgtgaggttattgctaaatacgaataaccatgaattatacaagatttattactcagaaaccaacagagtagagccttgcaattcattgctttaacattcatgaattcagttatttatgaaacagtgacccagaggatccatgtcatgtagtggtttgtcatttgaatcaggtgaagcccctgtgcaggggaaaatcacttagctggtgacaa

SEQ ID NO: 201098 - DNA, 601 bp, Human
gcctctttggaagaaattatcttgaatagggaagatagtgaagaactggtatgtccaagtagaactaggaattagagcaatagtctggatcctggagctcagaaaatgggcagtaagtcagggacaaaaggtggcttcttaatctgttgttaaaaattacttagagtagaaattcacattgagccagtccatcaagctcccagtatcactaaagaaaacctgtggtactaccactcccccttgtttatatctgacctcccacaaggctccttttttgtatgtgtagtgctttccctattcmagacacatttttatgttttttaattataacatggacaaaggatagcattgacataaaccccaaattttaataaatgactttcctgaaaatgagagtagcagtgactttaaaaatggtaagaaaaggagccgtgcgcagtggctcacgcctgtaatcccagcactttgggaggctgaggcgggtggatcacgaggtcaggaattcaagaccagcctgactaacatggtgaaaccccatctctgctaaaaatacaaaaattagccgggtgtagtggtgtgcgcctataatcccaactactca

SEQ ID NO: 201099 - DNA, 601 bp, Human
gttgcagtgagccgagatcgcaccactgcactccagcctgggtgacagagtgaaactctgtctcaaaaaaaaaaaagaaagaaaagaaaaagaagaggagaaaatggggaagaaatagagaaggctggcttcatcctcctcatttgctaggtaggagatctgcagtgccttcacaagactagggaggcagatgcatccactcaatatagggatagagtctttcagccatcagcaggagatgttcaggtaattaacttcccctcataaaaccaaggatcagaacaagagcagagaagcactrtttgaactgtgaggaagccatggcagcatgagagggtcttgtagacagaaagctttcagaggtgggagccgtaacaagccaaggcctgaagcagacacacaacttccacaggaagcattctaccatctttcatgttgagacaccctgtctagtcttaccagtggctctggtggaagagcttctactttcctctggctggacttcatcttctgaatgggttaaggagactgccagaggtctaaacttctggggattcagttgttacagagaagtccctatggtatggaggccctaggttgt

SEQ ID NO: 201100 - DNA, 601 bp, Human
aggctgaaccccatcttgccctggaagatggctttgagccagaagccaagccctttaatggctatgaaggggggaaaaagtatgatttccatgtaagggctaccaagaatataagtacctatttaataaattatttgttgaaatgccttttctattttggtagttgaagtttgaaaaatgtttggagtactataattatcatttctgggaaaaaaatacacattgcagtatttttgtttttgctacaggtcaagttgtagttcaggatggaaagtaaacacatccctttgctcagctgcarctcacatatttgtagtctctgggtgccctcttggcagtcgtggtggatacccaaaggacacaaacagggcatagaaacgcggggctccatcaggggcttgccccagtgcaagtctgattaggaagtttgctggagccgaaggaatggcccagaagggtggagatgccttcacagaaggagtcctaggaccagaatgaggctgttctcagaggcatgcccacctctgggaggggtctgcagaagcactttctcaccagggagagcctttatggtatgggtctaaacactgggagatctttg

SEQ ID NO: 201101 - DNA, 601 bp, Human
gggaaaaagtatgatttccatgtaagggctaccaagaatataagtacctatttaataaattatttgttgaaatgccttttctattttggtagttgaagtttgaaaaatgtttggagtactataattatcatttctgggaaaaaaatacacattgcagtatttttgtttttgctacaggtcaagttgtagttcaggatggaaagtaaacacatccctttgctcagctgcagctcacatatttgtagtctctgggtgccctcttggcagtcgtggtggatacccaaaggacacaaacagggcrtagaaacgcggggctccatcaggggcttgccccagtgcaagtctgattaggaagtttgctggagccgaaggaatggcccagaagggtggagatgccttcacagaaggagtcctaggaccagaatgaggctgttctcagaggcatgcccacctctgggaggggtctgcagaagcactttctcaccagggagagcctttatggtatgggtctaaacactgggagatctttgtttgtttttggaggcactccttaccattctatgccatcttgtcaatttgacaactttgtaaacagggccca

SEQ ID NO: 201102 - DNA, 601 bp, Human
tcagtaggatgcaaacaggccacatttggcatccggctctcccactccccagtccttccaccccactacctcccataaaaggcaaatcctggaagccactctgaacttttttccttcctcccaggaagctctgacttttccaggaagattccagggaacactagttggatccgatttcctaagaattaaagcagctttaaatctcctgggagtgtagaggatgaaggggttgagggtccctagaacaataggtcagcattgactgcagattggagtcagctggggaactgtaaaaaaaaawatataccgataccagggtaccacttccagtaattctgtttaattggaattggtctggggtgcactctgagcttttggatttttaatcttctcctagggtttttaatgggcagctgaggttgacagtcattattctggcactaaattttcaaactatagtatgcatgagaatcacctctagggtttgttcaaacccagattaccgagccccactcccagcatttctgattctgtaggtctggtgggccttagaatttgcacttctagcgagctccttaggagatgccgatgctgctggtgc

SEQ ID NO: 201103 - DNA, 601 bp, Human
ttcctcccaggaagctctgacttttccaggaagattccagggaacactagttggatccgatttcctaagaattaaagcagctttaaatctcctgggagtgtagaggatgaaggggttgagggtccctagaacaataggtcagcattgactgcagattggagtcagctggggaactgtaaaaaaaaatatataccgataccagggtaccacttccagtaattctgtttaattggaattggtctggggtgcactctgagcttttggatttttaatcttctcctagggtttttaatgggcagcygaggttgacagtcattattctggcactaaattttcaaactatagtatgcatgagaatcacctctagggtttgttcaaacccagattaccgagccccactcccagcatttctgattctgtaggtctggtgggccttagaatttgcacttctagcgagctccttaggagatgccgatgctgctggtgcaaggatcattgtttgagaaccatcactttagagcagttcatctcaaactttactgtgcatcttgctaaaatgcagattctgattcagtaggactggagtgaggtctaagtttct

SEQ ID NO: 201104 - DNA, 601 bp, Human
tatcacatgatatctctaaggccaaggaacaagtgaaatagaacagccagcaagaaagtaatgaggatacgctaaagacactgaacctctttatctttgcaaattaattttgtcctctgtatttaagcaaaaatgtagctattgactaaatatacagataccagcaacgccgagtaggaaagttgaagctcttcttgcttttggcattatggacgactagtgggaaaatcatgggctttggcagttctgccacttgctttgtgaccttggccaagtttcttatcctctctgggtctctctyttcatctgtcaagtagacatgaagatataatctcttcttcacacaggagtacaaaggcgtgtgagaatgagtagaggcgtgccccacacgtaggagatgctcaattagtagagatttctttcatttctccagcatgaccatgagaatttaatgcttaataagaagcattatccatcaaaacatttttcttgttgagtctttattggtattttctgcctattaattgtatcagtttagatttcttattaataatcatgaagtctgtttttccacttgaagagtaggccctttcttcttgct

SEQ ID NO: 201105 - DNA, 601 bp, Human
tccagaattgtaattctcaaggttggtctccctgtgctactgagtgaccaagggcccccgtgatactctaggctgataccacggctactctagggctttagattataaaagacatcagagggaggtgtcggaaaaaacagtgaccccagactcttctcttgactttgtgttctacctactaaatttccgctatcaaatataatccaaatttggggtcctttgaattccccgaagtagcttgaaccgcccaaggattgtctcaggatggctgtgtatctcactgtgtgtgtgtgtgtgtgttagtgagagagagacagagagagagaatgaagaacgagaagagatttcaaaatagaagttttcagtgtcagatgtatgggactctacaaactttaaatagaaataatggtaatctgccaatgtaatttttatcttctttttttttcctcttactaccagtagtttttcatttgtctttgtgttttatttaaatttgcttttaagcagaagctcttgcatgcatttgcttctcgtagatcatgattgtattaggttggtgcaaaagtaatcgcagtttttgtcattactttcaatggcaaaa

SEQ ID NO: 201106 - DNA, 601 bp, Human
gaggcaggagaatggcgtgaaccggggaggcagagcttgcagtgaaccaagattgcaccactgtactccagcctgggtgacagagcgagactccatctcaaaaaaaaaaagagttagtgtaactttgaaactaaaattggataaggccaacataaaaagagagagaactaaagatgaacattactcaagtttataaatttaaaaatcttaaaatgttaggaagtcaaattcaacaggatctttaaaaacagtttattcttagaacacaaggatgatttaaaatccaaccgattatattaataaagagaaagccagtgtgattgatcatcttgaaaagttgaaaagcatttaataagatttaacctgcatttttaacattcttacatcccttctagccgtcaaactctgatcgacttacacttaagactgtgtctttggtagcctaccctattccacttttattacaaaggcagctcttaagacataaatccatctcttcaggctcgaactgcaaaacacacgtcgagaggtgacaatgttgggactgtcaaaaagaacttaaagagtgggataaccagccgggcgcggtggctcactcctg

SEQ ID NO: 201107 - DNA, 601 bp, Human
tatccaacaggaaaattaagtgtagtcataaggtaggtggcagaaggaaggcagcattaagactcaacccatctcatctcgttctccaacacacccggtacccagctgtggtaaacagtgctagtatttgtcttcctccatattctttcttgccaagtgcctttccaacctcctcccacgtctccttcctccccagatattgtgtgccttcctgttgttgcccaggttcccaaagtcctatctttctaagaagggacctgtttttctgaattattctcttcctctttctatataatcaaakctctaatttgtcccatagtgaacggtacagtcttgaaaatggcataaggggttctaaatcgccaggtacccctgctgctcatccaacctcatctcctgtttgtcctctcactgtgcctcagccacactgacgttcttactcttcctgggacacacaagcctgcgtcagcagttccttctgctgggatgctcttctccaaagtatctccgtggctcgtcccctcactccttcaagtctttgttcagccgtaaacttctcaatcatgcccatccattctcaccacattgtaactgctaccca

SEQ ID NO: 201108 - DNA, 601 bp, Human
ttacttatgttctgtcatcctccaccaccatatcaactaacaaggtcaggaacctgtgtctttcctctttactgacatatcccaagctgctgaagcaacaggtgctcagtcaatgtttcagtgaatttactagaactataagtatgaagagtctcctatattatgtcttaggtagacaagaaatagataaggaagaggaaagatacagcaatcaaggtagaaaatgactagaggaacaggcatggttttaaaaagagatccactgctatgatatcaagacctgagtggactggaatgaggygacctggattcttgctttaagtttaccaatgaccttagccaggtcacttaagctctggggcctcagacgttctttatctacaaaatgagaaaactaaactaggtgaccttttgggtcttatcctactacccaattctgtgtttgggttttactttaggaagaccaattaacacttacggaaacattgcctggtactaactggcatcaatttcacctaatgtctcctgaactccccatctcccaccaaaggtcctgggctgggatgatgtcttttagtctatttccatcttttcctcaagg

SEQ ID NO: 201109 - DNA, 601 bp, Human
aaaactaaactaggtgaccttttgggtcttatcctactacccaattctgtgtttgggttttactttaggaagaccaattaacacttacggaaacattgcctggtactaactggcatcaatttcacctaatgtctcctgaactccccatctcccaccaaaggtcctgggctgggatgatgtcttttagtctatttccatcttttcctcaagggccttatgttcgtataggtctcttaaaactcaacccaagaagctaaactgtggactggggtttcagaagccagggctttgctcctccatygtaaaatctgagtaaacccacattgttttatttttcgcatctctaaaattgagatacagcaatgggtcggcagataatattagacagaggggaataaggtgcatttgatggagctctgctagaaatagaagcacatcaggtgccatttcaggaaattacacgggaatttggctcattatccatcttgctaagctgccacatcgtaaagtcacagactattaatagaataccattgataactcagagtgtgcaggtagagttcctccatgttgattgtcgtacacattgtctccagtttct

SEQ ID NO: 201110 - DNA, 601 bp, Human
gtgtgcaggtagagttcctccatgttgattgtcgtacacattgtctccagtttctgaagtagccatgatttgtttgtgttttaaggtacactgttttcaaagaacagcctttaaagctcttttgaattcaaagatctttcagttactcaaggaatgggtccagttttcagattctccacgccatgggtgcatcttcccttcagctttcttcattttggtcattgctccagatgttcattgtttaacacaagtgggtagggagacggagaagaagggaatttcaggctcatattttggtgtmatgggcagatcttgggtgaggttttcattgttagttaaactaagtttgaaggtttacactgaatttctttccctaccgtcctctttggctacttaaatagatcatcaggactgtttgttcttctgttgaaagtgccccacactgccctgggcataagctaaattctttctctcccttttagaagagaagccagattgctccaaggcccgctgtgaagtccagttctctccacgttgtcctgaagattctgttctgatcgagggttatgctcctcctggggagtgctgtcccttacccagc

SEQ ID NO: 201111 - DNA, 601 bp, Human; identical to SEQ ID NO: 38349

SEQ ID NO: 201112 - DNA, 601 bp, Human; identical to SEQ ID NO: 38350

SEQ ID NO: 201113 - DNA, 601 bp, Human
gtaacaactccctttttataagaatttattgcactttcatgggctagaaagtgggtttgtggacttttctcccctatcttgaagaatacattcctccctccttcattcccatccaaatggaattgcccttccctatgagactatttcacccattcgggcccttaactgccccatttctgtgtgagcttgatttgttagttttctctggaattgtatgttttcagttgattcattcatctattcatcaaacatgaattgagttcttaagagtgacagacactattctccggatgttcttackgtgcatgggtttcactttccacttctatccctcacaaatactggttttcccttctacctgtggcctttgtgagtataggctcttccttatttccttgctgcctttctgtcttgtttaatggcctttcattttcacttcttttgtgtcttttctcttgaacttcatcctgtttaaacatcattcttgtgtgtgatgtaattaatttttaaccattatttgattcttccttccctcaacttggcatagatttccaggcatcccgccgtttctttttatccttttttcttctgttggcatgaa

SEQ ID NO: 201114 - DNA, 601 bp, Human
ttcagttgattcattcatctattcatcaaacatgaattgagttcttaagagtgacagacactattctccggatgttcttacggtgcatgggtttcactttccacttctatccctcacaaatactggttttcccttctacctgtggcctttgtgagtataggctcttccttatttccttgctgcctttctgtcttgtttaatggcctttcattttcacttcttttgtgtcttttctcttgaacttcatcctgtttaaacatcattcttgtgtgtgatgtaattaatttttaaccattatttrattcttccttccctcaacttggcatagatttccaggcatcccgccgtttctttttatccttttttcttctgttggcatgaagacatgatatgagttatatggcagtgcattctacctttcaggagagggtggagagggataagaattagtggctctgggacttatactgggcctaaacactacacagtgacaaaaagggaaaatgggactgtctgtgaggtttaggacaccttgtggtccttgaaagtccctttgtgagtgtctgcatgtgtgtgcatgtacagatgctgctgtgcataa

SEQ ID NO: 201115 - DNA, 601 bp, Human
tttcagttattcactgctgtgtaacaaccgccccaaaagaagtagctgaaaatgacaaagatttattctttgtcctgattctgtgtgttgactgagcagttcttctgtagccagctggcaggttgactgagactggatgtccctcccatgtttggaaactcagctgggatggctggaaagacccctctccctacatgatgtcagaagcaggagaggaagttgcaaagcctttggagaccaagagttggaagttacagaacacttctgccatgttctgttggtcaaaggaagtcccaggtcragccctcattcaaaggtttggaaagtaggttccacttcttgatgagataagccacaaagaatttgtggccatttttaatccaccctaatctacatttaaccaagatagatgccctttagttttcattttctgattgcaggaatttggtggtgtgtttcagaaacgtgattcttttccaaaaactcatgcccttctggccctggaactctgggtcttcaggtgaaattcgggcagcattatagttaagccccctgtgtgcccagcagctctttttctgcttctttcttcacttgccatttg

SEQ ID NO: 201116 - DNA, 601 bp, Human
tggctggaaagacccctctccctacatgatgtcagaagcaggagaggaagttgcaaagcctttggagaccaagagttggaagttacagaacacttctgccatgttctgttggtcaaaggaagtcccaggtcaagccctcattcaaaggtttggaaagtaggttccacttcttgatgagataagccacaaagaatttgtggccatttttaatccaccctaatctacatttaaccaagatagatgccctttagttttcattttctgattgcaggaatttggtggtgtgtttcagaaacgtgaytcttttccaaaaactcatgcccttctggccctggaactctgggtcttcaggtgaaattcgggcagcattatagttaagccccctgtgtgcccagcagctctttttctgcttctttcttcacttgccatttggcagtccacccaggagcagacacgtgatttaagagcctctgagccaccgcttcagctttaatatcatttagccaaccattatttttaaccttccgcttcttgaagagtgctgtgaccacctaggttaaactaggttttctcccatcatacaaaagggaatgctactttg

SEQ ID NO: 201117 - DNA, 601 bp, Human
aagagtgctgtgaccacctaggttaaactaggttttctcccatcatacaaaagggaatgctactttgggataccagaaaatctgcctgataaaaccgggtccatttttaaaacaaaacaaagcttgcaaagatgttgaatagagattctcctctgtaatggttgagcttacctgagagaaatggattcaccagaggcagatgcatttgaaggatggatccagcctgggctatacatctgagagtccatgttctcctggtgtccaccagcccagacctcagcccaactgggctatttctcargaagatagagagttctaagaccacagtgttttctctgcacttcctactccttgctctctccagtgtttggacctaattttacagactcttcactttgcctccgtaatttttcaccagtgtttcagatacaggcttacacggtagacattaactagttaaaaatctagacagtaatacctccaccttactcactttcactgtaagtcacgagttttttaaataccctacgccttttgataagtaactttgtacctttttattattgacaagtcacctattttaaatttatttttatgaaat

SEQ ID NO: 201118 - DNA, 601 bp, Human
gttctcctggtgtccaccagcccagacctcagcccaactgggctatttctcaggaagatagagagttctaagaccacagtgttttctctgcacttcctactccttgctctctccagtgtttggacctaattttacagactcttcactttgcctccgtaatttttcaccagtgtttcagatacaggcttacacggtagacattaactagttaaaaatctagacagtaatacctccaccttactcactttcactgtaagtcacgagttttttaaataccctacgccttttgataagtaactttgtacctttttattattgacaagtcacctattttaaatttatttttatgaaatttgtcccaaactttttgttctaaaagttctgttatcaatttgttttataaatatgccgttcttaaaagttattgagaaaagtccaatccagctattttaaggtagaaataaattaagtcattgtttataatgtccaaaaacttaaaatagagtttcttctgggttgtgtgcatttcagaaagccagattcccaagctccctcctggctcctgcctctctctgaccaagggcctgatactcttccagaa

SEQ ID NO: 201119 - DNA, 601 bp, Human
caccagcccagacctcagcccaactgggctatttctcaggaagatagagagttctaagaccacagtgttttctctgcacttcctactccttgctctctccagtgtttggacctaattttacagactcttcactttgcctccgtaatttttcaccagtgtttcagatacaggcttacacggtagacattaactagttaaaaatctagacagtaatacctccaccttactcactttcactgtaagtcacgagttttttaaataccctacgccttttgataagtaactttgtacctttttattattgacaagtcacctattttaaatttatttttatgaaatttgtcccaaactttttgttctaaaagttctgttatcaatttgttttataaatatgccgttcttaaaagttattgagaaaagtccaatccagctattttaaggtagaaataaattaagtcattgtttataatgtccaaaaacttaaaatagagtttcttctgggttgtgtgcatttcagaaagccagattcccaagctccctcctggctcctgcctctctctgaccaagggcctgatactcttccagaacctatatctggaac

SEQ ID NO: 201120 - DNA, 601 bp, Human
accagcccagacctcagcccaactgggctatttctcaggaagatagagagttctaagaccacagtgttttctctgcacttcctactccttgctctctccagtgtttggacctaattttacagactcttcactttgcctccgtaatttttcaccagtgtttcagatacaggcttacacggtagacattaactagttaaaaatctagacagtaatacctccaccttactcactttcactgtaagtcacgagttttttaaataccctacgccttttgataagtaactttgtacctttttattagtgacaagtcacctattttaaatttatttttatgaaatttgtcccaaactttttgttctaaaagttctgttatcaatttgttttataaatatgccgttcttaaaagttattgagaaaagtccaatccagctattttaaggtagaaataaattaagtcattgtttataatgtccaaaaacttaaaatagagtttcttctgggttgtgtgcatttcagaaagccagattcccaagctccctcctggctcctgcctctctctgaccaagggcctgatactcttccagaacctatatctggaaca

SEQ ID NO: 201121 - DNA, 601 bp, Human
agcccagacctcagcccaactgggctatttctcaggaagatagagagttctaagaccacagtgttttctctgcacttcctactccttgctctctccagtgtttggacctaattttacagactcttcactttgcctccgtaatttttcaccagtgtttcagatacaggcttacacggtagacattaactagttaaaaatctagacagtaatacctccaccttactcactttcactgtaagtcacgagttttttaaataccctacgccttttgataagtaactttgtacctttttattattgacaagtcacctattttaaatttatttttatgaaatttgtcccaaactttttgttctaaaagttctgttatcaatttgttttataaatatgccgttcttaaaagttattgagaaaagtccaatccagctattttaaggtagaaataaattaagtcattgtttataatgtccaaaaacttaaaatagagtttcttctgggttgtgtgcatttcagaaagccagattcccaagctccctcctggctcctgcctctctctgaccaagggcctgatactcttccagaacctatatctggaacatgt

SEQ ID NO: 201122 - DNA, 601 bp, Human
gcccagacctcagcccaactgggctatttctcaggaagatagagagttctaagaccacagtgttttctctgcacttcctactccttgctctctccagtgtttggacctaattttacagactcttcactttgcctccgtaatttttcaccagtgtttcagatacaggcttacacggtagacattaactagttaaaaatctagacagtaatacctccaccttactcactttcactgtaagtcacgagttttttaaataccctacgccttttgataagtaactttgtacctttttattattgataagtcacctattttaaatttatttttatgaaatttgtcccaaactttttgttctaaaagttctgttatcaatttgttttataaatatgccgttcttaaaagttattgagaaaagtccaatccagctattttaaggtagaaataaattaagtcattgtttataatgtccaaaaacttaaaatagagtttcttctgggttgtgtgcatttcagaaagccagattcccaagctccctcctggctcctgcctctctctgaccaagggcctgatactcttccagaacctatatctggaacatgtg

SEQ ID NO: 201123 - DNA, 601 bp, Human
cccagacctcagcccaactgggctatttctcaggaagatagagagttctaagaccacagtgttttctctgcacttcctactccttgctctctccagtgtttggacctaattttacagactcttcactttgcctccgtaatttttcaccagtgtttcagatacaggcttacacggtagacattaactagttaaaaatctagacagtaatacctccaccttactcactttcactgtaagtcacgagttttttaaataccctacgccttttgataagtaactttgtacctttttattattgaccagtcacctattttaaatttatttttatgaaatttgtcccaaactttttgttctaaaagttctgttatcaatttgttttataaatatgccgttcttaaaagttattgagaaaagtccaatccagctattttaaggtagaaataaattaagtcattgtttataatgtccaaaaacttaaaatagagtttcttctgggttgtgtgcatttcagaaagccagattcccaagctccctcctggctcctgcctctctctgaccaagggcctgatactcttccagaacctatatctggaacatgtgt

SEQ ID NO: 201124 - DNA, 601 bp, Human
cagacctcagcccaactgggctatttctcaggaagatagagagttctaagaccacagtgttttctctgcacttcctactccttgctctctccagtgtttggacctaattttacagactcttcactttgcctccgtaatttttcaccagtgtttcagatacaggcttacacggtagacattaactagttaaaaatctagacagtaatacctccaccttactcactttcactgtaagtcacgagttttttaaataccctacgccttttgataagtaactttgtacctttttattattgacaaatcacctattttaaatttatttttatgaaatttgtcccaaactttttgttctaaaagttctgttatcaatttgttttataaatatgccgttcttaaaagttattgagaaaagtccaatccagctattttaaggtagaaataaattaagtcattgtttataatgtccaaaaacttaaaatagagtttcttctgggttgtgtgcatttcagaaagccagattcccaagctccctcctggctcctgcctctctctgaccaagggcctgatactcttccagaacctatatctggaacatgtgtat

SEQ ID NO: 201125 - DNA, 601 bp, Human
tcttaaaagttattgagaaaagtccaatccagctattttaaggtagaaataaattaagtcattgtttataatgtccaaaaacttaaaatagagtttcttctgggttgtgtgcatttcagaaagccagattcccaagctccctcctggctcctgcctctctctgaccaagggcctgatactcttccagaacctatatctggaacatgtgtatctcttgtgttctgagacactagaccaaaaatcctattttatttttaaatcaatcttcagaagtatttttttgacttgtttttttttttttccttagcttcaaggtaattaaaaatgttagattatctgtcagctaatatgttgactaatatgtgacttctgttttcaccaaaaaatgtaatagaatatgttggacacatgaaattctaagtacaatttcactagaaatattgacaagccagaatcacagagctcaacacaggaggcaggctgtatcactctcctgtttcatagagggagcattgtggagctggaagggtcctagccggtgcacatcagcggaacaggtctgtctggcacttaccactgagctgcactgtcccttgtggcc

SEQ ID NO: 201126 - DNA, 601 bp, Human
aaataaattaagtcattgtttataatgtccaaaaacttaaaatagagtttcttctgggttgtgtgcatttcagaaagccagattcccaagctccctcctggctcctgcctctctctgaccaagggcctgatactcttccagaacctatatctggaacatgtgtatctcttgtgttctgagacactagaccaaaaatcctattttatttttaaatcaatcttcagaagtatttttttgacttgtttttttttttttccttagcttcaaggtaattaaaaatgttagattatctgtcagctartatgttgactaatatgtgacttctgttttcaccaaaaaatgtaatagaatatgttggacacatgaaattctaagtacaatttcactagaaatattgacaagccagaatcacagagctcaacacaggaggcaggctgtatcactctcctgtttcatagagggagcattgtggagctggaagggtcctagccggtgcacatcagcggaacaggtctgtctggcacttaccactgagctgcactgtcccttgtggccctgggctcactcaccaccaggccctctccagtcctgcctctcagga

SEQ ID NO: 201127 - DNA, 601 bp, Human
ggttttccagtcgaagaaaggaggggaggaaggatttgattgtctcaaaagtaacttctacctctaaattctttgactttccaaaagcctttagaagggaaggaacccaagccgctagcgacaggagactcctgggaaacaaaggtaaagaaaaattttaggaaatttcagagctcagaaaataatgggagagatatatggctcgcctagggataagaaaaggagaaagtccaggggaagttataaaagaattatgggttttttctttaaactttcttaaaaaaacaaaacaaaaaaaaaaccttagaaacagcaaaatgaaataaactactagagtaatgatttaagccagggtaatcagaactggttggattgtgaaagctgagtaacaattcagtaaaatagattacgtatttggtcagtggttagttgactattgttagttaaccttttttttttctttacatctataaatagatagtccctacgtagcagaagcagagaatatctggccaaaggctgactccgcaagataaggatttactctgttaaactgctttctaatagaatgtcgatatctctgcctgtcagcctgccttgg

SEQ ID NO: 201128 - DNA, 601 bp, Human
gaacaacagatgacaattttttcttatccctcccttccctcctgaaaactcaataggacaggagggattttcttattcctctgttctggaacatctgtctgcttctgagaaatggaacgagcagcaggatcaagaatcctttagtgctctgtgtgctcaaatgcttatccttccgtggtagagctttccaaagtttgtcaactcttatctccagagctacagcccataactctgcggtttgaagcctttaggagggtgttgggaggtgggaggatcacgcaagagtcagaggctgtcaacmcagtgcgcatcaacccaacctgacaaatatgtcaaagccagaaacttcctgagggtggcttggaactgtcagggtcatgttcagagctcagaaagcacttctttttttcttcttggagacagttttaagtttttttaggccatcaaataatatttcctgtagatccatgtgctttttaccattgtgctaggcaattaagttgcttatatcatgcctactcaagctaaccagttttaactatccctgcatatgcattttcaaagggactttatctaattaagagtgttgtaattcattatc

SEQ ID NO: 201129 - DNA, 601 bp, Human
caggatcaagaatcctttagtgctctgtgtgctcaaatgcttatccttccgtggtagagctttccaaagtttgtcaactcttatctccagagctacagcccataactctgcggtttgaagcctttaggagggtgttgggaggtgggaggatcacgcaagagtcagaggctgtcaacacagtgcgcatcaacccaacctgacaaatatgtcaaagccagaaacttcctgagggtggcttggaactgtcagggtcatgttcagagctcagaaagcacttctttttttcttcttggagacagtkttaagtttttttaggccatcaaataatatttcctgtagatccatgtgctttttaccattgtgctaggcaattaagttgcttatatcatgcctactcaagctaaccagttttaactatccctgcatatgcattttcaaagggactttatctaattaagagtgttgtaattcattatcatgtccatctgttctaagatagtgtctcagagaagatggcacttaacagtttgggttttttttttttaagattgatctgttagtagacaaatttccataattcagttcatttttgttgttgtcg

SEQ ID NO: 201130 - DNA, 601 bp, Human
gtagagctttccaaagtttgtcaactcttatctccagagctacagcccataactctgcggtttgaagcctttaggagggtgttgggaggtgggaggatcacgcaagagtcagaggctgtcaacacagtgcgcatcaacccaacctgacaaatatgtcaaagccagaaacttcctgagggtggcttggaactgtcagggtcatgttcagagctcagaaagcacttctttttttcttcttggagacagttttaagtttttttaggccatcaaataatatttcctgtagatccatgtgctttttaccattgtgctaggcaattaagttgcttatatcatgcctactcaagctaaccagttttaactatccctgcatatgcattttcaaagggactttatctaattaagagtgttgtaattcattatcatgtccatctgttctaagatagtgtctcagagaagatggcacttaacagtttgggttttttttttttaagattgatctgttagtagacaaatttccataattcagttcatttttgttgttgtcgttccctttaatttgaataatttctccagctgctttttgggagtaaataaaatt

SEQ ID NO: 201131 - DNA, 601 bp, Human
aatttggaagtgtatttgaagctcatctttctcaactaagaaaagaacatctattctgttgccctctgtcacagtaatttttggcccaaaagagcgagtcaactcatgactaaaaaagccagagtctatattaaactctgatgtttttaaaacaaaataattgtaggaattccatgttattattggacctatccccagattgaagaaaatatgctttcctagaagtaaagccattgcccattggaaatgaactgtctccctagtagagtgtttgatttgtcaataattctcttcagatgcrtgcgtgctgtgtttcctgtactagggccttaggctttttttatctcaccttaaatttgacctagtgtctagccttattttgtatttgtcttagtcccgaaaacaagcagggaaggctctcagtcagtggcttccagtttaatccgagtggtcatggatatcaccagacactgtatatgtggccctccgagtcggactgagagaaggtaacttaactgaattccgtaagcctttcagtaaagttgaaagcggaatccacagcgtgataatattgaaactcagaggtctctccataccctct

SEQ ID NO: 201132 - DNA, 601 bp, Human
tgcaaaaatgctttgtgaaattacttgcatagctaataagcaagtctaaaatgtaaaagccctacctgtaatgaaaataccaaaagcaacccaaatcacggaatatattttactcttcatgtacacctttacattggatatggcttattgggttccccatcattgtagttgcaacagtttgcagataattcagggttatatttggtagacatttaattgctaattagaacccaggaggtagagacagctggtttctcttggccttggtcagtctgttgtgaatgtattatacagcaagtgstttgtaaattattctttcctgactttgcttttgattgaaaagaaaggaagttatatgtcatggctcttatgataatatgatcagggactttgatttccatagctagatcatgaagagttttaatgataattcctaagacattagattgtggattctttgagggcaaggacccaccctatatatttcattctcatcagtacctagcacgggtaagtaatgaatgcttttaactaaattagatagacaattagtctgcagcaaaagtcctagcatcaaaaccccatagtgttcttggattgt

SEQ ID NO: 201133 - DNA, 601 bp, Human
atgaagagttttaatgataattcctaagacattagattgtggattctttgagggcaaggacccaccctatatatttcattctcatcagtacctagcacgggtaagtaatgaatgcttttaactaaattagatagacaattagtctgcagcaaaagtcctagcatcaaaaccccatagtgttcttggattgttcagggagcagatattttgagcatttgtcatgtgccaggcattgggctacccagcaggaataaaatatagtcgctgatgtctaagagcatatattataaagggaaggcaratatgtataagtcattgtagtttaaagtgttgtgtgctttggtagtagaagtgtgcaaaaaacacaaagttagcaaagcaaacacatgctaattcctatttggagaacggtcagatttgacttttgaactgagtctttaagaatgagtcagagttcacaagatggagaaagagagaagggcattctaggctgttgttgatttttcgacttgtaatgtgtcttgcagcttaaaacattaacactaatcccacctacctttatgattcaagaaaaagggaattcatgacaatgttgggtttt

SEQ ID NO: 201134 - DNA, 601 bp, Human
agtttaaagtgttgtgtgctttggtagtagaagtgtgcaaaaaacacaaagttagcaaagcaaacacatgctaattcctatttggagaacggtcagatttgacttttgaactgagtctttaagaatgagtcagagttcacaagatggagaaagagagaagggcattctaggctgttgttgatttttcgacttgtaatgtgtcttgcagcttaaaacattaacactaatcccacctacctttatgattcaagaaaaagggaattcatgacaatgttgggttttcttgagataaccactccaytgcaagactgcattacttgtttaaggtgttttgttactttcctgtttcttacaagtgaagacgcttcttagtatggtaggcaaggccccatattactcagccctgacctccctctctggccatgactcctgccagtacccccataataaccccagtcctcctctcagtacatagtgtacttctggtgggctaacctattagtttaaacttaacacactgtattctttcttgcctttgtaaatttagtgtgttctttcctctatctggaatgccttccctctgtgcccactcccccacatt

SEQ ID NO: 201135 - DNA, 601 bp, Human
gtagaagtgtgcaaaaaacacaaagttagcaaagcaaacacatgctaattcctatttggagaacggtcagatttgacttttgaactgagtctttaagaatgagtcagagttcacaagatggagaaagagagaagggcattctaggctgttgttgatttttcgacttgtaatgtgtcttgcagcttaaaacattaacactaatcccacctacctttatgattcaagaaaaagggaattcatgacaatgttgggttttcttgagataaccactccattgcaagactgcattacttgtttaagrtgttttgttactttcctgtttcttacaagtgaagacgcttcttagtatggtaggcaaggccccatattactcagccctgacctccctctctggccatgactcctgccagtacccccataataaccccagtcctcctctcagtacatagtgtacttctggtgggctaacctattagtttaaacttaacacactgtattctttcttgcctttgtaaatttagtgtgttctttcctctatctggaatgccttccctctgtgcccactcccccacatttgatggtcatttcacaaactgccact

SEQ ID NO: 201136 - DNA, 601 bp, Human
ccagtcctcctctcagtacatagtgtacttctggtgggctaacctattagtttaaacttaacacactgtattctttcttgcctttgtaaatttagtgtgttctttcctctatctggaatgccttccctctgtgcccactcccccacatttgatggtcatttcacaaactgccactcacacccctcaccaccaccacacacaaacacacacacacacatacagcatcagctgtttatctttgtgctgctagttagagaaggcatcatggaagaagtgatcgtcaggaatgaaccgaggtctstgaggcatgatggggggcttcagggtagaagatgcagagtagctctgacttttctctagctgctcttaacagcttgagtatcagcacagaggaagtcaaagggttgaatcacagtttgcagttagtagttcttggggctgaattttaccccaagacatgttttctttaatgtgcccctttttttctatttttaaattagtcactgatatttaaaaactggcatacttcacgtaaaaatctggcttctcttgagtacatggaaggtatgccctcattgagtttaccctttggcatggaatg

SEQ ID NO: 201137 - DNA, 601 bp, Human
cttaacagcttgagtatcagcacagaggaagtcaaagggttgaatcacagtttgcagttagtagttcttggggctgaattttaccccaagacatgttttctttaatgtgcccctttttttctatttttaaattagtcactgatatttaaaaactggcatacttcacgtaaaaatctggcttctcttgagtacatggaaggtatgccctcattgagtttaccctttggcatggaatgagtagtgatgccctgttagaggtcacagaccttcttgaggtgtctagagtccccctctactcttytaggattcctgcctgattcaggtttgccatctctgggattaagtaagttgggtttgggagacagatacagaaggaggataaagaggcaggaaaggtaaaggcgttaggaagatggtggttcaagtgaaacaccgtgggttttgggctccgttgttaaagaggtacagtcaggaggaggttcaggccgcagagaaaaggaaacgatctggggagtagatgtctcagtgactttgaagtgtcagtgtggtagagcatgggccagggagaactggaaggatggaccattgtgatcagcagata

SEQ ID NO: 201138 - DNA, 601 bp, Human
ccagagcagtgctctctggggatgtgcattccttggaggatgagagacaatacggtctttcactttgcactgatgacaaggatgagaggctgggaattgactgcccaaaggaatccaagtggatgcatgcttaaagtcatctgtttcagcactagctcaggccccagatggttctggcggcctgaaggagtgttagcagccaggcaatggaggctttgctcagattttcaagtagaaggttagtccagacatcgttggtgtttgttctttgtgtgctctggggagaggatttaatagtcarcctcccattgtgttctcatttgtggttatatataaaagcttccctaaactaaattccctaaacttagggccagaaccctgtgtatccccagccgcaatccagcttagtacctgctgcatgtacacactcggtaaacagctacaaaatcattacgtgttcataaacaagctgattcattgttccaaagcatctattttctgaggcagttggaaattccactctgaagtgggaataacctatgttgctaaactaaaacttattctccacttcccagcccagttctcctttccacagcgtgat

SEQ ID NO: 201139 - DNA, 601 bp, Human
ttttatttccataggtttttgggaaacaggtagtatttggttacataagttctttagcggtgatttgtgagattttggggcacccatcacctgaacagtatacactgaacccaaacctaattgtctttaacttataccttccctacatgtgagcatgtcctttgattcctccccccagaaaaaaacaaagcgtaaaacaacaacaacgaaaggcagagtgattttttctggtggtcttcaaagggaaagtgttgaagaaggtacagtttctgctcactgtacacaggggagggatggctgyggggggagagtgtgatccccagggcagggctgcacttgctgtggctacagcacatctgtcagtgttagggggtgtaaatgccaggaaatcacgcaggaataagcttgagacaggggagaaagggtgaaggagggttagttattcatacacagatagtagtaaatctcttatggtgaggcacgaggaaaactgtgagcctaaggaactttcatagggaggagtgctgttttccataagaagggttggaccctcagataggaaacctgtttctttttggatattttatttgcagcctttaaa

SEQ ID NO: 201140 - DNA, 601 bp, Human
aaactgttgacccttgcgcttagttatgtagggtctgaaacatgcctagtggtagggagacaacagcatctagcatgttgtttcttttccggccttgcttagagttctttagtagggaaaaaaaagttatataattattatgcccccacgaaaaacaaaacgtcaccagtgcaaaggccctatcttgagctgggcctgaaggttgaggtgcttggagaggaggaggatcaggggagtaagggacacaaggtgactgatgttcctgaaggacagggtgcaggtgagtgagaagaggatgagmtgaggtcagtttgcagcagtgacgggaatgggaatggcagtgatagaatcaaaggattttatatttagagaagagtttattatgatccacctgtctcactttatggatgagaaaacagtctgcaagagtttaagtagcttgctagcagtcacacatttttcttctttgggtgacagtattggataaattggtaatatttctgttcttttcttccctcgtggtatctctcacttttaagcaatggtattcaggcaggaaggagtctttgtaagtgatctaaaacaagtactagtaatcatt

SEQ ID NO: 201141 - DNA, 601 bp, Human
ttatgtagggtctgaaacatgcctagtggtagggagacaacagcatctagcatgttgtttcttttccggccttgcttagagttctttagtagggaaaaaaaagttatataattattatgcccccacgaaaaacaaaacgtcaccagtgcaaaggccctatcttgagctgggcctgaaggttgaggtgcttggagaggaggaggatcaggggagtaagggacacaaggtgactgatgttcctgaaggacagggtgcaggtgagtgagaagaggatgagctgaggtcagtttgcagcagtgamgggaatgggaatggcagtgatagaatcaaaggattttatatttagagaagagtttattatgatccacctgtctcactttatggatgagaaaacagtctgcaagagtttaagtagcttgctagcagtcacacatttttcttctttgggtgacagtattggataaattggtaatatttctgttcttttcttccctcgtggtatctctcacttttaagcaatggtattcaggcaggaaggagtctttgtaagtgatctaaaacaagtactagtaatcattgttctcattataatgttaaaact

SEQ ID NO: 201142 - DNA, 601 bp, Human
taaacaatataatgttactgttatatcacagcagtatgattatgtgcttaccactgcaatggctagggatataagcgtgacaaagtatgggatgaccttatcaggcactaaaagcccagctcacatttactcagcgctagaaaatgattgtcctgcaggaatatagcgtatgaattgagagctccaagctctactcacacaaaacaggcaaacctttacttgaaaccactggtagaaatacaattgcagcaaaacctgaatgacctaacaccctcttctcccaggaatccaatagaactgycaccccacatggaagaatcctcaaggagcctaccttggggtgatagtggggtgtttaaagccacctttccagtggctttaatagtccttgatgcaaatcataacctaaagtaatttcttttctagttccatggttaactataaatgtaattaaatctctgggcctcattattgaagtacttgtggactataagcatattttaatttattaaagatccaaagaacaataagtgaacaaaccaattacttaaataagaaggggggacaaaagcacaattaatgaatgtattgatagttttcc

SEQ ID NO: 201143 - DNA, 601 bp, Human
atctctgggcctcattattgaagtacttgtggactataagcatattttaatttattaaagatccaaagaacaataagtgaacaaaccaattacttaaataagaaggggggacaaaagcacaattaatgaatgtattgatagttttccctgctgggaacattacctttcctgatcttgacctctaccgtatgtaaatacccacatacttcctgccaggatgtctttttttaggatgtcttccttttactcctgtcaacctgggaactcccgccgtcatcttctccaccctctgacccatacwtctctccccaggggagtcccagggcagaaatctagcggctctttcctcatcttacattcacatgctgacacccagctgccctaagtttcctgtgtcctgcctctctttcattgtagcagatgcaacattttgtctcctcttatttcacctgcccgtatttgccaggcttctgcgtttagcaatttttgcagcagcatcgaagttaggggtgagagccagcacagccagcttgcagctcatggaacacccccattcatgcgtgcagagagatcgatgctcaggtgggagcttaagatccaa

SEQ ID NO: 201144 - DNA, 601 bp, Human
tttccttcccttttctttggtttcagatgcgagtgtctctctggcttatgtggtttccccgtgtgtgaggtgggatccactccccgcatagtctctcgtggcgatgggacacctggaaagtgctgtgatgtctttgaatgtgttaatggtacgtggggtttctcttgttctcagagagtgtacatttgtgcagaggaggaggagggagggttcaacttagctgcttctgccttttacaaagcagggattaccttcaggggcttgctgaagggcactcaaaaaggtttgcttaagatccacmgtgcagtaaagaaagttaggttaggaactatcattccacccatcagaaggaggattctggaaatgtaatagcagattgcatgtagctgtcatactcagctgtgttacagaatttccaaaacttagggatttcaggaaaaggatcctggagcctgtgagagttttcctgctgtcactcagtaactggtcccatggctgtcgggaggtgacctggctaaaactgcattgggcctgccacacttgggaacaagaaaaacatggctcatcttgtttagcattttcctacttagaacatctttgc

SEQ ID NO: 201145 - DNA, 601 bp, Human
cttagctgcttctgccttttacaaagcagggattaccttcaggggcttgctgaagggcactcaaaaaggtttgcttaagatccaccgtgcagtaaagaaagttaggttaggaactatcattccacccatcagaaggaggattctggaaatgtaatagcagattgcatgtagctgtcatactcagctgtgttacagaatttccaaaacttagggatttcaggaaaaggatcctggagcctgtgagagttttcctgctgtcactcagtaactggtcccatggctgtcgggaggtgacctggcyaaaactgcattgggcctgccacacttgggaacaagaaaaacatggctcatcttgtttagcattttcctacttagaacatctttgcacctgatcttagccaaaaggctgagaggcggtggggaagacatctttaatcagtggttggtcactgatagcggcctgctgtaggcttgacccacgtggccctgaaaaaggattcttgggtcacgagattccttctgacagaatctgcctctccctttcactttatatgggaggatttggtgtttggtggcttgatgttgattgagtttaggtgct

SEQ ID NO: 201146 - DNA, 601 bp, Human
atggattatgcactgccgcactcacttcctatgctgccatccatgtgatccatatgcttatgtttttttctttttaaaatcaactttaaagtgaaaacatacaattttaaaatacacagaactcgaaaactcgtgagttttgaaaacactagcctgatgagtagatgcagagagagcatcctccataaatattactttgtttttgtagtttgattttattttgttgtggcggagggatgggagagttgcagaccagttcatgacagtttgtaactgcattctctgacaagcgccgaaaggrgaacttatgaggctttggctgaacaagatccttgttatttagaaaccaaaggaacaggtggtatgattatgtttcttttatgtgaacttagaagtcatcaaaatcatcacctagaaatatgacctccaaagcagtgttgtaacagccctccaccttcgtcaagaacccactgtatgtctgctcctgcccacaaacaaatgtcccatcagccgtcagctggagctggacaatggcctctactgttagatgggtggatgctctccacttaacacagtaccccctgctgtcttacacatggcc

SEQ ID NO: 201147 - DNA, 601 bp, Human
ttagctgctgtagatagtcattcctctgatggatcagaactaaatcaattgaaaaccttctgcaaaggattcactcaccattctagatgccattaagaacacaggtgattcaggggaaggtgtcagaatattaacatggagtttggaagaagttgattccaaccctcatgaatgactttgaggagctgaagacctcagtggaagaagtaactgcagatgtagtagaaggagcaagagaactagaattaaatgtggaacctgcagaatgtgactgaattgctgcaatctcatgataaaactkgaaaggatgaggagtttcttcttatcgatgagcaaagaaagtagtttcttgagatagaatctactcctggtgaggatgctgtgacaacatcttcaccagataaaacgacaaccagggatttagactattacataaatttagttgataaagcaacagcagggttttagaggattgactccagttttgaaacaagttctactgtaagtaaaatgctatcaaacagcatcacatgctacaaagaaatctttcatgaaaggaagagttagtcaatgtggcaaacttcattattgtgttatttaa

SEQ ID NO: 201148 - DNA, 601 bp, Human
taaggaatgtatattgttttttagacataatgctattgtatacttaatagactatagcaggggtgtccaatcttttggcttccctgggccacattggaagaagaagattgtcttgggccacatgtaaaatacactaacactaatgatagctgattagcttaaacacacacacacacacacacacacacacacacaccatcttacaatgttttaagaaagtttgcattcaaagccatcctaggcctcatgtggcccgcaggctgcaggttagacaagtatggactacagtacagtgtaaacrtaacttttaaatgcactgggaagccaaaaagtttgtgtgacttgcttgagctggtctggaactgaacccacaatatctttgaggtgtatctatcaccatccaccaatcagtgtagtttggtaggcagtagcatgtactaatagtctatattacaaaattctcttttaggagttctgaagtatattcaagaaggaagggaagatcccagaacttagaaacttaaagtttaattttgcagacgcaaaacacatacaaaaaatcactaaaaaggcacttctgtgcttcatattgagaagtaca

SEQ ID NO: 201149 - DNA, 601 bp, Human
atcccctcctgcttaagcttctgcacaccctaccataaaaacaagtccacttgaagcagctttattcataaccagaacctgccctccacacttcctcagatcatgcaccagggttgtggcttcacccagatggtagctgtggttgatcaactcaaccaaataattagtattgattggtttattttttttagtttccatggatgttcattttgttagagtacagtattttgcctcgctctacagcctgcaaatttaatgtataaaagtactccgttttctatactttttggaacttatagtstagctgcacaattcctttcaatcccaactcagattagtttgttagctaaaagtatatagaagaattctgagccatggtaagatgattcttttttaacattaattttctgaaaaaatgttgtatccatgtagcactaaggaaggagtttaaacattcacatgtagtacgtgtgcacacataaaatcactgcctcattcatgtgactttaagcaaatcacgtcatctctttaagtttcatcttcattatcgaaaaaactggtactaataatactcgttctgtcttcttagcggggttgttat

SEQ ID NO: 201150 - DNA, 601 bp, Human
aaataaatataaagtaattgtccttgagtacaatgcaaatgcaaatatcctccaaatgcggtgaaagtattttagacatgcaaggggacatattaaatgatttggggatggacagaagagcccttgaaagatggggatatcatcatccagctttcaccggcagattgagcagggctcatcacctcaggagaactttcttcagcttgggagtactttttttaaaaatagctttaggagacaccatgcaatttaccaacttaagttgtgcaattctgttgttttcagtgtatgctcagagttstgcaatcatcaacacaatcagtttcagaacattttcatcaagccatcagaaaactcctgaactgattgcagtcactgcccattttccccctaagctctcagatctaggcaaccactaatctactttctatctctatggacgtgcctatgatgggtgtttcatataagtagagttatataatattaataccttgtcttttgtgactggcttctttcacttagcataatattttcaagtgtcattcatgttatattgcatatcagaacttcatttctttttatggccacgtaatattttatt

SEQ ID NO: 201151 - DNA, 601 bp, Human
caacctcaggcctggcatggtggctcacacctgtcatcctagcactttgggaggccaaggtggttggatcacttgaggtcagaggagttcaagaccagcctggccaacatggtctttactaaaaatacaaaaattagctgggcatggtgtcatgcacctgtagtcccagatacttgggaggctgaggcaggagaatcacttgaacccaggaggtaaaggttgcagtgagctcagatgacgccactccactccagcctgggtgacagagtgagactctatatcaaaaaaaaaaaaaaaaaaagactttgaaccccactgagtcttggccatcttgtcaaaatacctgtaaatgtgatagtttattcctgaactctcaattccattgaactatatatctatccctgtggcagtaccacatagtcttgattactatagcattgtattatgttttgaaattaggaagtaggagttctctaactttgttctcccttttaagattgttttggcaattctgggtcccttgcattttcatatgaattttatgatcagcttatcaatttctacaaaagagccagctaggagtttgatagagattgcattg

SEQ ID NO: 201152 - DNA, 601 bp, Human
actttgggaggccaaggtggttggatcacttgaggtcagaggagttcaagaccagcctggccaacatggtctttactaaaaatacaaaaattagctgggcatggtgtcatgcacctgtagtcccagatacttgggaggctgaggcaggagaatcacttgaacccaggaggtaaaggttgcagtgagctcagatgacgccactccactccagcctgggtgacagagtgagactctatatcaaaaaaaaaaaaaaaaaaagactttgaaccccactgagtcttggccatcttgtcaaaatacytgtaaatgtgatagtttattcctgaactctcaattccattgaactatatatctatccctgtggcagtaccacatagtcttgattactatagcattgtattatgttttgaaattaggaagtaggagttctctaactttgttctcccttttaagattgttttggcaattctgggtcccttgcattttcatatgaattttatgatcagcttatcaatttctacaaaagagccagctaggagtttgatagagattgcattgaacatgtagatcaatttggggaatatttccatttaaacaatgt

SEQ ID NO: 201153 - DNA, 601 bp, Human
gcctgggtgacagagtgagactctatatcaaaaaaaaaaaaaaaaaaagactttgaaccccactgagtcttggccatcttgtcaaaatacctgtaaatgtgatagtttattcctgaactctcaattccattgaactatatatctatccctgtggcagtaccacatagtcttgattactatagcattgtattatgttttgaaattaggaagtaggagttctctaactttgttctcccttttaagattgttttggcaattctgggtcccttgcattttcatatgaattttatgatcagcttakcaatttctacaaaagagccagctaggagtttgatagagattgcattgaacatgtagatcaatttggggaatatttccatttaaacaatgttgtctttcaatccatgaacacgggatgtcccgtttacttaggcctttttagttttttgaaaatgttttgttattttcaaaatacaagtttgtacttatgttattacatttattcctaagtattgtatactttttgatgctattgtgattggaattgttttcttcattttctgattgttcattgctagggtatacaaacacaatttgggga

SEQ ID NO: 201154 - DNA, 601 bp, Human; identical to SEQ ID NO: 38351

SEQ ID NO: 201155 - DNA, 601 bp, Human; identical to SEQ ID NO: 38352

SEQ ID NO: 201156 - DNA, 601 bp, Human; identical to SEQ ID NO: 38353

SEQ ID NO: 201157 - DNA, 601 bp, Human; identical to SEQ ID NO: 38354

SEQ ID NO: 201158 - DNA, 601 bp, Human; identical to SEQ ID NO: 38355

SEQ ID NO: 201159 - DNA, 601 bp, Human; identical to SEQ ID NO: 38356

SEQ ID NO: 201160 - DNA, 601 bp, Human
gagacacataccttccaaatgacaagataatgtgtcttttggttactcctggaggactagggacatgaacctgggggcccttaaagactaggctgttacttgacagctaacttgattcacaagtacctaagtgctttttaaattggcacttaagtactctcatgatgaattcttagcaagttattgtcaacacccaattcaggtatacagataagcctttccagtctgttaactgattatattctcacattttgctttgttgacttttctctacatctcttgtttatcgatctcattattwttattttctgacccctgtgaagagctagggtggaaacgtgtggaatagcatataaagttttcagttgaatggcatacatagacgacacagccttaatctccttaaaaactaaaaacaaaaaagagattggacggcagaattaggtcttcatctgcagggccactgttatttgtaacccttaatgacagtggctaacatttcatacaattgttatgtgtcaggtttaagtgctttaagaggagcaactaatttgagatcctcacagcatcccttcggtatgggtgctgtcatcccagttta

SEQ ID NO: 201161 - DNA, 601 bp, Human
taggctgttacttgacagctaacttgattcacaagtacctaagtgctttttaaattggcacttaagtactctcatgatgaattcttagcaagttattgtcaacacccaattcaggtatacagataagcctttccagtctgttaactgattatattctcacattttgctttgttgacttttctctacatctcttgtttatcgatctcattatttttattttctgacccctgtgaagagctagggtggaaacgtgtggaatagcatataaagttttcagttgaatggcatacatagacgacayagccttaatctccttaaaaactaaaaacaaaaaagagattggacggcagaattaggtcttcatctgcagggccactgttatttgtaacccttaatgacagtggctaacatttcatacaattgttatgtgtcaggtttaagtgctttaagaggagcaactaatttgagatcctcacagcatcccttcggtatgggtgctgtcatcccagtttaccatcagagaacacaaagttcggaggccatgtaatttgcccagggtcatacagctcataagtgacagcacagtgtgtccccaggacca

SEQ ID NO: 201162 - DNA, 601 bp, Human
atgtgtaagtagatgctcaaaatttttaaatgagtaaataataagtgaggacagtgaggaggaaagaaagactggagcaggaagtcccaaccagacccttcatacagatcttctttttagttgagtgagggagcagaccctgatacagggttaccttaaccagagcgtcaaaagctgatggccattgggacccctgatctactagttgaaggaagaataatgtcagcatgcttatcactgaaaacacattttgagaacataagtaagagtgttatggaagtgtgtgacatgaggtgggccyacatgtctacaggccagttggaccagtttcctgcattgacggttcacccttctgatgggcactcagctctgggctccatccctgtgtcagcctcatgggccttccaagactgatgtgtattctgtggtttattctgtcccagttcagcccctgaagtccagaatcacagagtttaactggggcttcccagaccctctaaggctaatgcttgctgccacgttaatgtactgtttttaagacgccttgtgcatggtgtaggtgccactgcatttcagttacttacacgggcaaggatttttt

SEQ ID NO: 201163 - DNA, 601 bp, Human
cagaccctgatacagggttaccttaaccagagcgtcaaaagctgatggccattgggacccctgatctactagttgaaggaagaataatgtcagcatgcttatcactgaaaacacattttgagaacataagtaagagtgttatggaagtgtgtgacatgaggtgggcctacatgtctacaggccagttggaccagtttcctgcattgacggttcacccttctgatgggcactcagctctgggctccatccctgtgtcagcctcatgggccttccaagactgatgtgtattctgtggtttatyctgtcccagttcagcccctgaagtccagaatcacagagtttaactggggcttcccagaccctctaaggctaatgcttgctgccacgttaatgtactgtttttaagacgccttgtgcatggtgtaggtgccactgcatttcagttacttacacgggcaaggattttttttacattgtcattagatattgagaattatttgctgattttttttttcaataatagcaagtataaatgctgccaaagctgattcttaatgtcagagggatcctgaggagaggttgccatttccattagaaatct

SEQ ID NO: 201164 - DNA, 601 bp, Human
atggccattgggacccctgatctactagttgaaggaagaataatgtcagcatgcttatcactgaaaacacattttgagaacataagtaagagtgttatggaagtgtgtgacatgaggtgggcctacatgtctacaggccagttggaccagtttcctgcattgacggttcacccttctgatgggcactcagctctgggctccatccctgtgtcagcctcatgggccttccaagactgatgtgtattctgtggtttattctgtcccagttcagcccctgaagtccagaatcacagagtttaastggggcttcccagaccctctaaggctaatgcttgctgccacgttaatgtactgtttttaagacgccttgtgcatggtgtaggtgccactgcatttcagttacttacacgggcaaggattttttttacattgtcattagatattgagaattatttgctgattttttttttcaataatagcaagtataaatgctgccaaagctgattcttaatgtcagagggatcctgaggagaggttgccatttccattagaaatctattttgtgattgaaggtaagataaggtatcggggagggaagttt

SEQ ID NO: 201165 - DNA, 601 bp, Human
acccttctgatgggcactcagctctgggctccatccctgtgtcagcctcatgggccttccaagactgatgtgtattctgtggtttattctgtcccagttcagcccctgaagtccagaatcacagagtttaactggggcttcccagaccctctaaggctaatgcttgctgccacgttaatgtactgtttttaagacgccttgtgcatggtgtaggtgccactgcatttcagttacttacacgggcaaggattttttttacattgtcattagatattgagaattatttgctgattttttttttcaataatagcaagtataaatgctgccaaagctgattcttaatgtcagagggatcctgaggagaggttgccatttccattagaaatctattttgtgattgaaggtaagataaggtatcggggagggaagttttggctacatgacatctataacatccccgtgattactcaataagaaaaattcaagagatgtggacaggtgtgtggccagcttagctgtgacacctgatgcaagagattagagcttcctggggactttgaagtcttgatgtcagacctgatctgccttctcatcttgggct

SEQ ID NO: 201166 - DNA, 601 bp, Human
tattatcagatacccagctgagtttcaggcctaataattctgctaacctggacttaactcttgaagtagaggatagaggaataagagattcactgtgcatggattccttctaattctgggtttaggatggaatgtggttgaaccaaaaaatccactatctttcttcctgccacctggctttcttggatctcttacttagggaatcctggtcctacttgggacagtgttgaagactggatgtcaggcacgtcttgacctatgtggatttagtaagccacttcagtctcagctcacccaataytgtaagttgtgctcctctaaaaggctggagttctgtgagctgtcaaatatattgtcgtcttcttcatcaatcccaaatttatggaagcactatattctctccctgaaggctgatgatatagcttgaatcaagctgcccttctaatgagatttccactgggctgccagaaaagtctgtaccaggcacatatctgggtgggaattctttgaaacaagaaaaaatgtttccagccctgcccataatgcttcctcactgaacagtatctcaaatgattaagctactgcttttgtggcacggagt

SEQ ID NO: 201167 - DNA, 601 bp, Human
agagattcactgtgcatggattccttctaattctgggtttaggatggaatgtggttgaaccaaaaaatccactatctttcttcctgccacctggctttcttggatctcttacttagggaatcctggtcctacttgggacagtgttgaagactggatgtcaggcacgtcttgacctatgtggatttagtaagccacttcagtctcagctcacccaatactgtaagttgtgctcctctaaaaggctggagttctgtgagctgtcaaatatattgtcgtcttcttcatcaatcccaaatttatrgaagcactatattctctccctgaaggctgatgatatagcttgaatcaagctgcccttctaatgagatttccactgggctgccagaaaagtctgtaccaggcacatatctgggtgggaattctttgaaacaagaaaaaatgtttccagccctgcccataatgcttcctcactgaacagtatctcaaatgattaagctactgcttttgtggcacggagtcaaacatagtttggctgaccccaagaggcagtgaagtcaaagatgccatagggtcacatgttattaacattctggtacataac

SEQ ID NO: 201168 - DNA, 601 bp, Human
tatattctctccctgaaggctgatgatatagcttgaatcaagctgcccttctaatgagatttccactgggctgccagaaaagtctgtaccaggcacatatctgggtgggaattctttgaaacaagaaaaaatgtttccagccctgcccataatgcttcctcactgaacagtatctcaaatgattaagctactgcttttgtggcacggagtcaaacatagtttggctgaccccaagaggcagtgaagtcaaagatgccatagggtcacatgttattaacattctggtacataacagggatcraaactcagtttatgggtggtattgcttcagtgccatatacgatgctattattagtaagccaagaataataaaatattcgtaatagcctaaagactgttaggcatgtgttttatcctttaactctaaacgtcctggaaactagttccataaatggaaattaaaatataacacagtctattttttgcttgtccaaataaggtcatatgttgggtaacaaatgcgtagcaaatgactgtttcttaacctaggtctttaacataaacatcagaaatttttcaatgttgaatattgtcatatttt

SEQ ID NO: 201169 - DNA, 601 bp, Human
ttttgcttgtccaaataaggtcatatgttgggtaacaaatgcgtagcaaatgactgtttcttaacctaggtctttaacataaacatcagaaatttttcaatgttgaatattgtcatattttgatttttctctgatcatttaaaatgtctttacatatttgcaataaaactagaatataggtaaagtaaatgcaaaagacactcacatccagccttaatatatcactttcaagattttgtgatttttcacagctatatagaaatatgtacattatatgagtggctttctttacatgttagayccaccacttacattaatagttaaacaagtgtagaaataaatgttgtagaagtagtttaatagagaagaaatgtttattcttacttatacctaggagttctgctgctggttctccaagtccagcatgtctttgcttgtgtcggtaatgccttgctctttgtacttgattttgagtaagactgtcatactgaaccaagttttacgagtaaaaatgaagattggtcttatactcttaatttgctagatgaccaaactgatcaatgccttaaatgttcagaattgttgagagctaattctgaaa

SEQ ID NO: 201170 - DNA, 601 bp, Human
taattgcatctaatagatcagacttgggcctgctaattttcatctaatcaacagaggcaggaaaacatagtctggaatgctaactatgtgaatgaaaaatatttagtcattcttgaaatgataggaatgtttttccaacaagcttaaataaacacaatctcttttgagactgtgctaaactttttttggatgagacaactcttaggcaaccaaacagaagttaatgaaggttattaagagacatgcccttcagaaaaggcctgcagactttaaaaagaaaagattccatcttctttatgcygcaaccattgataaatagcagaattggtttactttttagcttttgtctacccagtagaatttaacattttaattagtaatcatactgcccaatgttcaacagataccattttacctaacatggctatatgagaccatcttattttaaaatcctcatcttcatctcctactgtttgcctcagttccaaggaattcattggactcaacactcctgtatttatagcacctgattacacttttcctatgaagcatgtttgtttattcccaccaacacaaggtcccgccagataataaaattatt

SEQ ID NO: 201171 - DNA, 601 bp, Human
aaaaagaaaagattccatcttctttatgctgcaaccattgataaatagcagaattggtttactttttagcttttgtctacccagtagaatttaacattttaattagtaatcatactgcccaatgttcaacagataccattttacctaacatggctatatgagaccatcttattttaaaatcctcatcttcatctcctactgtttgcctcagttccaaggaattcattggactcaacactcctgtatttatagcacctgattacacttttcctatgaagcatgtttgtttattcccaccaayacaaggtcccgccagataataaaattatttttaaacatactaaaatgtacatattcaagtgaagtgtttttcctttcacaagttatatgggaaaaatgtatacttactccagggatacagtcattcagaatatttttggtgcctctcttttgaaactgactttagagatcatagcacatccttttgaatatccttagctttgtaaacccttgactttgaaggtttattagactctaggaaatagccaaagtcatttatgttgaagtctggtttaaaaaaaaaaaaaaaggtggccgatct

SEQ ID NO: 201172 - DNA, 601 bp, Human
tattcccaccaacacaaggtcccgccagataataaaattatttttaaacatactaaaatgtacatattcaagtgaagtgtttttcctttcacaagttatatgggaaaaatgtatacttactccagggatacagtcattcagaatatttttggtgcctctcttttgaaactgactttagagatcatagcacatccttttgaatatccttagctttgtaaacccttgactttgaaggtttattagactctaggaaatagccaaagtcatttatgttgaagtctggtttaaaaaaaaaaaaaaaggtggccgatctagctgagtaaaactgtttagaggaagcaaaaagtgacagtaaaataaaggcactttgtcttctatgacatagtaatttgctctgaaagcaactatgaagaggtttcaaacagaattttaacatgaacagcattttggcataagaatatagcctctaaaagtgagtacttttatcaataacacttatttgtaagtataactcctggtgtgtttataaaaaaaatcaattcacctactacatagtatttttatgacttctagggattagaggcatgtatttaaatggtca

SEQ ID NO: 201173 - DNA, 601 bp, Human
attagactctaggaaatagccaaagtcatttatgttgaagtctggtttaaaaaaaaaaaaaaaggtggccgatctagctgagtaaaactgtttagaggaagcaaaaagtgacagtaaaataaaggcactttgtcttctatgacatagtaatttgctctgaaagcaactatgaagaggtttcaaacagaattttaacatgaacagcattttggcataagaatatagcctctaaaagtgagtacttttatcaataacacttatttgtaagtataactcctggtgtgtttataaaaaaaatcamttcacctactacatagtatttttatgacttctagggattagaggcatgtatttaaatggtcatatactgtattacaacgtttttctgaaattgcaggtgttctattccaacatttttttcaaatacattagactaaaataatttgcctacagaaacaggtcaaaataggttgcgattctaatataatttatttttagtattttagttatccaattccacttctagttataccatactgtttcctggtatagtcttaagtatatcctataaaaacagaatgatttcacattgcttaatata

SEQ ID NO: 201174 - DNA, 601 bp, Human
acccccttagtttgcctatcagtaggaagacaggagatcatgttgtttttcaccttaatggacagctattgccctgcatgtcagctcacttttaaaacaattcaaggagtctctatttgttagggaagctgtaatatgtttggagataataagctatccacttgggatggcctcgggccttgcatacggagagggtcggcaagctcagatcttttcaaagccataaatctctcatcctttctgggaatcaagtttttaaaagattccatggagattttatgttagacgaattccacagggkgtgtgtcccatagtcctgtgacagagatactaagaacatgactcattgcatgaggagcccctacaattcttgttatgaaagtactggttgaattttctcttactgttgacatatgtttgagatccctgacttcctaacactgagatctgctcgttaaagacagtttttagaaataggtcttctgtgtctttcaacttgagagtggcaagaaacactggcaaagataaaaagtagtataaatgattctgtgatgagtttgcccttgtccctaaagatctagcaaggcccccatcatgagag

SEQ ID NO: 201175 - DNA, 601 bp, Human
ggatccgttttctgcttctacttgtttattcctgcatcctcccacctagggacattactcaacccaagagccccgacccactctcccatcctgtcaggcttgacctctgcccattcttgtgcatatccatccaaattctaggccccaggccctaaccattggcacttaagtccccactgagtaactgagctgctcagcctccatcagtctgccaggcaccaggataccatcatcagcacgtgtgcattctgctatgcactcttccttttctttctctgattcttgtcagtctctaattaasccggttgtcaatttgccaagcagtcagcaaaagtgcccataacttcacgcagtagaagatgagctcctgagttgaatgactgcctagctgttttcaggattattttaataacactttttatttggcattatcaaggagtagggtagttccagaagtgaattctccagataattaaaatttgggatgtcagatcttacattaagaattttataggaggccttctataatgctttgtgtacttttctgccttcttaagccaaagatacagatcatatgatcgtattttaacccatctcagga

SEQ ID NO: 201176 - DNA, 601 bp, Human
tgcttccttttccgatcacaaaataatacaaatcttgggaacatttgcacactgttcattttaaaataaaataaactgctctgagataagtacttcagaaattacaaggatgtaggtgttgttatgagaagtgtacaaagggaaaaaggataaccaaatgtgtagcggctaaaagaatttgaaaactccaaccgtaagagacttttttccatgacttaatgaggctttcttaagtacacattcagatgctacggaaattcccacttccagattagggaatttttgtatcttcaattttttytttttcttattgtctgctttagtagagttttccctctagcttcatttgggaaaatttcatcttcactgtactttccttcccaagatgcaattatgttgacaatttagtgatttatttgaaaggtgttctgaccagttatgggtcacatttgaaaagcatctgtgttaacagcttgacatatgaaaatacagcaaaacagacaagctttgatgctgtcttggccagccttatctccagttttatggccctggctaggagacctgatatatttagccattgaactgccatgtcaagtcagtg

SEQ ID NO: 201177 - DNA, 601 bp, Human
cataatcaaataagcaggcttgggaatttacaaagaagagctatgtaaaatctgcaaagcattattaaagcctgaaagaagaggtaataagagaaacgagagacagataggaattgttagcttcatttatcttaatacttccacctgagtattttttcacttgtaaagaaatgtaagaatgtgtgtgtctttaaaaagtactttttctgtaatcccagcactttaggaggctgaggtaggaagattgcttgaggtcaggagttcgagaccagactgggcaacatagtgagacctcatctcraaagaagaagaagaaaaataaataaaaaggaaaaaaaaaagcattgttttctagaaatttgcctacaaagaggtttttccagaaagacttttcttagtgtgtgggtgtgtgtgcatatgaatgcataggaacagagggtgctggcagacagctgctttccacagccaggcctgcagtttaccagaggacagcacagtgaggcagcagtcctagagaccatcagaatctggaaacagagttaattaccctcctgacaagacagtactacacacagacccaacagggatggctgtgtatgcc

SEQ ID NO: 201178 - DNA, 601 bp, Human
tcaccatcatcctagaaaggcttgtattctccgacacacagtttcagtgccataccccctgtaacataggagcacagaaatgtaggatttaaatgagaatcttctggtcttcagaccaaaatccgacaggcaatttccgtattcaaagcactgttgcatagactagagaaaagtctgggataataacaattcctgatgagcaaatttcagaatgctctaacttttagacaagcagaatgtatatttcacatactttgctcacactccctcaagcctctttatttatttatttatttatttwtttttttttttttggatgagaaacagtcatactgagatactatgattctagattctttaaaatcacctcttctcccaccaggaactctcttggataaaagctatgttaagaatctgaccagctcttggtcattattctttaagaactataaatataatattgatttgaaatgctttaattgagaacagtgtcaaatatgtctcactttggagctaattatttagcataagaaattgaatctcagttgtctcatggcacttgtttccaaaaaattgccctgacattagtaataggatcagt

SEQ ID NO: 201179 - DNA, 601 bp, Human
tggattctctaagcaaatccctaaaattcactgctgctaaaattccatactaccctatgatatgatgattatacatttttcaaggtcagtttaatcttcagtatatacttttccatagtatgttttctgaaggcaaaattttctcataaatttcacatattaaatgtcagtaaagaatagaagattttggtatgtgtagatatgcttaagacatttctttacccataagctgtccaggaaagcagtgtgcctagagttcagaattcttccctcaactttggcctaatcgctctagaacatwgaagtcctttctcactgggataacctgtggtgggtttacttaaacctgatacttgccttctacgctctctcatatttgtggttagagtaattttgacaaaacattggcagtcttgggactgaagactggaatagaatcattatttggggtagctaagaaaagtagtgataaaagaaagactaataggtttgagaactaaagatgtttgcagtaaattttaagagaatggaggggagcagcaatacgctaactcaggatgtcttaaaacaactaaactttagttattttttgatgtttaca

SEQ ID NO: 201180 - DNA, 601 bp, Human
gccagttaccctctctgcacctcatattttccatctgcgaaaatgtaggtagagacattctatactcagctctttcacaaagatattgtgagcaacagcttactttgaagacgttagtatatttttgttgaaaagatgttgcataagtatgtcagtgcctctgttccctttggcaacaccgttcccacaacctggcattatataaactgtcccttattgatgcattgagaaacaggtaccattacagcagattttgtgttgcacagaagctgagagtgtgactggagtcagactgcctggrtttgaatcttgggtccaccacaaactaatgctgtaaccatgggcaggtcagtgtgctagatttcctcatctgtaaattgaggataataatagcacccacctcattggaatatggtaaagctggaaggcatttatgaacagcactttaaaccttatataaatacataatatgctttatgtaagtatatgtagttaccgttattacccaaagcaattcttcattaatatggtaaagcgtcacctctggtcttgctttgtttagtgcccttattcccagcatggctgctcactctttgtcctg

SEQ ID NO: 201181 - DNA, 601 bp, Human
ttttaaaccattttctaactagttgggatatttttgaatctcaataatgtgatcttatactttatgcctcccagcttatattaaataagcacaacttatatatccttatctaaatcactgaattaaaataaactgcacagaaccaaggacaaagacctgcagaatgatgctgaacatagctgcttacagtagtcctaagcatttataccttgagtagagttatttagctgacaacatatatctccacaagaaatcttgaaagacacttcgcccgtatcttgtctgaagtcaaaatatattrcaaaatacatcagagcattcctttgctggaaaccctatttttaaaatgagctgaagttataggggcctggcttatttttccagaatctgtactggctcctggtagtcagtgctttattcccctaaatgtcacaaatcatatatttaacaattatttctgaagaattttcagttgtgaatgtcaatttatgtagtttttagaacactttgtcccttttgaattgacatttggcctattttcttaaatctctttccattctcttcgatctctctcacacacagtactggttctgtaataagc

SEQ ID NO: 201182 - DNA, 601 bp, Human
aattattttaagaggaagctttggtccttcagcagaacccaggcttatgttcacaccagagtagagaaagaactgcccgtctcccagggctctacttggtgctcagcagatactggctgagtgaataaaaaggaaaccttcaggatcagagatgcctttggatatcattcttgcctgagatctccctttgaggtcttgctattctaataatatatccatcttattttggattcttcttaaagttagtcttgtcatctcgctcactgccccactgtatacctaaagacttacttcaacactrattggaatttttcaggttgtcctatacagaagtctagacatacagcattctgctgtcacctcccccattcgtattagcaatccaggttatttggcaactttggaagccacacctttgggatgtcagtcaaatcaaaccaaatttccaggtcctgggttttgtcagattcttgcgatcgtatgcaactctcctctcaggctctgcacagcagcttttgtgttgcacagaagctgagagtgtgactggagtcagactgcctgggtttgaatcttgggtccaccacaaattatgctgacttcc

SEQ ID NO: 201183 - DNA, 601 bp, Human
tctgtgtccacatatgtaaagggcaaataatagtacctaactaatgggttattttgaggactaaataaatgaatgaatgcaaagctaactctggctggcatatggccgttgcttactctgcactgtaactattttatagcatcttcttctgagtcggcccaagctagccaacatggaaagcccccagcgtccccgcccccctttgttcccaccccatcagcctgcctccagttcttcctgccctctaaggacactcacaccaacagctttccttttactttttcatttcattgtaaccctsaaatattatctttctcctccttggttttagagaagggagtttcttatagccaactatggaataataggttgttttttttctattgcagctgctttatataggtatttattttgtcccaaattcacccttacattatttttctgcatcccatcaaaacctttttcacatacagtagtcctaagcatttatacctgttttctcttaaggattaggcctagtttccattagcttctagattttttttttatacagggtcttgctttgttacccagattggaattcagtggtgcaaacacagct

SEQ ID NO: 201184 - DNA, 601 bp, Human
gacactcacaccaacagctttccttttactttttcatttcattgtaaccctcaaatattatctttctcctccttggttttagagaagggagtttcttatagccaactatggaataataggttgttttttttctattgcagctgctttatataggtatttattttgtcccaaattcacccttacattatttttctgcatcccatcaaaacctttttcacatacagtagtcctaagcatttatacctgttttctcttaaggattaggcctagtttccattagcttctagattttttttttatwcagggtcttgctttgttacccagattggaattcagtggtgcaaacacagctcactgcagcctcaacctcccaggctcaagcgatcctcccacctgagcctcccaagtaactgggactacaggcactgccaccacacccagctcattttttttgtatttttttgtagagacaaggttttgccacattgtccaggcaggtcacgaactcctggcgtcaagcaatctgcccgactcgatctcctaaagtgctgagattacaggtgtgaggcaccgtacctggcccttcaagatttcttaaaac

SEQ ID NO: 201185 - DNA, 601 bp, Human
ttcacatacagtagtcctaagcatttatacctgttttctcttaaggattaggcctagtttccattagcttctagattttttttttatacagggtcttgctttgttacccagattggaattcagtggtgcaaacacagctcactgcagcctcaacctcccaggctcaagcgatcctcccacctgagcctcccaagtaactgggactacaggcactgccaccacacccagctcattttttttgtatttttttgtagagacaaggttttgccacattgtccaggcaggtcacgaactcctggcrtcaagcaatctgcccgactcgatctcctaaagtgctgagattacaggtgtgaggcaccgtacctggcccttcaagatttcttaaaacaaggccagcaccccacaagtatttcttctgtcttcgttgatttgttgttcttcattcactcattattttattcatctagcatttgttgagtgcctactatatcctaaagaagattaaaaatagtccttacccttgactcacattggtaatttgttggtaatattagtcatatgttaatatgttgtaaagagacaacataatctagcatatttt

SEQ ID NO: 201186 - DNA, 601 bp, Human
aaacacagctcactgcagcctcaacctcccaggctcaagcgatcctcccacctgagcctcccaagtaactgggactacaggcactgccaccacacccagctcattttttttgtatttttttgtagagacaaggttttgccacattgtccaggcaggtcacgaactcctggcgtcaagcaatctgcccgactcgatctcctaaagtgctgagattacaggtgtgaggcaccgtacctggcccttcaagatttcttaaaacaaggccagcaccccacaagtatttcttctgtcttcgttgatktgttgttcttcattcactcattattttattcatctagcatttgttgagtgcctactatatcctaaagaagattaaaaatagtccttacccttgactcacattggtaatttgttggtaatattagtcatatgttaatatgttgtaaagagacaacataatctagcatattttaggcagtcacattaggattgaaatcaaaaccctatagaaacatgtgcttcaaaagtatgtggcaagtatatgatacagaattctttcatttgaacataacgtaatttgccgttttaatcggtaacaaat

SEQ ID NO: 201187 - DNA, 601 bp, Human
ctcactgcagcctcaacctcccaggctcaagcgatcctcccacctgagcctcccaagtaactgggactacaggcactgccaccacacccagctcattttttttgtatttttttgtagagacaaggttttgccacattgtccaggcaggtcacgaactcctggcgtcaagcaatctgcccgactcgatctcctaaagtgctgagattacaggtgtgaggcaccgtacctggcccttcaagatttcttaaaacaaggccagcaccccacaagtatttcttctgtcttcgttgatttgttgttsttcattcactcattattttattcatctagcatttgttgagtgcctactatatcctaaagaagattaaaaatagtccttacccttgactcacattggtaatttgttggtaatattagtcatatgttaatatgttgtaaagagacaacataatctagcatattttaggcagtcacattaggattgaaatcaaaaccctatagaaacatgtgcttcaaaagtatgtggcaagtatatgatacagaattctttcatttgaacataacgtaatttgccgttttaatcggtaacaaataacattct

SEQ ID NO: 201188 - DNA, 601 bp, Human
ttaggattgaaatcaaaaccctatagaaacatgtgcttcaaaagtatgtggcaagtatatgatacagaattctttcatttgaacataacgtaatttgccgttttaatcggtaacaaataacattcttgtaacactaagaaaagtagtactccaggacatacagaaagtttacattatccctgactcagttcctcaaaaacttgtttagaataaaaaatgtttttaaaagtatgatagcaacaaagtttaaaactaaaatgattttaaaatgatataaagcaactagtaacctaacactttrtagatacaagcttttaacaacattgctctttaaccagtgtcttttgctaatagacgtaatatacctgcttactacataaactctgtatgaaaggcatctgcatgaattaagtagcatcagtcttttggcatcttagtgtacacatctttaaatcaagtggatttgatcagattatttgtaagttctcttccaattttaacattctttaattgtagacattaatagtgctttttctagaaactgatgcagacttgtagaattctgcatcagtcagcagagaggaaagagccttcatatttt

SEQ ID NO: 201189 - DNA, 601 bp, Human
aaaaatgtttttaaaagtatgatagcaacaaagtttaaaactaaaatgattttaaaatgatataaagcaactagtaacctaacactttgtagatacaagcttttaacaacattgctctttaaccagtgtcttttgctaatagacgtaatatacctgcttactacataaactctgtatgaaaggcatctgcatgaattaagtagcatcagtcttttggcatcttagtgtacacatctttaaatcaagtggatttgatcagattatttgtaagttctcttccaattttaacattctttaattstagacattaatagtgctttttctagaaactgatgcagacttgtagaattctgcatcagtcagcagagaggaaagagccttcatatttttcatgaaatatgtatctgaatcaaacatcacaagaaggttgcagcatcaaatatagggaggcaggctccttgttttatttcactgtaattctaaactaacacctatcagggtcaaaattgggaccaccatttgtaatgttgcatttctttacttagtagtcttgggaacttcatggccatcctgaactgataataggtttgtaggaattgcc

SEQ ID NO: 201190 - DNA, 601 bp, Human
gtggatttgatcagattatttgtaagttctcttccaattttaacattctttaattgtagacattaatagtgctttttctagaaactgatgcagacttgtagaattctgcatcagtcagcagagaggaaagagccttcatatttttcatgaaatatgtatctgaatcaaacatcacaagaaggttgcagcatcaaatatagggaggcaggctccttgttttatttcactgtaattctaaactaacacctatcagggtcaaaattgggaccaccatttgtaatgttgcatttctttacttagyagtcttgggaacttcatggccatcctgaactgataataggtttgtaggaattgccagcatctaagagtttaaaatacactaagtcctcacttaacatcctctgtagattcttggaaactatgactttacgtgaaatgacatgtaacaaaaccagttttaccagaggctaattgatataaacaagagttaagttcctaccatatatttctggtcacgaaaacatcaccaaacttctaaataaagacctaaaacatttctaatagtaacaattaaagtaagcatgagttatatatacattta

SEQ ID NO: 201191 - DNA, 601 bp, Human
cctccttctgccatgcagttcaaacacataccatacccagtgtggcaggctcactgaacgctgttgtcctgcagtgtttattgttgtacgtttgtgtgattatcacctgctttaacagatttgtattttataagaatttgtatttattcactcatttattttccaacttgcttattccagtccagggttgagggtggccacagcccatcccagcagctctgcaagctgcaaggtaggaatcgaccttgaacaggacaccatcccattgcagggtgcacacacacacacacacacacacacwctctctctctctctctctctctcacacacacacacacacacacacacacacacacactcagattaggaccatgtagataccccagttcacctaacgtgcacatctttgggatgtgagagtacccagagaaaacccacacagcatgagagaacatgcagtctccacacagagagtggccccaaccgagaactggtttttattcccctcctaaaagttatgacacaatgatgttgaacaaaaccattgctgtttgaggacctgctgtactacagcaaagaagtatgcagtactcctctaggg

SEQ ID NO: 201192 - DNA, 601 bp, Human
cacataccatacccagtgtggcaggctcactgaacgctgttgtcctgcagtgtttattgttgtacgtttgtgtgattatcacctgctttaacagatttgtattttataagaatttgtatttattcactcatttattttccaacttgcttattccagtccagggttgagggtggccacagcccatcccagcagctctgcaagctgcaaggtaggaatcgaccttgaacaggacaccatcccattgcagggtgcacacacacacacacacacacacactctctctctctctctctctctctcwcacacacacacacacacacacacacacacacactcagattaggaccatgtagataccccagttcacctaacgtgcacatctttgggatgtgagagtacccagagaaaacccacacagcatgagagaacatgcagtctccacacagagagtggccccaaccgagaactggtttttattcccctcctaaaagttatgacacaatgatgttgaacaaaaccattgctgtttgaggacctgctgtactacagcaaagaagtatgcagtactcctctaggggacaccatccacagtgtgttctcc

SEQ ID NO: 201193 - DNA, 601 bp, Human
agattaggaccatgtagataccccagttcacctaacgtgcacatctttgggatgtgagagtacccagagaaaacccacacagcatgagagaacatgcagtctccacacagagagtggccccaaccgagaactggtttttattcccctcctaaaagttatgacacaatgatgttgaacaaaaccattgctgtttgaggacctgctgtactacagcaaagaagtatgcagtactcctctaggggacaccatccacagtgtgttctccatggaggttacgttgtatttatatataatgaatggygcccccgacagctgtgtcacgttttgagcataggagcaaacattcctttttttccagaatgaacagagttttactacatagttgctatcgaccggccatgctgtacaggccctgtactttgccattgttcatcactttctcttcaatcgtaacttctccccatgtattagaaagcaattttagatcacggtaaagtcatgacgctgaaaaattaggaacataaagccacctttttctgcgtggttgcctcaagtgatgtactaaagctttacaaacaaacatataaacccctacccttct

SEQ ID NO: 201194 - DNA, 601 bp, Human
gaatggtcccaattcagggcagcactagagcatcccactcctaggaggcatagccagtctccttctaatgaatgtcctgtatttttatttaaatgtaccagcctttgtttgaaattccattccattgcaaagcagaggtagattacagactagtttttatcacattgtttaaacttgaatggagacacaacagttttctttaaaggtgaagcacattcaagatcaaggtctgtggaaaaactccttctttattgcaggaccagaaaaataaaggcaccaaggtgctcaggctccaaaattkcagggaatttaatcccaagggatgttgactgactctgggaggttttcagggtgtttttaattcatctgtttcccaacataattcatttgtagccatgacctaagcattcttgtgacagaaaaatgggttcacaattgacatctgtgttagagaaacatgactaataaagtcttcttttttcaccattcccttaataatggggaatgaaaaattatgacctttcaagtcatataattacaaatttctaaatgaaccatttagaatttctcttttaaggatgcaaattagtaatcagttgct

SEQ ID NO: 201195 - DNA, 601 bp, Human
aagcattcttgtgacagaaaaatgggttcacaattgacatctgtgttagagaaacatgactaataaagtcttcttttttcaccattcccttaataatggggaatgaaaaattatgacctttcaagtcatataattacaaatttctaaatgaaccatttagaatttctcttttaaggatgcaaattagtaatcagttgctttacagtgtaatacaggcacatgaggttatatttatatgtgtaataaaaggtttatgataatgacagagtagaaaattacaccataaatcacattttccttyttaaaagatagcaaattaaatatgcaaatattgccaactgagattcacaaaagatgctatcttgaaatatttatgtaaaacacggacccatttcacctattcattgtagttaagttttaattttagattataatataagtgtgttttgaggggacagatgcgttctgtttttcccagtgacttctgtgttattacaatattcatgcttaaaggacggccagataaaataaaaatttgttcatcattccaataattagactctgcttcccatttcaccagtccatgtagaacaatattcaa

SEQ ID NO: 201196 - DNA, 601 bp, Human; identical to SEQ ID NO: 38357

SEQ ID NO: 201197 - DNA, 601 bp, Human; identical to SEQ ID NO: 38358

SEQ ID NO: 201198 - DNA, 601 bp, Human; identical to SEQ ID NO: 38359

SEQ ID NO: 201199 - DNA, 601 bp, Human; identical to SEQ ID NO: 38360

SEQ ID NO: 201200 - DNA, 601 bp, Human; identical to SEQ ID NO: 38361

SEQ ID NO: 201201 - DNA, 601 bp, Human; identical to SEQ ID NO: 38362

SEQ ID NO: 201202 - DNA, 601 bp, Human
tgacccgtggtggtgatgcatctttgtgagcagaggatctatgtatattagcacctaacatctggagcaaaactagtcctatggacataagccagatgctgttccgaggtccaaaaggtgagacagctggcagttctatcaaggacagcccgtgttccctgggctttcaccctcttttaacgcttttgtgtccagtaaagctcaaagtcaaatgaaagacaatgacacgtcttaatcagatagtgcacctataatcagagtagcagatgaaaaagtttacagtctgtactaattgcacatktattgttggggattttccatgttttctaaacacaagtcattgcatatatctggagtgatagatggggaataaaggagatctggctacacagttttgtggcatttctgatagataagctgaggaatggtggccataactcaagctcatgaggacatctccctgtccttgtcttgtgacttctggccactagacagggccactctgagtcttttactctgcgtgttggtatatgagatggaaatgcctgttcttaggaattttacacagattttcttactgtaatggtcaaagagtaataaa

SEQ ID NO: 201203 - DNA, 601 bp, Human
agggttaaaggatgaagaacaagaatcaaaagttgacaagtatgacgcaggtggagataaaaggtctggtgggaattctgatgggtgaaaagagatttcatatgtggttccttgtaaacagcaaatgcctctgttatgacctacttagccatgcaagagtgtactcgtttctaaagcatcccatggccatttcactgatgacatgctacatgcctttctcaaaccttgccagagcaaaaattatttcagtgctttcagtgaagtctttatttcatgacttcaaggaggatagcagagaagyaaattagcagccctcataccacaccactcatatgcctgtggggatactcatatccccatatgagccctgaccacatcaaccttgctctaatgttcgtgttggtgatgcttctgcccatactgagtgccagactctggcagcttctggaggggggaccgtgagtctttcagtggatcctccctgtgtccaggggtcagtcattcctggtcagatattaaaaagaaaaagtactactttgatcgtaacgtctatcttaggttaatttccaggattttcaagcccacttcattgctgcatcat

SEQ ID NO: 201204 - DNA, 601 bp, Human
tcattgctgcatcatacctgttgactttggaagtcaagatgctcaggtatgtcccccagttaagccactctaggtgatcaggactgacgttgaataaatagctcatgtgttggctaagtcttaagtgttagtatgtagaacattgttttgaaaattatgacttggcaagtatttgttagtaactacgtgttattttagaagatatttcaaggtcagatttttaaagtcatttgttggctagaaattcttgagtcagtgtatctttctcacttcagaaattgtggatgattgtttgtgtttattatatataatataaatatttacttatacattatataaaataaatacaagtatatatgtggctcataacttccatgtgaactaagttaaaatgttctgattacatgccttctaatcagcgagtatcattgaagtgtttttaagtgtcatatatctttaaggatctgtgaaaatgagttctattataggtagatggtacactaaaaatttcttacaggttgtattaatacctctgtttgattagaagttagctatttttatatttatatatttactaatattcgaagtgggactttgccat

SEQ ID NO: 201205 - DNA, 601 bp, Human
cttctaatcagcgagtatcattgaagtgtttttaagtgtcatatatctttaaggatctgtgaaaatgagttctattataggtagatggtacactaaaaatttcttacaggttgtattaatacctctgtttgattagaagttagctatttttatatttatatatttactaatattcgaagtgggactttgccatggagctggcttagcttgtgttgtgactgtatttcttctcaactggctgtgatactgtcactgtatagtgatcttctccatagtgatcttcaactcgcaaatgattaaataatatttaaccttaatagggaaatgtctataccttatatcaagtcaatacattattccttttgcttagatttctgtttatttaaacataactctactaaactggtatcttagagatatatagcatctctttggaacatctgttggtcattgtgtatttaattcagcccaagaatcaattatagtaaatatttaattcaggcatctttaagctatacaacccatgaaacttaatgttacgcatttcgaaaccataatgatatgatggtgcccaccttcattggaacatttttcaccgctg

SEQ ID NO: 201206 - DNA, 601 bp, Human
ctaatcagcgagtatcattgaagtgtttttaagtgtcatatatctttaaggatctgtgaaaatgagttctattataggtagatggtacactaaaaatttcttacaggttgtattaatacctctgtttgattagaagttagctatttttatatttatatatttactaatattcgaagtgggactttgccatggagctggcttagcttgtgttgtgactgtatttcttctcaactggctgtgatactgtcactgtatagtgatcttctccatagtgatcttcaactcgcaaatgattaaataatatttaaccttaatagggaaatgtctataccttatatcaagtcaatacattattccttttgcttagatttctgtttatttaaacataactctactaaactggtatcttagagatatatagcatctctttggaacatctgttggtcattgtgtatttaattcagcccaagaatcaattatagtaaatatttaattcaggcatctttaagctatacaacccatgaaacttaatgttacgcatttcgaaaccataatgatatgatggtgcccaccttcattggaacatttttcaccgctgctt

SEQ ID NO: 201207 - DNA, 601 bp, Human
aatcagcgagtatcattgaagtgtttttaagtgtcatatatctttaaggatctgtgaaaatgagttctattataggtagatggtacactaaaaatttcttacaggttgtattaatacctctgtttgattagaagttagctatttttatatttatatatttactaatattcgaagtgggactttgccatggagctggcttagcttgtgttgtgactgtatttcttctcaactggctgtgatactgtcactgtatagtgatcttctccatagtgatcttcaactcgcaaatgattaaataatatttaaccttaatagggaaatgtctataccttatatcaagtcaatacattattccttttgcttagatttctgtttatttaaacataactctactaaactggtatcttagagatatatagcatctctttggaacatctgttggtcattgtgtatttaattcagcccaagaatcaattatagtaaatatttaattcaggcatctttaagctatacaacccatgaaacttaatgttacgcatttcgaaaccataatgatatgatggtgcccaccttcattggaacatttttcaccgctgcttct

SEQ ID NO: 201208 - DNA, 601 bp, Human
atcagcgagtatcattgaagtgtttttaagtgtcatatatctttaaggatctgtgaaaatgagttctattataggtagatggtacactaaaaatttcttacaggttgtattaatacctctgtttgattagaagttagctatttttatatttatatatttactaatattcgaagtgggactttgccatggagctggcttagcttgtgttgtgactgtatttcttctcaactggctgtgatactgtcactgtatagtgatcttctccatagtgatcttcaactcgcaaatgattaaataatayttaaccttaatagggaaatgtctataccttatatcaagtcaatacattattccttttgcttagatttctgtttatttaaacataactctactaaactggtatcttagagatatatagcatctctttggaacatctgttggtcattgtgtatttaattcagcccaagaatcaattatagtaaatatttaattcaggcatctttaagctatacaacccatgaaacttaatgttacgcatttcgaaaccataatgatatgatggtgcccaccttcattggaacatttttcaccgctgcttctc

SEQ ID NO: 201209 - DNA, 601 bp, Human
ctgcctgccttttaaaatgacatttttatatttccaaaatgatttatgtgaataatgtccatgtacctgtagatgcatcttggattgtaggccctactatgacatgagaccacatttaaagttgaaaataaaatgtttccttcaacaactatccatgaagtgcttaatcaacccataacaaatgcttaacacaaggagtaagctctattactgagaaattgtgtcctctgcatgcagtggttctcagccaaaagtgactgtgtttactagtttggtgagatttctttttgtagaactaggrcttggaagcctgagcaatcacctatttctttctagtatgttgaagaaatctgataggctcttttaacctttataaattacttgcacttcctaccctaagaaataaatgaaataaaataaaacaaaaatggaattctaagaaaagccttaaactgtggccaaatctgctttcacagcaattaagattgaggcagtatggagaggtaggagtcagccgacatgacagcatgtacctcatttttttaaaagaaagatggattaagatcagatttttttttattggaagctaaaagttataaag

SEQ ID NO: 201210 - DNA, 601 bp, Human
accacatttaaagttgaaaataaaatgtttccttcaacaactatccatgaagtgcttaatcaacccataacaaatgcttaacacaaggagtaagctctattactgagaaattgtgtcctctgcatgcagtggttctcagccaaaagtgactgtgtttactagtttggtgagatttctttttgtagaactagggcttggaagcctgagcaatcacctatttctttctagtatgttgaagaaatctgataggctcttttaacctttataaattacttgcacttcctaccctaagaaataaatgaaataaaataaaacaaaaatggaattctaagaaaagccttaaactgtggccaaatctgctttcacagcaattaagattgaggcagtatggagaggtaggagtcagccgacatgacagcatgtacctcatttttttaaaagaaagatggattaagatcagatttttttttattggaagctaaaagttataaagtaaaatacccaaagatttaattaaatcagtaagcatttgttgcatttttaaccagaattctttaatcatttcctgacagaatgactgtgtattagatctctgcctcat

SEQ ID NO: 201211 - DNA, 601 bp, Human
aaaagccttaaactgtggccaaatctgctttcacagcaattaagattgaggcagtatggagaggtaggagtcagccgacatgacagcatgtacctcatttttttaaaagaaagatggattaagatcagatttttttttattggaagctaaaagttataaagtaaaatacccaaagatttaattaaatcagtaagcatttgttgcatttttaaccagaattctttaatcatttcctgacagaatgactgtgtattagatctctgcctcattgaaattgtctaggccccctgcatctgttttkagcaagacttcagttgagttccatcttttcattcttttacagtctgtaaaggcctggtgagtcagcgcattgaaaatcagtcatcatcttctgtctatgagttcttagtggcccgtacattattttctcagatccctgcatcattacaatttccatgtgtttaagtctcttctttatgttttttaaaaaaacaagtgaagccagtttctcaaacaggaggtgctcacattctatttattctccaagtgtggagtttgtgcccagcatgtgaccgacaatacagaatgaaaagcacatgac

SEQ ID NO: 201212 - DNA, 601 bp, Human
attggtaatacttggctgccttttctaccgctcccctttctaaatctcatgttacccatagtatacatgggccctttgtatgcctgcctaaatgacttcactgaagttttctgtaaatccctcaaacctcaaacttaagaacccaaactgtaatatcatgttattagcaggaccagctgtctgcgcgtcttttccagacactgggctcatccatttggatatggactcccacaaagctgacgagaccctctgggtgcaggagcgtctcctgaggaccaaggccttgaatgccttgttcacktctgcatccccaacacttaggatgacactcggggggccttgatctcaatgtgtgggaagaacaaatgcccccgttatagtactgtgttggcttgttttgcagtgagacttattctgagattaagagctgcatttagcttcttggccaccaggatcccagagtaaattacttttcaggactctaaatagtacgcaggagatttgaaagaactgatgcaatttctaaagcagcctgacttcctcccaggaggttactcccacaccaagcctctgacttcatgaccaccagatttagaaattg

SEQ ID NO: 201213 - DNA, 601 bp, Human
ttttcgttggatattcccagtctttatttctacatccctcttcaggctgagtgcttaaaatacatttatatgtagtctcaattagattatgctgtttcccccaaaagactacagtgactattattttaatttatagaacctcgaattgcatggaatagctaccacatctccctttaaacctggtagcttccaaaacttcctgatggcgttttcgcaaatgggtccctatgtgtcattgaaggagacagtgtatctaggaaaagaaatgaggatactgagcaaggtgttggtggctcatgcstataattccagcattttgggagactaaggcaggtagctagcttgaggccaggagttcaagaccagcctggccaacacaatgagaccccatctccacaaaaaaaaaaaaaaaaaaccctaaaaattatccaggcataatggtgcatactagtagtcctaactactcaggaggttaaagtaggaggatcacttgagcccagaagttcaaagagctatgattgcaccactacactccagcctgggcaacagagtgagaccctgtctcttgagaaaaagaaaaaagttattggttttcccattg

SEQ ID NO: 201214 - DNA, 601 bp, Human
tggcctaaagtatacagggggatgtgagtaggtatatacaaatactacgctgttttatattagggacttggcacatgagcgtctttggattttggtatccatggggtcctagaaccagtctcccaagggacaattgtaattggtaagaagaaaatgtagagaccacagatctgtgagcatttctgtctgtgaccttcctctggaaaagctcagtctgaagcacaaactgggtcttcatagagaggcacttccagctgcctcagagcactcgctgcaaagcttcgggctgctcagagaaaayggctcctgatgccattatgggcttctcatcgtgccctgagatgtgctgggttctgtttcttgtgtctattcaatgaattctgacccttcaagagcttcccagatgctttccaggaagaaccctgggccctggggacgactgccttcctaaggaactttccttctagatatctgcctttgtagtttttcatgtttaagtgacaagtagtgagtggcgctgcttgtagaatctgaacacaaaatgtccccggattagtaggtgtcatccagttatcagtctcgtgctcacacccccgccacc

SEQ ID NO: 201215 - DNA, 601 bp, Human
tcagagaaaatggctcctgatgccattatgggcttctcatcgtgccctgagatgtgctgggttctgtttcttgtgtctattcaatgaattctgacccttcaagagcttcccagatgctttccaggaagaaccctgggccctggggacgactgccttcctaaggaactttccttctagatatctgcctttgtagtttttcatgtttaagtgacaagtagtgagtggcgctgcttgtagaatctgaacacaaaatgtccccggattagtaggtgtcatccagttatcagtctcgtgctcacayccccgccaccgggtttcgatttgcccatctctgctttgctgctggatctgctggtccttggggcctcactctgaaccacattcttgtgtgctagagggaaatttctgtgtgtgaaatgtggccactagggagtcagtaagttcaggtacaccaggaaaaggcgttgagtcccagagaaaggaaccttcaaggagaagcttggaagagggaggaaatgagtgtgacaagggaccatgggaagaaggagcagaatgtttaaactgaaatccctgtatatactgtacagacaaatagctcttt

SEQ ID NO: 201216 - DNA, 601 bp, Human; identical to SEQ ID NO: 38363

SEQ ID NO: 201217 - DNA, 601 bp, Human; identical to SEQ ID NO: 38364

SEQ ID NO: 201218 - DNA, 601 bp, Human; identical to SEQ ID NO: 38365

SEQ ID NO: 201219 - DNA, 601 bp, Human; identical to SEQ ID NO: 38366

SEQ ID NO: 201220 - DNA, 601 bp, Human; identical to SEQ ID NO: 38367

SEQ ID NO: 201221 - DNA, 601 bp, Human; identical to SEQ ID NO: 38368

SEQ ID NO: 201222 - DNA, 601 bp, Human; identical to SEQ ID NO: 38369

SEQ ID NO: 201223 - DNA, 601 bp, Human; identical to SEQ ID NO: 38370

SEQ ID NO: 201224 - DNA, 601 bp, Human; identical to SEQ ID NO: 38371

SEQ ID NO: 201225 - DNA, 601 bp, Human; identical to SEQ ID NO: 38372

SEQ ID NO: 201226 - DNA, 601 bp, Human; identical to SEQ ID NO: 38373

SEQ ID NO: 201227 - DNA, 601 bp, Human; identical to SEQ ID NO: 38374

SEQ ID NO: 201228 - DNA, 601 bp, Human; identical to SEQ ID NO: 38375

SEQ ID NO: 201229 - DNA, 601 bp, Human; identical to SEQ ID NO: 38376

SEQ ID NO: 201230 - DNA, 601 bp, Human; identical to SEQ ID NO: 38377

SEQ ID NO: 201231 - DNA, 601 bp, Human; identical to SEQ ID NO: 38378

SEQ ID NO: 201232 - DNA, 601 bp, Human; identical to SEQ ID NO: 38379

SEQ ID NO: 201233 - DNA, 601 bp, Human; identical to SEQ ID NO: 38380

SEQ ID NO: 201234 - DNA, 601 bp, Human
ggggcggcgacgtgtcccctagtccctacagcagcagcagctggcgccgctctcgcagtccctacagccctgtgctcaggtgagttctgccgttctgcctgtgtgtgccttggctgcgctggccagatccccaggaggaagggaaagtggtgcccgggtcctcagaacgactcaggtccaccaccgagacgagacaacaccgcctgagcctcccaggaaggataggcgttttcgcgcgcgtgacacttttttagggggtcgaagggacaaagcaactgggcgaagggaacttttctcctarctgtggcagggaagatttctaaggaagaattaaaagtttcagacttgttgcattaatgtgttaacaggtttctctcagttgctctttgcttttctggtacaatttgggtaaacctagaggtggtttaagtcttaattttgaaagttctgtgaagaggtttcattgttgggaatttaggaatggactgcaacttaagatctagtattgtacaggggaataagaatcaggtactgatgtcagagttagatgtggattgcagatgtttcttatgattattacagaaatgggagaagcagcctt

SEQ ID NO: 201235 - DNA, 601 bp, Human
aagtttattcttttagtatgttaaaaaagcttaggtggaagccgatagttctgaatactgaagttaaaaaaggtatctatttagtgatattcttgtgtgggatagtttttacctgatctttcaaagtcataattatagaaggtagaaaaaatgacaagactgtggtttctttgttggtttgtgatgacacccagttgctaataacattataaatctgggtggtgtaacctagtgtaaccaagtgaatggctgagtacattcttatactattataagcctgtaactgcttactttaaaagckaagtagactttttcttagatatatacccgaaggataaaaacacaatataactagacctttaaatatcaggatctttgtccagaaatctttaaaaggtgtaatttaatttaatgaaattggagtaaaacttttctgtagctttcttgcctttttgttatataatattctttttaaaaagtgtgccttaaaatatacttatccactaagcaaagtgcattaaaaacaactttcgagtattttatgggttcttatattccttgagatgtttggacattccagaccttatagtgtagagtattg

SEQ ID NO: 201236 - DNA, 601 bp, Human
cagttgaatttgttttgcaaactggttggttgaagtttcagcacttgaacaatttaaagtgcttgatgcaattttaagaatggattttgtacttatcaggttttttagttgctggatacttcagcgagatcctttattgtataatagtggtatgtattttttatatacatatatgaaatatataatcgtggtatgtatgactaggactattcatatttagcaagtattttttgaccctgtattgtatgccatatactgttttaggtattgggatgtagcaggaaagaaaaagttacttgcsctcatagagcttgcattctggaggaccgttcaacacataatcttttcatggtgtttacattgaccaccagtatttctaaagagttgaatttggaaggaactttagggtgtcttggctaacattcctgacagatggccatttggtatgtgcctgaaatacatctagaggtgggaagcacgttagttagaggcaacctgttcactagatttgggacttgagtgttttagcaagatccttgaagactcagtttcctaaactgtaacagggaaacacttgtttttctggattatttcaaggatt

SEQ ID NO: 201237 - DNA, 601 bp, Human
ttttagcaagatccttgaagactcagtttcctaaactgtaacagggaaacacttgtttttctggattatttcaaggattaagtgaaaatttatctttttaaagcatgcagccttacagaaatatttaaggtcgttgaattattcaatatcccaaattgttagaattcttcatattgtgaccaaaatccaccttcgaaccattgctccaagtttaaccctttggaatggtacagagcacacgtgtatgctaaccctttaaaatataaagacagttgtcatgatttctgagtcttctagactwaaaaactcatacggttttcagatttttcacattatatctagtttgtcaaatgtccagcttaaaacatagggcctagaattaatagctaaaatagttgattggaaaaatctaaagattttaaaatataataagtgtattgttactttttaggaacggttaattgaactcacttgtacagattaatggaaaagttttatttattttcagaatttattacttgtggtaagtggcccatgttctttaatgaatggactgctgtgagttccatgaaggcaactgggctgtcttatccatcattgt

SEQ ID NO: 201238 - DNA, 601 bp, Human
ctctaaatataaataagaaaaattattgttatatgtggtacctctgtaatggattatttagtgttttgtcctgaaaactatagttcaaaagtatatgaaatgaagatattccgtaatgaaaaaaaaactcaaaaaatatgccactgatttaatatatacttaatagaaataagtcatgaaaatccctaggtgaatggaattcttaaaatgcttttaaaaagtgtcaaaaaataggatactagaacaaatggagaaactctcagaagggaatggaagtttaggttaactgtcttaaatttcyaaagctgtaatcattattttcattctcaaagtgatggccttgtgttttgctccttctctgaccaaacttcacctgacatttacatctactcagtccttatcacatttcttttccgctaacgctaatatttatttctttccatttctatcaccatttcaggttaattagctagacttcatgttactgtgaacattcttctcgtttcatccattcttctcagttcattctgtatcaggagagttttcttaatatctttgtttagctcatgtcactcccattatattagaattattattagaa

SEQ ID NO: 201239 - DNA, 601 bp, Human
caaaatgcctttcagaaggcttttacaaatttacatttcccaacagtgtggaattacccatttcctgagtctcaccaacacttggagttgtcacatattccattattggttttttttgttgttttgtatttttagtagagatggggttttgccatgttggccaggctgatcttgaactcctgacctcaaatgatctgcccaccttggccttccaaagtgctgggattatagttgtgagcccctattggtgcctggcaccattatcgtttcattcatttgcatttctttgatatttaataaggtttaatatattttcatctgtttactggatattttaatttctttctttttttttttttgctcttgttgcccaggctggaatggtgcgatctcggctcaccgcaacctctgcctcccgggttcaagcgattctccttcttcagccttccgagtagctgggattacaggcatgcgccaccatgcccagctaattttgtatttttagtagagacgaggtttttccatgttggtcagactggtctcgaactcctggcctcaggtgatccacccgcctcagcctcccagagtgctgggattacag

SEQ ID NO: 201240 - DNA, 601 bp, Human
gattatagttgtgagcccctattggtgcctggcaccattatcgtttcattcatttgcatttctttgatatttaataaggtttaatatattttcatctgtttactggatattttaatttctttctttttttttttttgctcttgttgcccaggctggaatggtgcgatctcggctcaccgcaacctctgcctcccgggttcaagcgattctccttcttcagccttccgagtagctgggattacaggcatgcgccaccatgcccagctaattttgtatttttagtagagacgaggtttttccrtgttggtcagactggtctcgaactcctggcctcaggtgatccacccgcctcagcctcccagagtgctgggattacaggcgtgagccaccgtgcctggcctttttctttcttttttttttttaattgagaccgggtctcactctgtcacccaggctggagtgcagtggcaccatctgctcactgcaacctccacctcccagctcaagtgatctctcacctcagcctcccgagtagctgggatcgcagatgcatgccagcatgcccagttaaattttttatttttggtagagacagcgtttc

SEQ ID NO: 201241 - DNA, 601 bp, Human
gcggggattacaggtgtgaaccactgcacctggccagatgttctaatttcttgatttttttttttttaaattaacttgcaagacctacttgtgtgttatagctactaacttgttttttttttttttgcggcattagcaagtatttttcgtgagcttgtcttttatcttttaaccttctttatgtaacgttttattttaggactaggtttttgatttgtctctgtgtgtgtgtgcacacgtgtgttttaagtggtagtagtttctcccaggtacctagtgtcaaactttagtagtacttttmtctctccatagttgtaatgaacttcttgttctgtaaagttttttcttttttttttttttccagtggtcttttggtccatacatttatcttggaatgctttgttagttctgcttgcttttagatttctctttgagcccctcctgttctctgcattcagatttaaaataccactttcatttgatcattttttttttctataagatacttacagaatcaaatacttttttttttgagatggagtctcgctctgtcacccaggctggagtgcagtggcacgcagtgtcatgatctcggctcact

SEQ ID NO: 201242 - DNA, 601 bp, Human
tttcttgatttttttttttttaaattaacttgcaagacctacttgtgtgttatagctactaacttgttttttttttttttgcggcattagcaagtatttttcgtgagcttgtcttttatcttttaaccttctttatgtaacgttttattttaggactaggtttttgatttgtctctgtgtgtgtgtgcacacgtgtgttttaagtggtagtagtttctcccaggtacctagtgtcaaactttagtagtacttttatctctccatagttgtaatgaacttcttgttctgtaaagttttttcttttttttttttttccagtggtcttttggtccatacatttatcttggaatgctttgttagttctgcttgcttttagatttctctttgagcccctcctgttctctgcattcagatttaaaataccactttcatttgatcattttttttttctataagatacttacagaatcaaatacttttttttttgagatggagtctcgctctgtcacccaggctggagtgcagtggcacgcagtgtcatgatctcggctcactgcaagctccgcttcccaggttcacactattctcctgcctcagcctc

SEQ ID NO: 201243 - DNA, 601 bp, Human
tagtgtcaaactttagtagtacttttatctctccatagttgtaatgaacttcttgttctgtaaagttttttcttttttttttttttccagtggtcttttggtccatacatttatcttggaatgctttgttagttctgcttgcttttagatttctctttgagcccctcctgttctctgcattcagatttaaaataccactttcatttgatcattttttttttctataagatacttacagaatcaaatacttttttttttgagatggagtctcgctctgtcacccaggctggagtgcagtggyacgcagtgtcatgatctcggctcactgcaagctccgcttcccaggttcacactattctcctgcctcagcctcgcgagtagctgggactacaggcgcccgtcaccacgcttggctaattttttttgtgttttcagtagagacggggtttcatcattttacccaggatggtcttaatctcctgacctcgtgatccgcccgccttggcctctcaaagtgctgggattacaggcatgagccaccgcatctggccatcagatgcttttaaaattaatttatttatttaagatggagtctcactgt

SEQ ID NO: 201244 - DNA, 601 bp, Human
gggcacaaagcaagactctgtctcaaacaaaaaaactactgttttgtcagtatcagaatatgcagtgcattattgtagtcaccattctgcccaatagatcgctaaaatttattacttctgtctatctgaaactttgtgtcttttgatcaacatctccctttccctatacactcctctcccctagaccctggtaaccaccattctactccctacttctatgagtttgaattttctagattccacatataagtgagatcatgcagtatttatcttcctgtcacaaatgacataatttacttctttttttttttttaattatactttaagttttagggtacatgtgcacaacgtgcaggttagttacatatgtatacatgtgccatgttggtgtgctgcacccattaactcatcatttaacattaggtatatctcctaatgctatccctcctccctccccctaccccacaacagtccccagagtgtgatgttccccttccagtgtccatgtgttctcattgttcaattcccacctatgagtgagaacatgcggtgtttggttttttgtccttgcaatagtttgctgagaatgatggtctccagc

SEQ ID NO: 201245 - DNA, 601 bp, Human
tgtagtcaccattctgcccaatagatcgctaaaatttattacttctgtctatctgaaactttgtgtcttttgatcaacatctccctttccctatacactcctctcccctagaccctggtaaccaccattctactccctacttctatgagtttgaattttctagattccacatataagtgagatcatgcagtatttatcttcctgtcacaaatgacataatttacttctttttttttttttaattatactttaagttttagggtacatgtgcacaacgtgcaggttagttacatatgtatayatgtgccatgttggtgtgctgcacccattaactcatcatttaacattaggtatatctcctaatgctatccctcctccctccccctaccccacaacagtccccagagtgtgatgttccccttccagtgtccatgtgttctcattgttcaattcccacctatgagtgagaacatgcggtgtttggttttttgtccttgcaatagtttgctgagaatgatggtctccagcttcatccatatccctacaaaggacatgaactcatcattttttatggctgcatagtattccatggtgtatatgt

SEQ ID NO: 201246 - DNA, 601 bp, Human
tcagttcctttgggtatatacccagaagtgggatcatgtggtaatcttgtttttacttttttgaggaacctccataccattatccatgatggctatagtaatttacattcataccagcagtgcacaagggtctccttttctgtatacacttgccaacacttgttatctttcatttttttgatgctagccattctaacaggtgggaggtggtatctcatagtggttttagtttgcatttccttggtgattattgatgatgatgagcattttttcatgtatctgttggccatttgtatgtcctttttaaaaaaaaaaattgagatgggatcttgctatgttgcccaggctggtctcaaactcctgggctcaaggagtcttcccacctcacccacttcagcctcccaagtagctgggattcaagcactaatcaccaaatccaactgtattccctcttttgaggaatgtctatttaggtcctttgcccgtttttgaaattgggttattttctttctgttgatttgagttgctaatatattttgaatattaatgtgttatcagatatgtggtttgtaggtattttctccttatccacaggttgtca

SEQ ID NO: 201247 - DNA, 601 bp, Human
tttaatttgattccatccctttgtttatttttgtttttgttccctgtacttttgggtttataaccacgaaacctttgcccaaactaatgtcatggagcttttcttctcctttctactgtataaggtgtgagatgagagtctattttcattattctccatgtggatatccagttttcccacccctgtttatttttaagacacagggtcttgctgtgttgccaaggctggtcttggaactcctaggttcaagcagtcctcccgcctagcctctgcagtagctgggactacagacatgcaccaytgtgcctcactcccatcaccatttattgaagaggctgtccttttcttactgtatgctcttggctactttgccaaaaatcagttgactataaatgggtttatttctgggttctctattgtgttccttcagttaatgtctctgtttgtatgccagtaccatactctttggattaacatagctttggaataaactttgaagtcaggtagtgggatacctccagccttgttctttttgctcaggattgctttggccatttgggatcttttgagggtttgagtattccactgaatcagagtcttg

SEQ ID NO: 201248 - DNA, 601 bp, Human
ctgtggctggagtgcagtggtgtgatctcagctaactgcaacctctacctcccaggttcaagcgattcccctgtctcagcctcccaagtagttgggattacaggcacacaccaccacgcctggctagttgtttttgtatttttagtagagacagggtttcaccatgttggccagctggtctcgaactcctcacctcaggtgatccacctgcctcagcctcccaaagtgctgggattacagttatgagctacggcacctagcctcaggtgttatttttatctatgaagtcttcattaatctygttcagaagtgatttttaaaaatacctttagaactgagatcactttgtgagtacttattacatccagtttacccagttggtaggcatttgagttatttccagtttttggctgttatgagcaaagctactgaacatttgagtacaggtcttttgtttttgtttctcttgaataagttaggagagggtttgctgtgttgttgtatgggaagcgaatgcttgacttcctacagtcccatggtgtttttcaaaatgtctttgccatttgcattccagtcagtagagtatgggattccagatgcc

SEQ ID NO: 201249 - DNA, 601 bp, Human
gagttcaagactagcctggccaacatgacaaaaccccatctctactaagggtacaaaaactagctgggtgtggtgatgtgcacctgtaatcccagctactcggaaggctgaagtaggagaatcacttgagcccaggaggcggaggttgccatgagccaagatcttgccactacactccagcctgggcaacagagtaagactcggtctcaaaaaaacaaaacaaaaaacaaaaaaaacactttgtattttctagcaaactattccttcagcataaattgctttggattaaaaaaaaaaagaggtccaggctgggtgtggtggctcacgcctgtaatcgcagcactttgggaggccaaggcaggcagatcacgaggtcaggagttcgagaccagcctggccaatatggtgaaactctgtctttactaaaaatacaaaaattagccggacgtggtggtgggcgcctatagtcccagctacttgggaggctgaggcagaagaatcacttgaacctgggaggtggagcttgcaatgagctgagattgcaccactgcctgggcaacagagcaagactccatctcaaaaagacaaaaaatgaaaaaca

SEQ ID NO: 201250 - DNA, 601 bp, Human
gttgttgttgtcgttacttttaatatggcataagaaccataaaggaagtgtatttttagaataaacacaaaacatttcagttttatgttatcttttctagttttaaaaataacatgtttattgaaatgtatttcacatactgtacagttactgttttaaactataatttattagtctttagtctcttcatagctttgtgtaaccactaatttgagaatatttcagtcactccagagagaaactccatggctatttagcagtcactccccattcccacattccacagttttggcaaccaacrgttggtgatttctttctgtctttgtagatttacctatgctggatatttcatttcagtggaatcatataatgtatgatcttttatggctggattctttcactaaagcataatgttttcaaggtttatctgtgttgtagtatatggatcaatattccttttattggccaaatatcccattgtatggttatgccacattttatcattagtcatggacctttgggttaactttttggctatttttttaatgctgctatgaacatttgtgtacaagtttttgcatgagcatttgtttttctcttg

SEQ ID NO: 201251 - DNA, 601 bp, Human
taatataagtattcattactattctaggggccatgaaaaaaggaaatctcctattttgtagtatgtgtgtaatgattgccacattggtttctcatataccatgcgtacagaaacatttgaacagtgttttataatgaataatgtatgcattaatgttgaaatgatgagagagagcccgccatgtgatgatctaagcatcccaggaaaagaaaatgatgcatgcttaggcaccaagtcaagaagaagcttgaccttctgcaaaagcagaaaggagaccagcatggctggagtctggtaaatraagaagggtataataaagatggaaggcggtttaggccttgtgagtcacaacacagagttttatttttattttaaatgcagttggaaaccactacagagttttaagcaaggacatggcataatccaatttatgtttttaaaagacaaagacataaaatacaagccaacctgtaacaagtactgtgtgatcagcaaatagggaagtgatagagatgagactttagcttgacccatgcaaaatagataagaattaaacaggatcacacctgtactcccagcactttgggaggccgagatgggc

SEQ ID NO: 201252 - DNA, 601 bp, Human
ttctcatataccatgcgtacagaaacatttgaacagtgttttataatgaataatgtatgcattaatgttgaaatgatgagagagagcccgccatgtgatgatctaagcatcccaggaaaagaaaatgatgcatgcttaggcaccaagtcaagaagaagcttgaccttctgcaaaagcagaaaggagaccagcatggctggagtctggtaaataaagaagggtataataaagatggaaggcggtttaggccttgtgagtcacaacacagagttttatttttattttaaatgcagttggaaamcactacagagttttaagcaaggacatggcataatccaatttatgtttttaaaagacaaagacataaaatacaagccaacctgtaacaagtactgtgtgatcagcaaatagggaagtgatagagatgagactttagcttgacccatgcaaaatagataagaattaaacaggatcacacctgtactcccagcactttgggaggccgagatgggcggatcacctgaggtcaggagtttgagaccagcctaacatggtgaaaccccgtctctactaaaaatacaaaatttagctgggtgtagtg

SEQ ID NO: 201253 - DNA, 601 bp, Human
tgtggtatacagtcatgtccccagttttccatggggcatatattctaatactcccagcggttgtctgaaaccaccaaaatagtactccactctaaatatactatgtttttttctatacatacatacctgtgataaagtttaatttataaattaggcacagtaagagattaacaacaataataaaatagaacaattataacaataccctaaaataaaagttatgtgaatgtagggtctctctcaacatatcttattataccgtaccttgcataagagaaaccatggaaagtgaaattgaggwcgaggggactgctgtacggtatttgttttattcagtgaataaaacactgaattatgctaggggctgtggagtgatacaacaatgaattagactcagtttctgctcctcaaagagggtgcagtctgatagacaatgtggttgatatctaaaatgtgaagttaagagttatcataagaagggtgcagataaaatgctatgggagttcatagaatggagaccgtgctgcttgtttggatttggcttctttcttcataaggctttatgaagtcctttatgctagtccttgagagatggataagc

SEQ ID NO: 201254 - DNA, 601 bp, Human
tacagattaaatttgcaggcaagagacatgcctggtagtctttgtttttttctgtgaaacaataagtaaagctatgctatgagaagactaggaatgggattgtgtgagcttgatgaaagttgtgaaagtttggaatagctactaagaggaggaaaatgagtgaatttgggacatgtaataatcgctgaacagtgaggattagtttggttatggtgtctgtagaaatggagcagacacagactagtaataaagtaaaaaagactagtaacgtagatttttttctttcttttttttctttttyttttttttttgagacagagttttcgctcttgttgcccaggctggagtgcaatggcatgatctcggttcaccgcaacctccgcctcccaggttcaagcgattctcctgcctcagcctcccaagtggctgggattacaggcatgcgccaccacacccgtctgattttgtatttttagtagagacagggtttctccatgttggtcaggttggtctcgaacttctgccctcaggtgatctgcccatctcggcttcccaaagtgctgtgattacaggtctgagccaccacacgtggccaagagat

SEQ ID NO: 201255 - DNA, 601 bp, Human
agagggtatggatataagggaatagtatagagttagaatcagtaaaatgagacaattaagaggttgtggtatgggaactgggaaactagatttctagcctgggtaaatgagtggagagtagtgaaattaaaaatagagaatggtaaggagtagatgttacaggagggtatatttgctttgcaagtcataatttcaggaactggtgagaatagtattttgcgtctagtaatatagattagagtggaagaaaatttgaaacaaggagatgaatttaagaggctaccacagtgctgttacatayagttaatagagctgttataataacgttacatgacaaaatacacaggatcatcactttatatagtgattttcagtttgggagtcatattcatacctttttgggggggttaataagtttttgaaatggacacagctgctattagcatgagaaataagcagagtggaaacattggcctcaaagatgttgtggatagcagctactgtattgggcatcatatgtatagaacatttctgtcatccagaaagttccattgagtgatgctgctctgtgttattttcaacagtggaggactggatatta

SEQ ID NO: 201256 - DNA, 601 bp, Human
gtcataatttcaggaactggtgagaatagtattttgcgtctagtaatatagattagagtggaagaaaatttgaaacaaggagatgaatttaagaggctaccacagtgctgttacatatagttaatagagctgttataataacgttacatgacaaaatacacaggatcatcactttatatagtgattttcagtttgggagtcatattcatacctttttgggggggttaataagtttttgaaatggacacagctgctattagcatgagaaataagcagagtggaaacattggcctcaaagatrttgtggatagcagctactgtattgggcatcatatgtatagaacatttctgtcatccagaaagttccattgagtgatgctgctctgtgttattttcaacagtggaggactggatattatcagtattacagtaaaatttttaggacacagtatttgctaattagaaataattttcagaagacctagactcctggagaaactgtgagataatagtcaagtgaacaatatacattgctctccaaggaacactaaatagtctaacaacgagcactaaccagttgggtttcaggatactgggtttt

SEQ ID NO: 201257 - DNA, 601 bp, Human
ctgtgttattttcaacagtggaggactggatattatcagtattacagtaaaatttttaggacacagtatttgctaattagaaataattttcagaagacctagactcctggagaaactgtgagataatagtcaagtgaacaatatacattgctctccaaggaacactaaatagtctaacaacgagcactaaccagttgggtttcaggatactgggtttttattctggtactactttgtgttgtgtgtatttgggaaaacctgttagaaacatagaaagttctcttcttaaagaggtcctgtmgcctcttaaaaacatcacaagcaagaaacaggtaatatgtattcattaatttctacaacagtgtcggaatattaggaaaacatttttagaaagaaaaatcttggctgggtgcagtggctcatgcctgtaaccctaggccaaagtggacagatcacttgagtccaggagtttgagatcagcctggacaatatggcgaaacccctatccctgcaaaacatacaaaaattagtcgagtgtggtggtgcgcgcctgtagtccccgctacttttggggggtggaggtgggacgatcacttgaccc

SEQ ID NO: 201258 - DNA, 601 bp, Human
tttgtgttgtgtgtatttgggaaaacctgttagaaacatagaaagttctcttcttaaagaggtcctgtagcctcttaaaaacatcacaagcaagaaacaggtaatatgtattcattaatttctacaacagtgtcggaatattaggaaaacatttttagaaagaaaaatcttggctgggtgcagtggctcatgcctgtaaccctaggccaaagtggacagatcacttgagtccaggagtttgagatcagcctggacaatatggcgaaacccctatccctgcaaaacatacaaaaattagtcragtgtggtggtgcgcgcctgtagtccccgctacttttggggggtggaggtgggacgatcacttgaccccagaggtcaaggctgcagtgagccttgtttgcgccactgcactccagcctgtgcgaaaaagtgagagaccctgtcttaaaaaaaaaaaaaattatctattaaacaaggaggttggacctgctacctacctccatttcagttcttttagtaaaacattatcatgccataattcattatatagttttaaagatgcacttctctcttattctcataactttttatggctgaaatg

SEQ ID NO: 201259 - DNA, 601 bp, Human
tgtcggaatattaggaaaacatttttagaaagaaaaatcttggctgggtgcagtggctcatgcctgtaaccctaggccaaagtggacagatcacttgagtccaggagtttgagatcagcctggacaatatggcgaaacccctatccctgcaaaacatacaaaaattagtcgagtgtggtggtgcgcgcctgtagtccccgctacttttggggggtggaggtgggacgatcacttgaccccagaggtcaaggctgcagtgagccttgtttgcgccactgcactccagcctgtgcgaaaaagygagagaccctgtcttaaaaaaaaaaaaaattatctattaaacaaggaggttggacctgctacctacctccatttcagttcttttagtaaaacattatcatgccataattcattatatagttttaaagatgcacttctctcttattctcataactttttatggctgaaatgttaatcattagtaaaaatggcctaaactgaaatttgtttagttttaggttcccaaaccatgtttgttataaacagtaaatatatttttggaatttattagcaaatcacaatatctgagagaatggaaact

SEQ ID NO: 201260 - DNA, 601 bp, Human
aaacatttttagaaagaaaaatcttggctgggtgcagtggctcatgcctgtaaccctaggccaaagtggacagatcacttgagtccaggagtttgagatcagcctggacaatatggcgaaacccctatccctgcaaaacatacaaaaattagtcgagtgtggtggtgcgcgcctgtagtccccgctacttttggggggtggaggtgggacgatcacttgaccccagaggtcaaggctgcagtgagccttgtttgcgccactgcactccagcctgtgcgaaaaagtgagagaccctgtcttaaaaaaaaaaaaaattatctattaaacaaggaggttggacctgctacctacctccatttcagttcttttagtaaaacattatcatgccataattcattatatagttttaaagatgcacttctctcttattctcataactttttatggctgaaatgttaatcattagtaaaaatggcctaaactgaaatttgtttagttttaggttcccaaaccatgtttgttataaacagtaaatatatttttggaatttattagcaaatcacaatatctgagagaatggaaacttactaagacgaaataa

SEQ ID NO: 201261 - DNA, 601 bp, Human
ttggctgggtgcagtggctcatgcctgtaaccctaggccaaagtggacagatcacttgagtccaggagtttgagatcagcctggacaatatggcgaaacccctatccctgcaaaacatacaaaaattagtcgagtgtggtggtgcgcgcctgtagtccccgctacttttggggggtggaggtgggacgatcacttgaccccagaggtcaaggctgcagtgagccttgtttgcgccactgcactccagcctgtgcgaaaaagtgagagaccctgtcttaaaaaaaaaaaaaattatctattaaacaaggaggttggacctgctacctacctccatttcagttcttttagtaaaacattatcatgccataattcattatatagttttaaagatgcacttctctcttattctcataactttttatggctgaaatgttaatcattagtaaaaatggcctaaactgaaatttgtttagttttaggttcccaaaccatgtttgttataaacagtaaatatatttttggaatttattagcaaatcacaatatctgagagaatggaaacttactaagacgaaataaatagtttaaggaaggaacttttg

SEQ ID NO: 201262 - DNA, 601 bp, Human
ttttgttgccattgcttttggtgttttattagacatgaagtccttgcccatgcctatgtcctgaatggtaatgcctaggttttcttctagggtttttatggttttaggtataacgtttaagtctttaatccatcttgaattaatttttatataaggtttaaggaagggatccagtttcagctttctacatatggctagccagttttcccagcaccatttattaaatagggaatcctttccccattgcttgttttttcagtagagatggggtttcaccatgttagccaggatggtcttgatmtcctgacctcgtgatccgcccacctcagcctcccaaagtgctgggattacaggcgtgagcaactgcgcccggccccaaaatatctttatatagaacaaaagttttctgagtctttatctctgttattcagattctgtctaaaagagattaatagttcagaagaatgaattgtgttgggattttacctattatctttgtatctcttttcttagataagattcactgattgtaaatttcaattaaatatagtttatgtgtctgaatgaaattgatgaccagaatcttgccagtgtaggaaaa

SEQ ID NO: 201263 - DNA, 601 bp, Human
gttttcccagcaccatttattaaatagggaatcctttccccattgcttgttttttcagtagagatggggtttcaccatgttagccaggatggtcttgatctcctgacctcgtgatccgcccacctcagcctcccaaagtgctgggattacaggcgtgagcaactgcgcccggccccaaaatatctttatatagaacaaaagttttctgagtctttatctctgttattcagattctgtctaaaagagattaatagttcagaagaatgaattgtgttgggattttacctattatctttgtatstcttttcttagataagattcactgattgtaaatttcaattaaatatagtttatgtgtctgaatgaaattgatgaccagaatcttgccagtgtaggaaaagttgatttcctacactgctttcttctgctgcttacctttctgctactcatcagtatctgatcaggggatagaaacatgacgtatatcagacttgtttggagctccaacaaaatctgaagggagaggaaattaaaaatgtggctgagtatttcatgttatgacacttttggttcctatattaaagttaaccaagttatttca

SEQ ID NO: 201264 - DNA, 601 bp, Human
aattaaatatagtttatgtgtctgaatgaaattgatgaccagaatcttgccagtgtaggaaaagttgatttcctacactgctttcttctgctgcttacctttctgctactcatcagtatctgatcaggggatagaaacatgacgtatatcagacttgtttggagctccaacaaaatctgaagggagaggaaattaaaaatgtggctgagtatttcatgttatgacacttttggttcctatattaaagttaaccaagttatttcacaaccagcttacaatcacttcatatttagccaaacatttcttctcatttctatgtataattataagcttattgatattaaagtgtgggtttttatgaaatgcttcctcaatactgaaccttagttgacccaaagcacatacttgtttttgaaagaggggggtagatgttgaatttgtgtttgagtttatcctaaacctaatcatcattttgtttttgtcctagaattagaatgtttctaaacacttccctccacactgtattaatgtcaactaagaacggaaattttcagtgtccaggcacggtggctcatgcctgtaatcccagcactttgcgatg

SEQ ID NO: 201265 - DNA, 601 bp, Human
tgggtgacagtgagaccctgtttcaaaaaaaaaaaaaaaattatctgcctatttattattttttttgaattaaaaaaattcacgaaataaaaatttaaaaaaattttgtgggtgcatagtagatgtatatatttatgggttacatgagatattttgatacaggcatgcatgcatattagtcatgtcagggtaaatggggcatccttttatcctttgtgttacaagcatttatcctttgtgttacagacaatccaactatcctcttatggttttttgtaaatgtacacttaaattatttttractgttggctgggtgtggtggttcacacctgtaatcccagcactttgggaggccgaggcaggcagatcacctgaggtcaggagttcgagaccagcctggctaacatggtgaaaccttgtctctactaaaaatacaaatactagccaggcatggtgcaggcatgcctgtagtatcagctatcaggaggctgaggcaggagaatcgcttgaacccaggaggcaggataatcgcttgaacctggtaggcaaaggctgcaatgagccgagattgcaccactgcactccagccagggctggagcg

SEQ ID NO: 201266 - DNA, 601 bp, Human
gttacagacaatccaactatcctcttatggttttttgtaaatgtacacttaaattatttttgactgttggctgggtgtggtggttcacacctgtaatcccagcactttgggaggccgaggcaggcagatcacctgaggtcaggagttcgagaccagcctggctaacatggtgaaaccttgtctctactaaaaatacaaatactagccaggcatggtgcaggcatgcctgtagtatcagctatcaggaggctgaggcaggagaatcgcttgaacccaggaggcaggataatcgcttgaaccyggtaggcaaaggctgcaatgagccgagattgcaccactgcactccagccagggctggagcgagactctgactaaaaacaaaaaaaaaaagaaaaaaaatgtgactatagtcagcctattgtgctagcaaatagtaggtcaccttcattctttgtattttttgtgcccattaaccctcccccgaccctccaccatgtcactacccctccagcctctggtaaccgtccttctactctctatctccatgagttgaattgttttaatttttagctcccacaaataagtgagaacatgcaaagtt

SEQ ID NO: 201267 - DNA, 601 bp, Human
aaggagcaacatgtagctttagtcacctctacattaccaccgttacctttgcctcccatgctgcctgaagataaagaagctgataggtaagtgcaaaaagtatttgtcaataactgttcaaagaaaaaatgtaagtctgaagtgagaaatgagttgacctcccctaaccccctcgaaacaactttagtgaaaaagactacaagtgaatgaattttcttgattatatgcatcttaaaatgaagcacattgcatacaagatggcaaaattaaagtttatactaagacattcagggaaaaattrccattgtcttgggatacaatgaatatttcaatatgattttgggtattagaaatgccagtattctctttggtttagttttccttgatgatgtaatcagagacagaatattttatgaataagttggccctagttaatatacatctcacaagcatttgtctcatttatttctaagtttcttcagtggccttgtaaatttatcactgtcagtgattttgttatcactttttagtttagtcttttcttaactcttttaattaaaaaaaaatttttttagcctgtcttgcagttgggattaatcac

SEQ ID NO: 201268 - DNA, 601 bp, Human
tggctcaagcctgtaatcccagcactttgggaggccgaggcgggtggatcacctgaggtcaggagttcaagaccagcctggccaacatggtgaaaccccgtctctactaaaaatacaaaaaacttagctgggcgcagtggcaggtgcctgtaatcccagctactagggaggctgaggcaggagagtcacttgaacctgggaggtggaggttgcagtgagccgagattgcgccactgcactccagcctgggtgacacagtaagaccgtgtctcaccaaaaaaaaaaaaaaaaaaaaaaaaagagaaaattcataatgtgattatgctttcctttaagatgtttaaaaatttctattatgaacagtgagggtatggcttattttttattgagaaacatattcttaagaggcagtaaaaatacagctaagaatgtttcttttttgtatcctagtgtagaaaaattagacttgtgtggtttatctgcctgttacaccacctagctgtttttatttttatgaagaaattagagcttccaccccctcccactccccattaaaaagcaactatatgagtagttttcctagctgattttttttttttta

SEQ ID NO: 201269 - DNA, 601 bp, Human
ggtgaaaccccgtctctactaaaaatacaaaaaacttagctgggcgcagtggcaggtgcctgtaatcccagctactagggaggctgaggcaggagagtcacttgaacctgggaggtggaggttgcagtgagccgagattgcgccactgcactccagcctgggtgacacagtaagaccgtgtctcaccaaaaaaaaaaaaaaaaaaaaaaaaagagaaaattcataatgtgattatgctttcctttaagatgtttaaaaatttctattatgaacagtgagggtatggcttattttttattgrgaaacatattcttaagaggcagtaaaaatacagctaagaatgtttcttttttgtatcctagtgtagaaaaattagacttgtgtggtttatctgcctgttacaccacctagctgtttttatttttatgaagaaattagagcttccaccccctcccactccccattaaaaagcaactatatgagtagttttcctagctgatttttttttttttaatagattttgaagtcagatggataaaaatgccatgtggacaagtgcttactttggcattatgaaaattttataatttaacacaaacaa

SEQ ID NO: 201270 - DNA, 601 bp, Human
ggagacttattttatatttactatttataatactgttagaagtacaataacatttgttagtgggctgtagtagaaagcttagtttttagtgccagttgtacctcttactactctcatgagttaatctttctgtgccccagtccatagttctattcatgggtgaaaatatttacagtttaacctcacagattagttgtaaagattaaattagttgatggactgaattttgcaagctgtaaagtgttatgcatctcagttattgtaattagtcatagtataaatcagcactgctggaaatacyacagatatttaaaactgctttagattattgaaaaaaagtaaaaattacaaaatatgatttacattgtataatatataaaccattatatgtgtaacatgtagatccggtgtgtaacgaatagacctagtgcttcatttgaaaaggattggtttttgtaaaagaggaactattggttggttttccatccccttttataatgaagggggaccacccccaggccatttttttcatgtatctgaaagtaatgctcttggtaattttgtttacaagtttctttttagtaaccattgtatacttttt

SEQ ID NO: 201271 - DNA, 601 bp, Human
tagaaagcttagtttttagtgccagttgtacctcttactactctcatgagttaatctttctgtgccccagtccatagttctattcatgggtgaaaatatttacagtttaacctcacagattagttgtaaagattaaattagttgatggactgaattttgcaagctgtaaagtgttatgcatctcagttattgtaattagtcatagtataaatcagcactgctggaaatactacagatatttaaaactgctttagattattgaaaaaaagtaaaaattacaaaatatgatttacattgtataatatataaaccattatatgtgtaacatgtagatccggtgtgtaacgaatagacctagtgcttcatttgaaaaggattggtttttgtaaaagaggaactattggttggttttccatccccttttataatgaagggggaccacccccaggccatttttttcatgtatctgaaagtaatgctcttggtaattttgtttacaagtttctttttagtaaccattgtatactttttgttttttgctgaacagctattagttgaaagtggtttataaactatttctcttgaggtaaagaaacaatct

SEQ ID NO: 201272 - DNA, 601 bp, Human
aatgttttccatttttatctagtcaaatctattattctctttcctttaaaacttctaggtttataaaatttaaaaaggttaagtcagatctgatagaagtttggttttggttattgtgtaaagaagtgttctgattcttcactccccccaacccagtgttgttactggtaccgtttattgtataattcatctcactaatttccatatataaaaattcttacatatatctgtttctctactttcttttcttttaacatattgtatttgtcagtatcttaactgttgtagtgtctttagatayattctatattggctcccaaactcaaatttctattttaggggcagacagtaatataaaaatgaaggggatggagtaaattagtgatgcgtaaatggctctgctgttgagcctcaacatcaatgttgctctacaagaatttaagcttgtcttagaacttttgcttttttaaaagaggaagcctagaacctgaatattatgtaaatctttggatttaaaattacaattcatagttctttataaaacattggatagactgagtaatatatatcctttgacttcagccaccgtttggcttttagt

SEQ ID NO: 201273 - DNA, 601 bp, Human
ttttagttctggatctctgaataggttgacagggcaaatgccacttaatttttctttttgagaaacttcttggcagttcttttgccgttattcttagacaaattttataatcaggttgtcaagttgtatttaaaaaaaaaaacaactcttccttgaattttttttggaactctattaaatctaatacagtcataatttggagacagctttataatattagtttcccatattaaaacatggtttcttttcattcgttcagatctaattttatttcttcagtcaaatgttttatttttttctkttgctggtgtgtatttctttttaaggcattttatttttgttgctggggtgtatagaagtgtttttaaaaagcgcattttctattttattattgcaaatattcaataaaaatgttttaaattatgtaacattgttcttggaaagtaatattcgataatacactggacatttaatatagatagtcttttaagttttaaattataagtgaaattaagactttagttttttgctctaaaaaatgttgatttgaatcttcaaataagaactcttgactaaagcctcattacaagttagagactat

SEQ ID NO: 201274 - DNA, 601 bp, Human
tcgcttgaactcgggagatggaggttgcactccgtctggatcatgccactgcactccagcctgggtgacaaagcaagactgtcttaaagaaacaaaacaaaactacaaaccaatttgttttaaagcatgttttttctctgttaaagaaccttccagtgagtaacacaggacataaatttactatgataattaagtcgtttttatcagatggtattattaagttgtttttatcaagtggtattaaaggattcatttgttttacagtattattcaacacgaataggaggataattacaattasattatttacattgataatatcttcagtaatttctgatcacagcagtgtagttgcaataaattttttcattatgggactcaactgctatgaaagtatgtgaagtccaaattttattatcattatgagattctctttcaacatgtcacattatattagatgacagactttgtcatatcagggaaatttaaaataaattgccaagttaagatatactttaaaactcagagctctttatgcattcataaaaagtacaaagctaatggagtttaaatttcagctgtaattctagaaagctggaat

SEQ ID NO: 201275 - DNA, 601 bp, Human
cattatttacattgataatatcttcagtaatttctgatcacagcagtgtagttgcaataaattttttcattatgggactcaactgctatgaaagtatgtgaagtccaaattttattatcattatgagattctctttcaacatgtcacattatattagatgacagactttgtcatatcagggaaatttaaaataaattgccaagttaagatatactttaaaactcagagctctttatgcattcataaaaagtacaaagctaatggagtttaaatttcagctgtaattctagaaagctggaawcttaaaaaaattagaagaataattgtccaatttagaaaaattaattaaccctgaaaagggtcaaagctgaattagctgttgcttgtggttatttaaatgggcaagataaatattatcatgtgctttcttttatttcttacggtaaaatgttttgtgtctctaccagaatcaaactaaatgctttgcagctgagcgttgtgaggccaaggcgggcggatcacttgaggttgggagttcaagaccagcctggccaacatggtgaaaccccgtctctattaaaaatacaaaaattagctggtt

SEQ ID NO: 201276 - DNA, 601 bp, Human
gagttggttatattaatatcttttgtactctcttagactgaaaaatcttttttttttgatgtttttcagatgatttcatccagtcataagtctaaatttgtcaataagttttatagttagatttttgttcacattctttatcaaactcttgtttcgtaaaagtagattatatatattattgttaatggatgcaaaataaaactttctggagattggttagagaattttgactctactagtgttggtttcatcttctcactgaaaaattatattttatttctgaaaagccttcatacaagcyctactactttttttctcagtttaaatacttgtctacagaagaagagtcagtatgtagaaatgatacctcagtttttacgataacttacaataccaaatcagtgttacttgtttgggatagatgatgataaatactgcaagggtagggaaaaataaagaatatacaattgggtggcgagtagatattgagttattagacagtttattcaatttgcttgattgtatataaaaactttagaactatatttgatagaatatgtgggcctcgctatggtgaaaccaaagaaaaagatattgactg

SEQ ID NO: 201277 - DNA, 601 bp, Human
tccaaaaaattaaattcaattttattgtgcttttgtttcatcttgtttttttattctatatatgcattttgtaagatatgagtacatgtaagtgggtctgtatatgtgtatattttaaaaagtgttcctttagtatttgtgatatactgtatggtaggatttagtttttctttcctcttttatggtgaataattcttatactgttattaatcagagggaaaggtatcttgacctgaattaattttagtagtaaattttttttgtcataagccttacacaacactttcatttagccttcagttttttttcctgcagtaactatccttggaggccagttttagcagcttaatctttcagaacataatcaggaattcagagaaagttttaaaaggcttcacaggagagcaaaaagtagctgtgtcagaagctatgtattttacttaataatgcatagagctagtattttatctttctttactcataactgcttattgaaataaaccaataggccgggcgtgattgctcatgcctataatcctagcactttgggaggctgagacaggcagatcacctaaggccaggagttcgagaccagcctggc

SEQ ID NO: 201278 - DNA, 601 bp, Human
atagtggcacatgcctgtaaacccagctactcgggaggcttgaggcttgaacccagggagtggaggttgtagtgagctgagatcacaccactgcactccagcctgagcgacagagcgagactccatctcagaaaataataaaataaaaacacaaaaattagccaggtgtggtggtgggcacctataatcccagctacttgggaggctgaggcaggagaattgcttgaaccttggaggtggaggttgcagtgagccgagattggaccactgcactccagtcagggccacagaacgagactcygtctcaaagaaagaaacaaatagattaaaatagcacagctattagaggccatatagtatatgggagatgaccttacggttagaaactactgagggcaattactgcatagagtaataattggtgtttataatgatgtgttatcaaaaagattaaatgacaacttttaaaactgttaagtaaaacggactcatacacaatatagaaggcattccataaaaattaatagaataagtttaatgattaaaagaatatgcttccttcttttagaaaatttgtaagaacattttttttctccaagga

SEQ ID NO: 201279 - DNA, 601 bp, Human
gaattgcttgaaccttggaggtggaggttgcagtgagccgagattggaccactgcactccagtcagggccacagaacgagactccgtctcaaagaaagaaacaaatagattaaaatagcacagctattagaggccatatagtatatgggagatgaccttacggttagaaactactgagggcaattactgcatagagtaataattggtgtttataatgatgtgttatcaaaaagattaaatgacaacttttaaaactgttaagtaaaacggactcatacacaatatagaaggcattccatamaaattaatagaataagtttaatgattaaaagaatatgcttccttcttttagaaaatttgtaagaacattttttttctccaaggaagtggaatgaacaaacctttattatagtgaattttttcttgtaataggcttcgtgtatgtgtgtatatttcattttctatttggatcatttctgatacaaagctgactcatacttaaattatgtggcaatttagtgtagtggggaagaacatatatttttgagacaagtaactggattttgaattccagttttactgctaggtaactggccaggtt

SEQ ID NO: 201280 - DNA, 601 bp, Human
gcatcatgataaataagaatgtgttctactatgtgagaagttacatgtaggtacctagaattacttaaatgcattagagaatgtgagaggttataaaatttaaaacataattatttcttaaatgaatctaataattttgatgggaactatgatgaagcaacatgattttccgaaaagggaactagatttgaagtctaatcctgagcatgctagctgtatgacattacactaattgtgattgccatgctgtgtggtattaaactaaatttgattgtctagttagagcataaagacagttcartaacactggttaaatgttatgggctaatctaaaatgagtgtattagaacatataaacattaaaaagcaaaagttaaacaatgtaaatatgcaaattagaaacaatacaaaaatcaagtaaaaatattaacttttaaaaatataaacatttgcactgttataactaactaagctattagttgtgtaagagaaacatcataaatgcctggcatagtggcttaaacctgtaatcccagcacttagggaaggccgaggtaggtggatcacccgactgaggtcaagagttgtttgagaccagcct

SEQ ID NO: 201281 - DNA, 601 bp, Human
gccgagattgcaccattgcactccagcctaagtgacagagcgagactcttgtctcaaaaaaaaaaaaaaggaaaacatcataaatatatttttttaaaacttagctttacttaaaaatgagaaaaagttaatcacgaaggttattaatttcaattaattatttaaagtgaatttttttttttttttgagacccaagtcttgctctgttgcccaggctggagtgcagtggcatggtctcagctcattgcaatctctgcctctcagattcaagctattctcgtgcctcagccttccaagtagmcagcattacaggtgtgtgtcactacacccatctaatttttaatttttatgtttttagtagagacagggtttcgctatgttggccaggctggtctggaactcctgacctcaagtgatctgcctgccttggccgcccaaagtgcttagattacaggcgtgagcccctgtgccctgccaaaagtgaaattttattgcgtcttaaaaaaggaattattcttaagaaacagagggttaagtggtatcaccaagtcatgggtatatttttgtgcagaaacttgcagatgctgaagaagatttttct

SEQ ID NO: 201282 - DNA, 601 bp, Human
gtgagcccctgtgccctgccaaaagtgaaattttattgcgtcttaaaaaaggaattattcttaagaaacagagggttaagtggtatcaccaagtcatgggtatatttttgtgcagaaacttgcagatgctgaagaagatttttcttgttttttgttttgttttttctttgagacagggtctcattctgtcacccaagctagcgtgcggtggcatgcaatcagggcttactgcagccttgacctcaggcagtcctcctgcctcagcctcccaagtagctgggaccacacacgcatgacagcrtgcctggctaattttttaaaaagtgatttgtagagatgaggcttgtcatgttccccaaggccggcgtcaaactcctggctcaattgatcctcctgccttggcctcccaaagtgctgggactggcgtgagtcatcacacttggcctgaagaaactttttctaaactaattgggtgaatggacaggggataaactgattctgaaatttcctcctaacgctttcatctgcatatagtttcatctcttttaatcactttgaggggaactttgaacctttttgtctgatttttaatcttttattg

SEQ ID NO: 201283 - DNA, 601 bp, Human
tgaagtaatacatgctactatttgggtaaaccaagaaaacgtgctaagtgaaagaaagctagtcacaacagactatgtattatatgattccatttatatgaaatatctagaataggtgccaaatattatcagaatatagattggtgattgccagagacatggggaggggattggaaatggagaatgactgctaatgcgtgtgaggtttctttctagggtcatgaaaatgttctaaaattcattgtagtgatgatggttgcagaactccaagtacactcaaaccaattgaacactttaagtkgttgaatgtatgatatgtgaattatatctcaataaagctgttatttaaggaaaaaaacgataactagctcctatgaattctgtgtttaatgaaaatagagtccaaattgagagggatagacgggtgaggggtgtctctgttataaaagatgagactgtaaaggtgctagacgtttgaatactatgccaaggaaccaaaatatcaaaaaacttctacttttttcaaaaaataatacagtgcttattgtacatttcaaccagcatttatagtaattttatctttgggcatttgataggcaaa

SEQ ID NO: 201284 - DNA, 601 bp, Human
attgagagggatagacgggtgaggggtgtctctgttataaaagatgagactgtaaaggtgctagacgtttgaatactatgccaaggaaccaaaatatcaaaaaacttctacttttttcaaaaaataatacagtgcttattgtacatttcaaccagcatttatagtaattttatctttgggcatttgataggcaaaaaatgctgtcttgtctttttttttttttttttttttttttttgagacaagcatttcactctattgcccaggctggagtgcagtggtgcggtcttggctcactgcartctccgactcccgggttcaagcgatttttctgcctcagcctcctgagtagctgagactacaggcaagtgctgccacgcccagctaatttttgtatttttaatggaaacggggtttcaccatgttggtcaggctggtctcgaactcctgacctcgtgatctgcccgcctcagcctcccaaagtgctgggattacaggtgtgagccactgcccccagcctgtcttgtctttttaatacacattttttaatttctgtggagcttgaatagtttcttatacttagaggccatgtgtatttctct

SEQ ID NO: 201285 - DNA, 601 bp, Human
aacattgaaagctgttcaggcatctggttttctggctctcagtgtttttcttatgttagtgatcaataaatttttttgaggggtgagttgaattgagaagaaaaatatgtataaaatagattgtagtctgtttcagaataatcaaataattagtagaagatgatagaggaatgtgttttagttaagatacaccaaataatgtcttaaaggaaaaaagctcaaatcttaatttggaatgactttcttctctgggtttcaaggaaatgtagagttagtaccacgttttgaaatttaaagaacrtagaacagaatgtgttagatgcacatcaggagatgacacatggcaaagggactgttaggagtttaatggaaagggaaactgtgggcaagtagggaagggagttggataggaatggaaagtagggtggggagtacatttcccatgtcactatttcctgaacagtgcagtagagcactagaaatatgtgctcttggaacaggtggtataaggtaatagtgatggtaatatgtataatgggttaagagcatgaattagaatcctatactctgttttcttcatctgcaaaatggggtaataatg

SEQ ID NO: 201286 - DNA, 601 bp, Human
acatagaacagaatgtgttagatgcacatcaggagatgacacatggcaaagggactgttaggagtttaatggaaagggaaactgtgggcaagtagggaagggagttggataggaatggaaagtagggtggggagtacatttcccatgtcactatttcctgaacagtgcagtagagcactagaaatatgtgctcttggaacaggtggtataaggtaatagtgatggtaatatgtataatgggttaagagcatgaattagaatcctatactctgttttcttcatctgcaaaatggggtaatartgactaactcacaggtttgttgtaattatttagtgatatagtgcatgtgaaggacttcacatagaatatggcacatagtaagcacacatcagtaaagtttagcttggtagtagattgattttgagggcagaattagattattaatacaataattattaggcaggtaggatggaattttggaagaaataaaaattttagttttagtcctctagtgaaattttattatgtggagatcagacctcaggaatggagttgatccagaagtttaaaaaaaaattttttttctgaaagcttagaagc

SEQ ID NO: 201287 - DNA, 601 bp, Human
ttcatctgcaaaatggggtaataatgactaactcacaggtttgttgtaattatttagtgatatagtgcatgtgaaggacttcacatagaatatggcacatagtaagcacacatcagtaaagtttagcttggtagtagattgattttgagggcagaattagattattaatacaataattattaggcaggtaggatggaattttggaagaaataaaaattttagttttagtcctctagtgaaattttattatgtggagatcagacctcaggaatggagttgatccagaagtttaaaaaaaaawtttttttctgaaagcttagaagcagtctctaattgtgaagagtttcagtcacatctgactagctgtgagtaattggttaacccaccagaaagaaaaaaacgagtcattggttgcgatcaaacccaaactggcagtgaaaggaagactgacaagtgaaactcaagagcagataataagggaaatgcaaagagcagatgccttggtacaggttagaaatggagggtagaagaggaagttaaggagcagatactgttgagattgagataactatagccaacaagaacagatagaattctgcag

SEQ ID NO: 201288 - DNA, 601 bp, Human
aagtagaggacaatgaggctgggggattgttttacttttgccacacagtagttatgtcaacgtgggcaaattatttattgtctctgagcttgagtgttacaagaagatcattatactttttgggttgttgtgagacctaagtgagacaatatgtgaagtattttcaccattcttcatgattaccattagagtctacctatatgtactagatgtcactgttactatgccatgtgataggagagactttatatagtagttgatccatcatacagttaccatataaaacttccaggtttcttayttgttttggtttgtgtttagaattttgttgaaagtcagatgttaaagtttgggagtaccaggtgttatgtatttatagaaatacatcatctgatgttgagaaatatgaactgtggcataacttttaaacaaggaggcatagttcttctttatacctcattaaagatttactataaaagtacataaggtggggcaaaaagaagaaaataatttctggtaaatgtaagaaaaaagaaaaaatatccagcctcactataataaaagaaatgtaatttaaacgatacaaactttttatctctca

SEQ ID NO: 201289 - DNA, 601 bp, Human
gtttcatatgtcagataattttcccatttatattgcttgccctttgtttttctttgttattttaaatctttaaatatggtcacatctgtctgtttggtggcttttttttaattttggaagggtggtttctctcatgcttaggaaggctgaatccttggcagaataataggaatttttttatattaaaaaaaattctattatagtttgaaaaagtattcaggtatcttaatcttttatttttatcttacagtgttctgccatctttagcctgtatgaaattcccacgttctttttttttttwaaattcccacatgttctgaggattcctgtttcactgatgtttttgtatgtcctgccaccatattatatcgctttaattatcaccaccctatagcatattttaatttctggtggataaagatcgccttctctttcccctttaaaaaaaaagattttatttttgtgcattttagatggatatgaggtctgaaaacatactgatggaaatttggctggaattacattgatgttagtgtgggaggaagaatgctttttaaaaaattggtcagggtgtgggatcattgacaagcatattaatgta

SEQ ID NO: 201290 - DNA, 601 bp, Human
tttcatatgtcagataattttcccatttatattgcttgccctttgtttttctttgttattttaaatctttaaatatggtcacatctgtctgtttggtggcttttttttaattttggaagggtggtttctctcatgcttaggaaggctgaatccttggcagaataataggaatttttttatattaaaaaaaattctattatagtttgaaaaagtattcaggtatcttaatcttttatttttatcttacagtgttctgccatctttagcctgtatgaaattcccacgttctttttttttttawaattcccacatgttctgaggattcctgtttcactgatgtttttgtatgtcctgccaccatattatatcgctttaattatcaccaccctatagcatattttaatttctggtggataaagatcgccttctctttcccctttaaaaaaaaagattttatttttgtgcattttagatggatatgaggtctgaaaacatactgatggaaatttggctggaattacattgatgttagtgtgggaggaagaatgctttttaaaaaattggtcagggtgtgggatcattgacaagcatattaatgtaa

SEQ ID NO: 201291 - DNA, 601 bp, Human
aaaaaatttttgaaaatatcactaaaaaagtagaaccaacatacttttttttgaaaactagttagaaacttaacaaatctaaaaaagtagtgttttatttaattaaaatatatatgtataatgcttactgtgggctagacactgctttaagctaattagaaatattcagttaatcatcataacaaatctatgaaggatagagaaggaaatgaggtacaggggtataggaaaagttagaatttttgtcatgcactaaatatgtgaaaaatagcaactaaaatttttcttttcaagcagatakttatttctgttggtttgattttaacaggatgtagagaatctcattatttatcaaggtatatttatgggaaaatgtgtttggaactcagattttgaggcaagatgcacacctgttcccactcccagttgtagtgtcattaaatggatttttactctttatattcctaccacctttcacgttgagggcgagtatttacttaggcagctcactatcactagtggccttaaggcctgaaatttggaatggaaaagagccaggaggtcttaagttttcagcattcgaaggtttgaggaccagagt

SEQ ID NO: 201292 - DNA, 601 bp, Human
aatttttgaaaatatcactaaaaaagtagaaccaacatacttttttttgaaaactagttagaaacttaacaaatctaaaaaagtagtgttttatttaattaaaatatatatgtataatgcttactgtgggctagacactgctttaagctaattagaaatattcagttaatcatcataacaaatctatgaaggatagagaaggaaatgaggtacaggggtataggaaaagttagaatttttgtcatgcactaaatatgtgaaaaatagcaactaaaatttttcttttcaagcagatagttayttctgttggtttgattttaacaggatgtagagaatctcattatttatcaaggtatatttatgggaaaatgtgtttggaactcagattttgaggcaagatgcacacctgttcccactcccagttgtagtgtcattaaatggatttttactctttatattcctaccacctttcacgttgagggcgagtatttacttaggcagctcactatcactagtggccttaaggcctgaaatttggaatggaaaagagccaggaggtcttaagttttcagcattcgaaggtttgaggaccagagttttc

SEQ ID NO: 201293 - DNA, 601 bp, Human
aatgcaattgttgcagcccttagttttacagtcagaactgttaaatcttgtttctgaaattatcttccttagttatttctgttgttgaatttgagaaagcagagttctagtacaacttatacttaactttttttttttttttttgagacagagtcttactctgttgaccaggctgcagtgcagtgacgctatctcggcttaccacaacctctgcctcccaggttcaagagattctcatgtctcagtctcctgagtaactgggactacaggtgtatgccatcatgcccagctaatttttgtrtttctggtagaggagatgaactcctggcctcaagtgatttgcccaccttgtcctcccaaagtgttgcgattataggcatgagccaccgtgccctgcaaacttctgattatacattttcataaggtattcgtggttgaaataggtgattttctgagactttgatcgggaagtttatacctctgatattttgtcttctggtgtcacacctgccctagccttcaaccttggattgatctctttttttttttttgagactgagtctcgctctgtcacccgggctggagtgcagtggcatgatct

SEQ ID NO: 201294 - DNA, 601 bp, Human
ttagttatttctgttgttgaatttgagaaagcagagttctagtacaacttatacttaactttttttttttttttttgagacagagtcttactctgttgaccaggctgcagtgcagtgacgctatctcggcttaccacaacctctgcctcccaggttcaagagattctcatgtctcagtctcctgagtaactgggactacaggtgtatgccatcatgcccagctaatttttgtgtttctggtagaggagatgaactcctggcctcaagtgatttgcccaccttgtcctcccaaagtgttgcrattataggcatgagccaccgtgccctgcaaacttctgattatacattttcataaggtattcgtggttgaaataggtgattttctgagactttgatcgggaagtttatacctctgatattttgtcttctggtgtcacacctgccctagccttcaaccttggattgatctctttttttttttttgagactgagtctcgctctgtcacccgggctggagtgcagtggcatgatctcggctcactgcaagctccgcctcctgggttcacgccattctcctgcctcagccttcagagtggctggg

SEQ ID NO: 201295 - DNA, 601 bp, Human
cgcctcccgggttcgagcgattcccctgcgtctacctcctgagtagctgggattacacgtgtgcgccagcacgcctggctaatttttgtatttttagtaaagatggggtttcaccatgttagccaggctggtctctaactcctgacctcaagtgattcgcccgccttggcctcccaaagtgctgggattacaagtgtgagccaccgcacccagctgtagctctgtggttttttaatcatcatatctctgtgccattaccttatgaaaacattcccagatcttagcttcagatagctacagstattcactaggtatctcaatgttcatatttcacaaaggtatctcaaactcatgctcctgatccctatcagcctgcttgctcttagtcctgctttaaatctcagcttaagtatctcttcctgatagctgaatcaggttttatcttttgggataccactgcatttttaagcctatcaaagcattataatactacagttactttacttacatatttatctgcagtggtattaataaatttccagcctcctgatgtgaacaagtcttacttgtctttgtacttgtaatcaataaacttctgttg

SEQ ID NO: 201296 - DNA, 601 bp, Human
catatctctgtgccattaccttatgaaaacattcccagatcttagcttcagatagctacagctattcactaggtatctcaatgttcatatttcacaaaggtatctcaaactcatgctcctgatccctatcagcctgcttgctcttagtcctgctttaaatctcagcttaagtatctcttcctgatagctgaatcaggttttatcttttgggataccactgcatttttaagcctatcaaagcattataatactacagttactttacttacatatttatctgcagtggtattaataaatttcyagcctcctgatgtgaacaagtcttacttgtctttgtacttgtaatcaataaacttctgttgttttgttgaatagtctcacaaagaaaaaattccaaaataattggtagagtttatataaaattataatttaaaaattatttaaattatatttgtaaatgtaaacttgtagttttttgatccactttcaccattgctattccttgtatctactttcaacctttgccaacttactagtcttaacaggtaggatctatattaattcagataatttctagaattggtaattaaaagttgattgg

SEQ ID NO: 201297 - DNA, 601 bp, Human
atttcattagcttttttgaacaacaaacaatttcaagttatatatagacttagctggtttctcttcaagctattagctggttagggagatgattcgcacctttctgataaataatgctaaccgtgtatgtaaattttaaatgttctaaaaaccccatttaaactaaaaagacaagcgaaattattttaatattatcttttattaggctgagtgcagtggctcatgcttgtaatcccagcattttgggagcccgaggcgggtggatcgctggaggtcaggagttcgagaccagcctggccaycatggtgaaaccccgtctctactaaaaatacagaacatttgctggacgtggtggcgtgtgcctgtaatcccagttactcaggaggctgaggcaggagagtctcgagcccagcaggcgaaggttacagtaagctgagattgtgccactgcactccagcctagatgacagagtgagactctgtctcacacaaacacacaaacaaacaaaaaaacttttatttaaccccagatataaaaattatttagctactttagattttttggtactaaatcttcacaatccactttgtattgtacactc

SEQ ID NO: 201298 - DNA, 601 bp, Human
gctctgttttttccataattacagtagaagctcagaagattgagaaattaaccttgtttttttttttttttaaattagtgtacattgggttttctgtcacttgcaagagtgacattccaagtaaataagtatggattagggaggttcagtatggtgttagaatgccccagcagctgaaggtcgttctcttgttgatcagagtgggggttttcaccaggtagaagtcagatcctttgtgattcccaggatctcagatgcttgaattgactttttttttttttttttttgagatggagtctcrctctgtcgccaggctggagtgcagtggcctgatctaggctcactacaagctccgcctcccaggttcacgtcattctgctgcctcagcctcctgagtagctgggacgacaggcacctgccaccatgcttggctaattttttgtatttttagtagagacgaggtttcaccatgttggccaggatggtcttaatctcttgacctcatgatctgcccgccttggcctcccaaagtgctgggattacaggtgtgagccaccacgcccagcctgagttgactttttaccagggtttttacagacct

SEQ ID NO: 201299 - DNA, 601 bp, Human
agaaaagaaatatgatattaagcattttttcacttgcttatttgccattggtatatcatctttggtgagatgtctgttcaaatgttttgccttctttttaattgggctgtttgttttcttttctcttttattttggagacaggatctcgctctgtcatccacgctggagtgtggtggcacaatcatggcttactgtagcctcaaactcccagtctcaagtgatcctcccgcctcagcctcctgagtagccgggactgcaggcactcaccaccaagctcggctaatttattattattattgatattattattattattattattattattattattgggagaaatggggtcttgttatgttgcccagggtagtctccaactcctgccttcaagctatcctcctgcctcggcctcccaaagtgctaggattatagacgtgagccaccatgcctagtggataccaatctcccagtctgacttgtcttttcgttttcttagcagtgtcttttgaagagcagaagttgttcttcggttgttttgttttgtttcaggtcctgctctgtcacccaggcctggagtgcagtggtgtgactttggttcac

SEQ ID NO: 201300 - DNA, 601 bp, Human
actcttgacctcaggtgatctgcccacctcagcttcccaaagtgctgggattacaggcatgagccaccatgcctggcctgaacattgtcctttgattctttcttagagtttccatttctctgcttttgcattttgcccaccttttttccattagagctctaggaatattaattagagctttaaaaaaattagtagtctgataatgccagtatttctgctatatctgagtctgactctgatgcttgtttcttcaaactgtgttttagcatgctttaaaatttttcattgaaagtcagagatmgtacgtggtgtagaaggaactgaggtaaataggcctttagtgtaaggttttgtgtttatctggctaggggttaggctatgttcactgtttgctgtacctgtaagtatcagaggccaaaatttcctctagtgttcatgtttttgtcttccctgttgtcttttggtttctttggaatttcttcttaaataaggtctgaggtgtgcagtttgtttagttgtattctccacttagtatacaggagccatatttgtatagtggtaaggtgtagagggagggaagtgttctatagcctaaagattt

SEQ ID NO: 201301 - DNA, 601 bp, Human
ccagtatttctgctatatctgagtctgactctgatgcttgtttcttcaaactgtgttttagcatgctttaaaatttttcattgaaagtcagagatagtacgtggtgtagaaggaactgaggtaaataggcctttagtgtaaggttttgtgtttatctggctaggggttaggctatgttcactgtttgctgtacctgtaagtatcagaggccaaaatttcctctagtgttcatgtttttgtcttccctgttgtcttttggtttctttggaatttcttcttaaataaggtctgaggtgtgcartttgtttagttgtattctccacttagtatacaggagccatatttgtatagtggtaaggtgtagagggagggaagtgttctatagcctaaagatttgttctcagtcttttagtgaacctgtgtccctggtctgtagtctctacaagtacttctaagttttggtttttccctgcagtgagacaggagtgctagaggatgctggtattgggtatttcattaccctaagtctaaggctagaatgctctggagttgaatatttcccttctagattggtaaggctctggtggaaccctggtaggtt

SEQ ID NO: 201302 - DNA, 601 bp, Human
agcatgctttaaaatttttcattgaaagtcagagatagtacgtggtgtagaaggaactgaggtaaataggcctttagtgtaaggttttgtgtttatctggctaggggttaggctatgttcactgtttgctgtacctgtaagtatcagaggccaaaatttcctctagtgttcatgtttttgtcttccctgttgtcttttggtttctttggaatttcttcttaaataaggtctgaggtgtgcagtttgtttagttgtattctccacttagtatacaggagccatatttgtatagtggtaaggygtagagggagggaagtgttctatagcctaaagatttgttctcagtcttttagtgaacctgtgtccctggtctgtagtctctacaagtacttctaagttttggtttttccctgcagtgagacaggagtgctagaggatgctggtattgggtatttcattaccctaagtctaaggctagaatgctctggagttgaatatttcccttctagattggtaaggctctggtggaaccctggtaggttagtctctgataattaatttctcttgaagtcaggccttgttaaggacagaatgctctggg

SEQ ID NO: 201303 - DNA, 601 bp, Human
attgcaatggcacaatctcagctcactgcaacctctgtctcccagattcaagcgattctcctgcctctgcctccccagtagctgggattacaggcacccaccaccacacctggctaattttttgtaattttgtagattcatttgctttttatgctggtgtatagtgtgagagacagacaagttttatctttttctggctattcagttatcccaataccaccaattaaaaagtccatcttttccacactgaattgatatgccatctttatcatatagtaaaggtccatatgtatgtggatayatttctgaattttctgttttatttcatgtttatttaccagtatcacactttttaacgatggaaatgtatactggtttaatatctgatagtgtgtacacataccccctttctctttcaggtgttactttgctattcttaattatttttctacgtggatatacattacagaaaaacaaccaataagtattgtgaaaaattgggctgtgtctaatttataaactaacatagggataattaacatctttatcatgtttagccctgctatccatttgctcatgtgtacttttctgtcttgtaaga

SEQ ID NO: 201304 - DNA, 601 bp, Human
ttatattttaactggtggttgatgttagtgactattatatgtaatattctacttttttaacctgtttaactgtaataatttttttgttgtcattgagtgtttatggctctccggaggccaaaaacttgttatctgcatttaaagatagttttagctttcctatgtcaattcttaaatctcgaattaagtgctgtttaatggaaatagaatgtgagccattgcattttaatttaaaatcatctggtaacttcattttaaaaaaagaaaggttgaaattaataacgtatttaacccaggcacrgtggctcgtgcctgtaatcccagctctttgaggggctgaggtgggtggatcacctgaggttaggagttcaagaccagcctggccaacattgtgaaaccccatctctactaaaaatacaaaaattagccaggagtggtggtgcacaccagtaatcccagctgcttgggaggctgaggcatgagaatcacttgaacccaggaggcggaggttgcagtgagccaagatcgtgccactgcactccagcctgggcaacagagtgagactctgtctcaaaaaaaccaactaaacaaataatacatt

SEQ ID NO: 201305 - DNA, 601 bp, Human
cgtttgtatagtttgtgtgtgtgtgctatgtgctattttaggttttggtagcaggactaagctgttttttataaaataaagttgtaatttcaaattatattgtttttcctcaaattcttgcttttaggtactctggagctgtataaacagaattaaattacatgtttattgaggcatttagaagtcgcctaacatctttcttggcctgtactctttttttttttttttttaattaaaagcagttcttttaccaacttttaattttttgataaactatattgactttattcagcttctaagagacaatttgacgtctaaaacattaatcacacctagaaactatacaatatggagaacagcagggtgatttttttttttttttaaatcataactgtttttttgcggggagaagaaaatagattagatgttttccttgggatttatttattaatattattaagtccagagagaaagatgaatgttattaaagtaacaaagtaacacttcttttcaaggattaattcttcctctaccagccttttattgttaaaaattgtgaatttatggaaaggttgtaggaataagtttctaatgtattaat

SEQ ID NO: 201306 - DNA, 601 bp, Human
ttgtaatttcaaattatattgtttttcctcaaattcttgcttttaggtactctggagctgtataaacagaattaaattacatgtttattgaggcatttagaagtcgcctaacatctttcttggcctgtactctttttttttttttttttaattaaaagcagttcttttaccaacttttaattttttgataaactatattgactttattcagcttctaagagacaatttgacgtctaaaacattaatcacacctagaaactatacaatatggagaacagcagggtgattttttttttttttwaaatcataactgtttttttgcggggagaagaaaatagattagatgttttccttgggatttatttattaatattattaagtccagagagaaagatgaatgttattaaagtaacaaagtaacacttcttttcaaggattaattcttcctctaccagccttttattgttaaaaattgtgaatttatggaaaggttgtaggaataagtttctaatgtattaattattctcattcttaggtgcattttatctggtgtttgaatatatggaccatgatctgatgggactactggaatcaggcttgg

SEQ ID NO: 201307 - DNA, 601 bp, Human
accatgatctgatgggactactggaatcaggcttggttcattttaatgaaaatcacataaagtcatttatgagacagctcatggagggtctggattattgtcataagaagaactttttgcatagagatattaaatgttccaatatccttctaaataataggtatgggtatgaactttatatatatttaaaatgagttttaccatggacatgtacatggagagaatagactggaaaccgtagcggcggggaatgtcgggggtggtgagcgttgaaagttacctattaggtacagtgtccaaygtttgggtgatgggtaccccagaagcctaacccctactattacacttgtaatacccatgtcaccaacaaacacatgtacccccgaatctaaaatttttaaaataaagatacggtgttacatgatgttgcaccttgattatgttaaaaaagatttaaaatttagtttactttatacaaactatgtaaaaataatcaggccagccacagtggctcacgcctgtaatcccagcaccttgagaagtagagacgggcggatcacttgagaccaggagttcatgaccagcctggccaacgttgatg

SEQ ID NO: 201308 - DNA, 601 bp, Human
gaaaccctgtctctactaaaaatacaaaaataaacccggtgtggtggcacacacccgtaatcccagctgctagaaagcctgaggaacgagaatcgcttgaatcccagaagtggagttgagtggagtcagtgagctgagatagtgccactgcactccagcctgggtgacaaagcaagcaagactcggtctcaaaaaaaaaaaaaaaaaaaaaaatctaataatagtctgtaatgcatataaaataatacttagttgacttttctgtttgctattattccaagtaatgtgaatggatcatctrataagcaatgtaacttcagctttaggttaagaatagattttagaaaattttaaaaaagcagtcacagttgtaaagtgaacttcttggaagtgtgtacacacacatacacattcacatatttaaaacttatgtaaataagcttagatttgtaacatcttatatttgaaccctgataattctcttgtaattggtactgtttgttaatttaaataaggcatggctggttctcattttaattaatagacagtgttctatgcacctagcccctctaaaactggagaattaaacaaattaaaagtg

SEQ ID NO: 201309 - DNA, 601 bp, Human
gcagtggtgcaatctcagctcactacagcctccacctccggggtccaagtgattctcctgcctcagcctaccgatagctgggattacaggccacattttctttatccgtccatctcttagtggacgcttaacgttgattccctatcctggctattgtgaagggttgagtgactttaaagatcaaaaaatgttagcagagccaagggtgtatagttaagttttcaattcgcaattttttattctttctgtcatatataatagtgcctcttggtagaagttgaaaggaaaaattggtctgaastgtacttaatccaaaacttaacttgaagtatatttttttcttctgctgtttaagaagcatatgtattttattttatttgagacagtctcactctgtcgcctaggctggagtgcagtggcgtgatctcagctcactgcaacctccgcctcccgggttctagcgattctccagcttcagccttccgagtagctgggactgcagatgtgcaccaccatgcccagctaatttttgtattttttagtagagacaggatttcgccatgttggccaggctggtctcgaactcgtgaccacaagtgat

SEQ ID NO: 201310 - DNA, 601 bp, Human
gttgagtgactttaaagatcaaaaaatgttagcagagccaagggtgtatagttaagttttcaattcgcaattttttattctttctgtcatatataatagtgcctcttggtagaagttgaaaggaaaaattggtctgaactgtacttaatccaaaacttaacttgaagtatatttttttcttctgctgtttaagaagcatatgtattttattttatttgagacagtctcactctgtcgcctaggctggagtgcagtggcgtgatctcagctcactgcaacctccgcctcccgggttctagcrattctccagcttcagccttccgagtagctgggactgcagatgtgcaccaccatgcccagctaatttttgtattttttagtagagacaggatttcgccatgttggccaggctggtctcgaactcgtgaccacaagtgatctgcctgccttggcctcccaaagtgctgggattataggcatgagccaccatgcccagctgagaagcatatatatgactaaattaatgtggctattattttgggcaagttctggttaattaagaattctatctgctaagctggttgagatttcactgtagtta

SEQ ID NO: 201311 - DNA, 601 bp, Human
aagttttcaattcgcaattttttattctttctgtcatatataatagtgcctcttggtagaagttgaaaggaaaaattggtctgaactgtacttaatccaaaacttaacttgaagtatatttttttcttctgctgtttaagaagcatatgtattttattttatttgagacagtctcactctgtcgcctaggctggagtgcagtggcgtgatctcagctcactgcaacctccgcctcccgggttctagcgattctccagcttcagccttccgagtagctgggactgcagatgtgcaccaccaygcccagctaatttttgtattttttagtagagacaggatttcgccatgttggccaggctggtctcgaactcgtgaccacaagtgatctgcctgccttggcctcccaaagtgctgggattataggcatgagccaccatgcccagctgagaagcatatatatgactaaattaatgtggctattattttgggcaagttctggttaattaagaattctatctgctaagctggttgagatttcactgtagttagattttgcttaatataagtttgtgtctgttgttaattatgtaaatcctttcct

SEQ ID NO: 201312 - DNA, 601 bp, Human
gggccatggtccctgttgccctgctggattgatgtagaaattttgagtttagagaaccagagttttaaagtcccataactttgcatcttcaggtaatgtatactgaatttttctgctcagttaaatgtataagaggaaaattcagtctgtcattttgttttaagagcaaatatcctatcattatggggtttatatactcctttaaaacttctcttttttttttttaagagaataattctgatttcttcagaatctcctggagaggtagtattaatataatggaatacctttaaaatacatwtgttgctctagtgaaccttaataactgtgattttaaaagaaatctacctttaacagatttattgtattgtctcaaattttctagatattttttgagataaatatgtaacaaatgatttttcattcatatttctgcttcattataaacagagagccaggtagggccttactgtaatactcatgcaagtataaagtcactttgaagtgtttttattttctaagtagttaatatagatcgaataactgaattgttcaagaattttgtgtaaggttttttgtttgtaaatagagcagttttcag

SEQ ID NO: 201313 - DNA, 601 bp, Human
ccacagctctcattagattttggatgttccttttttgaatttgaggaaagctgggtggagttacagctagtacttgggggtctgtgaccaatgtggatctgctcttcatgtgcctattgaagaaagaaagagaaccactggattaaaattagaggggaaaatgatttcttaaatttcagtcattttctcattttgaacattgggatttatactttgtcccattctgcattgggaattttaaaacttgagaatagagatttttgccccatttcttcattaactgttcatcttttagtatatrgttttttaagtatagtttttctgacagctacaatgtttccctcttcttagtttttattttaccaagtcattgctccagtggttttcaaaaggatggagtatctttctctctttatgtgaccgtcctgtatgaaaaaaagttttccatattaattgaaactagcctcattttctagagaagaaactataatgtgacactttatttgtttatttatatttatgagacggagtctcactctgtcactcaagctgcagtgcactggtgtgatctcggctcactgcaacctccgcctcctaggtt

SEQ ID NO: 201314 - DNA, 601 bp, Human
tttgccccatttcttcattaactgttcatcttttagtatatggttttttaagtatagtttttctgacagctacaatgtttccctcttcttagtttttattttaccaagtcattgctccagtggttttcaaaaggatggagtatctttctctctttatgtgaccgtcctgtatgaaaaaaagttttccatattaattgaaactagcctcattttctagagaagaaactataatgtgacactttatttgtttatttatatttatgagacggagtctcactctgtcactcaagctgcagtgcastggtgtgatctcggctcactgcaacctccgcctcctaggtttaagcgattctcctgcctcagcctcctgagtagatgggattacaggcacctgccaccacgcccagctaatttttgtgtttttagtagagacggggtttcaccatgttggccaggctggcctcgaactcctgacctcaagtgatctacccacctctgcctcccaaagtgctaggattacaggtgtgagccactgtgcccagccctgaaaaacgtatctttaataatattactatgatcaaaatgaaagttttttaaacaa

SEQ ID NO: 201315 - DNA, 601 bp, Human
agatgagtgcagggagctttggggattctaggtaatgaaaaggatcttctgagaatcactagacaagattggaaccatggtaataaaaaaattactaataacagatgaatgacaataaataatatgattaaacaagcttcaggaaaggagatctcatttagatcattgacttttaactgtaagatcaagattaaattgttctcccttcaactctaatggagtagtcttcatttttgagcatataaagtggaaagaattcccccctccttctgttgggggtatatcatccgagacattactrctgaatacttacaaaactgaattccaatccttgatctttcttctggtctccagaccttttgtttattggaaatctctacccaggtgatttgggtaccctaaattaaaccttgttacaaaacctatctatttcattccccagaaaaatgtctactccttttcctttatttcccgttttagttaaaggtttccagtcacctcatataggccattgtaaatagaattgtattggtttttctgtcctctggtctttctcccttatggtcttctcttctgccattccagcccccctgataatagc

SEQ ID NO: 201316 - DNA, 601 bp, Human
aaaaagtagaaattgaaatgcacagtagttaacgttgagaccattatttttgggtctttacaaagtttagtttcttgccatccaataacaacttattgaagttactaaattttgttttccaatttaatggcagaaggactgtgtgtgtgtgtgtgtgtgtgtgtgtgtgtgtgtgtgtgttttcctgggttattgagtttattgcttggaattgatctaattatgtaaagtggagtggttcatttcatttttagatttttcttttttgtatgtacacatttatttgataacatctaagaastcgactatatgtttttcagtcctgtttctttttcattgtgagttaatttgctttttgtgcaaatactgggtatagacacaccacaagaatgtaatttgttttttaatccatgaaagaaaaaagcatcgtatatgtagtgtcacatcagtttgcttcttctttgtgtgatctaaacaagatcatctctacgatgttgacagttggtagccaaatctaatagcgcaagtttgaaattcatttttgaggattctggattttttttttttttttttttgagacagagtctttcttgctctgtca

SEQ ID NO: 201317 - DNA, 601 bp, Human
ttgccagctctgttctctccctggctttatcccctttctctggaaaatgaacatttgctcacccgcctcagggaactgaaggtttagtgtgattggaacaaaaaccaaatgataatggattttataggccttgtgtaggtattctctagatggaagcaatgtgtactatagccataacatattcatgtttcatttcacgctatcactttgactgcactttggaaagtggtttggccttatacgtctggaagcaagaacaatcacttaagaaagctgttgcagtaaatctaaataggatgaytatagctagaaccaaggaatgggcacaggtagtggaaagacagattaattatatcataaggatgtagacttgttagaccttgatggttgaatgtgttgtgagatacatccctgcctccaccccctactgtaaggtttctgcttaagcaactggatgaatgatttgttggttaggatagtctaaacttttgtaacaaagagaaccacaaaagttagtggcttaaagaatgagaagtttatatatgtatttctcacttaataatcttgagtggtggctgggcgtggtggctcacgcctgtaa

SEQ ID NO: 201318 - DNA, 601 bp, Human
tatcacacgtgcttatgttccactggagagcacttggtcatgtggccacacctaactgcagtgaggatgggaaatgtagcagagctggacagctgccatagaagggaggagtaacagatttttagagggcagctatgagtatctgccacgaatggtgaggctgtttgctgagacagtaaagaagaacagagatgcattttttagcaaaaggtaataatgtaggtacttataggacttctaaatttgcttgtgtaataagaatgggcaagtaagacagctgatcttagatgacagcatcagktgggaaaaaattggttttgtttctctatagcactgtgatgatagaggaatttaaaagttatttttcttggaagatatcaaaaggagaaaaacaggagttcaaatagggggaaagaacatgagagaaaagattgtgtttattgttatgtagttatgttatatgaaagtattaataagttaggcaatgcatatgtagggtgaggaatttaaaatagctgagtgctacaaagcaaataaaataacgactatagtgtcaaagtaggggtggtagtggataattgggtaattttcattaggggag

SEQ ID NO: 201319 - DNA, 601 bp, Human
aaagattgtgtttattgttatgtagttatgttatatgaaagtattaataagttaggcaatgcatatgtagggtgaggaatttaaaatagctgagtgctacaaagcaaataaaataacgactatagtgtcaaagtaggggtggtagtggataattgggtaattttcattaggggagttaagaaggcctcttttaggaagtaaattggagctaagaccagagtgatgagaaagggaaaacttaatgaagacctgggccaagaacattccaagtacaaaggagaaggaactcagtacggcctgrgaacagacttgggaggtttaaggtcaaaggttgcccagtgtaataggaggtaagatccttgctgtacagtcttatcaactgaagtaaagtttaaattttatttgattgcagtgggaaatcactgggcagttttaagcaagcagttgatacctggttttatgcttaataaaaaaactgaaaagaagttaagggtagctgggcatggtggtgcatgcctgtaatccaagctactccagaggcaggagaattgcttgaatccaggaggcagaggttgcagtgagccaagattgcaccactgaa

SEQ ID NO: 201320 - DNA, 601 bp, Human
ttggtttgttgtggatacggtgcagcttatcaggccttaaggtagggaaggccataaccgtatctcatcttccctgccctccatctctggaattcctgggattgctttttgttttttgttttgttttgttttgttttttgagacagagtctcgctctgtcacccgggctggagtgcagtggcacgatgtcagctcactgcaacctctgcctccagggtttaagcaattctctgcctcagcctcccaattagctgggattacagatgcatgccaccacgcctggctaatttttgtattttcrgtagagatggagttttaccatcttggccaggctggtcttgaatgcctgacctcgtgatccacccacctcggcctcccaaagtgctgggattacaggcatgagccactgcacccagccttcttgggattgttcagaggcaaagtattggaatctatcaatgaacagatagtctttgatctctactccgttgacacttccttgaatgtaaaaataatttttagagtgtggtactttttgttttataaaaagtatgtatcagtctgaatgtttgtttgcttcataaatcaaaacatttccata

SEQ ID NO: 201321 - DNA, 601 bp, Human
ttgtctaacagaaactaagcatttggaaaggccattaattagtacacgttaaatatttttctgtacagttagaaatatatttcatgtggttttgtgtttatttttgaaaatttactattttcacgtctgaattaataaaacattatagcaattaataaaaagtatattctagtttgctaaggtgactgctaaatattgcattagatgatgctacatattgcttagaatttgatatacaatatataaaataatcttttacttattcctttttagtcacctgaatttgtttagtttctctacrattcaacatacttttaatttttaagattttttaaaaaatacaagacactaaaaatattttttaaagtaaaataaaaattaactatttgtagatagatttatataaatttaaacatttccttgagcctagttatccagttgcacttttataacaccattgtataggtttgatatactcatagatccttgatgtgtttgagaaactagttgtcataatttttacaaattttgttcttccacccagtaaatcatgtgtcatctaaagttagagggcaatatacattaaggtgcctgacctgtg

SEQ ID NO: 201322 - DNA, 601 bp, Human
ttgtcatccattagtaatttagcaagatttgatcagaaccagtcaacgctctttaaatcagttaatcccattaaaggtttttatggaaaggaaaaacagtgctcaacaattgagttgatactaaagctttgctttgaccaaattgcagttaataccagtaaactactttttttttttgagacggagtcttgctctgtcacccagactggagtgcagtgacgctatcttggctcactgcaagctctgcctcccgggttcacatcattctcctgcctcagcttcctgagtagctggggctatrggcacccgtcaccacgcctggttaatttttttttagtacagatggggtttcaccgtgttagccaggatggtctcgatctcctgacctcgtgatctgccagcctcggcctcccagagtgctgggattacaggcgtgagccaccgtgcccagcctatcagtcaactactttttgtttttatcttcatatattaagggaatttttagttaaacaggttgccctcacatacattttatgatcttatattagatacctttggatgtctgtattttttagtaggcagatgaaagtgtttttagtta

SEQ ID NO: 201323 - DNA, 601 bp, Human
ctataggctaaattctctaaaatagaataaaactagaaattaatataaacatggaaacaacaaagtctcttaactatctaaaaatttacatatgctaaaaaatcctggattaaagagaaatcaaactttaagacagggttgtccagtcttttggtttccctggaccacactggaagaagaatagttgtcttagaccacacataaaatacagtaacactaatgatagctgattgataggctaaaaaaaaaattccaaaaaaaaaatctcataatattttaagaaagtatgaatttgtgttgsgctgcattcgaagccatcctgggttgcatgcagcccatggactgcaagttggacaagcttgctttagaacatctaggtttaaaaagagtgataagtataaaaatccatgggctaataaccctgtgcttaggagaaaatcacaaccttaaatatactactaaataagaaaaggaaagcaaattaattaagcattctacagacaaactagacaaaagcagcaaaataaacccaggaaataaaaatgaattataatacataaaatgtaaaatttatgaagaaacctatgatctggtcttgggt

SEQ ID NO: 201324 - DNA, 601 bp, Human
aaattctctaaaatagaataaaactagaaattaatataaacatggaaacaacaaagtctcttaactatctaaaaatttacatatgctaaaaaatcctggattaaagagaaatcaaactttaagacagggttgtccagtcttttggtttccctggaccacactggaagaagaatagttgtcttagaccacacataaaatacagtaacactaatgatagctgattgataggctaaaaaaaaaattccaaaaaaaaaatctcataatattttaagaaagtatgaatttgtgttgggctgcattygaagccatcctgggttgcatgcagcccatggactgcaagttggacaagcttgctttagaacatctaggtttaaaaagagtgataagtataaaaatccatgggctaataaccctgtgcttaggagaaaatcacaaccttaaatatactactaaataagaaaaggaaagcaaattaattaagcattctacagacaaactagacaaaagcagcaaaataaacccaggaaataaaaatgaattataatacataaaatgtaaaatttatgaagaaacctatgatctggtcttgggtttattcaca

SEQ ID NO: 201325 - DNA, 601 bp, Human
gataagtataaaaatccatgggctaataaccctgtgcttaggagaaaatcacaaccttaaatatactactaaataagaaaaggaaagcaaattaattaagcattctacagacaaactagacaaaagcagcaaaataaacccaggaaataaaaatgaattataatacataaaatgtaaaatttatgaagaaacctatgatctggtcttgggtttattcacacatatatgcaatataaattagtctactagtttaacttcatatgaaaagagagtataaagaaattaaaagactgaatgcggkggctcatgcctgtaatctccgcatttgggaggccgaggcaggatcactcgagcccaggagttttagaccagcctgagcaatatagtgagaacttgtctctacaaattaaaacaaacaaacaaaaacaacaacaacaaattagctagtcattggagggtgagcatgtggtccgtactactcgtgaagctgaggtgagaggattacttgagcccaggaagtcgagactgcagtgagctaatgacaccaccgcattccagcctggttgacagagtgagaccatgtctccaaaataaaaaacca

SEQ ID NO: 201326 - DNA, 601 bp, Human
ttacacatcttttagaaaccagtacttgtaatgttctttaaactattccagaacataagaataattcagtacaagctttcttattcagtcttctcttgaagagtcttattagattaattgatgctcttcattccctctgtaaagaaaaactggcttgataacatggcaagctgaatgcttgtagctagtaggctgtcactttctagtaagactatgtatttatcccaccagttgaagagtatgctgaacaggaggtagttgttagttttcaatttttatgctttttattattataattacwtagtttaagcgtagatacagtgctttacaaaaactttaagacattgctgtctaattagggatggacaagtaattgtgtaagttagaaaagttataaaaatccaagatgtggtattagattgctttgaaagtgtttttaatttctagatttatttaaagaaatcaaaactaaaaatccttgatgatgtgttatgggtgtggtttgtacaagagagctaatacagaattccattcagtgaatcctctgtttaaagagaaagccttggcctttgtcagaagatgggaaaacaaatgtacattt

SEQ ID NO: 201327 - DNA, 601 bp, Human
gggcacagtggctcacacctgtaatctcagcactttggaaggccaaggcaggtggatcactagagcccaggagtttgagaccagcctgggcaacgtggccaaaccccgtctctacaaaaaatacaaaaattaggtgggtgtggtagcacacacctatagcctgagctattgggaggctgcggtacaaggatcacccgaacccaagggaggtcgaggctacagtgaactgtgattgcaccactgccctttagtctgggcagcagagcgagaccttgtctcaaaaaaacagaaataaaacaayaaaacataaaaagatgcttcaattttgatttcatagcattaatttcttttcagacatgaagaaaatgaagtttctgataaacaaatctgactataatgaggcaacggagtataccgaaaagtgtgtggcctttagaatcttacagggttgggttctaatgccagctcagctacttcctgcgcttatggtttagggtcccatatgctcttaagtttttttcttcaaaagtaaaagaggactgataacatgcttagggttgtgagaattaaatgtaaataagttttcagtacatatttcttc

SEQ ID NO: 201328 - DNA, 601 bp, Human
ggaaggctgaggcaggagaatcgcttgaacctggaaggtggaggctgcagtgagccaagatcgtgccactgcactccagcctgggcaacagagcgagactgtgtctcaaaaaacaaaacaaaacaaaaagtgatggaggaagagaatggaaaacacacattgggacaaaatgggatgaatgaaggcagaaagctctgtgtggccatatatatatatatatatttaattgtttttaaacatgaggatcacattaccctaagccttctagcagtcagctgaagagcctttatatcacacaatrtacattgcttatgagataaaaaggattataatcagtgaagaaattgaaagtagattagaattaaatgaatccttttctctatctgccacctcacccagtacacacaaaccctcaggcctaggtggtttacacaggtgaaattttttaaactttaaaggaattagattttggttgtaccagaagataggaaaagagggaagcttcccatattgaaagaaatgaatcatgtataccttcataaactgatggcataaaatattctgtagagttgtgcttctcaaactttttggtttcataact

SEQ ID NO: 201329 - DNA, 601 bp, Human
ggccatatatatatatatatatttaattgtttttaaacatgaggatcacattaccctaagccttctagcagtcagctgaagagcctttatatcacacaatgtacattgcttatgagataaaaaggattataatcagtgaagaaattgaaagtagattagaattaaatgaatccttttctctatctgccacctcacccagtacacacaaaccctcaggcctaggtggtttacacaggtgaaattttttaaactttaaaggaattagattttggttgtaccagaagataggaaaagagggaarcttcccatattgaaagaaatgaatcatgtataccttcataaactgatggcataaaatattctgtagagttgtgcttctcaaactttttggtttcataacttctttatgctcaaattattaaagatcccgggagtttttgtatctactgagatttaccgtattagaaattaaagatatttatgaattcattttaacataataatgttaacatgttttaaagtctataacgtctatagtttctaaaataaaagttgttggaatggcagatctgtctggtttaatagacatgacacttggatc

SEQ ID NO: 201330 - DNA, 601 bp, Human
atatatttaattgtttttaaacatgaggatcacattaccctaagccttctagcagtcagctgaagagcctttatatcacacaatgtacattgcttatgagataaaaaggattataatcagtgaagaaattgaaagtagattagaattaaatgaatccttttctctatctgccacctcacccagtacacacaaaccctcaggcctaggtggtttacacaggtgaaattttttaaactttaaaggaattagattttggttgtaccagaagataggaaaagagggaagcttcccatattgaaaraaatgaatcatgtataccttcataaactgatggcataaaatattctgtagagttgtgcttctcaaactttttggtttcataacttctttatgctcaaattattaaagatcccgggagtttttgtatctactgagatttaccgtattagaaattaaagatatttatgaattcattttaacataataatgttaacatgttttaaagtctataacgtctatagtttctaaaataaaagttgttggaatggcagatctgtctggtttaatagacatgacacttggatcctcatatctgtgatgt

SEQ ID NO: 201331 - DNA, 601 bp, Human
aatactgttgttttccttcaagtgacaagctgactttgttcctatttgagaaaatgtctggaaaatacccaagtttggatgactgtagtttgttagttttctttgccggtaaaaatagtggtccatgaaaaaagcagctgcctcagttcgcaagtcaaatcattgcacatcttctcaagataactatcatattttgttgtacagtagaagtgcttatgagtatttcccatttcatcgcagagaatattaaaaagatacatactcaaatatcagaattaaatgccattaacaatttgtactkcttcaacaagtacattctttttttgagagagtctggttctgtcacccaagctggagggcagtggtataatctcagctcactgcaacctctgcctcccgggttcaagcaattctcatgcctcagcctcctgagtagctgggactacaggtgcgcaccaccacacccggctaatttttgtattttcagtagagacagggttttgccatgttggccaggttggtctcgaactcatgacctcaggtgatccgcccaccttggcctcccaagtgctggagttacaggcatgagccactgcacctc

SEQ ID NO: 201332 - DNA, 601 bp, Human
aaatttttattgaaataaaatttcaataaaataaaattttattgaaataaaattttagtataatgaaactgttgtttattataagactattaatgggccagatgctagctcatttaatttcgtagcttcaaaataaaattaatcttaagtttccaaaagaggagcagattcctaagcaatgtaatttgaccgatgtcagacaagagtcaaatataaaacttgcttttaaattctgtcttcattatacataggcaaagtaccttagaactgtattgtggactgggtgcagcggcccatgctkgtaatcccaacactttaggagactgaggtgggaggatcacttgaagccaggcgttcaagaccagcctgggcaacatagcaaaaacctgtctacagacaaacctaccgcagtattatctagacccaggttatgcttccagctgagcctccctgagccctgtattccccctacactgatttacatagtgttcctcccaaatgtctatactttgctacttccatgcctttgcctgtgttctctcttctggtaacataatttatcttattccatttcccacctgtctatggtttacttatcctt

SEQ ID NO: 201333 - DNA, 601 bp, Human
tgtttagggtccttccattgatggcagttagcagtagtctttacactacagttaccttcctgaggtcatatagaaatccgtttctgctattattgtagactgccttatattcatgggaaggaggagtgacaggtaccaaaaaaccagagagggacatatattcaactctagttccttaatttatgggcataaattttttatgttggttttaaggtgtaagtcacatattttgagtgtcatcatgttttaagatttcattttgcaaataatgaaagtcctctaagaattggaatgcttggaytgttaaaagtatccactgaaaataaattaatttcttaaataattaaattcggatgactaaaatatttaacgagggccgggcgtggtggctcatgcctgtaattccagcactttgggaggcctaggcaggtggatcacttgagaacaggggttcaagaccagcctggccaacatggggaaatcctgtctctactaaaaatacaaaaactagctgggccgtggtggcgcatgcctataatcccagctactcaggaggctgaggcaggagaatcacttgaacccaggaggcagagattgcagt

SEQ ID NO: 201334 - DNA, 601 bp, Human
taatgaaagtcctctaagaattggaatgcttggattgttaaaagtatccactgaaaataaattaatttcttaaataattaaattcggatgactaaaatatttaacgagggccgggcgtggtggctcatgcctgtaattccagcactttgggaggcctaggcaggtggatcacttgagaacaggggttcaagaccagcctggccaacatggggaaatcctgtctctactaaaaatacaaaaactagctgggccgtggtggcgcatgcctataatcccagctactcaggaggctgaggcaggrgaatcacttgaacccaggaggcagagattgcagtgagctgagattgtgccactgtactccagcctgggtgacagagtgagactctgtctcaaaaaaaagaaagaataaaataacaaaagtttttatagaccaaggcttcaatttttgtgtatttaaaaatgagttgatgttttgtataacagttgtatgtattctttatgtagttgatagtgatgtacttccttttgtgtgttgcttagccgaatatgtgggagtccatgtcctgcagtgtggcctgatgtaatcaaactaccatatttc

SEQ ID NO: 201335 - DNA, 601 bp, Human
tgtcatattcagcttcagtaagcttttattgagctgtacatggttggcctttatgggatgatttgagagccaaaaaggatctattacctgacatcatgagggacctgaatttttcactgttgaattattgtttcatgtttgcttttttcttagtgtgtatcagtaatcttaaaacttgggctcagtaccccttcaaataacattttttaaacttctgatttggaaaaatttcaactctatagaaaaataggaagaatagtacaaagagtattcatgtatatcctttacctagattcaacarttaataatagttggacacatttgctttatcactgtctacttttttcctgaactagttggatatcatgttgtggaggtgacacttataaatatgtaatcatatctgtaagaactaggactttattctacatgcataccatataaagcatatgaaatttaacatgagaatatttaatggtcaatccacattcagatttccccagttgacccaataatttctcttatagacttttttttttaagataaagaatttttcaaagttcagcattctgtttatttgttatgtccttttcatctttaa

SEQ ID NO: 201336 - DNA, 601 bp, Human
atcagaattagattaagagtttggggggcaagaatgtaatgttgatggtgatcctgctctgtgataattatgttcaagagaacataatgttactttgtaccattattattggtaatggtaactttgaccaagagatgtaaccactgtacttaaaaatgtcaacatagtaaatgctgacatttttaagtagagcaattatatcactcttgtaaatatatcaagtggaaagcaactatcatagcattttgatatccaccaccaatagtcatttggaaaatgttgagcagttgtacgttgttcsattttcatcttgaacttatgttactcccgtaggcttttattctaatgtaaagtatttatgctagaaagtattttattgattactgtatcatatattttaaaaaacaaatacatgtatataaatggaaattaaatttcacgtttcctgtgactaaaagctcttttcttgattaaattgtcattgtaaatatcagtaatgaatatttccttatttatttattgattgattgatggagttttactcttgttgcctcagcctcctgagtacctgggattacaggcatgcgctaccacgcccggc

SEQ ID NO: 201337 - DNA, 601 bp, Human
gagattgcagtgagccaagatcttgccgctgcactccagcctgggtgacagagcaagactctgcctcaaaaaaaaaaaaaaaaaaagttattttaggccgggtgcagtggctcatgcctgtaatcccagcactttgagaggccaaggcaggtggatcccttgagcccatgagtttgagaccaatctgggcaacatggtaaaatcctatctctactaaaaatactaaaaaattagccaggcgtggtggcacacgcctgtaatcccagctactccagagggtgaggcacgagaattgcttgakcttgggaaacggaggctgcagtgagccgagatcgcgccactgcgctccagcttgggcaacagagtgagactctgtctccaaaaaaaaaaaaaaaaaaagattctaatgaccttctaggtgttaagattctttctccttcagttttttggatagtaaagaattggaggctgggcatggtgactcatgcctgtaatcccagcactttgggaaccaacgcaggaggattgcttgaggccaggagtttgagacctacctgggtaacataaggagaccctgtctttacaaaaaaaaaaaaaaaag

SEQ ID NO: 201338 - DNA, 601 bp, Human
gtccttattgtaaagcaaatcacctaaatcagacttaattttatcagaacacacctgactgcattttttcattaaaaacaaacatgttaaaaacacattcaaggaacattctgtaagctatctgtaacaaattatggaatgtatcttgttagatacattactaaagcaatcaagtaaagagtatcagattgatccaatatttaaataaaaacattttataaacaatataatataatatctctcactattttgcaatatgatataatgagtagttaaaattatgcattacttatgaggtaaggactatgaagaaatacatggtattcctttagaaagttggaaggtgtatcaaactcttttgatcaattttttaggaataatcaaatgagagaatggggtatttaaaaatcggaaataggctgggcacggtggcagtggctcatgcctataattccagcactttgggaggccgaggcggacctatcacttgaggccgggagttcaagaccagcctggccaacatggtgaaaccccgtctctagtaaaaatacaaaaattaggccgggcgcagtggctcacacctgtaatcacagcagtttgg

SEQ ID NO: 201339 - DNA, 601 bp, Human
tcaaacatgaattaatacattgcctactttgtaagaggcactgctgaagagcttgcacatgttaacatacagtactaccccatgaggtagatagtattgttaatcccatttttaaagacaaggaaaatgaggcacagaggtccagttatttgcctaagacacatcaagtaagtgactgagctggcatttgaaccttcaagaaagcaaataaaagtttggttatctggaagacattcctgatccatctgaaagtatcagcatcagtaacctgtactattttagctatttcttgggtaaaatktatctttcctagagatgagtattaagatcatccataaagaatctcttacttttaagggggccaggtacggtagctcatgcctgtaatcccagcactttgggaggccaagactggcagatcacctgaggtcaggagttcaagaccagcctggtcaacatggggaaaccccgtctctactaaaaatacgaaaattagccaggcatggtggcatgtgcctgtaattccagctactggggaggctgaggcaggagaattgcttgaacctgggaggcggaggttggagtgagccgggatagcacc

SEQ ID NO: 201340 - DNA, 601 bp, Human
ctgtagcatcagtttaattctagagcatttggatagacaagcaagttagtaaaaagtaagcttttactgtaaagttcttcacaaatgttatgttctagccttactctttttttttttttttttttttgagatagggtctggctctgtcacccaggccagagtgcagtggcatgatcttggctctctgcagcctctgcctcctgggctgaagccatcctcccacctcagcttcccgagtagctgggactacagacatgtgccaccatgactggctaatttttttatagagacagggtttcascatgttgcccatgctggtgaactcctgagctcaagtgatccacccaccttagcctcccaaagtgccaggattacaggcatgagctgctgcgcctggccctttactacttttttatcccatatctggtttctgcaaatggcatgtttttcttttttgtgtgacagggcctggttctgtcgcctaggctggagtgcagttacatgatctcagctcactgcaaccaccaccacctgggctcaagctattctcccacttcagcctcccaagtagctgggactgcagtgcacaacatcatgccca

SEQ ID NO: 201341 - DNA, 601 bp, Human
ggctaatttttttatagagacagggtttcagcatgttgcccatgctggtgaactcctgagctcaagtgatccacccaccttagcctcccaaagtgccaggattacaggcatgagctgctgcgcctggccctttactacttttttatcccatatctggtttctgcaaatggcatgtttttcttttttgtgtgacagggcctggttctgtcgcctaggctggagtgcagttacatgatctcagctcactgcaaccaccaccacctgggctcaagctattctcccacttcagcctcccaagtakctgggactgcagtgcacaacatcatgcccaactaatttttgtatttttggcaaagacagggttttgccatgttgcccaggctggtcttgaactcctgggctcaagcaatcctcccgtcttggcctccctaagcactgggattataggcgtgagccactgtgcctggctggaaatggcatatttttctgccttctttttcatgtcttattcagtgtatgatgtactatcataagaactgactttgaaaggttgcaccaacagcaatagtggtgttttttttttttttttttttgagacgga

SEQ ID NO: 201342 - DNA, 601 bp, Human
gcctggctggaaatggcatatttttctgccttctttttcatgtcttattcagtgtatgatgtactatcataagaactgactttgaaaggttgcaccaacagcaatagtggtgttttttttttttttttttttgagacggagtctcgctgtgtcacccaggctggagtgcagtggcgcaatctcggctcaccgcaacctccacctcccgggttcatgccattctcctgcctcagcctcctgagtagctgggattacaggtgcccgccaccacgcctggctaatttttgtatttttagtagaracggggttttgccatgttggccaggctgatctcaaactcctgacctcagatgatccacctatgtcggcctcccaaagtgctgggattacaggcatgcccagcatagtagcctatttttatgaatatatattcttcattcataattttgataaatgattatttattgattattcaaaagccaaagaaaaatagattatctgtaaaggcaaagcaagccctgaaggaagtgggacaataaggatgatttttattggaagagttttacagagccattctatgaagtcttcaagaactatttgg

SEQ ID NO: 201343 - DNA, 601 bp, Human
acagagcgagactgtctcaaaaaaaaaaaaaaaaggatatcttatatctagttattttagggaaacttaaatttcttcctttgactcagtctgtcatagagtaagctttttgatgcaaagtctgcctcttcaatgttgtcaagagtgttaaaatcatttaacaactttttaaaaggacctccactccctcattttgcctaaagcatccagaaacacccatctttaatttaacaccatctttagttgaagttttatgaaaacagagactgatataaaatagagagagagagagagagagagwgagtgtgtgtgtgtgtgtgtgtgtgtgtgtgtgtaggtggtggcttattaaacatgaaaaaatagactagcacttcttaagagatgagtatatgttgattgatgagttagttgattaaaacagatgtgtggatcagactgaacttttggtggttgaagataaatatagattaactgagaaagctttaggaagataaccattaatgcttgccaatgtagtctacaagcttctacttgaccttggttcaactgcatacttaaagtactcattcaatgaataccaaaagcaattgttatttgt

SEQ ID NO: 201344 - DNA, 601 bp, Human
agagcgagactgtctcaaaaaaaaaaaaaaaaggatatcttatatctagttattttagggaaacttaaatttcttcctttgactcagtctgtcatagagtaagctttttgatgcaaagtctgcctcttcaatgttgtcaagagtgttaaaatcatttaacaactttttaaaaggacctccactccctcattttgcctaaagcatccagaaacacccatctttaatttaacaccatctttagttgaagttttatgaaaacagagactgatataaaatagagagagagagagagagagagagwgtgtgtgtgtgtgtgtgtgtgtgtgtgtgtgtaggtggtggcttattaaacatgaaaaaatagactagcacttcttaagagatgagtatatgttgattgatgagttagttgattaaaacagatgtgtggatcagactgaacttttggtggttgaagataaatatagattaactgagaaagctttaggaagataaccattaatgcttgccaatgtagtctacaagcttctacttgaccttggttcaactgcatacttaaagtactcattcaatgaataccaaaagcaattgttatttgttg

SEQ ID NO: 201345 - DNA, 601 bp, Human
gagcgagactgtctcaaaaaaaaaaaaaaaaggatatcttatatctagttattttagggaaacttaaatttcttcctttgactcagtctgtcatagagtaagctttttgatgcaaagtctgcctcttcaatgttgtcaagagtgttaaaatcatttaacaactttttaaaaggacctccactccctcattttgcctaaagcatccagaaacacccatctttaatttaacaccatctttagttgaagttttatgaaaacagagactgatataaaatagagagagagagagagagagagagattgtgtgtgtgtgtgtgtgtgtgtgtgtgtgtaggtggtggcttattaaacatgaaaaaatagactagcacttcttaagagatgagtatatgttgattgatgagttagttgattaaaacagatgtgtggatcagactgaacttttggtggttgaagataaatatagattaactgagaaagctttaggaagataaccattaatgcttgccaatgtagtctacaagcttctacttgaccttggttcaactgcatacttaaagtactcattcaatgaataccaaaagcaattgttatttgttgt

SEQ ID NO: 201346 - DNA, 601 bp, Human
gggcatggtggctcacgcctgtaatcccagcactttgggaggctgaggcgggcggatcatgaggtcaggagatcgagaccatcctggctaacacggtgaaatcccatctctactaaaaatacaaaaaattagccgggcgtggtggtggcaggcgcctgtagtcccagctactcgggaggctgaggcaggagaatggcgtgaacccagaaggcggagcttgcagtgagccgagatcgtgccactgcattccagcctgggccacagggcgagactccgtctcaaaaaaaataaataaataaamcaattagccaggcatggtggcacgcgcctgtaatcccagctcctagtgggggctggggcaggaaaattgcttgaacatgggaggcagagattacatatcatgccactgcactccagcctggggaacagagcaagactctgtctcaaaaaaaaaaaagaaggagaattctggttttttgaaaaaaggatgaatcctctgagtcattttcttctccgtcatcagtaagtatgctgaaataagaaaacgccccttcagcaaaagaggcacctcaattaaagaccacatccctgaattcatatg

SEQ ID NO: 201347 - DNA, 601 bp, Human
gaatatcagattcagatctcacctctgccacttacagaatatttgcccttgggcaagttgcttggtctctttcggtgtcagtttcttcttctcagtaaaaggaggctaataatagagtctgccttctaaggttgttgtaaggaataaaggatattaaatgcttagaaggtatgtgacactcccttagctgtcatcattatcattattcatttcccattcacaatgtgctgtttcctggttaaatccataacatgaggttttagtagtggtcttgattttccttttgaagtatttacccctraagatttattcaaaattgactgcagttctttttatgtacaggtacattttaaatgtacatgatatttaactagacttgaggttctctttttacagtatttcttaaatactctccctcaaatatatattttcatatggtaatacagagccattttggtgtgggagtgggaggagctgtgaattatgacagttctaattaatataattttgtctttagtaaaaacaggccctggacagcacttaaaccacagtgaattggcaattctactaaacctactacaatctaaaacaagtgttaata

SEQ ID NO: 201348 - DNA, 601 bp, Human; identical to SEQ ID NO: 201234

SEQ ID NO: 201349 - DNA, 601 bp, Human; identical to SEQ ID NO: 201235

SEQ ID NO: 201350 - DNA, 601 bp, Human; identical to SEQ ID NO: 201236

SEQ ID NO: 201351 - DNA, 601 bp, Human; identical to SEQ ID NO: 201237

SEQ ID NO: 201352 - DNA, 601 bp, Human; identical to SEQ ID NO: 201238

SEQ ID NO: 201353 - DNA, 601 bp, Human; identical to SEQ ID NO: 201239

SEQ ID NO: 201354 - DNA, 601 bp, Human; identical to SEQ ID NO: 201240

SEQ ID NO: 201355 - DNA, 601 bp, Human; identical to SEQ ID NO: 201241

SEQ ID NO: 201356 - DNA, 601 bp, Human; identical to SEQ ID NO: 201242

SEQ ID NO: 201357 - DNA, 601 bp, Human; identical to SEQ ID NO: 201243

SEQ ID NO: 201358 - DNA, 601 bp, Human; identical to SEQ ID NO: 201244

SEQ ID NO: 201359 - DNA, 601 bp, Human; identical to SEQ ID NO: 201245

SEQ ID NO: 201360 - DNA, 601 bp, Human; identical to SEQ ID NO: 201246

SEQ ID NO: 201361 - DNA, 601 bp, Human; identical to SEQ ID NO: 201247

SEQ ID NO: 201362 - DNA, 601 bp, Human; identical to SEQ ID NO: 201248

SEQ ID NO: 201363 - DNA, 601 bp, Human; identical to SEQ ID NO: 201249

SEQ ID NO: 201364 - DNA, 601 bp, Human; identical to SEQ ID NO: 201250

SEQ ID NO: 201365 - DNA, 601 bp, Human; identical to SEQ ID NO: 201251

SEQ ID NO: 201366 - DNA, 601 bp, Human; identical to SEQ ID NO: 201252

SEQ ID NO: 201367 - DNA, 601 bp, Human; identical to SEQ ID NO: 201253

SEQ ID NO: 201368 - DNA, 601 bp, Human; identical to SEQ ID NO: 201254

SEQ ID NO: 201369 - DNA, 601 bp, Human; identical to SEQ ID NO: 201255

SEQ ID NO: 201370 - DNA, 601 bp, Human; identical to SEQ ID NO: 201256

SEQ ID NO: 201371 - DNA, 601 bp, Human; identical to SEQ ID NO: 201257

SEQ ID NO: 201372 - DNA, 601 bp, Human; identical to SEQ ID NO: 201258

SEQ ID NO: 201373 - DNA, 601 bp, Human; identical to SEQ ID NO: 201259

SEQ ID NO: 201374 - DNA, 601 bp, Human; identical to SEQ ID NO: 201260

SEQ ID NO: 201375 - DNA, 601 bp, Human; identical to SEQ ID NO: 201261

SEQ ID NO: 201376 - DNA, 601 bp, Human; identical to SEQ ID NO: 201262

SEQ ID NO: 201377 - DNA, 601 bp, Human; identical to SEQ ID NO: 201263

SEQ ID NO: 201378 - DNA, 601 bp, Human; identical to SEQ ID NO: 201264

SEQ ID NO: 201379 - DNA, 601 bp, Human; identical to SEQ ID NO: 201265

SEQ ID NO: 201380 - DNA, 601 bp, Human; identical to SEQ ID NO: 201266

SEQ ID NO: 201381 - DNA, 601 bp, Human; identical to SEQ ID NO: 201267

SEQ ID NO: 201382 - DNA, 601 bp, Human; identical to SEQ ID NO: 201268

SEQ ID NO: 201383 - DNA, 601 bp, Human; identical to SEQ ID NO: 201269

SEQ ID NO: 201384 - DNA, 601 bp, Human; identical to SEQ ID NO: 201270

SEQ ID NO: 201385 - DNA, 601 bp, Human; identical to SEQ ID NO: 201271

SEQ ID NO: 201386 - DNA, 601 bp, Human; identical to SEQ ID NO: 201272

SEQ ID NO: 201387 - DNA, 601 bp, Human; identical to SEQ ID NO: 201273

SEQ ID NO: 201388 - DNA, 601 bp, Human; identical to SEQ ID NO: 201274

SEQ ID NO: 201389 - DNA, 601 bp, Human; identical to SEQ ID NO: 201275

SEQ ID NO: 201390 - DNA, 601 bp, Human; identical to SEQ ID NO: 201276

SEQ ID NO: 201391 - DNA, 601 bp, Human; identical to SEQ ID NO: 201277

SEQ ID NO: 201392 - DNA, 601 bp, Human; identical to SEQ ID NO: 201278

SEQ ID NO: 201393 - DNA, 601 bp, Human; identical to SEQ ID NO: 201279

SEQ ID NO: 201394 - DNA, 601 bp, Human; identical to SEQ ID NO: 201280

SEQ ID NO: 201395 - DNA, 601 bp, Human; identical to SEQ ID NO: 201281

SEQ ID NO: 201396 - DNA, 601 bp, Human; identical to SEQ ID NO: 201282

SEQ ID NO: 201397 - DNA, 601 bp, Human; identical to SEQ ID NO: 201283

SEQ ID NO: 201398 - DNA, 601 bp, Human; identical to SEQ ID NO: 201284

SEQ ID NO: 201399 - DNA, 601 bp, Human; identical to SEQ ID NO: 201285

SEQ ID NO: 201400 - DNA, 601 bp, Human; identical to SEQ ID NO: 201286

SEQ ID NO: 201401 - DNA, 601 bp, Human; identical to SEQ ID NO: 201287

SEQ ID NO: 201402 - DNA, 601 bp, Human; identical to SEQ ID NO: 201288

SEQ ID NO: 201403 - DNA, 601 bp, Human; identical to SEQ ID NO: 201289

SEQ ID NO: 201404 - DNA, 601 bp, Human; identical to SEQ ID NO: 201290

SEQ ID NO: 201405 - DNA, 601 bp, Human; identical to SEQ ID NO: 201291

SEQ ID NO: 201406 - DNA, 601 bp, Human; identical to SEQ ID NO: 201292

SEQ ID NO: 201407 - DNA, 601 bp, Human; identical to SEQ ID NO: 201293

SEQ ID NO: 201408 - DNA, 601 bp, Human; identical to SEQ ID NO: 201294

SEQ ID NO: 201409 - DNA, 601 bp, Human; identical to SEQ ID NO: 201295

SEQ ID NO: 201410 - DNA, 601 bp, Human; identical to SEQ ID NO: 201296

SEQ ID NO: 201411 - DNA, 601 bp, Human; identical to SEQ ID NO: 201297

SEQ ID NO: 201412 - DNA, 601 bp, Human; identical to SEQ ID NO: 201298

SEQ ID NO: 201413 - DNA, 601 bp, Human; identical to SEQ ID NO: 201299

SEQ ID NO: 201414 - DNA, 601 bp, Human; identical to SEQ ID NO: 201300

SEQ ID NO: 201415 - DNA, 601 bp, Human; identical to SEQ ID NO: 201301

SEQ ID NO: 201416 - DNA, 601 bp, Human; identical to SEQ ID NO: 201302

SEQ ID NO: 201417 - DNA, 601 bp, Human; identical to SEQ ID NO: 201303

SEQ ID NO: 201418 - DNA, 601 bp, Human; identical to SEQ ID NO: 201304

SEQ ID NO: 201419 - DNA, 601 bp, Human; identical to SEQ ID NO: 201305

SEQ ID NO: 201420 - DNA, 601 bp, Human; identical to SEQ ID NO: 201306

SEQ ID NO: 201421 - DNA, 601 bp, Human; identical to SEQ ID NO: 201307

SEQ ID NO: 201422 - DNA, 601 bp, Human; identical to SEQ ID NO: 201308

SEQ ID NO: 201423 - DNA, 601 bp, Human; identical to SEQ ID NO: 201309

SEQ ID NO: 201424 - DNA, 601 bp, Human; identical to SEQ ID NO: 201310

SEQ ID NO: 201425 - DNA, 601 bp, Human; identical to SEQ ID NO: 201311

SEQ ID NO: 201426 - DNA, 601 bp, Human; identical to SEQ ID NO: 201312

SEQ ID NO: 201427 - DNA, 601 bp, Human; identical to SEQ ID NO: 201313

SEQ ID NO: 201428 - DNA, 601 bp, Human; identical to SEQ ID NO: 201314

SEQ ID NO: 201429 - DNA, 601 bp, Human; identical to SEQ ID NO: 201315

SEQ ID NO: 201430 - DNA, 601 bp, Human; identical to SEQ ID NO: 201316

SEQ ID NO: 201431 - DNA, 601 bp, Human; identical to SEQ ID NO: 201317

SEQ ID NO: 201432 - DNA, 601 bp, Human; identical to SEQ ID NO: 201318

SEQ ID NO: 201433 - DNA, 601 bp, Human; identical to SEQ ID NO: 201319

SEQ ID NO: 201434 - DNA, 601 bp, Human; identical to SEQ ID NO: 201320

SEQ ID NO: 201435 - DNA, 601 bp, Human; identical to SEQ ID NO: 201321

SEQ ID NO: 201436 - DNA, 601 bp, Human; identical to SEQ ID NO: 201322

SEQ ID NO: 201437 - DNA, 601 bp, Human; identical to SEQ ID NO: 201323

SEQ ID NO: 201438 - DNA, 601 bp, Human; identical to SEQ ID NO: 201324

SEQ ID NO: 201439 - DNA, 601 bp, Human; identical to SEQ ID NO: 201325

SEQ ID NO: 201440 - DNA, 601 bp, Human; identical to SEQ ID NO: 201326

SEQ ID NO: 201441 - DNA, 601 bp, Human; identical to SEQ ID NO: 201327

SEQ ID NO: 201442 - DNA, 601 bp, Human; identical to SEQ ID NO: 201328

SEQ ID NO: 201443 - DNA, 601 bp, Human; identical to SEQ ID NO: 201329

SEQ ID NO: 201444 - DNA, 601 bp, Human; identical to SEQ ID NO: 201330

SEQ ID NO: 201445 - DNA, 601 bp, Human; identical to SEQ ID NO: 201331

SEQ ID NO: 201446 - DNA, 601 bp, Human; identical to SEQ ID NO: 201332

SEQ ID NO: 201447 - DNA, 601 bp, Human; identical to SEQ ID NO: 201333

SEQ ID NO: 201448 - DNA, 601 bp, Human; identical to SEQ ID NO: 201334

SEQ ID NO: 201449 - DNA, 601 bp, Human; identical to SEQ ID NO: 201335

SEQ ID NO: 201450 - DNA, 601 bp, Human; identical to SEQ ID NO: 201336

SEQ ID NO: 201451 - DNA, 601 bp, Human; identical to SEQ ID NO: 201337

SEQ ID NO: 201452 - DNA, 601 bp, Human; identical to SEQ ID NO: 201338

SEQ ID NO: 201453 - DNA, 601 bp, Human; identical to SEQ ID NO: 201339

SEQ ID NO: 201454 - DNA, 601 bp, Human; identical to SEQ ID NO: 201340

SEQ ID NO: 201455 - DNA, 601 bp, Human; identical to SEQ ID NO: 201341

SEQ ID NO: 201456 - DNA, 601 bp, Human; identical to SEQ ID NO: 201342

SEQ ID NO: 201457 - DNA, 601 bp, Human; identical to SEQ ID NO: 201343

SEQ ID NO: 201458 - DNA, 601 bp, Human; identical to SEQ ID NO: 201344

SEQ ID NO: 201459 - DNA, 601 bp, Human; identical to SEQ ID NO: 201345

SEQ ID NO: 201460 - DNA, 601 bp, Human; identical to SEQ ID NO: 201346

SEQ ID NO: 201461 - DNA, 601 bp, Human; identical to SEQ ID NO: 201347

SEQ ID NO: 201462 - DNA, 601 bp, Human
cgctttttcaaaagtcgctcattttttttcaaactaaacacctaactgagaagtaaaaaaatgacaagatctcatacaactgagagaagactgtcacagaaaggaagaccacacataagaaagaatgtaaatggtcaaattttttcactgccaaatctctaaatgctaagagagtgatttgctatacaagtccagtaagtcagaaagaggggcatattgctagtaacggtagtgcggttaaaagtggtcaaaggcataggtatacttagtcatatgacatggttaaaggcaactggatacragctgtcattgaatccatcatgtgtggaggttggtatacaaagacaggaagcaaccctctagaccactgaaatctgtttcacatgcacagccaaatattgtaaatattttcttttttaccttttcccaccatgaaaagttgagaaaaaaaaatgggtgtcaacttgaaaagttccaacctagctttcttcctcaaaaagctccagaagataaagtcctaatgatcatgccttttggggctgggttaagaaagagctttagggaaagaaagtaggatcttccctaagtgagagaggcttct

SEQ ID NO: 201463 - DNA, 601 bp, Human
ccacaaaatttcagagacttcttccaaagttcctgagaactttggcacttctcattttggacttaggaaccagtcgagtacgaagaattcagaactacagctaggagatcacgtgcaagtattttttagcagaagaggggccaagacaaatatgtgttttcaagaaaagtgcctgggaaggtattactgcagttctttaaatattacaacggactttccaccctggcatctccaccacccccagcccagtccatccactgcacaggccgcagaccactattaatctcttttcccatctttccccaccatttctctccacaccctcagttcggaaacaaacgcatcctcagaagccgaacaccatgttcccacaaggcattacagaaagaacctttttcctccctgtttgaagtcacttgtcatttgtcgctggtggaaactgttgataaggcaggaaaactaggcaacaaaatcaggggagatggaagatgtttttgttacgacccgggagaccgtattagggagagacttgtgagcaaatcagtatcgctgatgattcatagtcacatttctccctgctccgctttgtttgcttttgaaa

SEQ ID NO: 201464 - DNA, 601 bp, Human
ttctcctggtgtccatttctggaactgctatttgtatattgcatgatattttatcaggaaaaaatataaaacagatctaatttcatgaaaatgctgttgccataatgctcaggagaacagggggaagagagagattcaagtcttcctaatgtctaccttatatgcaggtacattttacaagttctattgtattctgacttattaagcagtgcatatttctttcttttacattagctttcattgcagaagggtgtggggagatgagactgctggaaactgacgtgggattgatgtttatcarggctgtaggcttcagaaatatattaagcctcggaatgtcctaggtatgaaaaagataataaataacaggtcaatttattatattccctttatctctatattacctgagagagattgctatactgcagtgacactttcaagatgccccaatcctccaatctccatgcataacaatttgaaaaagggaaggttgactaaggctgggatgttcaggatcaatttctaatcagtttcaggttttactcaaatatctcatgctgtaaactcttgaaatgaatgtcttcccatagtgcgccgtgag

SEQ ID NO: 201465 - DNA, 601 bp, Human
cgagggaaacctcccaagccttggataactagcctggagggtgtgcaggtttcctccagcttgggcacatctgccttgccccatagagaatgttaacaagatacctgctgttttcccttctgcctctatgcaggacagcttctgaaatcctaaactgcacagggtgtcactccaaaaacagacagatagtagctgctaaattagagaacccagagggcacaaggttgggttttgtttttctaggaaagagtgtaaaactggagtgtctgactagtgccccggatagggaggcttaataggwttggggtaactcatccccatgagctctgctctactctcatccacacctgccagaaggggtcagggtgaagccgatggacagcagtgctgacccgcatgcagtggactttccatgaataacacccaaggctgactacagatgtttaggtgggggtgccgagggagggttacttggctgactagaattagggacagccgtgtgcaaattgcttttttagggccagagaggctgaggctgctggcttccagtcacacagcctacaggacagcccctgatttcacaagagcaggtttctgatgc

SEQ ID NO: 201466 - DNA, 601 bp, Human
tattctcagacaaaaatgcagcccctggccccacctcgctgtgtaagtctgtgcagtcgagacacacttgagccagcctcttcttcccttgtcacagcctgattcctccgccatcacctctttgctgggtcactgcagcagcattttctttactttgcctctgcaacactaaggaaggcctcctctccagtcatttctccatgaagcagctaaaggcatctttcccacaggtggatctgatcacatcacttcttcttgaaagtcctttactgaattcctattgctcagtatccaacagaamgtggctgggactttgggctctgtacatgctgttcctcccttgaatgtcagctcttgcccagtcctgttctctggggtctaaggccttgagaattccaccccctttctcaactgcaggcagtgacacctgctgttccttctgccttaagtgctcctgccccaactccaacataccacccttagtgctgcctttaataatgtttcaattttcagattgtttggatgacagttcctctaggaggcttacctcacatcacctccaccaccaccctcctgccagcctggtttagaatgcccgggg

SEQ ID NO: 201467 - DNA, 601 bp, Human
atcttctataaaaatgggaatgacataaggacatttgacctgttatctcacaggtttaggaaggtcaaatgagataacataaacaaaaagacactgtaagctctagaaagctaaggaaatactattctcagacaaaaatgcagcccctggccccacctcgctgtgtaagtctgtgcagtcgagacacacttgagccagcctcttcttcccttgtcacagcctgattcctccgccatcacctctttgctgggtcactgcagcagcattttctttactttgcctctgcaacactaaggaaggsctcctctccagtcatttctccatgaagcagctaaaggcatctttcccacaggtggatctgatcacatcacttcttcttgaaagtcctttactgaattcctattgctcagtatccaacagaaagtggctgggactttgggctctgtacatgctgttcctcccttgaatgtcagctcttgcccagtcctgttctctggggtctaaggccttgagaattccaccccctttctcaactgcaggcagtgacacctgctgttccttctgccttaagtgctcctgccccaactccaacataccaccc

SEQ ID NO: 201468 - DNA, 601 bp, Human
ttcttttttccttgatctttcattctttccatacttgttctcaattttttaatgttgtttgttttgttttgttgcaaaagtggtacagaaaaaggaagtgtgaccacctgcacacgattgttcttttaccagtatgtgtatatatgtaatgtgtggaaatgcctgtgtgtgtgtgtgtgtgtgtgtgtgtgtgtgtgtatgctgatatacacagagataagtgtcacacagacataccttatgacctgggtaattgggtaggaaagtgcctgtgatgggccctttcaaactcatggctttctagatgctatttgggttgttctagtccacactactgcagactagattggttgattcaaggctcacaagggaacctcaaggggggaaaggacaataccccgtttaaacaactgatgtcatcagtgtgatttcagaagaaataaagggtacaccattctccctttccctcccaattcctgtctctttcactgcttcatctctgagccctggctaaggattttttccacatcttccttcatctgtttcatcaggttttgtttttaatttacttttgtttttttttgtttttttttttgttttg

SEQ ID NO: 201469 - DNA, 601 bp, Human
atcgcgccactgcactccagcctggcgacaaagcaagactccgtctcaaaaaaaaaaaaaaaaaaaaagtgattaacttttattgccgacacacacacacactttcagcaactatgggcagtgtaggttagtagttaagaactggctccagattcaggcctgggtgaccttggcaagttacttcctctatctgtgtctttctgcagcttcaaaggggagatgataacagtacctccttccctgcctcccagagttgtcatattaacgaatacacgtaagcctggcataccagggcttcagmtatgttggctgtggttattattacggttattatcatggttagtagaatggacaggccacaggcctgtaggaatctactccagtaaaaggtaagccagatgctcacgcgggacaccagatgacaacggtagaagtgggggccggactgggagggacgtggccatgtttgagttgagctcccctcacaggaacggtgggtgctggagacaggggcctgccttcttctaagcggcgtgggctgggagagtccggccggagacaaaagaccgtgattttgagtgtggggacacggccccgtgtg

SEQ ID NO: 201470 - DNA, 601 bp, Human
ggccacgcgcagtggctcacacctgtaatcccagcactttgggaggcccgaggcaggcggatcacaaggtcaagagatcgagaccatcctggccaacatggtgaaaccccgtctctactaaaaatacaaaaattagctgggcgtgatggcgcatgcctgtagtcccagctactcgggaggctgaggcaggagaatcgcttgaatcagggaggcggaggttccagtaagccaagatcgcgccactgcactccagcctggcgacaaagcaagactccgtctcaaaaaaaaaaaaaaaaaaaaagtgattaacttttattgccgacacacacacacactttcagcaactatgggcagtgtaggttagtagttaagaactggctccagattcaggcctgggtgaccttggcaagttacttcctctatctgtgtctttctgcagcttcaaaggggagatgataacagtacctccttccctgcctcccagagttgtcatattaacgaatacacgtaagcctggcataccagggcttcagatatgttggctgtggttattattacggttattatcatggttagtagaatggacaggccacaggcctgt

SEQ ID NO: 201471 - DNA, 601 bp, Human
acaagcaaactccaagttggtcactctgtttagtgcttaccttgtgccagcaataagtagtatccaattcaactaccccataaggagggggctggtattatccacattttacaaatgaggaaactgaggttctggccaaggagcttactggaggccatgaaactggtaagactagaagccagtgttcaaatctgggtctagctcattcactgccaggaacccatattcagatgcttctgacacatccatgaaaaggaattaatgttaaaaggtgatttatggccacgcgcagtggctcacrcctgtaatcccagcactttgggaggcccgaggcaggcggatcacaaggtcaagagatcgagaccatcctggccaacatggtgaaaccccgtctctactaaaaatacaaaaattagctgggcgtgatggcgcatgcctgtagtcccagctactcgggaggctgaggcaggagaatcgcttgaatcagggaggcggaggttccagtaagccaagatcgcgccactgcactccagcctggcgacaaagcaagactccgtctcaaaaaaaaaaaaaaaaaaaaagtgattaacttttattgccg

SEQ ID NO: 201472 - DNA, 601 bp, Human
tgcatgaggtcacacagggccatgagggctttctgcctcgtctggaggtcctctgactgcagctcctccttcagcttgggcagggcccgatggccataggcagtggtaatctgggtggcattgatgttaatgggaagctccaaggagttctgggaatgggccatctttccccaactacagaggcctttccaaatgaagctctgcagaaaccactcactaaaagagaccaaaaagctgtcattatttctattatgatttaaaagctacttctcatttgatcctccaaactgtgagggcaggmaaatgggtatttttactttcattttacagatgagcaaactgaggctgagagcaatgaagagatttgctcaaagtcccagtgaaggtaagtaagtagcagcccaaactgcaaactccagagccctcccacacaatagtgcttcacagaagaaaccactgatactttcatctggatcttcagtcaaaggcattaaaggacaaaacaaaccaaacaagcaaactccaagttggtcactctgtttagtgcttaccttgtgccagcaataagtagtatccaattcaactaccccataaggagggg

SEQ ID NO: 201473 - DNA, 601 bp, Human
tggccttgtagatacactcggggtcatgcatgaggtcacacagggccatgagggctttctgcctcgtctggaggtcctctgactgcagctcctccttcagcttgggcagggcccgatggccataggcagtggtaatctgggtggcattgatgttaatgggaagctccaaggagttctgggaatgggccatctttccccaactacagaggcctttccaaatgaagctctgcagaaaccactcactaaaagagaccaaaaagctgtcattatttctattatgatttaaaagctacttctcatytgatcctccaaactgtgagggcaggaaaatgggtatttttactttcattttacagatgagcaaactgaggctgagagcaatgaagagatttgctcaaagtcccagtgaaggtaagtaagtagcagcccaaactgcaaactccagagccctcccacacaatagtgcttcacagaagaaaccactgatactttcatctggatcttcagtcaaaggcattaaaggacaaaacaaaccaaacaagcaaactccaagttggtcactctgtttagtgcttaccttgtgccagcaataagtagtatc

SEQ ID NO: 201474 - DNA, 601 bp, Human
atctcttgaccccaagatttcaaggttacagtgagctatgattctgccactgcactctagtctgggagatggcaagaccctccctcaataaataaacattttttaaaaagaacccgggcaccgcacctatagtggaactggcctggagtcaggctcaaacaatagcaacccttattactgaagttctacccagtgcctgaagccatgctaggaccccagtcatggtcacctgtgctgtgtcacgctcacctatgttcatggccttgtagatacactcggggtcatgcatgaggtcacacarggccatgagggctttctgcctcgtctggaggtcctctgactgcagctcctccttcagcttgggcagggcccgatggccataggcagtggtaatctgggtggcattgatgttaatgggaagctccaaggagttctgggaatgggccatctttccccaactacagaggcctttccaaatgaagctctgcagaaaccactcactaaaagagaccaaaaagctgtcattatttctattatgatttaaaagctacttctcatttgatcctccaaactgtgagggcaggaaaatgggtatttttac

SEQ ID NO: 201475 - DNA, 601 bp, Human
agcgagatgccatctcaaaaaataaataaataaataaatacaaatctagctttatttatttattgggcaaccctagacttacaatccttctctgaaccatgcttttcttatctgtgggttgagaatggactctcccctgtaggtggcctttctaaggattaagataatccaggctgggtgtgatggctcacacatataatcccaaaactttggaggctgacctgggagaatcaattgaggccaagagttcaagaacagcctgggcaacacagcaagatcttgtttataaaaaaataataakaagaaattagtcagccatggtggtacttgtagtcctagttactcaggaagctgaagcaggaggatctcttgaccccaagatttcaaggttacagtgagctatgattctgccactgcactctagtctgggagatggcaagaccctccctcaataaataaacattttttaaaaagaacccgggcaccgcacctatagtggaactggcctggagtcaggctcaaacaatagcaacccttattactgaagttctacccagtgcctgaagccatgctaggaccccagtcatggtcacctgtgctg

SEQ ID NO: 201476 - DNA, 601 bp, Human
tgcttgaacccaaagaggcaggggctgcagtgagctgagatcgtgtcaccgtactccagcctgggtgacagagtgagagactgtctcaaaaaagaaagaaaagaaagagagagagagagagcgctcagagcttggaactaacataaaataaataaaaatcagtctggaacagagggccccataagatccacacagaggcaaccaaaaccaccccacaaagagtcctgctctggctaaatagaagcccctgcaaaaactgatgcggcagacaacactccagagcactctaagcagctcaagkgcatccacccaggggagaagtgcggctcgcaagcgtcacactggtttccagaacagcatcccacctgcccacgctatggcttgccgtgatgtggagcacctcggtggtctttatgcgcaccatactgttgctatccttcagcaaagctttcaggttctccatacagcctagaaaaaaaaaaaaaacaaacaaaccaacccttgaatttttgccagtctcagaaaccaaccaacccagaagtcaataagtgggccagttggggcaggaatgtaccagagtttctgctgctttggggcactg

SEQ ID NO: 201477 - DNA, 601 bp, Human
ttagtagagactggtttcaccatgttggcctgtgtgcctcctcaccagaggcaagcaagagggcagggaacaggctgccaggaagctctcttgtccgtggggtgtcatgcaaattaactcctcaaggtgacaagatgccaagcccagggctgctatcctcattcccccttcctgtcactacttctgtgggtagaagaggcagaagagtttcaacctgggcagttcagggcagctacttagagcttgatgggctctaagtaaaggttaggggcacacaggagtcaagtcacctttcctgcttttttttttcccttcaaatcctgaaccgatttgaagcctctctgaatggctgcctgtttacaccaaacaacccccaaggcagtcagcaccttgcctttcttgtcttttcttccttctgggcctgtgcacactgggcagtggccccctttatccgaaagacctgggccagggcttgggggtgtttgtgatgtggggttctgtttttttggggggtggggacgggggctggtggggagaggttccagtgaaaactggaaaacctgctagaaaaattctaaaagagctgtaacactggggtttt

SEQ ID NO: 201478 - DNA, 601 bp, Human
cacacagggccggggctgcacacaggatcagccaccaaggcagcgagagcttggggactagcagggctgagtgactttgggttttatgagatgccctgcagcctctgcctctctgggttcaagcaattcttgtgcctcagcctcctgagtagctgggactacaggcatgtgtcatcatgctcagctaatttttgtatttttagtagagactggtttcaccatgttggcctgtgtgcctcctcaccagaggcaagcaagagggcagggaacaggctgccaggaagctctcttgtccgtgggrtgtcatgcaaattaactcctcaaggtgacaagatgccaagcccagggctgctatcctcattcccccttcctgtcactacttctgtgggtagaagaggcagaagagtttcaacctgggcagttcagggcagctacttagagcttgatgggctctaagtaaaggttaggggcacacaggagtcaagtcacctttcctgctgttttttttcccttcaaatcctgaaccgatttgaagcctctctgaatggctgcctgtttacaccaaacaacccccaaggcagtcagcaccttgcctttcttg

SEQ ID NO: 201479 - DNA, 601 bp, Human
caacctgggcagttcagggcagctacttagagcttgatgggctctgaaagctattgacattggttataagatcaccactgacctcaagggaaatttagaagttggccacatttctgagaacgctgaaggagtgcacgggccaggccattatcaggtccctggtcagggatggtcacttcaccatgtcttcctgccttgctaatgtgggcacagccaggacccctggcttaggcactctaggtgctgctaaacaaatccttactaccattcattataagtaggttgatgcaaaagtaattgyggtttttaccactacttttaattgcaaaactgcaattacttttgcactaacctgataattgctcaggcttcagggacctgtcctctcagcatctgtcccccctaactggggattactacctaatgtccacatcaggtccagaaaagtagggaggaaaaaccagcaagaaaggtgacttgactcctgtgtgcccctaaccttttaaagcaccttgcctgggtcatctaagatctgcagagtgaggctgggattaggattgttgcccagatcacagagcaggaaagagtgggccccccaaaa

SEQ ID NO: 201480 - DNA, 601 bp, Human
aacaggctgccaggaagctctcttgtccgtgggatgtcatgcaaattaactcctcaaggtgacaagatgccaagcccagggctgctatcctcattcccccttcctgtcactacttctgtgggtagaagaggcagaagagtttcaacctgggcagttcagggcagctacttagagcttgatgggctctgaaagctattgacattggttataagatcaccactgacctcaagggaaatttagaagttggccacatttctgagaacgctgaaggagtgcacgggccaggccattatcaggtccytggtcagggatggtcacttcaccatgtcttcctgccttgctaatgtgggcacagccaggacccctggcttaggcactctaggtgctgctaaacaaatccttactaccattcattataagtaggttgatgcaaaagtaattgcggtttttaccactacttttaattgcaaaactgcaattacttttgcactaacctgataattgctcaggcttcagggacctgtcctctcagcatctgtcccccctaactggggattactacctaatgtccacatcaggtccagaaaagtagggaggaaaa

SEQ ID NO: 201481 - DNA, 601 bp, Human
gaaacaccaaccagtggtctcatatccgacaaaaagcctgggtcccacatggggattgatgaatgccttatcatttgtgttttgggttaaaatgaaccatttaaaggaaaccatttcttcagttccttgctttgtaatcatttcttttgattaaccaactgactgctgggcctgaatgcatctgaaagaggccttctgaggtcacgtctctgagggctgggttcaggaatgaatgagaatgcatgtgcaaacccctcagccaagtgcccacaggaagtgcccaaccagctgtgccactgcrgcatttattataaataaaaataaattttatttattttatttatttatttattttcacttatggtgtgttttgaatcgtctggaaaaagaaagtcaccgttggacacacaagttgcaggggtcttccctgaccacgggggcttccttggtccgtgtctagtcacccactccatgtctctcatgctttgatagtcagttgtgtttgcctgtgtgcctcctcaccagaggcaagcaagagggcagggaacaggctgccaggaagctctcttgtccgtgggatgtcatgcaaattaactcctca

SEQ ID NO: 201482 - DNA, 601 bp, Human
ctctgtctcaaataagtaaataaataaataaatataaattaataaataaaaagattctagaagggttttgcatacaggttatttcattaatgtctttgagttcttgctctactttaaaaaaaccaaagctgcaaatcagacgatgttatgagtatggtttaagcaaaaaaaatatgataggaaacaccaaccagtggtctcatatccgacaaaaagcctgggtcccacatggggattgatgaatgccttatcatttgtgttttgggttaaaatgaaccatttaaaggaaaccatttcttcrgttccttgctttgtaatcatttcttttgattaaccaactgactgctgggcctgaatgcatctgaaagaggccttctgaggtcacgtctctgagggctgggttcaggaatgaatgagaatgcatgtgcaaacccctcagccaagtgcccacaggaagtgcccaaccagctgtgccactgcggcatttattataaataaaaataaattttatttattttatttatttatttattttcacttatggtgtgttttgaatcgtctggaaaaagaaagtcaccgttggacacacaagttgcagggg

SEQ ID NO: 201483 - DNA, 601 bp, Human
taaaagttagccaggcatggtggtgtgtgcctgtgttcccacctactcagtaggctaaggtgggaggatcgtttgagcctaggagtttaaggctacagtgagctaggatcatgccactaaactccagcatggatgacagagctagaccttgtctcttaaaaaataaaaagattctaggccaggcgcggtggctcacgcctgtaatcccagcactttggaaggccaaggtgggcggatcactaggtcaggagatcgagaccatcctggctaacacagtgaaaccccgcctgtactaaaaatmcaaaaaaaaaaaaaaaaaaaaaaaaattagctgggtgtggtggcgggcgcctgtagtcccagctactttggaggctgaggcaggagaatggtgtgaacccgggaggtggagcttgcagtgagccaagaacgcacaactgcgctccagcctgggtgacagagcgagactctgtctcaaataagtaaataaataaataaatataaattaataaataaaaagattctagaagggttttgcatacaggttatttcattaatgtctttgagttcttgctctactttaaaaaaaccaaagctgcaa

SEQ ID NO: 201484 - DNA, 601 bp, Human
ttaaaagttagccaggcatggtggtgtgtgcctgtgttcccacctactcagtaggctaaggtgggaggatcgtttgagcctaggagtttaaggctacagtgagctaggatcatgccactaaactccagcatggatgacagagctagaccttgtctcttaaaaaataaaaagattctaggccaggcgcggtggctcacgcctgtaatcccagcactttggaaggccaaggtgggcggatcactaggtcaggagatcgagaccatcctggctaacacagtgaaaccccgcctgtactaaaaayacaaaaaaaaaaaaaaaaaaaaaaaaattagctgggtgtggtggcgggcgcctgtagtcccagctactttggaggctgaggcaggagaatggtgtgaacccgggaggtggagcttgcagtgagccaagaacgcacaactgcgctccagcctgggtgacagagcgagactctgtctcaaataagtaaataaataaataaatataaattaataaataaaaagattctagaagggttttgcatacaggttatttcattaatgtctttgagttcttgctctactttaaaaaaaccaaagctgca

SEQ ID NO: 201485 - DNA, 601 bp, Human
aagcaaaaatcagtaatacatcccacacgtaaatctcagaaataaaacgttaagcaaaagtagctacaagcaagatattacaagctggatgtttccatttatgtaaagttttaaaaggggcatcatctatggtcttataaattgaagataccatttatcattggtaagggtaatacccagtatgggcatgtgggaagtttctggagaggtggtaaatactctctacatgtcttgattggggtggcagttacaccacatgttcactgaaaacaacttgaccaaatgttcatttaggatatgygcttttcttttttctttctttttttttgtcttaagacagagtctcgcactgtcgcccgggctagagtgcagtggtgcaatcttggctcactgcaacctccgcctcccaggttcaagcgattcttctgcctcagcctcccaagtagctgggattacaggtgcccaccaccatgcccagctaatttttgtatttttagtagagacagggtttcaccatattggccaggctggtgtcgaactcctgacttcgtgatctgcctgcctcggcctcccaaagtgctgggattacaggtgtgagcca

SEQ ID NO: 201486 - DNA, 601 bp, Human
tccagcataaacaagcaaaaatcagtaatacatcccacacgtaaatctcagaaataaaacgttaagcaaaagtagctacaagcaagatattacaagctggatgtttccatttatgtaaagttttaaaaggggcatcatctatggtcttataaattgaagataccatttatcattggtaagggtaatacccagtatgggcatgtgggaagtttctggagaggtggtaaatactctctacatgtcttgattggggtggcagttacaccacatgttcactgaaaacaacttgaccaaatgttcrtttaggatatgtgcttttcttttttctttctttttttttgtcttaagacagagtctcgcactgtcgcccgggctagagtgcagtggtgcaatcttggctcactgcaacctccgcctcccaggttcaagcgattcttctgcctcagcctcccaagtagctgggattacaggtgcccaccaccatgcccagctaatttttgtatttttagtagagacagggtttcaccatattggccaggctggtgtcgaactcctgacttcgtgatctgcctgcctcggcctcccaaagtgctgggattac

SEQ ID NO: 201487 - DNA, 601 bp, Human
ggactggttgagagcagcaagtcccctgtctccacactccaagaatgaggggactagaccctcgcttattcctcaggttcctgcatggtgagcacagggcattaatttagctcaacccagcactggtcccccatggatcaccctaataccccaggggctctcaaccctggggcatgcatgactgtcattcaaggtgcattttcagaaatatgtgtgcagggccccacccccagagactgctcctggtggcctgggagaggaccaggggcacggtggtgtttttaaaaaaccacaggcctartgtgctcaactcccaggccagatcagctggaagaagatgtgcttcaggagccaagcaacaatcctagaccctcacaggctctgctctgttgggcctgcctatctgcacctgatcccgtagtcatttctctctgagccttaacccagggaatgctcacgcctggccttgaatgtttgcactccatccttgggcaggacgctgagctatacaccaggccagtgtttccacttcaacctcatttctggcctctgaggcaggtactttagacatgggaaataacctgtccagggcacacgggga

SEQ ID NO: 201488 - DNA, 601 bp, Human
cactgggcaggagaggaatctgatgaggtgtcaggcagagggaagatgtttcctctcaccaggacagggacagtaaagccatatcacagtgaaacaccatagcacatccatcaggctgggatatgccccgggctctctggaggccagaggctgggctggaagcagttgcaatatccagcaaagctgaaggcaaacacattctccctggcccagcgatgccctccctggcagatgctctaggggactctccttccagggtaccaggaagccctgggcaggaacagccatggcacagtccttytgcagtacaggagtacaaacaaccaacaagcctgccagcctgggatgggtgagtgtatcatgatacattcaaacaccggaacagtgtgcagtgatggaaatgaatgaaatacagccagtggcgcaacatggattcatctcaaaatttctataaatctctaatgttatttaggttttttaaggttttggaagtaacagagggatacatacagcaagatccacttacatagttttaaaacatgcaaaacaagattatatatcgtccatatgtaattatatctgtggtaaaatataaagatat

SEQ ID NO: 201489 - DNA, 601 bp, Human
agaaagaaggaaagaaagaaagaaagaaagaaagaaagaaagaaagaaagaaagaaagaaagaaagagaaagaaggaaagaaggaaagaaagactgctgcaccagtgaatcaacaaaggcacagtgagaagccaagaaaacagcctggtttgaaatgatatttgcaatgtaggtaaccgacaaagggctggaatccaggataaattacacactccttcaaatcaataagaaatggaaaaacaactcggcaacagaatgaacacactctctccagaggcactgggcaggagaggaatctgaygaggtgtcaggcagagggaagatgtttcctctcaccaggacagggacagtaaagccatatcacagtgaaacaccatagcacatccatcaggctgggatatgccccgggctctctggaggccagaggctgggctggaagcagttgcaatatccagcaaagctgaaggcaaacacattctccctggcccagcgatgccctccctggcagatgctctaggggactctccttccagggtaccaggaagccctgggcaggaacagccatggcacagtccttctgcagtacaggagtacaaacaac

SEQ ID NO: 201490 - DNA, 601 bp, Human
gagatcgagaccatcctggctaacacggtgaaaccccgtttctactaaaaatacaaaaaatcagccgggcatggtggcgggtgcctgtagtcccagctactcgggaggctgaggcaggagaatggcatgaacccgggaggtggaggttgcagtgagctgagactgcgccagtgcactccagcctgggcgacagagtgagactctgtctcaaaaaaaaaagaaaaagaaaagagaaagaaagaaggaaagaaagaaagaaagaaagaaagaaagaaagaaagaaagaaagaaagaaagaaaaagaaagaaggaaagaaggaaagaaagactgctgcaccagtgaatcaacaaaggcacagtgagaagccaagaaaacagcctggtttgaaatgatatttgcaatgtaggtaaccgacaaagggctggaatccaggataaattacacactccttcaaatcaataagaaatggaaaaacaactcggcaacagaatgaacacactctctccagaggcactgggcaggagaggaatctgatgaggtgtcaggcagagggaagatgtttcctctcaccaggacagggacagtaaagccatatcacag

SEQ ID NO: 201491 - DNA, 601 bp, Human
agctgagaccatgccactacagtacagcctgggtgacagagtgagactgcatctcagaaaagaaggaaggaaggaaggaaagaaggagaaagaaagagagaggaagaaagagaaagagacaaagagagaaagagaaagaaaggaaggaaaagaaggaaagaaagaaagggaagggagagaaagaaagagaaagaaaaagaaagaaagaaagaaagaaagaaagaaagaaagaaagaaagaaagaaagaaagaaagaaagaaagaaaaagaaaaagaaggccgggcatggtggctcacgcckgtaatcccagcactttgggaggccgaggcaggcggatcatgaggtcaggagatcgagaccatcctggctaacacggtgaaaccccgtttctactaaaaatacaaaaaatcagccgggcatggtggcgggtgcctgtagtcccagctactcgggaggctgaggcaggagaatggcatgaacccgggaggtggaggttgcagtgagctgagactgcgccagtgcactccagcctgggcgacagagtgagactctgtctcaaaaaaaaaagaaaaagaaaagagaaagaaagaaggaaagaaa

SEQ ID NO: 201492 - DNA, 601 bp, Human
cagtaccacagccccctactcctaatggtgcacccagtgttggtggatggcagaaaaagacaaggggaggagatggggaaaagcaaactcgtacattttagaagaaaatatggcagaatatcttcatgagtcagggtaaagaaagattatcttacacggcactcaaaaaaaaaaaaggccagagggaaaaaaaatcatgaaattgacttcattattcaaatgaaaaactgctaaggctgggcatggtggctcacgcctgtaatcccagcactttgggaggccgaggcaggaggatcgtgargtcaggagttcaagaccagcctggtcaacatagtgaaaccccgtctctactacaaatacaaaaattagctgggcatggtggcacacgcctgtagtcccagctactcgggaggctgaggcaggagaatcacttgaacctgggaggtggagtttgcagtgagctgagaccatgccactacagtacagcctgggtgacagagtgagactgcatctcagaaaagaaggaaggaaggaaggaaagaaggagaaagaaagagagaggaagaaagagaaagagacaaagagagaaagagaaagaaag

SEQ ID NO: 201493 - DNA, 601 bp, Human
acccggtgtcccaggcctcccttctgggcccttcacagatcatgagcagcactcagtaaaccccgtgatgaagggccgaggctccccaccctgaccctcactgaggcttctgttcgtgagcttgtcagtaccacagccccctactcctaatggtgcacccagtgttggtggatggcagaaaaagacaaggggaggagatggggaaaagcaaactcgtacattttagaagaaaatatggcagaatatcttcatgagtcagggtaaagaaagattatcttacacggcactcaaaaaaaaaaaaggccagagggaaaaaaaatcatgaaattgacttcattattcaaatgaaaaactgctaaggctgggcatggtggctcacgcctgtaatcccagcactttgggaggccgaggcaggaggatcgtgaggtcaggagttcaagaccagcctggtcaacatagtgaaaccccgtctctactacaaatacaaaaattagctgggcatggtggcacacgcctgtagtcccagctactcgggaggctgaggcaggagaatcacttgaacctgggaggtggagtttgcagtgagctgagaccatgccac

SEQ ID NO: 201494 - DNA, 601 bp, Human
accccaaaatctggttagagaagaattgtcaatttcagccacagaactctctctcccacaaaaatgaaacctgttttctcatggggttctactccattcctggacttagcaggaatgatggtcaccgatagggacactctggcctcttggttcctggcctgccaggcctccccctctcatcgggctggggagcagaagcagaccctgtgcatcactcagggcccagctggcagggagcctgggctggcagcctgtgtgtgacatctgtctctacaatcctattttctcctctcctgacacrgcaccaccacggcgcatgagtagccagcctggaaggaacttagaggaatgcgtgtgggtgagcgcagcagcttgggcccagggcccctgcagggccagggcccacttgggacaatcctcagtcctggggtgccccctcctggttactctgggaaatcatgcaagtcagacttggccagagcaaggattctgaaaccactctcccagacacccatgacacaggggaagaaactgaggcacggtggccagaacaaaacaggggcccaacacatactgtcaaatgaatgaaggaatgagcaag

SEQ ID NO: 201495 - DNA, 601 bp, Human
actggggggcacactcatgggaggccaagatgcttgattccatcctacagaagtggaagcagagaccaggagaggcgatgacttatcagcatcacacaatgtgaccccaccaggccaggacctgaggggttttactctgtccacattccccagatccccacagtggcaacaggccctggcaccctacttccaacgtcagccctccagaacaaatggtccatctggctcaggggacagtgccaggaagggctgcactgcaccatgaggacttgaggcaacactgaggctggacctcgccctrgatgagctcacctcacccagatgagcctgacgagatggggatgcctgacaggccgggaaccaagaggccagagtgtccctatcagtgaccatcattcctgctaagtccaggaatggggtacaactacccaccaaagactgtcaggctgaggatgtgcctggggttctggtgcaccctgccctgagggcaggcaagacagaaaagggcctgctcctctagggcagctggcctccacccctcaccctgtggcatcaaggggaggaggaggaggaggctgctctgggtccatcgaaggaagct

SEQ ID NO: 201496 - DNA, 601 bp, Human
tgctcactggggggcacactcatgggaggccaagatgcttgattccatcctacagaagtggaagcagagaccaggagaggcgatgacttatcagcatcacacaatgtgaccccaccaggccaggacctgaggggttttactctgtccacattccccagatccccacagtggcaacaggccctggcaccctacttccaacgtcagccctccagaacaaatggtccatctggctcaggggacagtgccaggaagggctgcactgcaccatgaggacttgaggcaacactgaggctggacctcrccctagatgagctcacctcacccagatgagcctgacgagatggggatgcctgacaggccgggaaccaagaggccagagtgtccctatcagtgaccatcattcctgctaagtccaggaatggggtacaactacccaccaaagactgtcaggctgaggatgtgcctggggttctggtgcaccctgccctgagggcaggcaagacagaaaagggcctgctcctctagggcagctggcctccacccctcaccctgtggcatcaaggggaggaggaggaggaggctgctctgggtccatcgaagg

SEQ ID NO: 201497 - DNA, 601 bp, Human
tcccgccttgtcctacttcacgcagccccagcctcctttcccaggacccaccatcatgtggctccctgtgggatattgccatcctcacctatagcccacgtggtcaccctggtggtgcaatgggtcaacaacagtggtcacgataatcccagctctcctcagtgactgctcactggggggcacactcatgggaggccaagatgcttgattccatcctacagaagtggaagcagagaccaggagaggcgatgacttatcagcatcacacaatgtgaccccaccaggccaggacctgaggggytttactctgtccacattccccagatccccacagtggcaacaggccctggcaccctacttccaacgtcagccctccagaacaaatggtccatctggctcaggggacagtgccaggaagggctgcactgcaccatgaggacttgaggcaacactgaggctggacctcgccctagatgagctcacctcacccagatgagcctgacgagatggggatgcctgacaggccgggaaccaagaggccagagtgtccctatcagtgaccatcattcctgctaagtccaggaatggggtacaactaccc

SEQ ID NO: 201498 - DNA, 601 bp, Human
gagaggaggctagagtaggtggcagggtgcctgaaggggaggacctggggatggctgggccagccctgcccactgcaggtgactaatcccgccttgtcctacttcacgcagccccagcctcctttcccaggacccaccatcatgtggctccctgtgggatattgccatcctcacctatagcccacgtggtcaccctggtggtgcaatgggtcaacaacagtggtcacgataatcccagctctcctcagtgactgctcactggggggcacactcatgggaggccaagatgcttgattccatyctacagaagtggaagcagagaccaggagaggcgatgacttatcagcatcacacaatgtgaccccaccaggccaggacctgaggggttttactctgtccacattccccagatccccacagtggcaacaggccctggcaccctacttccaacgtcagccctccagaacaaatggtccatctggctcaggggacagtgccaggaagggctgcactgcaccatgaggacttgaggcaacactgaggctggacctcgccctagatgagctcacctcacccagatgagcctgacgagatggggatg

SEQ ID NO: 201499 - DNA, 601 bp, Human
cccagaggggcttttgtttctgaagaaataacgtgtgacttaaaatcgttgagacttattttgtgcttttaatgccaactgtgaaaagagcagtaatttcgccgtgagcatctttaatctaaaaatacatggctaaagggagaaagggattgagcctcccttcctaatgtgtgcaaagatcagaggaggccttccctggagggaggtttctcccggttcccagaacctagtcaggagtctccagttcccccataggctgcagagaaacctcaggcgctgtcgacctctctggccccgtccycccctgcagttcacctgcactggttctcctcctgagcctgccttgttccgctcttgcccccaatgatccctttgcctagcatgtccttccccatcctcacagctcaaagtcacctgggcagcttcttggaagtctcctccttccctgcattccatctgtcagggctccagggtcgagtgggaaggggtgttggaaactccattgagcagctcaaggccagcgcctctgacccacctcattcctccaaacaatgccccatggagaaggcgcatgctgagctgggatggtccaggagtctta

SEQ ID NO: 201500 - DNA, 601 bp, Human
gccccatccctactcctaagcccacgcagggactcccttcacaccttcctacgtcaccaaacagccagaacccagaggggcttttgtttctgaagaaataacgtgtgacttaaaatcgttgagacttattttgtgcttttaatgccaactgtgaaaagagcagtaatttcgccgtgagcatctttaatctaaaaatacatggctaaagggagaaagggattgagcctcccttcctaatgtgtgcaaagatcagaggaggccttccctggagggaggtttctcccggttcccagaacctagycaggagtctccagttcccccataggctgcagagaaacctcaggcgctgtcgacctctctggccccgtccccccctgcagttcacctgcactggttctcctcctgagcctgccttgttccgctcttgcccccaatgatccctttgcctagcatgtccttccccatcctcacagctcaaagtcacctgggcagcttcttggaagtctcctccttccctgcattccatctgtcagggctccagggtcgagtgggaaggggtgttggaaactccattgagcagctcaaggccagcgcctctgac

SEQ ID NO: 201501 - DNA, 601 bp, Human
aagagggaggaccagtgcagggtctgtgcaccttccctgctggcctgcacacagctgctcagcaccactttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctactagtctgatgttttataaatcaaaacctggttttccttctctgacatttttttttgtkttttgttttttggtttttttttttttttggccaaatctcgtggtgtttcgcagaaaaaaatccagaaaatttcaaatgcagttgagtattcttttttaaatgcagattttcaaaacatattttttttcaggtggtcttttttgtgtctggcttgctgagtgtaaaagttgttatctggacgatctgtctctctgctccaaagaaattttggagtgagtggcagtcctgcgccagcctcgcgggacacgtgttgtacataagcctctgcagtgtcctcttgttaatggtggggttttctgc

SEQ ID NO: 201502 - DNA, 601 bp, Human
ccaagagggaggaccagtgcagggtctgtgcaccttccctgctggcctgcacacagctgctcagcaccactttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctactagtctgatgttttataaatcaaaacctggttttccttctctgacatttttttttgttttttgttttttggtttttttttttttttggccaaatctcgtggtgtttcgcagaaaaaaatccagaaaatttcaaatgcagttgagtattcttttttaaatgcagattttcaaaacatattttttttcaggtggtcttttttgtgtctggcttgctgagtgtaaaagttgttatctggacgatctgtctctctgctccaaagaaattttggagtgagtggcagtcctgcgccagcctcgcgggacacgtgttgtacataagcctctgcagtgtcctcttgttaatggtggggttttct

SEQ ID NO: 201503 - DNA, 601 bp, Human
cccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactttgccttcctgagttggccccactccacttgggggtctgcattggattgttagggataggcagcagggctgaggcaaggtaggccaactgcacccctgtcrcctggaggagggccagctcgctgcccgagctctggcctagggaccttgccgctgaccaagagggaggaccagtgcagggtctgtgcaccttccctgctggcctgcacacagctgctcagcaccactttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctac

SEQ ID NO: 201504 - DNA, 601 bp, Human
gttgcttcgtgcctgagtcatcactaccagctgcagttaccacttgcattaccacggtcactggtgatgtagtctagtcagaaaagttcctttttttttttttttttgagacagagtctcgctgcgtcgcccagactggagtgcagtggcatgatctcggctcactgcaacctccacctcccgggttcaagtgattctcctgccccagcctcccaaggagctgggattacaggtgtctgccaccatgcccagctaattttgttgttgttgttttatttttagtagagatgaagtttcactrtgttggccaggctggtcttgaactcctgaccttgtgatccacctgcctcagcctcctaaagtgctgggattacaggtgtgagccacggcgcctggccagaaaagttcttaaatccaaagcatcagatctaagccagattggttccagatttttgatattttgctcattgagtttatcttagaagcaggggtagcttttgccagcagcaaattccaggtagttactccttttagaagttagaatttattcattttgcagggaagtggtgaactggggagtcagacaagagcatcatgcttc

SEQ ID NO: 201505 - DNA, 601 bp, Human
cgtcattgtcactgcagtcattggtgatgctgttgcttcgtgcctgagtcatcactaccagctgcagttaccacttgcattaccacggtcactggtgatgtagtctagtcagaaaagttcctttttttttttttttttgagacagagtctcgctgcgtcgcccagactggagtgcagtggcatgatctcggctcactgcaacctccacctcccgggttcaagtgattctcctgccccagcctcccaaggagctgggattacaggtgtctgccaccatgcccagctaattttgttgttgttgttttatttttagtagagatgaagtttcactatgttggccaggctggtcttgaactcctgaccttgtgatccacctgcctcagcctcctaaagtgctgggattacaggtgtgagccacggcgcctggccagaaaagttcttaaatccaaagcatcagatctaagccagattggttccagatttttgatattttgctcattgagtttatcttagaagcaggggtagcttttgccagcagcaaattccaggtagttactccttttagaagttagaatttattcattttgcagggaagtggtga

SEQ ID NO: 201506 - DNA, 601 bp, Human
tggtggccagatcacgcccttcccaaccccggaggaagccccctaccccaaaaggaccctgccatccctgcctggctctattcctgcagccccaggactcccacctcaagctccatcacctggcatgagagctgatgtggactcagggcgcgctcagcaagtgtttgctcagtaaattaataatacgtgctaatggtcatatctgttatttaactgatgcaaaatttggggtcagaagcatagcccccaattacagcatcatttctatgagaaatgacagctctgttaccacagtcctctrtgatgtggcttccaggaatccattagagctaattactccctcagcagaatgtgacattcctagaccaccacttatctcacatttgggaatgtgcagccaggttcactgcggaggcgctggctcctctctgctctgctggggatgagatcttgtgtgttgcttgtctctgcagaaaggccagcacccccatccccagacctgaggctgctcactcctcaggactcctgttattccgaagctcattctaaagaaagagcaagattggtttggaaaaacagtcttccaggtggagtgcagggt

SEQ ID NO: 201507 - DNA, 601 bp, Human
aagctgggtattaaaaccatctcaactgtcatccccaagtgacccatcagggctcagagaggcagacccaggcctagcacccactctgtgcttgtcccctcacccttgaacccccaggtccataccctgctggtggccagatcacgcccttcccaaccccggaggaagccccctaccccaaaaggaccctgccatccctgcctggctctattcctgcagccccaggactcccacctcaagctccatcacctggcatgagagctgatgtggactcagggcgcgctcagcaagtgtttgctcrgtaaattaataatacgtgctaatggtcatatctgttatttaactgatgcaaaatttggggtcagaagcatagcccccaattacagcatcatttctatgagaaatgacagctctgttaccacagtcctctgtgatgtggcttccaggaatccattagagctaattactccctcagcagaatgtgacattcctagaccaccacttatctcacatttgggaatgtgcagccaggttcactgcggaggcgctggctcctctctgctctgctggggatgagatcttgtgtgttgcttgtctctgc

SEQ ID NO: 201508 - DNA, 601 bp, Human
ccggggcccaggctgggcactaggtcagaggacaagactgggcttctggcctggcaacacctttccccactgcctcctctgcagttgatctttcagacccaaatatgaggctcttctctaggtttggcctcctctcatcaacttcagctggtcagggtcctgactttgtaaccgtctgtggttcttcagcctcccgctctgtcttgtcccccatctctgagagctgcaggcctctggtctaggaacaaacccacgatgcagctcctgcctcacttgctggtccatcagcaccacactgccrgcaccacactgtcccatgctgggccctctgaccttctttatagccttcctgttctataaagattacaggatgggcacccaccatctcctaagcttcacctcctactagggtggagcccatgtgcagtgaaggctcagcctgcgtcagggacgctgggatggagtgaggcggcaagctcaggtgcttcccacgctctgaagcttcctgtctgagcccggaagtgaggtatgtggttggtgcctcctgcaggctttcctgactcctgccagacagggcccagccaagaaacaagaccaggaa

SEQ ID NO: 201509 - DNA, 601 bp, Human
ggccagatgggtgcaggaggcacagccagtcatgttttgcagggtgagcagagcatggacaggtcagagggctatgaggccaggccctggaggccagcagaaggcatgctggggcttcttgcttcccatatgcatgcttgagtcacagtttccagagctacagcttcaaatagacggctctgttttcagtggtggtgatttgagtgtcaggatgccgctttgcccacctgtctgcactccaggctgcaagagtgcaggcaccgctgtgacacaggctcccgaggtcaccaggcaagcaccrgggcccaggctgggcactaggtcagaggacaagactgggcttctggcctggcaacacctttccccactgcctcctctgcagttgatctttcagacccaaatatgaggctcttctctaggtttggcctcctctcatcaacttcagctggtcagggtcctgactttgtaaccgtctgtggttcttcagcctcccgctctgtcttgtcccccatctctgagagctgcaggcctctggtctaggaacaaacccacgatgcagctcctgcctcacttgctggtccatcagcaccacactgccggc

SEQ ID NO: 201510 - DNA, 601 bp, Human
tgcatccagctgcctggtggctgaaggcctggttacaaatcacctcaccattccccgacgccaagcagtgagattcccaccattgcacaagcttctcacaggaactgtctgctccgtgttatttatataaataaatgtgcagacaaaccccagcctcctagaaggcgccatcttgctggtaagcaggccctggagagagcaggatgggcactggagccctgggctggcatcacagcagtgaatggtggtgtgtttctgcctccctcttccccgccccgccccgccccccgcggctgcctttggcagccatagaggtgaaggcaaggagggcttcttgccagaacaggacactgtggcagttggaaaataccaggctctcaactgcaccctggggagtcagcccctcttgaggccttgggccccatatgtgaagtgaggagccctcccccttgccatggggtcatggttggcagaggcagctcctctgaatccagggtctgtcaggctgatggaggaagtcactgcaggacaagggggtgatgcactaccatggtgcagggccacatgactccaaagctgcatccagctctaccccagtggc

SEQ ID NO: 201511 - DNA, 601 bp, Human
ccacaccaccccagggactgcatccagctgcctggtggctgaaggcctggttacaaatcacctcaccattccccgacgccaagcagtgagattcccaccattgcacaagcttctcacaggaactgtctgctccgtgttatttatataaataaatgtgcagacaaaccccagcctcctagaaggcgccatcttgctggtaagcaggccctggagagagcaggatgggcactggagccctgggctggcatcacagcagtgaatggtggtgtgtttctgcctccctcttccccgccccgccccrccccccgcggctgcctttggcagccatagaggtgaaggcaaggagggcttcttgccagaacaggacactgtggcagttggaaaataccaggctctcaactgcaccctggggagtcagcccctcttgaggccttgggccccatatgtgaagtgaggagccctcccccttgccatggggtcatggttggcagaggcagctcctctgaatccagggtctgtcaggctgatggaggaagtcactgcaggacaagggggtgatgcactaccatggtgcagggccacatgactccaaagctgcatc

SEQ ID NO: 201512 - DNA, 601 bp, Human
ctggttccaggaagagctgaaaccttaatgtcacgtgcattttatgtgaggtttgaggcccctagttgggccagctggccttgctctgtgctgtggccacagcaaactgcatggggtcctgtggagtaagggacctagtggagagtgagtggacagggagaccagatgggtcagtacagagccttccccagccatgtggccatatcacactggcatcacccacctattccccaatacaacacagtccgggggcccctcacctggctgaggtatgtgacaaggctctgagctgatggtgtaygttcagcctgagtaggtgtttgcatgtggttgcccccaaaccagtgtgatttggggctgcatggatccagagtagggaggtgacggtcccaccatctctggggtgtgtgcaagggtcagggtttgggaaggggttggacaagaccagtgtccctgaggactgcctacctgctgggagctgacatgggaatctgggagtgcgtctggcctcctggagggggtctcgggttgcccagaggggagcgaggaggaggcccagaacataccccttcctagaacaggaaggtggggtgaccctgca

SEQ ID NO: 201513 - DNA, 601 bp, Human
ccatgaaggcatctcagaagctggcagggctgggggttccaggtcatctgtgtcccagggatgatgctggttccaggaagagctgaaaccttaatgtcacgtgcattttatgtgaggtttgaggcccctagttgggccagctggccttgctctgtgctgtggccacagcaaactgcatggggtcctgtggagtaagggacctagtggagagtgagtggacagggagaccagatgggtcagtacagagccttccccagccatgtggccatatcacactggcatcacccacctattccccaayacaacacagtccgggggcccctcacctggctgaggtatgtgacaaggctctgagctgatggtgtatgttcagcctgagtaggtgtttgcatgtggttgcccccaaaccagtgtgatttggggctgcatggatccagagtagggaggtgacggtcccaccatctctggggtgtgtgcaagggtcagggtttgggaaggggttggacaagaccagtgtccctgaggactgcctacctgctgggagctgacatgggaatctgggagtgcgtctggcctcctggagggggtctcgggttgccca

SEQ ID NO: 201514 - DNA, 601 bp, Human
tgcctgggtgtggggactaagctgtccatgtgtatcccacatcagccctcagccccctcacgagggaagtatgcttacatattctgtgtgtgtgtggttatttttttggaggggggacaggttcagaacagctggcagagcaggaggttgggcctgcattggccactccgcagctgccacaccggctccagcattccctcctgcctgtcctcacccaccttgttgagagcaaggctgtctgcttgcctccatccctcacacaagagcacctggagagcctctgcccagggaggtgaggaargggagagggcagtggggactgccatgaaggcatctcagaagctggcagggctgggggttccaggtcatctgtgtcccagggatgatgctggttccaggaagagctgaaaccttaatgtcacgtgcattttatgtgaggtttgaggcccctagttgggccagctggccttgctctgtgctgtggccacagcaaactgcatggggtcctgtggagtaagggacctagtggagagtgagtggacagggagaccagatgggtcagtacagagccttccccagccatgtggccatatcacactgg

SEQ ID NO: 201515 - DNA, 601 bp, Human
cccacagctccagctgggcagagctaccccatgctgtgctgtgccatggaataccagccaagagaccaggagcagggagcgttctgataggaacatccagctttcaggtctgacgtggcccattttaccagaagaaggggacctgctctgagcatagcagccccctctgcctggaacctcacagggctcacctccaggctagcaccctgcccctgcggctgaccctggccaggaagacacatgttagacagctggctggacttggtgcctgctgtggctgcaactcccctgggaagacagytgagtgttctgacgttggctaaactgcatctttacaacagctggggccccagcgccacctggccctgtgcccaggcaaggccctgctggtcccagcatccttctctcccacagatcttaccccggctcccaccccagcactctggccagcaccgcctccctgtttcatagtcccatcaacccctcacacactggctcccagctgctgccaccaccttgagctgtctcggatagcctcctgcccatacccctttggcctgagggtagatgtaggccaagagcttgcacctacaagcttccc

SEQ ID NO: 201516 - DNA, 601 bp, Human
ttccctgtgagcgtgagcaggaatgactcatgcctcctccacctgctctcacactgagcctctgccggggagtggcctcactgtctgcctggtttttgtctgtctgcccctttgtctcccagtcccattacctgtcatgcatcctaagctcctgaggacagagaaggtggagagtagcagagccagagaggctctcctgtgacgtggctggctctgtaccgagcagggggtgcggccacaaatctccaagcccaggccaggggagagaggcaagcgcactggactcggttccgcctagtgrcaaagaggcccagaaaagtctcaagtgcttgggacagggccccatctgcatgtgatgtgttggggcctctggaaacggagatgccaaggcagtcttctctgaggtcagtggtgatgccagagaggtgaggctcaggccattgccagctgcaccagagacaccaaagcactccagggtcccccaaggtcactttagtagaacccagtgaccatcttggacaaacagcttattttactgaggcaggagctgcggcccagagcagaagtgacatgcccagggtctcactgcagtttggtggga

SEQ ID NO: 201517 - DNA, 601 bp, Human
ctgcgcgccttccctgtgagcgtgagcaggaatgactcatgcctcctccacctgctctcacactgagcctctgccggggagtggcctcactgtctgcctggtttttgtctgtctgcccctttgtctcccagtcccattacctgtcatgcatcctaagctcctgaggacagagaaggtggagagtagcagagccagagaggctctcctgtgacgtggctggctctgtaccgagcagggggtgcggccacaaatctccaagcccaggccaggggagagaggcaagcgcactggactcggttcygcctagtggcaaagaggcccagaaaagtctcaagtgcttgggacagggccccatctgcatgtgatgtgttggggcctctggaaacggagatgccaaggcagtcttctctgaggtcagtggtgatgccagagaggtgaggctcaggccattgccagctgcaccagagacaccaaagcactccagggtcccccaaggtcactttagtagaacccagtgaccatcttggacaaacagcttattttactgaggcaggagctgcggcccagagcagaagtgacatgcccagggtctcactgcagt

SEQ ID NO: 201518 - DNA, 601 bp, Human
gagccagccctgctggcatccagaggccagggtgggcctgccctcccatggccccgagctctgcccccaccctttaggattgcaccctgccttgttaagggatcagctgctgctcctctcaggtctttttgggagtcctgaatctgaagtgagcctgggagaaagggagtcagacaggagaggggtgggtgctgagccaagtgagggtctcaagaccaaggggaccccagagcatgggtacccagggcctacacttgggaggcctgtggctgggccaggaggatgaaccagtgtggagttsagagccatggagtggcagagaatgggtgccaggagctgaggtgttcaagctggaacagagccctccgtgcaggcagggccgagcctgtctccctcagcatctcagatgctcacagaaccacgggggcagcagggttcagtgttaaaggccaggctagaggaatggaaacagctgccccagccctggaagctgtgggagtggtggttgccctgcaagagaaggctcagagcataggcaggccttctgctgggaggcaggacccagcagttgagcaggtaccagccccccacctctcagttc

SEQ ID NO: 201519 - DNA, 601 bp, Human
gagtgtctgaggacaggagttgtggccaccccaggttgtcaatcctcctgtgccactcgagagtctccacttcagccaggcaagtcctgtgaactgggggcctctgtctgcaggtggcagcagctggggtgtagggagcagaagctggggcgggagcaggggtcccaagcacagtgttccagcaagaagcaccggaacccaccaagggagcgcagcagtggagtcgggtcctgggcctctgcacacagaaccccagggggttggccgcagggtgtgaaaatcaaacccacattttcattcrccagaatacgggatcagatagttcctgatcgttttaaagccggaagagcacctgcttatcaaatgcctcttcagtctgttctgccagattgacccattgaccgacgaagccacagtgaggaaggacacagaccagctgtcactggagggccagcccagggcaaggcctgctgcgggggaggaaggcccagcccgagtcccttcaaagcctcctataggtgcccatcacccaccccagccacaccctaggcatccacagaagtggcgggtctgggtgtgaggcctgtgccccccgccctga

SEQ ID NO: 201520 - DNA, 601 bp, Human
tctcatgtccctcccaggaaagagcctgagcctgctgcagaggggttcacaagcccttgagcctacaggtgtgggtccgaggctgcagtgccagcggctaggagtgcagagtgcacccaccttgctgaacaaagcaaaggcaaaccaggcaagggtgtcggccttgggttcctggggatcctctggagctgaaactaggaggggtttctcacactgtgctttcttcgcatggtgatggcgtgcaagctcctggccaggcctgtgtctgtgttgacagcttccaatctacaacacacctgtrtcatgctgtttgttaatttcccttcagcgactgacactggctggtggggagcaggggtgcaggttacttaaaagcagcaagatttaacacaaaaacaaataggagacagttctcagctgaaacagaagtggactggggctttggaagaggccagtcctcccagttgggcaggagagcttatggggtcaaggtgagagcaggtgggacccaggtgctgagggtgcccacggcctccctttctgggtctgggtgtgaagccagggagcaggacacaggagctccaggccctttcggagcaaa

SEQ ID NO: 201521 - DNA, 601 bp, Human
gattggaatgacagtcagctagggtgcatggccctgggcatctcaggggggacacccagtgttggccagggcagagtgaaaggtgtttcttctctctgcatgtggctcccgtctggatagtggacaagcttaggccagcccaggagcctggctgcagctcaccctaatccctgcttcatcacacctcgtggtggacatgtcctcagctcaggtactttctctaatttcattaataatgaaaccagagtcgactgggggccctgggccttgtatcctaaggttcccagcccaggccggccasggccacagccccacacaccttttcctggcctgtggtgaccaggggagaagcacagcagcatcctgaccaagggggcccagagcctcgaaggcaacttggctcagctggaggagtgactatgggcaaggtcctgccccacagggccacccagctcaagcagtaacaacccaaatatgtttttttaaaggatgaatatttttgaaaaccatctttttggccataggcagaggttccccactgggatctctccccactacccccagtttctcatgtccctcccaggaaagagcctgagcctgc

SEQ ID NO: 201522 - DNA, 601 bp, Human
ccgcatgctctctgtgactggccctgagcctgccctaggaaacagttttctaggtgcagagaagccaggaacaggtgcctcctctgtcccaaagaccaacatttgcaggagagacgggggcctagacgttgggagcaggcctgcacagattgggatgaacgtgggggtggtgatctgatctggaccttgcagaatccagtcaaggctgtgggggagcagtggggacagtcaacaaaggcaggactgagggggctgtcgggggccatggagagcacagagctatgcacagtgccctgcagcrggatgacggaggaccaggcggtgtaaggtctaagcaggcagggcaaggtcgcaggcacagtgtccagtccccagtgtggcccagggtgggtgtcgctgcctgagcgccctgtgatgacggagccagggttcagccccaggactgtgtccctcccagtttatacacctcctgctctgcctcgtgatcaggctggatgctcacaatgataccctgtctgaactgttccaagagcttcagggcagagctgcttcccaccccacatcccctcaacctgcatcggctaggcttgcccaggccagt

SEQ ID NO: 201523 - DNA, 601 bp, Human
gggatgagcagggaggggtggagaaggcagcatgtcctggcacctatttgaggcccttgctagcacttcagtccttgggttagctccttccttcctctgctcccagggaggatgcagccacaaggcccctgtcaaaagcagctgctcctttcctgtcacactgggagcttccaagggtggggccatttcttagcccgccttgtgcagtggctccttgccctgggtaggtccttggtcagaggtcagccacaaggcaagaggcggcagggccctgggctcaagccctgctgcttgggctgcycccacacctgctctgcctgcagggccttttcctttggcccccaactcctcatcatcatgaacctggtggctctgtcgttcagtgcatcagccacccctccatgatggtcacctcctgctgtgtcactagaggccattcccagggcacaagctgtcactgaacacagcagtgcagcagccaggaggccaaccccatcactctgtctcttccaccatgatgacgttgtcaggtgccttggcagaacctccatggggatgcccatggtgttcctcagatctctcagacaagtgttcctgccac

SEQ ID NO: 201524 - DNA, 601 bp, Human
caagcccacagcagcaccctgatggcacctcgcatggcaggcatggaattgggagcagggctcagctggccacatgatatccccagcccgcatccctctctaagcttggcctggcttcctctctatggcctgttatcctacccgagcactggagcgatggggccagcctcaagagggctgggcacacacctatagctgggccacccgtggcctagaggccccaccaacacttgtgaacagcccctgccatcccttcagcaccggctccccgcatccaagttcccttgcctcattgcccagsactcagccttaactggggctgcggccacctcagtgggccttcagccgctctgagcctgtggccagtgctcagtgaatgatgggtatctgctcgcctagggtcccaggctttatgcgtgaccccatgggatgctggctcaagcccaagatgggagggggatgagcagggaggggtggagaaggcagcatgtcctggcacctatttgaggcccttgctagcacttcagtccttgggttagctccttccttcctctgctcccagggaggatgcagccacaaggcccctgtcaaaagcagctgc

SEQ ID NO: 201525 - DNA, 601 bp, Human
gtcaagggcatagctccaagccagaaggcctgccgcccttttcccgacacacacaggtctcccaagcagttccttctgatcttgcaatgtgccagggccacatgcagtttgtctgcagcatcctcaagttatcatgaccctggaacagcagagcctcctgaccagatccagaggcagggccaggctggcacactgggctcccaaggactggacagcccccatggcagtgcagcttgagaggctccacaggggtgggagacacagaggaccaagcccacagcagcaccctgatggcacctcscatggcaggcatggaattgggagcagggctcagctggccacatgatatccccagcccgcatccctctctaagcttggcctggcttcctctctatggcctgttatcctacccgagcactggagcgatggggccagcctcaagagggctgggcacacacctatagctgggccacccgtggcctagaggccccaccaacacttgtgaacagcccctgccatcccttcagcaccggctccccgcatccaagttcccttgcctcattgcccaggactcagccttaactggggctgcggccacctc

SEQ ID NO: 201526 - DNA, 601 bp, Human
ggtggtctatgcctggccctggatagtggtcccttgtcctggggccattggcttcctgaggaacccctccccactccagggcaggtcagcagcctcagcacaccacgagggcaggtccacacccacccggcacagcctgtgctctgagcagagggcctggcacacagtgggtgctctgcagactttgtggagcgggcgggaggcggtaggcttgggaagagctggagctccagagccctggcttctgggtgcagagcagctgggacactcagcccttcccaaggagaccctatgggtgctsgtccataacaggagtgtatgcagtaccctgaggaggggctgcccaaggccgtcctgtgaacacagcgtgttcctgccaccctagcgctgtggtttatcatttagcccaaaaagggtgcttgttttagtgcttttaaaatggagtttaaacatttgtgccataaaatggcgtgttgtgggtgaaacaaggtgtttccagtaagacaggcttatacctattgatgacagagctggttatatttgcccaaggagggaattacaaatgggcaatagccagacacagatgataccctctccccag

SEQ ID NO: 201527 - DNA, 601 bp, Human
gccagggctctggacacggctcctccatagccctccttccgtgctcagcttccaaggcctcatcttccctgatgctggcagtgcctccccacccccacgcctggcgaaggagccacagccccccggcccacccgctggcttctgcgtcagcacgttgccaaggagaacgtcagtgtctctgggctcccgggtgtgagggctgcagtgagtgcagggcagcacctcagagcagggaaggcagatttccgggtgtctgtggagcatggcagcgagccacatggggagccacgcccctccatgsccacggttcccaccctcgtccgaaggaattggcagtcccttgccctgactagggccaagtcctgcaggtgtgtcaggcaccccagtgcccccaagcccaacacccagctggggcttcctcaggcagcacaggaggcctgaacacagcccagcaacacaagggggtttttctggcgcacctgtcccctgaatgatcctgtggggcagcagcgcctgttatttttgtcacagatcgaggcactgaggctcaggcacacagctggcgctggcgggcccccagccctcaagtccacaaggacag

SEQ ID NO: 201528 - DNA, 601 bp, Human
tgttcccagtgtgtatctgtgtgctctccagggttctggccccttaccctgtggttgccacaagttcagccccatgtgtggttctgggcagaggggacatctcagcagatgagtgaggtcaggctcccttgatgaggcatggccgtgggcagagcgcttggggctgagaagctgcaaggcaaagtgaggtgctcaggccagacccttgggacagtgccatggtgggtctgccagtcacacgggcttgcgccactggcctcacccatcaccacagtggcaggcgtggcaaattccccgggcrccaggcctggctcccagttgcatcctttgacaggccgtgcccacaggtgtgctggacacaggaggcaggatacctgggtcctgagtcagtccagtttttcatggagggctttggctgtcatgtttgctttctgaacttgtcagtgaggagatgacccaggtgtcttcacagatgggcccaaggctaggcctttgcctgcctgcagccctcttggctcttactggcctgtgcctgccaccttgctgcctctctctcctctccttctgctctagccgtggtcagcttgttttgctccagcag

SEQ ID NO: 201529 - DNA, 601 bp, Human
cttgggagcactggcctccgaggtcactccttgcttcacccagtcctaaggcaagctttattctttaggttcagcggagagcaacaatggttctagctttggacctgtgccccagccagggaacctggacagctctaggcagtggccatggtgctaggagcctgagtgttctgagagagaggatctttggctttcctcaggcagctggggaggcgggcttgcctccctcccctcctcgcatcaggggtctccctggaactgtgcctaggtgttgatggtgtgcctgggggaaacgaatgayggacgggcaggcaggtgtgtacgcaggcggctgcgtccaccctgttcccagtgtgtatctgtgtgctctccagggttctggccccttaccctgtggttgccacaagttcagccccatgtgtggttctgggcagaggggacatctcagcagatgagtgaggtcaggctcccttgatgaggcatggccgtgggcagagcgcttggggctgagaagctgcaaggcaaagtgaggtgctcaggccagacccttgggacagtgccatggtgggtctgccagtcacacgggcttgcgccactggcc

SEQ ID NO: 201530 - DNA, 601 bp, Human
tcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgaygctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggg

SEQ ID NO: 201531 - DNA, 601 bp, Human
gctcctgcgggggtaatgagagtcagggaggcgctcagttatcccagggctgggccgaggcctggccacccgtgtaaaacagggcaaggctgagctctatcagtgctgtctgggagaagggccccagggggcatcacaacagggtgaccttattgaatcctaactggatgcggtagaagtgagtccagcatgggggctgggtgggcagaggcctcgcacacaccctcctctccctcatgcacctggcttcaggtggactgtccaggcaacagcagacatatgtgttacaccatggtgtggrccctacagcgccccatggaggagagggggttggatggattgttgccggctcattttccaaggccagtctctgctgctttgctttcagaagagctccctttcactgtccagcctgaggtggggctgcggggaggaggctcacgcttttctctgtgtttggcaggtgaagggctggatgcacagtgggagccggaggcggggggctgcagggagcacaccagcgaccggccctccaaccctccagccactcagcaacatcgccacagcaaccagcaaccagacggcagcagccgaggcaaac

SEQ ID NO: 201532 - DNA, 601 bp, Human
agtgacccagctcctgcgggggtaatgagagtcagggaggcgctcagttatcccagggctgggccgaggcctggccacccgtgtaaaacagggcaaggctgagctctatcagtgctgtctgggagaagggccccagggggcatcacaacagggtgaccttattgaatcctaactggatgcggtagaagtgagtccagcatgggggctgggtgggcagaggcctcgcacacaccctcctctccctcatgcacctggcttcaggtggactgtccaggcaacagcagacatatgtgttacaccrtggtgtgggccctacagcgccccatggaggagagggggttggatggattgttgccggctcattttccaaggccagtctctgctgctttgctttcagaagagctccctttcactgtccagcctgaggtggggctgcggggaggaggctcacgcttttctctgtgtttggcaggtgaagggctggatgcacagtgggagccggaggcggggggctgcagggagcacaccagcgaccggccctccaaccctccagccactcagcaacatcgccacagcaaccagcaaccagacggcagcagcc

SEQ ID NO: 201533 - DNA, 601 bp, Human
ctagtggtcaaggtctgtgaggggcaagggacagtgaggggcacggatggctgctgggaggatgaagtgccatttgctgagggtttagcaggttgagtttcagatgctggtcacacccaggagttgagggtggggccttggctgttggggtctctctgcctcgggccttcccaccccagggcctgtcacagagttgatgggtggtattaaaggggcgaatgctgcctgtggcaggatggggaggctgcgtgggtctccggacagggacataggtcagggaaggagcaagaggggtgcgtgygagttgggtggggcctggtgccaccctgggctcacagccggggaagaagcctgagctttgagctgcccctcgtgtggggaggcctggcctaagcacccggcaaagtcacaggggcatcctagggtgtgcccctccctgctggcaggaaaggtggatggggaggccctgactcgcggggttggtgaaagattctgcctgaggcctctaggccaccctgccttgccctggcctcggtgattactactacccttgggagccactgtgacatctggtctcccaggtggatttccccgcagcacc

SEQ ID NO: 201534 - DNA, 601 bp, Human
aaccctgcccacctggagctccatttccactgtagcactgggcaccttctgccacttgctgcttatttactgcctgtagtctgactcctgccctcccacctgagcaaaaatagggaatagatcttcatctgcctcattcagcagccccagcccaagtgccagaatcaaagccatggtttagcaagtaagtgtgggatgctggagagcccctgacccatctcccttctgccccagtcgcctcagcctagctccacaccacagctggttcctcctctccagggcatctctgctcccaggatgscacatgcaaccacatgcagatgcccacatgcaccagtacacatgcagctgcacacacgcacaaccacatgcagacagaggcatggacctgtgcatgcacacccaaagatgtgtacatggacctgctcacagacatgtacatggatctgcgcgtgcacatgaacagacacatgcacacactggcatacaagcaaccagacacagacacatccatgcacctgcactctcacagacacaaacagggacctatgcatacacgcacacataccgcaatggacctgcatacacataggcacctatg

SEQ ID NO: 201535 - DNA, 601 bp, Human
agggtcctgtaccacagggacagctgacagtccccctttcccagtacctgccactttctcctaatatgtcccctctccaagagcagcccctgcttcagcctactggctggtccctggagttccctgatcgtctccctgttcccacccagccgccactccatcaccaggcactgtgcaccgtacagctcacacatcttgcagagcctcactgcatccacttcccccagccctcacctgtgttgctccccttttatcacctggatgtttgcatccaggagcctcctctggtctggcttcagcrcagcagccagagggatgctggtcacacagggcaggtcatggcacttctcacccaaaccctggctggctcctgactcgcccttaagtgacctcctaccctcttggcaccagccacatggcctccttcctgcccctcagactggtcaggcatgctcccacttcagggcctttgtgccggtggttccctcatccctgatgcctgcttgcctccctccttcaccacctgttcatactcatctcttaccaggaggccagccccacccacctttgctgacttgcagcccgcatgtgccacccccaa

SEQ ID NO: 201536 - DNA, 601 bp, Human
acaggaagcaagcggccctcagcagagggttcctgagtgggctcagggcttggagatcgtgccttaggaatctttgggtaggtgagtcaaggaccaggatggagctccttaagagcctacagccaagagatgctagtttcctgaggctgctggggaggaggcaggcaggtgcagactctggcctgagcacagcccactagggcttcttggcctctggctgccagcatgtcgaacctggtgcctggccctatgtcgcactaagtcctaagcgacctcctggtgaatttgccacacccttcaygctgcaaacactacacatctgctgggggcgggggccagggactggatactagctggtgttcactgatacagtccactcatctgtactgagccctggccataagcacagcagggtcctgtaccacagggacagctgacagtccccctttcccagtacctgccactttctcctaatatgtcccctctccaagagcagcccctgcttcagcctactggctggtccctggagttccctgatcgtctccctgttcccacccagccgccactccatcaccaggcactgtgcaccgtacagctcaca

SEQ ID NO: 201537 - DNA, 601 bp, Human
agccgggggcactgactctgtgctgtgctggctgttgtggaggaggccttgagcaaagctttggggacagcctggaggttacgggcagggcaggctggctcccatggcctggtgtggtcctggcgagctcaggctatggtgggtgtgaccatgggtattatgttgccccagctctatgcctagcagcaggctgagcctccagggattgtgcctggggagggaagtggttcctagagtggagggcatccaggatgcaaaggtcccaagagaggtggcagcactttccctccatgaccatgtmcccatcctgactcagggctatcactcaacatctgttacaggaacagacttgagagggccacgtctggaaggagggtgatgagggcaggccgggcctgctggacggtgggtgagaagggagggtcttgagggggatgtccatgtgtgggctgaaggatctgtcccgaaaccacaggaagcaagcggccctcagcagagggttcctgagtgggctcagggcttggagatcgtgccttaggaatctttgggtaggtgagtcaaggaccaggatggagctccttaagagcctacagccaagaga

SEQ ID NO: 201538 - DNA, 601 bp, Human
ggtcctagcttctgttaccagcaaaggtggccatctgagtggcttctattgggcctcaggcatgactgcctgtgcctctcccccagtcacagtctgggtacagttccgtctcctcaacaagcctaaactatctccctgggggcagggtctgtgtgttgaaccatcacttcgtcttggctcactctttccgtcgcccaagctcagcatggggcaggctttcctgggaggtgaggagggagggaggcaggtagctagggacctggagagtgaggggctggactgccgtctctgaggaagtcargcacagtgatgagggagctggtctataagctgataagtcttcccgcccctggcttagccggcttgggcagtgagaccttcggtgaccttggctgtgggctgtcttcttctgcctcagccgggggcactgactctgtgctgtgctggctgttgtggaggaggccttgagcaaagctttggggacagcctggaggttacgggcagggcaggctggctcccatggcctggtgtggtcctggcgagctcaggctatggtgggtgtgaccatgggtattatgttgccccagctctatgcctagca

SEQ ID NO: 201539 - DNA, 601 bp, Human
taggcgcaggcagccctggggtcagctccggtagggtggaaaggacttgttggtctgaaatgggttccatgactcctgttgccaccccaagcctgggacagtggacaccactggtccccacattgaggctagagagtcctgcaggttcagggtgtgtggtaggtatctggggagggctgggagcccatcgggcattaggggtgtggccttgctctcccttgctggccctgtggcctgggctgcctgccacctcttggggtcctagcttctgttaccagcaaaggtggccatctgagtggcytctattgggcctcaggcatgactgcctgtgcctctcccccagtcacagtctgggtacagttccgtctcctcaacaagcctaaactatctccctgggggcagggtctgtgtgttgaaccatcacttcgtcttggctcactctttccgtcgcccaagctcagcatggggcaggctttcctgggaggtgaggagggagggaggcaggtagctagggacctggagagtgaggggctggactgccgtctctgaggaagtcaggcacagtgatgagggagctggtctataagctgataagtcttcc

SEQ ID NO: 201540 - DNA, 601 bp, Human
tctgagttatatgaaccatctacacgcccaaaatgtgggttcagggtaccccagtgcgtttcctcctgctggtccctgcatgctctgagctgtgggctggcttggggttggagccttacccactctgccccacatccttgtgtgaggaagggcctgtggtcacaggcatcagtgagcctggagatctgtcactgcgcgggcctcctccctccccagaccagctgctgggtgccaaggtggagctggcaggtacaggagccgcggctgcctggataaaaggcgtctcagcaaactggggtcrggatgggggtggggcagtgctgagtcatagccccgcttggggcatgccaggcagctcagcctccacaggggactccaggacagggtgagtggcaggtaggcgcaggcagccctggggtcagctccggtagggtggaaaggacttgttggtctgaaatgggttccatgactcctgttgccaccccaagcctgggacagtggacaccactggtccccacattgaggctagagagtcctgcaggttcagggtgtgtggtaggtatctggggagggctgggagcccatcgggcattaggggtgt

SEQ ID NO: 201541 - DNA, 601 bp, Human
atttctaatcttgtggctaatgtgagtcctacaaaggcagtctagtgcccaggcaagaaggaggtctgctttgggagagggctgttaccgtctttgtttaaactataaactaagtttctctccaagttagttcagcctacacccaggaatgaacaaggacaacttggaagttagaagcaagatggagtcagttaaatctctttcactgtctcagtcataattttgtaaaggcggtttcaagcttggcctgcaggttcccatactcacgcagcaagtcaagtgatctgagttatatgaaccrtctacacgcccaaaatgtgggttcagggtaccccagtgcgtttcctcctgctggtccctgcatgctctgagctgtgggctggcttggggttggagccttacccactctgccccacatccttgtgtgaggaagggcctgtggtcacaggcatcagtgagcctggagatctgtcactgcgcgggcctcctccctccccagaccagctgctgggtgccaaggtggagctggcaggtacaggagccgcggctgcctggataaaaggcgtctcagcaaactggggtcaggatgggggtggggcag

SEQ ID NO: 201542 - DNA, 601 bp, Human
tagccagtgagccaggagtgctgattggtcagagatgaaatcatagggaattgaaactgtcttcttgttcagtctgttcctgctcagtcagttcctgggtgggggccacaagatcagatgagccagtttattgatctgggtggggccagttgatccatcaagtgcagggtctgcaatatttctcaagcactgatctcaagagcagtttagggagggtcagaatctttagccttcagctgcatgactcctaaaccataatttctaatcttgtggctaatgtgagtcctacaaaggcagtctrgtgcccaggcaagaaggaggtctgctttgggagagggctgttaccgtctttgtttaaactataaactaagtttctctccaagttagttcagcctacacccaggaatgaacaaggacaacttggaagttagaagcaagatggagtcagttaaatctctttcactgtctcagtcataattttgtaaaggcggtttcaagcttggcctgcaggttcccatactcacgcagcaagtcaagtgatctgagttatatgaaccatctacacgcccaaaatgtgggttcagggtaccccagtgcgttt

SEQ ID NO: 201543 - DNA, 601 bp, Human
cagtctgagcaacatagtgagacccccatttctccaaaattaaaaagattagctgggcgtggtggcgcgtgcctgcagtcccagctactcgaggctcaggtgggaggatcgcttgagcccggggggttgaggctgcagtgaactgtgatggtgcactgcagctgggtgacagttaaaataagataaaaatgcctcaattgagcttataaccgcccaaggggttcaccttgcccgctgcctagacagagccgattcttcaagacgagaattgcaatagagaaagagtaattcatgaagagcyggctgtgcaggagaccggagtgttattattactcaaatcagtctcctggagcattcaggaagcaaagtttttaaggataacttggtggatggggggtagccagtgagccaggagtgctgattggtcagagatgaaatcatagggaattgaaactgtcttcttgttcagtctgttcctgctcagtcagttcctgggtgggggccacaagatcagatgagccagtttattgatctgggtggggccagttgatccatcaagtgcagggtctgcaatatttctcaagcactgatctcaagagca

SEQ ID NO: 201544 - DNA, 601 bp, Human
atggccacaggcacaggcttttccagaccttcggtttctaaaatagtatcatggtgggagctgatgtagggacggcggctccagagttgggggcagcacccactctttaagagatgatagaatgagcatggtggctcacacctataaccccagcactttgggaggctgaggcaggaggattgcttgagcccaggagttcgagaccagtctgagcaacatagtgagacccccatttctccaaaattaaaaagattagctgggcgtggtggcgcgtgcctgcagtcccagctactcgaggctsaggtgggaggatcgcttgagcccggggggttgaggctgcagtgaactgtgatggtgcactgcagctgggtgacagttaaaataagataaaaatgcctcaattgagcttataaccgcccaaggggttcaccttgcccgctgcctagacagagccgattcttcaagacgagaattgcaatagagaaagagtaattcatgaagagctggctgtgcaggagaccggagtgttattattactcaaatcagtctcctggagcattcaggaagcaaagtttttaaggataacttggtggatgggggg

SEQ ID NO: 201545 - DNA, 601 bp, Human
ttgatttctacagccgtaaagccgaggccacctcccaggcctgcttttagcatgagatgacgtgtgtgagcaaagcactcggcccagcagtggcagcagacggggtggcacggaggtgcagctgtcccctgcgtgtctccagccacgggcctctggacctaggttccctgggcaccttcctctcctcccagtggcctcagccacccgagcaggcacactatagttgaggaaagcacagcagagccacagctgggacccagagtcccctccctgaccccaccatgcccagcttccctgagamagaccctccccggggcccagcccacagttgcccctgacctcccatgaagatgtgtggaaatggctccatgaagagcctgtgaggacactggaccatgaccagaccactggagagaggggaaatgcagtcatggggctgcagcatctgtggagcccacttcccactgggtggggccagcatgacaggattgaaggcagtgggacagaagaactgggcaacacaaaggacacctggctcctcagcaacagagagctgccaccgaggaggcccctacaggtccaggccaggccctgggaaacc

SEQ ID NO: 201546 - DNA, 601 bp, Human
tccagcaggcgctaatccccgctgtttaagcaacagccagtggccttgcctggcccctcggcagggtcccgcccctggctagtggcagaagcggttcctctacactgttttgtatttagattacttctgtctacggcgggtgaccctggctttccactgaaagtaggactatgaagtcattatgaagtacattttttaagtaaaaaaggcagtcaatttaaagaaaaatgctgagtaaaaacagcaagtgatacccaggtgtggccaggttaggcaggctgcagtcccgtggggcccagtyggagggcttggtgggagcagaggcctgcagactcccagccaggccaccccgggaaatcacctccatctttgcgctttgatttctacagccgtaaagccgaggccacctcccaggcctgcttttagcatgagatgacgtgtgtgagcaaagcactcggcccagcagtggcagcagacggggtggcacggaggtgcagctgtcccctgcgtgtctccagccacgggcctctggacctaggttccctgggcaccttcctctcctcccagtggcctcagccacccgagcaggcacactatagtt

SEQ ID NO: 201547 - DNA, 601 bp, Human
ttgctcatttttgccttcatccccacctggtcctgagcacctgcgcttcgtggcccatgatgcaatgcagccttgagagctgcagccccgcccttcactaccccaaggcccagtggggagctggacagagagccattcagtggggatgccacagacagtgtcgtgctgggaaggcagggaagtcaggtccctgctctcccagatgagtgtgggcgtggacaccaaccctggctcacttgccagaggacgcactgtctgcggttttgtggtcaccctaccatcgcatgtccaggtgacatcrcacgtccaggtgccattgcacactggaggttatgatgcagaagtgctgctccaggaggccataccaacccccatcctgtcctgggtcccttggggccacctgccactaggtggggagcctcatctggagcccctgagttttctggaggcagctctcaggctggaacccccacctcagataggtggacatggtttccaggcagcttctccccaggctaagcccgtctgctgcatctgcggggtcagctctgggaatcaccccaccccttgatgtcctcagcgattcctcactgctgccatt

SEQ ID NO: 201548 - DNA, 601 bp, Human
gtcaggggtcctcatcagagaaggaggttctccctgggcttcacagggctgtgttttcagccaggtggggtggaacagggcactgtgagtgtggtgggtgggagatgcagccagagaggcaggaaccttgcttcttgtggagttaacaaggagggaggggtgagctatgcaggcgatctttccccagagggcagttcctgggagggtagcttgtccctacccatgtccagtgtcactggcattaaggcaagtggggtttttatcttccccggaagatgtggctttttagtccaaaaatacragcagtccccaacttaggatggtttgacttgcagtttttcaggttatggtgcaaaagcaataaacattgagtagaagccttactttgagtactcatacaaccattcattctgattctccctgtcagtacggtattcagtaaattccacaagatacgggttagattcttttgtctacctgcaggctaatgtaagtgttctgagcacatttaaggtaggctaggctaagctgtgaggttcagcaggttgggggaagtcaacacattttcaacttaggatgggtttatcaggacataacccca

SEQ ID NO: 201549 - DNA, 601 bp, Human
aggacactgggaggcccagccggggcatagcctggggttgtctgtaggatggggacactgtgttcactaaccgtagtccttcctcccatctgctcggactatggcttcaggataggcagagagctttgaggaggcaaagaaaggaggacctgtttctaaggtgagacccgttgcggatctgcaggtgcaaggcccatcaggcaggttgtggggagagtgtagagaagccaacccagtggcctgggccctggttactgtggagtggctgcaaagagcccacaaacacggagtcacatgtccycaagccatgaatcagtgatgtctttcatgtgcgtatgctctcatttttcaaacactgcaaaagctattgtgataaatgaaatgcagagtcatttacaagccttgaggaaatcttggcgcgcaaaaaccctttttacctctgtcatcagcactcactggattaatgggtgctctcccttctcactgtaaagcatgctggcttgtgtcagtacagggttggccctccagggcagcgggcactctctagaacccccttgcccttccacatgtatccctttgagtccgttgtgattgtcccaaa

SEQ ID NO: 201550 - DNA, 601 bp, Human
ggagcaaacatgagaaggtttcaagcacaagtgagacatactctgcctcatttttacaaggatgcccctggctgctggtggagcacagggcacagggggctggagacagcaagaccagagaagtcatactgctgcaaaacagatgagaggctggggctggctagcgggagtgagtggtagaattctggacagtcagggcaattaagggttcccctgaggctggctgggtccagccacaacctgtggtgccagcctcagttctcaaggaaagggacgcagggaaggcgtgctgggcatgtartggacaccactcatgcccctaggtccccaaggtaggggatgggattgtgggatgccacacatggaggcagagggcaggaggttgcagggcctcaaagacccagaaggtgaaatcagattccccactcaagtgagggtttgatggagtcagcagtttccttccctggggaaactggggagccaggagcctggggctacggctctctccaaggcagcaacctctttgatttggctcttaatgaaggccccacttcttctctgctgtcatggccaccctctcctccataggtggaacctttgc

SEQ ID NO: 201551 - DNA, 601 bp, Human
cctcccaggatggtgtggaatggatagaggaggtgtggagggtgtggccactgcggtccccagggaccacagggaatgggctgcagccccaggctctgggtgggccagggtttgggggattatccccatcactggcacaggaagaaggccaagggtgagggccagggcttctaagggggctgaggggccatgcaatgtatgtggggtgggagcacacttgcaggggtagcaacagaagcccagccccaaagggcttacaagatgaggggacatcctggctcccgggcctgagggcttagtmgtggggcagcatcaggatcggccaagtccaggtgggcgggggctgtgcgtctacccgtgtccacccagggaaggccacgggcctttccagaagacctcccagaagtccccaactatcccctccgtgagccacgttgaccgattcctcactcagtcactacgagggcctgggattgatttattggcacctgcttggtgctaggtccttgtgggcacatgggatacatcaatgaacaaacagaccaacagtccctgccctatggcacagtgggaaagaggtgggcgataaacactctaagta

SEQ ID NO: 201552 - DNA, 601 bp, Human
cccttgtccccccaacactgcccacctcctccaaggagtctcctggccacactgacacccccatctctgtcgtggctcctggagtgcttggcctcagtctccagtgtgtttgtcttgccacgctggctgttctggggctctccctcctcccaggatggtgtggaatggatagaggaggtgtggagggtgtggccactgcggtccccagggaccacagggaatgggctgcagccccaggctctgggtgggccagggtttgggggattatccccatcactggcacaggaagaaggccaagggkgagggccagggcttctaagggggctgaggggccatgcaatgtatgtggggtgggagcacacttgcaggggtagcaacagaagcccagccccaaagggcttacaagatgaggggacatcctggctcccgggcctgagggcttagtagtggggcagcatcaggatcggccaagtccaggtgggcgggggctgtgcgtctacccgtgtccacccagggaaggccacgggcctttccagaagacctcccagaagtccccaactatcccctccgtgagccacgttgaccgattcctcactcagtc

SEQ ID NO: 201553 - DNA, 601 bp, Human
cagcctgtgagcttcaccttggcaccatggcccagggaacccaaagtgaaaactgcagcaggcaattgcctgctgcaattcttcactaaatgtcttgcttcttgccccttggtctgtggacccttgggcaagaggcagcaggaggcacatcttgaggttgaggtttagatggtcccatcagcaggccctggacctacatggccacagcttcacacagcaatggcttctttgcgttcatctcttttccaaaggaagctgccacatcacagagttttgagttatttgcttctaaattaaggtrtaactctcttttagagacgtccctggagaatccatcaaaaagtgctaagaagcgagactgttaaaagccacagtgcagggaggggccttacacatagtgtcaagcccgggggtgttccttctagcagcctccaaccagaaacacaccccgtccccgagggctcagccaggcctctcatggccatgggggaccgtggttgtggttagagcaaacctttcaggagacccttggcccctgggatggagagctgccaggacagaggtccctttgtgaggtctgcccctgtgagtcacggaggcc

SEQ ID NO: 201554 - DNA, 601 bp, Human
cacagggacctcaaggataatattggggatgtagtggcccctgtggagaaggaaggcctggagggtgggcccgcaacctgcctgctgcccagtccccacagcatttctcctcccttccctgagtgggcgggtgggttgcgttggactttcagggccgctggagtcagtcacacccagcctgtgagcttcaccttggcaccatggcccagggaacccaaagtgaaaactgcagcaggcaattgcctgctgcaattcttcactaaatgtcttgcttcttgccccttggtctgtggacccttgkgcaagaggcagcaggaggcacatcttgaggttgaggtttagatggtcccatcagcaggccctggacctacatggccacagcttcacacagcaatggcttctttgcgttcatctcttttccaaaggaagctgccacatcacagagttttgagttatttgcttctaaattaaggtataactctcttttagagacgtccctggagaatccatcaaaaagtgctaagaagcgagactgttaaaagccacagtgcagggaggggccttacacatagtgtcaagcccgggggtgttccttctagca

SEQ ID NO: 201555 - DNA, 601 bp, Human
tgaacctcattatcctcatccatacccaaagccaagagtgccctgccctgtccccacaccagcccctgccacacattttggccctttcgtgcgaacaccgccaggggaggcgcttcacaggattgaaccaacagggaccgcttgacagatcctagagcacataggaggagacatcagccctctggactgagccggaggagcagaacctcacgcgattcatccattcatttgttcagctaacatttaccagcgcctgctgcatgccaggcactgtgccaggtgcaggggtacagcagggacrtagcatccactcacagtgctcacaccagacgggcaggggttgacagtaacacatgttactaagtgctgcactgtggagaacactaaagcagaaggtgggggacacgagatgggggtgggggactgacacagtgccatgcagaagtgctgggtgagtggtgtggctgagcaggggagagacagcaggtgcaaaggcgctgagcagacactccctggcccctggaggccccaccagagtggctggaacctggtgcaggagtgtgggtggggtgtcagggccaggtcctgcaggactcagtgg

SEQ ID NO: 201556 - DNA, 601 bp, Human
ctggctctctcacgcttgtctgggctgggggccagctcctcggtccttctcccttccttccctcccaaggccacccttccgtgtgccaggattgccagggacgccaaagagcccctagacactgggcggtggcggcggggggcggcggcagagatgactaatgctccctcccatcgctgcacaaacctcaccggtgtaaatcgttagggtttgcataggcctttcacacgttctgaaggattggtgagacaatccaggaaagcaggtgccactagccccactttgcaaacagaaaggctgrgagaggtcagtcggttgcccaaggacgtagagctcacaagaggccgaactgggtttgaacccgagtggagagaaggcgagccgggactggctgcagtaaagagggccaggaccatggctgggctcaggcttggtttcccgggctgccagaggtggcccctggggctcggctaccaggcctcagcgcagcggagtcggtggaacgccggcgcggggagctcttgcgggactgcggcgcgcgcggagctgcgaccccgcccctgtccgtccccattgggctactggcccgtccgtcagctgc

SEQ ID NO: 201557 - DNA, 601 bp, Human
actgtgcctacaactataccctggtggaggaggctatctgtaagtgactgctgcatgaatacaatattggtttgatgccaggtgagatgtccctctcttactttgaggtcaagtcagggaggtgtcagccagccccagtggacccctccgcaggctagcctctgctctggaccactggaaagggccatctcactgttgcatgtgggcttacctctgcaaacaattcaactctgacccccagactctgcagtggaaacagcctctggctatcccaagacatgctaatatgcatttcctatawacattaaccctcagagccaccctctgaccacagtctgttacattcccttttgacagaagaggaaacagaggctcagccaggtagcacagctgccggtctctgtgtggtcctcctggcaagaggtccagcctgacacagcctggtggtgtggaaggcaagcacaaagggtagctagcccctcagccattggctgaattcccttggtcctcactggacacctccagtgagcactaagttcgcctccatgatgcccataacaaatatacgtcctgttcctgacagttgaggcagcaccctcac

SEQ ID NO: 201558 - DNA, 601 bp, Human
ccagtggtggagtctgggtcattttctttgtggtggggcagggcgggtgctgacaccatgttgaggggccactcctcagccagctgtgcctgctgggttggggaggtgctgagtgggctcagtcaccaccatggcccccttcctctggctacagcaaagccccagctgttgtctcccagccaatgagggctcaggacagagcaccagcacccaggttctggtcgcagccacaccctttcctgttaggggactgcacatccacacatggcatctggggcccaccttgccgcaggtgacccamctgtccagctttagccttgcatggccctgtgccctgaactcctggcccactgggcctgcctttgctccaaggggtgcttctctgtcctcagctttctcggcttccaggtagctgggagcatggttaacagcttcttcctttaccacatgctctcttcccgtgcctctggtaccctccattctctggttcctgaccacctccccaactgctcctccatctttttggtaagcaccatctcttcctccagtggtccccaccctctccccttctctcatctccctgggtcctgataatgccccg

SEQ ID NO: 201559 - DNA, 601 bp, Human
gtggaatagtcagctggggacaggtcactacagaacaggttgacatgtgtgtagaccaggaattccagggtcctaggggctctggaggtgcacaaagggaggccccggggaagctggttctcatggatgtggaggagagcccagaacagcagggctcaaatgtatgtgtttgtggggagtccccgatctggcctggctgatatgtaggggctaggatgggttcagtggttgatgagccaaagagatccaatgggattgaggggtcacggatgtccatggtgtggagccccagtggtggagkctgggtcattttctttgtggtggggcagggcgggtgctgacaccatgttgaggggccactcctcagccagctgtgcctgctgggttggggaggtgctgagtgggctcagtcaccaccatggcccccttcctctggctacagcaaagccccagctgttgtctcccagccaatgagggctcaggacagagcaccagcacccaggttctggtcgcagccacaccctttcctgttaggggactgcacatccacacatggcatctggggcccaccttgccgcaggtgacccacctgtccagcttt

SEQ ID NO: 201560 - DNA, 601 bp, Human
cgctgggggtggggggtggttgcagaagaggtaggacaggtggggcacagagaatcagccagatggggtggcaccagagcaggccaggctctgggccatccatggtttagagacaagcaacatatgcccaccccacccccgggaagtgggaaaactagtggaatagtcagctggggacaggtcactacagaacaggttgacatgtgtgtagaccaggaattccagggtcctaggggctctggaggtgcacaaagggaggccccggggaagctggttctcatggatgtggaggagagcccakaacagcagggctcaaatgtatgtgtttgtggggagtccccgatctggcctggctgatatgtaggggctaggatgggttcagtggttgatgagccaaagagatccaatgggattgaggggtcacggatgtccatggtgtggagccccagtggtggagtctgggtcattttctttgtggtggggcagggcgggtgctgacaccatgttgaggggccactcctcagccagctgtgcctgctgggttggggaggtgctgagtgggctcagtcaccaccatggcccccttcctctggctacagca

SEQ ID NO: 201561 - DNA, 601 bp, Human
tttccttatcactgaaacgggcctacctggcagggggttgtggatgaaaacgtgttccacgtgctgtggatttcttcatccatgtaagggtctgtccctgtgtgcccagaacatctgggcctagggtggcaagagtctcctgaattccaccaacactgagtcccagctacaagcaagggcctgctggaggctgaggagtaggatacaagacaaacgctgcacagcccaagccctgcagatcccatcagtgcagaaaccccccaaccctaccacccctcccgaggcctgatcctctctctckcgcagctccctgctttgcccataccacacacctggcctcctgctcccgctctgcttcccctcaggttctgcccacggtctccctacccactcctggctatagattcaactcagtggtgacctggacggccctcttccagctcacagcagggaggcgacaatttgaccttctgttaattttgctggcagatggaaggacaaagttctgggatggggacacttgagcaaagacctgggggtaaggaagttgttaattttcaaatcagggctagattgtagcctcgtctcacctatctgagct

SEQ ID NO: 201562 - DNA, 601 bp, Human
gtgcaggtactgggagaagcacaatgaggcaaggctcccccataaacaggccccacctggctcctcccagctcccttccctcctgaggaatgtcagcatgtgattgcctagagaacccagcacgagtggcatcctgagcccaggacggtgggcagaacagccctcctgagtcactgagatgagaagcacagggaatgtgcacagtgcccttccctacggcacgcagctgccctcgccactgccctgcagcccactgcctactgcaaagccatctacagcccccagggaggtggccaccagmagacacctctttcttccgccctccccagctaaaccctctaatttactctagagagagaaataaacaggttgattagcctaaaggtctccaagtgccaattagtaccagggatttcctctttgaagacatcaccccaaccttcttcccccactccctgaggacatcaaacagcaggtgcccagggtgatggggtagaaaggcggagcagggtgctgagtggctcttaccgccccccaccatgtctcataatgtccagcagctctccatgccccatcccccaggtcctctggtgtcaggtgg

SEQ ID NO: 201563 - DNA, 601 bp, Human
tggagaccccacactggtctgaccagccctggagaagagcttggttttgactctgagacagaagacctagagtgtaggccagtgtcacactcaccaaaaagagctgtgccccaactaaaggtgacgggaagccataggctctcgtcttcaagggacctggggctctgtgggaagggggctccacatggcacagctggggtgcaggtactgggagaagcacaatgaggcaaggctcccccataaacaggccccacctggctcctcccagctcccttccctcctgaggaatgtcagcatgtgrttgcctagagaacccagcacgagtggcatcctgagcccaggacggtgggcagaacagccctcctgagtcactgagatgagaagcacagggaatgtgcacagtgcccttccctacggcacgcagctgccctcgccactgccctgcagcccactgcctactgcaaagccatctacagcccccagggaggtggccaccagaagacacctctttcttccgccctccccagctaaaccctctaatttactctagagagagaaataaacaggttgattagcctaaaggtctccaagtgccaattag

SEQ ID NO: 201564 - DNA, 601 bp, Human
gcaggaaagggcactgagggcgggctggccacacacccacccacccatgccagttggcctgcagggctcaaggagggtcttgcagaaccagtgggtgggtttgacaaaaggacttgcaagtgccacccccacacacacgtcccgcctggccaggggcctgagcgaccagcaggcagctgcagtgacagccatgtcaggggctaagggcggaggctcagagaacccaggaaggaccagtcttttgtcgcctgtgtctcagggggcatctaccatagcaagcgcacagcagctggagaggcartaagccacccctcggagagctgacagctcactcctgcagggcccaggcacaccaggagacctccactcttccctccccctgccccagagttggggagccagccaagcccccgcttcccatccaccaaaatatttcaaagctgctggagaccccacactggtctgaccagccctggagaagagcttggttttgactctgagacagaagacctagagtgtaggccagtgtcacactcaccaaaaagagctgtgccccaactaaaggtgacgggaagccataggctctcgtcttcaagggacc

SEQ ID NO: 201565 - DNA, 601 bp, Human
gtgagacacaagacactgcctccttttctcacctgtgaaggcagacatcacctccctggagggtcgcctaaatgtgaggtttgtagacaacgcctggcacacaggaggcactcagtgaccgctgggtgtcatgatcatcaccagtgcatctcctgtgctggccttcctcatggggagggggtgcacaatcatctggctttgtccaggctgaggggtttcctgggatacagtacactcccaggccaacgggatggtggtcaccctaggggagaaggtcatcctctgtcccagctccctcctrcccctgggcacaagcaggcaaggggaagcaggcccagggtggccgcccttgagctctggaccagtccagctcaggtgccttctcccagccttggtagaaacccagcctaggccaggcctcacctgacattaaggagcgcacgggcggccttgctgcggatgttctggttggcgctgaggagcttctgcttcaggacaagcaccacattgctgcccagggcctcggtggcatcctcctgcaggcagaggaccagtgtgtccaggatgaactcctggaactcctcctcctccacctccacct

SEQ ID NO: 201566 - DNA, 601 bp, Human
ggtggtcacagtggacatgggaggacaggggacagcagggaggttacagtttcagagagagagagctctctcctggaaagccactctcatggtcccacagaaaggggacctctgagcagacctaagaatgatggggctgggacagggcccaggaatctgcattttcacaaacctcccggtggcttgggtccggggccccacttgcagaaatactggcctgagcctctagtgagactctcagaagagaagccaggacttagggaaggcaagagggtctccactaaagagacatagccacagytaaggcagagactctggggttcggtgaccagcctgtcctcgtgaaaaggggcccagtgtgagaacacacaccgcaccctgccccctgcagctttgaggctttgggctccctcagtttccaggccaggatgtagactgtgatcctgtgtgacctggtgtgagacacaagacactgcctccttttctcacctgtgaaggcagacatcacctccctggagggtcgcctaaatgtgaggtttgtagacaacgcctggcacacaggaggcactcagtgaccgctgggtgtcatgatcatcaccag

SEQ ID NO: 201567 - DNA, 601 bp, Human
gaggatggcataaaagccggagtcatctctagcgcccacatcggatgctgttagcagggactgatttatgtcttgggcattccccgccaccccactgatcctgttctggaggggttatatgacacgtttgtgaaacctgagatatgctagctgctcctaggccatagaagtgtcaggtttgcttgctaaccagcagtcctgaacacaagtcacagcaggtgagaataggaattagaaggaagtgaggcgacaggcagttgtgactcagtgggccaccgaaaatcaactgcatggagatttyatctgggggtgaagcagagccacacccgttctgatctgcctggctttgatgggaggcttcacccatgattattcaccaccaggctcctccatggtggtaacccagccccatttgctgaccctccagtgtgctcctgctgcctcatcttgccaaggataagcacccacaggtgcttatttggggctcccaatctgtggtcagattctagcactaagattaaaactatgggattgtacgcctaacttctgtgctagatgcaaataccatcaggcattttgggtcatgggactatgttttgag

SEQ ID NO: 201568 - DNA, 601 bp, Human
tctctagcgcccacatcggatgctgttagcagggactgatttatgtcttgggcattccccgccaccccactgatcctgttctggaggggttatatgacacgtttgtgaaacctgagatatgctagctgctcctaggccatagaagtgtcaggtttgcttgctaaccagcagtcctgaacacaagtcacagcaggtgagaataggaattagaaggaagtgaggcgacaggcagttgtgactcagtgggccaccgaaaatcaactgcatggagattttatctgggggtgaagcagagccacayccgttctgatctgcctggctttgatgggaggcttcacccatgattattcaccaccaggctcctccatggtggtaacccagccccatttgctgaccctccagtgtgctcctgctgcctcatcttgccaaggataagcacccacaggtgcttatttggggctcccaatctgtggtcagattctagcactaagattaaaactatgggattgtacgcctaacttctgtgctagatgcaaataccatcaggcattttgggtcatgggactatgttttgagatccagacacagtttgccattgggg

SEQ ID NO: 201569 - DNA, 601 bp, Human
ctcactgcaacctcaaaactcttgggctcaggtgatccaccacagccttttcagcagctgggactgcaggctcaaaccactatactgggctaatttttaattttttttttttgtaaatacagggtcttgctgtgttgcccaggctggtatcaaactcctgggctcaagcattcctctagcttcagcctcctgagtagctggggttacagggatgagacacctcaccaggcctcttagacgtttttagtaactaaggtcacttaaacatttttaaaagggattattttccctcagacagttkttcttttttaagacttaatttttttagagctattaggttcacagcaaaattgatcgggaaatatagcaatttcccacatactccctacccctacacccccacagcctccccagttaacatctcccaccagaggggcatgtttgttacagtccatgaacctacctgcattggtgcctcattattacccaaagtccagagtttacatttgggttcactcttggtgttgtacagtctatgagtttggatcctgttatgttttaaaactcctgcttcttttagccctgggcaccttgacactct

SEQ ID NO: 201570 - DNA, 601 bp, Human
gggccaactgtgctttttgaaggcaggaataactggttcatttctgggtgtcccagggagcctggttctgagctttacacatagcacatactggaagagcccttcctccttttcatagcccatggggtcaggactggggacttttactgatcattggaaagtgacttatcaattactcggtctttttctcatttcatccctgtagtttactttctgaggatcttttttttttaagtggcttaaaatactttttttttttttttttttcacagttctctggttggctaggcagttttcctgwtgtgggcccactgggctgaaataggacggtctagttagcctcacccacacattctgtgattgcaggctgattgacattggggaggaggggctgtcttatttgtgttgcagctggctcgatatcagttgggacagcagacgtttctccttctctttctctctctctctcttttttttttttttaatagagattggatctccctatgttgcccaggctggcctcgaactcctgggcttaagcaatctacccacctcagcctcccaaagtgctggaattacaggcgtgagccaccacacccag

SEQ ID NO: 201571 - DNA, 601 bp, Human
caattactcggtctttttctcatttcatccctgtagtttactttctgaggatcttttttttttaagtggcttaaaatactttttttttttttttttttcacagttctctggttggctaggcagttttcctgttgtgggcccactgggctgaaataggacggtctagttagcctcacccacacattctgtgattgcaggctgattgacattggggaggaggggctgtcttatttgtgttgcagctggctcgatatcagttgggacagcagacgtttctccttctctttctctctctctctcctttttttttttttaatagagattggatctccctatgttgcccaggctggcctcgaactcctgggcttaagcaatctacccacctcagcctcccaaagtgctggaattacaggcgtgagccaccacacccagcctcctcctttttctttttttcccccattgagacataataattgtacctatttagagggtgtgatattttgatacatatctgcaatgcataatgatcagattgaagtgattagcatattcatcacctcaaacacatttattatttgtttatgctgggaggtctgaggaa

SEQ ID NO: 201572 - DNA, 601 bp, Human
tttttctcatttcatccctgtagtttactttctgaggatcttttttttttaagtggcttaaaatactttttttttttttttttttcacagttctctggttggctaggcagttttcctgttgtgggcccactgggctgaaataggacggtctagttagcctcacccacacattctgtgattgcaggctgattgacattggggaggaggggctgtcttatttgtgttgcagctggctcgatatcagttgggacagcagacgtttctccttctctttctctctctctctcttttttttttttttaatagagattggatctccctatgttgcccaggctggcctcgaactcctgggcttaagcaatctacccacctcagcctcccaaagtgctggaattacaggcgtgagccaccacacccagcctcctcctttttctttttttcccccattgagacataataattgtacctatttagagggtgtgatattttgatacatatctgcaatgcataatgatcagattgaagtgattagcatattcatcacctcaaacacatttattatttgtttatgctgggaggtctgaggaattcttgattcaaa

SEQ ID NO: 201573 - DNA, 601 bp, Human
atcccgctggttctgtttccttctttgctggtgattggtactccctggctcacccttagagaacttcccgaatcctcagactggggcctgctaattagctgtcttgggttctagctctcactgccacgactttgcaaaatgactatagatgtggatggtggctggtgcccatgggcagagcaatcagcacattcatagacccaccttcctggggctggggtgtgaagaccggacaccccactgaagtagtaaatatgactttcatggaggctgcttcatgggccctcgaaagtttcttgtraagtggctggagcaggattataattatactccctccactgattgagtctgagggggtatgagacactctggcctggagtaacctgcccaaggtcaagtggttggtggaggggctggcgctgcctctctcctcagactgagtggttgtgttaatcacatgagagcagacacagaatgactttgcggaggtggaggagacctggatcatttgctcagcaaaccggttttgggcacctgctgtgttgggcacagatggtgctcagtacagtcaggcaggccttccagcaggtcggctttggtc

SEQ ID NO: 201574 - DNA, 601 bp, Human
gaaatgcataatttagtatggacatttcactcacttggctcagccattgtataaccagtatgagctccggggggaccctggggtgtgtcagggccctcattctcctcctataatcctcctgggctgagtggagttcttacattttgaaggttatgcaatggactgcatgtttggatccatctgcaaattccccttttggggagaggctgagttgccctgtgcttgagggagctgggcagatggtactttgtgtagcctgctgcattttgcagaatgtcttctctcacaggggtccctgtgraggagtgacaggaaccctcttagctgagtgttgggaggttttaggtggagggctcaggtcacccgcaggggtcatttgactcctaccttatctgggtagataggatcatctttgtcccacagtccttcccagtattgtgaagtgatgcattggcgtgagcccaggggtgccaagggtgggctggcaatgcccacatccagttctctgtccctgaggcacggaggtggttgtgctgggctcagagccgccgtctgactggttggaagccctgctctgattttgtgaatcaccctagttaag

SEQ ID NO: 201575 - DNA, 601 bp, Human
aagaactcggaggcttgaagcattcagtacagtcgtctctcgatatccgcaggaaattggttccaggattcccttgggcagcagtccccagcctcctttttgacaccagtgaccagtttcatggaagaaatttttccacagactgggggttaggggatggtttcaggatgggactgttaacagctcagatcatcaggtattagattctcatgaggagcctgcacagcctagatccctcgcatacataagccacaatagggcttctgctcctatgagaatctaatactgctgccggcctgacaggaggtagagcttaggcagtaatggagcaatgaggagcagctgtaaatacagatgaagcgtcactctccgcctaccgctcacctccagctctgcggcccagttcctaacaggccacggactgataccagttcatggcccgggggttggggacccctgcccttggggatcccagaatccttggatgctcaagtccttatgtaaaatgccatagctagcttttgcatataacctatacacatcttcctgtacactttaaatcatcttgagattacttataatacagtcatgcaccacataa

SEQ ID NO: 201576 - DNA, 601 bp, Human
aactcggaggcttgaagcattcagtacagtcgtctctcgatatccgcaggaaattggttccaggattcccttgggcagcagtccccagcctcctttttgacaccagtgaccagtttcatggaagaaatttttccacagactgggggttaggggatggtttcaggatgggactgttaacagctcagatcatcaggtattagattctcatgaggagcctgcacagcctagatccctcgcatacataagccacaatagggcttctgctcctatgagaatctaatactgctgccggcctgacaggaggtagagcttaggcagtaatggagcaatgaggagcagctgtaaatacagatgaagcgtcactctccgcctaccgctcacctccagctctgcggcccagttcctaacaggccacggactgataccagttcatggcccgggggttggggacccctgcccttggggatcccagaatccttggatgctcaagtccttatgtaaaatgccatagctagcttttgcatataacctatacacatcttcctgtacactttaaatcatcttgagattacttataatacagtcatgcaccacataacga

SEQ ID NO: 201577 - DNA, 601 bp, Human
ctgtaaatacagatgaagcgtcactctccgcctaccgctcacctccagctctgcggcccagttcctaacaggccacggactgataccagttcatggcccgggggttggggacccctgcccttggggatcccagaatccttggatgctcaagtccttatgtaaaatgccatagctagcttttgcatataacctatacacatcttcctgtacactttaaatcatcttgagattacttataatacagtcatgcaccacataacgacattttggttattgatggtggtcccataagattataatrctgtgtttttactgtaccttttctacatttggtatgtttagaaacagataccactgtgtcacaattgcttacggtattcagtacggtaacatgctgcacaggtttgtagcctaggagcaataggctgtgccacgtagcctaggtgtgtagtaggctctgtcgtgtaggtttgtgtaggtacactctatgatgtttgcatgaagatgacattgcctaatgatgcatttctcaacatatccccttttaagcaaggtatggctttatctaataaaatataaatgctttgtaaatagttgttac

SEQ ID NO: 201578 - DNA, 601 bp, Human
ccagttcatggcccgggggttggggacccctgcccttggggatcccagaatccttggatgctcaagtccttatgtaaaatgccatagctagcttttgcatataacctatacacatcttcctgtacactttaaatcatcttgagattacttataatacagtcatgcaccacataacgacattttggttattgatggtggtcccataagattataatactgtgtttttactgtaccttttctacatttggtatgtttagaaacagataccactgtgtcacaattgcttacggtattcagtacrgtaacatgctgcacaggtttgtagcctaggagcaataggctgtgccacgtagcctaggtgtgtagtaggctctgtcgtgtaggtttgtgtaggtacactctatgatgtttgcatgaagatgacattgcctaatgatgcatttctcaacatatccccttttaagcaaggtatggctttatctaataaaatataaatgctttgtaaatagttgttacagtgtattgttattacatttatattattcttattgttggttatttctttccaaatagtttcattctgaggttgcttgaatctgca

SEQ ID NO: 201579 - DNA, 601 bp, Human
ccagaatccttggatgctcaagtccttatgtaaaatgccatagctagcttttgcatataacctatacacatcttcctgtacactttaaatcatcttgagattacttataatacagtcatgcaccacataacgacattttggttattgatggtggtcccataagattataatactgtgtttttactgtaccttttctacatttggtatgtttagaaacagataccactgtgtcacaattgcttacggtattcagtacggtaacatgctgcacaggtttgtagcctaggagcaataggctgtrccacgtagcctaggtgtgtagtaggctctgtcgtgtaggtttgtgtaggtacactctatgatgtttgcatgaagatgacattgcctaatgatgcatttctcaacatatccccttttaagcaaggtatggctttatctaataaaatataaatgctttgtaaatagttgttacagtgtattgttattacatttatattattcttattgttggttatttctttccaaatagtttcattctgaggttgcttgaatctgcagatgtggaacttgaggctgtggagggccaactgtatgctcagaa

SEQ ID NO: 201580 - DNA, 601 bp, Human
ccatagctagcttttgcatataacctatacacatcttcctgtacactttaaatcatcttgagattacttataatacagtcatgcaccacataacgacattttggttattgatggtggtcccataagattataatactgtgtttttactgtaccttttctacatttggtatgtttagaaacagataccactgtgtcacaattgcttacggtattcagtacggtaacatgctgcacaggtttgtagcctaggagcaataggctgtgccacgtagcctaggtgtgtagtaggctctgtcgtgtrggtttgtgtaggtacactctatgatgtttgcatgaagatgacattgcctaatgatgcatttctcaacatatccccttttaagcaaggtatggctttatctaataaaatataaatgctttgtaaatagttgttacagtgtattgttattacatttatattattcttattgttggttatttctttccaaatagtttcattctgaggttgcttgaatctgcagatgtggaacttgaggctgtggagggccaactgtatgctcagaaagtagcaggctctggttggagagttggtataaaatgt

SEQ ID NO: 201581 - DNA, 601 bp, Human
caggcacatgccaccatgcccagctaatttttgtatttttttgtagagatgaggtgtcttcatgttgcccgtgccagtctcaaactcctgggctcaagcgatccacccgccttggcctcccaaagtgctgggactccaggcatgagccaccatgcctggccaagggggcttttcaaaggctgggctgggctgttcatttggaaaaaaggttggggatgttttcacttcaccaggacttctgccagtcagcaggctggtacattaggagcccaagttttgcctggtgctggtggacgggtcyaggcctgagaagccgtagtctcctagtgcttggtgctgctaagcccaaagaacagagtggttacaggaaatggaacatttagtctggcagaggccaagggcagcaggtccctactctggctgcccatgtagttaaaaagtcacacacgtgcgcagctggtctgattaatgagtttgttttttgatgtcacagtttctgggcacagcagagctggctcctctgcttggggtctcctcaggctgcagttgaggtgttggccggggctgcattccctgctggggcttggggttctcttctaag

SEQ ID NO: 201582 - DNA, 601 bp, Human
tgagtccccatttccttgctggcattggctggaggccccttctagagcccaccctgttcataggcagttcacacacagctgtttgcttttctcttctcagtgaatctggtttttttgttttttcgtttttgagacggagtcttgctctgttccccaggctggagtgcagtggggcgatcttggctcactgcaagctccgcctcctgggttcatgccattctcctgcctccgcctcctgagtagctgggactacaggcacccaccaccatgcccggctaattttttgtatttttagtagagrtggtttcaccatgttagccaggatggtctcgatctcctgaccttgtgatccgccctcctcggcctcccaaagtgctgggattacaggtgtgagccaccgcgcccggccaagtctgggttttttgaaaagctccctgggtgacttgactctagccctcagggttcagacccttcggtttctgggagtccgtggacattggctgcaggttttgaaaggctggcatctcaagaggggagcagatgaagagtcatggggaaggttcctgtgcagtatgaggaaggtttaattttcttgccaact

SEQ ID NO: 201583 - DNA, 601 bp, Human
ccaggatggtctcgatctcctgaccttgtgatccgccctcctcggcctcccaaagtgctgggattacaggtgtgagccaccgcgcccggccaagtctgggttttttgaaaagctccctgggtgacttgactctagccctcagggttcagacccttcggtttctgggagtccgtggacattggctgcaggttttgaaaggctggcatctcaagaggggagcagatgaagagtcatggggaaggttcctgtgcagtatgaggaaggtttaattttcttgccaacttttgagataattatgtgyaaatcttttttatatagttaagatgttgctgtgtagttgggtgtccggccttagttaatgtgaacgtttccatgtattagtaaatcttgtgtaaatattatttttaagggccatattattactttgtagtggagttatggtttaatttatctaattttaatgaatttttgttggacatttcgagtggttctttatgcagctggttagtataatgtttcagtgaacttctctctctttttttaaatagcttcactgaggtaattcatgtaccatacaattcaaccctttaaagcagccaat

SEQ ID NO: 201584 - DNA, 601 bp, Human
gtacagttcagtggcattaattacattcagtgaatttttttgtggggttttttttttgtttgtttttgaaacaggatctcgctctgccatctcactctgcatctgcactggtgcagtaagagctcactgcagccttgacctcctgtgatcctcccacctcagcctcctgagtagctgggactacagatgcacatcactacactcatctgtcgttttttttctttttgtagagacagggtcttgctgtgttgcccaggctggtcttaaactcctgggctcaaatgatctgcccgccttggcytctcctgaagtgctgggattacaggtgtgagccaccatacttggccaagtgaatacctttttatatgagtttctgcccatgatggggtgggcctctgtcactggatttaccaggtcagagaggtggatggtcttaagacccttgatggctgctgccaggtcaccttccagaaatcctgccccagtttacccttggctttatggttaactgcctgctcttttttgacttttttcttgcctccttctgttcacaggattgtactgaagcagttccatcaggtgctaaaacgtctgagctgtg

SEQ ID NO: 201585 - DNA, 601 bp, Human
tgggctgggacgggaggacaaacacctccctgtgcaggcagtgggttcagatggtcttggctggaaggagggcagataatggtgagaccacgtttggagggagggcagcatggtgtcatgggcttggggaggaaaggagaggaatggccccttcttcagcactgactagtcgtcctgcaccgtggagggtgttccgtcttattttccagcgctcacaactaggagccagcagttcagttttagccatcccagctcatggattatggagctgggacccacgcttgctcctcctcttgctctscgttgcccatcttagctgtgcccttggccgccactctgactccagtgaatcacgtagactccttgggcctctgaattcctgtccgtaaatgatgaagctgaatggcagcatttttaagatccgttagttttgtgattctaaataaaattaagtcatgttgctctgagttcccagaaaattattttaagatccgttagttttgtgattctaaataaaattaagtcatgttgctctgagttcccagcaaattatttggaaatccctcttggtggatgtcccaaagcagccttcctgtaggat

SEQ ID NO: 201586 - DNA, 601 bp, Human
gaaaggagaggaatggccccttcttcagcactgactagtcgtcctgcaccgtggagggtgttccgtcttattttccagcgctcacaactaggagccagcagttcagttttagccatcccagctcatggattatggagctgggacccacgcttgctcctcctcttgctctgcgttgcccatcttagctgtgcccttggccgccactctgactccagtgaatcacgtagactccttgggcctctgaattcctgtccgtaaatgatgaagctgaatggcagcatttttaagatccgttagtttkgtgattctaaataaaattaagtcatgttgctctgagttcccagaaaattattttaagatccgttagttttgtgattctaaataaaattaagtcatgttgctctgagttcccagcaaattatttggaaatccctcttggtggatgtcccaaagcagccttcctgtaggatcctggttgtgtctggcttcctgcagtaatgtggattggggtggattggcctctgtgtgcacccttaatgggaaccaggacactgctttgctggctgatttgttgtcctcccttactgcccactggccagtc

SEQ ID NO: 201587 - DNA, 601 bp, Human
atgagagatggtcacttggtttctaacttccctttctcttccctgtttcctgctgcttcccagggctgaatgaatattccctgaaacaaggctggccatgagctaataatcgttgaagccaaatgatggggtaatgggcattcatgatgctgtgctcttacttttgtatttgtttgaaattttccaggataaaaagctaagaaaataggctgggggcggtggctcacgcctgtaatcccagcactttgggaggccaaggtgggcggatcacgaggtcaggagatcgggaccatcctggctwacacggtgaaaccatgtctctactaaaaatacaaaaaaaaagtagccgggcgtggtggcgggcacctgtaatcccagctactcgggaggctgaggcaggagaatggcatgaacccaggaggcggagcttgcagtgagccgagattgtgccactgcactccagcctgggcaacatagcgagactccgtctcaaaaaaaaaaaaaaaagttaagaaaatagtcattcattgattaaagttaccaaaaaacccttccacattgagagaacagggtgttaaaactcagaaaccttttcaagccc

SEQ ID NO: 201588 - DNA, 601 bp, Human
ttcatgatgctgtgctcttacttttgtatttgtttgaaattttccaggataaaaagctaagaaaataggctgggggcggtggctcacgcctgtaatcccagcactttgggaggccaaggtgggcggatcacgaggtcaggagatcgggaccatcctggcttacacggtgaaaccatgtctctactaaaaatacaaaaaaaaagtagccgggcgtggtggcgggcacctgtaatcccagctactcgggaggctgaggcaggagaatggcatgaacccaggaggcggagcttgcagtgagccragattgtgccactgcactccagcctgggcaacatagcgagactccgtctcaaaaaaaaaaaaaaaagttaagaaaatagtcattcattgattaaagttaccaaaaaacccttccacattgagagaacagggtgttaaaactcagaaaccttttcaagccccaagatgagcaaacttgctcctcttatttcctagcagcagatgttcctgagaaaggggtagctgtgcttgagccattccatcattcatccaagccatccatctatccatctattcatcatcaatccaagatccaaacatt

SEQ ID NO: 201589 - DNA, 601 bp, Human
tggttagtattatctcagagttgtgcagtcatcatcactgtctgattgcagatcattttcatcacccccaaaagaaaccctatacctattagcactctctccccatccccttcttctgttagtcctggcaaccaccagtctgctttctgcctctgtggatttgtcttttctgggcttttcataaatgggatcacatggtacatagcttttggtgacagagttcttagagcttctttttttatttgtttgttttttgttgagacggagtcttgctctgtcgcccaggctggagtgcagtggygcgatctcggctcactgcaagctccgcctcccgggttcacaccattctcctgcctcagcctcccaagtagctgggactacaggcgcccgccactacacccagctaatttttttgtatttttagtaaagacagggtttcactgtgttagccaggatggtctcgatttcctgacctcgtgatccgcctgccttggcctcctaaagtgctgggattacagacgtgaccactgcgcccggcccttttttttgagacagtctcactctgttgcccaggctggagtgcagtggtacaatcttggct

SEQ ID NO: 201590 - DNA, 601 bp, Human
tgatccgcctgccttggcctcctaaagtgctgggattacagacgtgaccactgcgcccggcccttttttttgagacagtctcactctgttgcccaggctggagtgcagtggtacaatcttggctcactgcagcctccgcctgccgggttcaaggattctcctgcctcagcctcccgagcagctgggattacaggcgcccaccaccacgcctggctagttttttttgttttgttttgttttgttttttgtatttttaatagagacagggtttcatcatgttgtccaggctggttgtaaactyctaacctcaggtgatccacccgccttggcctcccagagtgctgggattatcttagagcttctcaatagaagtcctatcttccaggccacatctcaccctccaggggtaggggctggtggagctgttctcactcagtttgtcctcagttccttcttgagcctggacccttccctctagatttggggctgctcctctcagagtgccccagaacaaaaccccctccctgttcccacttcccactgtctgcaggactcccctaccccataaccagggtcctgccagccctaccctcagcctccc

SEQ ID NO: 201591 - DNA, 601 bp, Human
ggcacgttttatggataggtgctccgagttctttccgctttggtccagtctgagtggctctgataagcgttggcaacaccaccgatttttgtggggcctggcttcagaacatgaatgtctgtgtttctgcaaaaccaagtgtactcactgcctccttttaaaatcatgctacaaggatgtctttcactttgaattctgcgcttacattgttcaagaggcatcaccatgtttataacctcagacgcagtaattccaccctagggcattttcctaaggaaaattgcttcccccttttcttttwtggtagtattatgtgaaattattcattgtattcataacagtggaaagctggaaacaaactgagcatcctgtaatacaaaaggggttccattagcttggtagacgattctgtcatcatccgatggtaaggatgaaaatgaattagcaacgtggaacattgtcataagtggaaaaagtgagatgcccaaagtgtgatgatttgtatcagtcatctcttgttcggtaacaaaccatcccaaagtttagaggcttaaaacaatgcgatttaatcgcagtgccatctggcttggtatgaggtggt

SEQ ID NO: 201592 - DNA, 601 bp, Human
gtctctgggcagcatctctcctgcttctgataaagactaacaaggtgtcttagtctgttcaggctgccataacaaaatgccaggctgggctgtttataaacaagagagatttagtgcgcacagttctggatttggggaagtttgagatcaaggcacctacagattacatgttagataagggctccctgcttcatagatggcatcttcctgctgtttttcatgtggcagaagggccaaagaagctctcttgggcttcttattgtaaaggcattaatttcattcatgagggttccacccttaygacctcatcacctcccagcagccccacctcttagtattatcacattgggggttagactttaacataagagctttggtggggggtacagtattaagtccatagcacaaggggtgacaccttggagtgggtggagggtgaccacctagcagtgtgacaagaactccactaagggaattggggtgtgagtgtgagcatgtgtgagtatttgtatgtgcacacttgtgtgtgtacatgcatatctccaagtgtccatgtatggctgtgtgagtgcatgtgcctgtgtgtggcccattgggggac

SEQ ID NO: 201593 - DNA, 601 bp, Human
ccatgtggcttgcaaagctgaagatattcattagctggctctttccaggaaaagtttgacccctgctttaggataaaacagagaaatggagagacatggaatagcagagtatcttttcaactaggttcaatatgaatgaacaggtcccctcaattgcacctgaaaggggccagaagtcctataggtttgggtttgggggagattgaagttagacttgcttggttcagagaccaggccaggatcgagcatttgccattggtgacctggaggtgtctggagcaggatccttttaaataggcargctgcttgctgggaacacagttcaccttaagctttaaaaaaaattccttcaaagccaaaaaccatgcaaatatggagctgcctgacaagccgaatgattgatagggtagaaaatagggtctgtcataaaatatttgaggaggtggatttttacagcagggagaagcaggctgacaagtgccacttgttaatggtgactaccaccttccgtacctactgtgtgccaggcatagcaatagacactttgttattgtgttccgtctagaaacaaccctgctaagtagctcccagtattccccag

SEQ ID NO: 201594 - DNA, 601 bp, Human
attcaggaggctgagtcaggaagattgcttgagccccaggagtttgaggcaatggtgagccatgttcatgccactgcactccagcctagccaacagagcaagaccccgtctcataaaataaaataaaataaaataaaataaaataaaataaaataaaataaaataaaataaataaaataccaacagcctgtgctggctggagccatggtgttaaaaggcccatggacttgggccatgcctgagctggctgtgctctgcctgccacttaggctgcccctccctgacccagcttgtgtggagsaggcatggaatcctacaggaatgtgaagttcatccttccctggatacttgggcaccatctggccaggctcatggagcaaatgggcctgtgagttatgtccccacccgtgcctacgcccaacctttatgccccgtttttagtgggagaattttgtttggagctgcaggtgttggggggtggcacgtctcaggctttggggtcttcctgttctctttcttggccctgctccactccttggttcccctggccctgtcttgcctgcctgttaactttgggtaccctcagcctgtcccaaggcag

SEQ ID NO: 201595 - DNA, 601 bp, Human
tgctggctggagccatggtgttaaaaggcccatggacttgggccatgcctgagctggctgtgctctgcctgccacttaggctgcccctccctgacccagcttgtgtggagcaggcatggaatcctacaggaatgtgaagttcatccttccctggatacttgggcaccatctggccaggctcatggagcaaatgggcctgtgagttatgtccccacccgtgcctacgcccaacctttatgccccgtttttagtgggagaattttgtttggagctgcaggtgttggggggtggcacgtctcargctttggggtcttcctgttctctttcttggccctgctccactccttggttcccctggccctgtcttgcctgcctgttaactttgggtaccctcagcctgtcccaaggcagctcatccctcaggccctgccctgtcttgtctctccagcctcccagcccaggggcttgctctccatgtagtaactaataccttagtgtgatcctctaattttctgttgctttcttgcttccatggttgttggaagcctggagacccagtgtttggccaaggacagggcctgctggttttagagctcctggc

SEQ ID NO: 201596 - DNA, 601 bp, Human
ctggctggagccatggtgttaaaaggcccatggacttgggccatgcctgagctggctgtgctctgcctgccacttaggctgcccctccctgacccagcttgtgtggagcaggcatggaatcctacaggaatgtgaagttcatccttccctggatacttgggcaccatctggccaggctcatggagcaaatgggcctgtgagttatgtccccacccgtgcctacgcccaacctttatgccccgtttttagtgggagaattttgtttggagctgcaggtgttggggggtggcacgtctcaggytttggggtcttcctgttctctttcttggccctgctccactccttggttcccctggccctgtcttgcctgcctgttaactttgggtaccctcagcctgtcccaaggcagctcatccctcaggccctgccctgtcttgtctctccagcctcccagcccaggggcttgctctccatgtagtaactaataccttagtgtgatcctctaattttctgttgctttcttgcttccatggttgttggaagcctggagacccagtgtttggccaaggacagggcctgctggttttagagctcctggccc

SEQ ID NO: 201597 - DNA, 601 bp, Human
tgtctctccagcctcccagcccaggggcttgctctccatgtagtaactaataccttagtgtgatcctctaattttctgttgctttcttgcttccatggttgttggaagcctggagacccagtgtttggccaaggacagggcctgctggttttagagctcctggcccagtagggatgataggacccaggaccccaagtgctctaggcaggcactgttctgggtgctgtaaagcacggtgcctagcacctcacagggactcggggtgtcctggctgaccagccgaatccactttttattgacragaagcctgggtcccagagacattaagtaacgtgctaaggtcacccacctgggcagtggtagggctgggtttgaaccaaggtctgcactgcccagctcatgaattctgctgcttgggagccagcagcactactggcacaagggtagggggacctcaggcctgtcagagagggtgcctggctctttgggagtggggggtgcaccagagtgggttggagacaggacccagagcaccaccctttacctgaccagcatcttggtggggttccccacctggaaaggcaggaccctggggtccaac

SEQ ID NO: 201598 - DNA, 601 bp, Human
ctcacagactctgcccctccaaagcccttccagccctctcctgggggctgggttatctctgtcctcagactccatggcaccgagttcaggccatgtcttagtgtcctgtggcttccttaacagaatgccacaagcttagtggcttacaacaacaaacatttattctctcccagttctgaagactgaagtcccacatcaaggtgtccgcagggccaggctgtctctggaggctctaggggaggatccttcctttctgttcccagcatctgatggcccacggcattcctcgacctggtgacarcatctctccagtccctgcctccgccttcaaatggcctcctgtatgcctgtgtcttctgtctctttaaagatatttgtcattggatttagggtccatcagtgtgatattgtgatataagaaacctgtatgtggtcttccttctggtttctggcacaagctcctaaaatcattgtaatttcctgaacgatggggtgataggagcatcttttgttattcatacaagcccttttctgtgggacctgaggttatgctaatgaggtgatgcttgaggggcccctagatagctgtgggacggggctg

SEQ ID NO: 201599 - DNA, 601 bp, Human
tggctccgtggtcatttcctcagggagaggccctgctgtccttcctgggtctgtcttcctccctcctgcatgtgctccggtgccacctgcctctctcccgtggccttgtcatggttgctgtgatgcccacgtcacgtgactccatggattccgctggctcccatgggcaggggctgggtgtgcggtgctcaccattccatacccagcacagtgtcctgcacgtattagatactcagtaagtacatttgtctggggctaaaccttcagggtctccaggaagtctttctgagccccagagtcstaaaaagcccaggtgctgctgaggaataataactgtatcatcctggggcggagggctgctgcctcttcccagctggggtttcagcctctgccctgcccccgcaccagccggcccccaacctgaagcctagagcatcaaattattattgcctccgggaatgactgggagccttaggcacaggtgggtccttggagacaggggatggtcctttaacagtgttctggatcctgatggagaagagagggggttctcctctgcccacactgaggcacactcggcttgtggaggaaaacggctgac

SEQ ID NO: 201600 - DNA, 601 bp, Human
tggtgatgtcattgttggggtacggcatgagggctgggaggccacaggatcctggggtgctctctgtgtacccttccaccacagaaccaaggaccctggtggcaggcctttagccagggtgcggtggctaactggatggggcacgtctcatttataaagaattttgaggcacttggcgtggatgcaagaaggggcagctgccagcctggcagaggaggagaaagtagagaaaccaccagaaccaaccacacatctccgaaagcactcactgcatgtgggtggcctgaggttatggccaggyggtactgatgtccatccggaaggatactctcagccctcgggaaacagtggaattatgttccgggttccctgcttaggagaggaaaacaggtcagccttaaaaaaaaaaaaaaattgaggtaaaattcacataacataaaatgaatcattttaaagtgaacaattccgtggcttttagtgccttcacagtgttgtgcaaccaccatctccgtttagttccgaaacattttcgtcaccccagaaggaaacccctgcccattaagcagtcaccgacctcctttctgtctttatgggtttacat

SEQ ID NO: 201601 - DNA, 601 bp, Human
taaaagttcatgcccactcaggtgcgtattccaagagatgatacgtgggttttcagcaccatatgtgacctggaggaagtaccccgtaaagggtggtgggttttttttgcccactacttcaaagatttgggtcttttttgctgtcagaggaacttacctccctgaagcactacgggtattccctgaccttacctgaggttctgctacgatagccagcttcggagcccccaagatccacagcccttctcgagggtagagtctgctcttggtgggtgcatggtggtaagaaggtgccaggctrtggatgagcgtggggtgcagagccagctccgactgtggactctgcacccttcatgagacccgaacctctgtcccagccatggttttccaagcctctctggaggacagtgcctgcctgacaatccctccaaaagacgtgtgctgctgtttgtagaagtcgctggcaccatgctgccatggcctgcctaggacctgggagaagatgggaggccaagaggagggcaggagccgggaaggaggacagctgcagccatgacagggtgggggtttgatgtccgcctctgtgaaaacctccaccaca

SEQ ID NO: 201602 - DNA, 601 bp, Human
agtgcctgcctgacaatccctccaaaagacgtgtgctgctgtttgtagaagtcgctggcaccatgctgccatggcctgcctaggacctgggagaagatgggaggccaagaggagggcaggagccgggaaggaggacagctgcagccatgacagggtgggggtttgatgtccgcctctgtgaaaacctccaccacagctggccgagccaccggatgtttgatctccttttacctttgtaaataaatactgcctagtctttggctgccagtgtaaacaaggatggagaccactctgctgatgwtctctgtgctccctggagttcctgcctcctccacccaaattcctcccagtgcccctttcttctcttgactccagtacatgttgatcggagggccctttacagccgctctcattgttctgggtagggagggcccagagcatgacctctgatcccctgagggcttgctcccatctcaccctggggcacattggcagagggtgggtcaggggctgggttcctggaaccccacacctctggcagccacaccacggatggaggatctggggtctctctaggcatatctggcctgggagagcctct

SEQ ID NO: 201603 - DNA, 601 bp, Human
tgcctaggacctgggagaagatgggaggccaagaggagggcaggagccgggaaggaggacagctgcagccatgacagggtgggggtttgatgtccgcctctgtgaaaacctccaccacagctggccgagccaccggatgtttgatctccttttacctttgtaaataaatactgcctagtctttggctgccagtgtaaacaaggatggagaccactctgctgatgatctctgtgctccctggagttcctgcctcctccacccaaattcctcccagtgcccctttcttctcttgactccagtwcatgttgatcggagggccctttacagccgctctcattgttctgggtagggagggcccagagcatgacctctgatcccctgagggcttgctcccatctcaccctggggcacattggcagagggtgggtcaggggctgggttcctggaaccccacacctctggcagccacaccacggatggaggatctggggtctctctaggcatatctggcctgggagagcctctcctgcctggctgtacccaggcatcacatggccgatggtctgagctcagttctgcatgcatttcctgggagcccacc

SEQ ID NO: 201604 - DNA, 601 bp, Human
aaaacctccaccacagctggccgagccaccggatgtttgatctccttttacctttgtaaataaatactgcctagtctttggctgccagtgtaaacaaggatggagaccactctgctgatgatctctgtgctccctggagttcctgcctcctccacccaaattcctcccagtgcccctttcttctcttgactccagtacatgttgatcggagggccctttacagccgctctcattgttctgggtagggagggcccagagcatgacctctgatcccctgagggcttgctcccatctcaccctrgggcacattggcagagggtgggtcaggggctgggttcctggaaccccacacctctggcagccacaccacggatggaggatctggggtctctctaggcatatctggcctgggagagcctctcctgcctggctgtacccaggcatcacatggccgatggtctgagctcagttctgcatgcatttcctgggagcccaccgttccgccttctgtctctatgaatctgactactgtaggtacctcatatgagtggaatcataacaatatttgtccttttgtgtctggcttattccactaagcaga

SEQ ID NO: 201605 - DNA, 601 bp, Human
agggccctttacagccgctctcattgttctgggtagggagggcccagagcatgacctctgatcccctgagggcttgctcccatctcaccctggggcacattggcagagggtgggtcaggggctgggttcctggaaccccacacctctggcagccacaccacggatggaggatctggggtctctctaggcatatctggcctgggagagcctctcctgcctggctgtacccaggcatcacatggccgatggtctgagctcagttctgcatgcatttcctgggagcccaccgttccgccttctrtctctatgaatctgactactgtaggtacctcatatgagtggaatcataacaatatttgtccttttgtgtctggcttattccactaagcagaacatcaaggttcatccatgagattgcatgtgtcaaaatgtccttcctttttaaggctgaatgatgttccattgcgtgtatacattacattgtgcttctcccttcttctgtcagtggacattgggttctttccacctcttccttcccatgttgtgatgaatatgggtgtgcaaatatgtcttcaagttcctgctttcagttcttttagag

SEQ ID NO: 201606 - DNA, 601 bp, Human
acacctctggcagccacaccacggatggaggatctggggtctctctaggcatatctggcctgggagagcctctcctgcctggctgtacccaggcatcacatggccgatggtctgagctcagttctgcatgcatttcctgggagcccaccgttccgccttctgtctctatgaatctgactactgtaggtacctcatatgagtggaatcataacaatatttgtccttttgtgtctggcttattccactaagcagaacatcaaggttcatccatgagattgcatgtgtcaaaatgtccttcctktttaaggctgaatgatgttccattgcgtgtatacattacattgtgcttctcccttcttctgtcagtggacattgggttctttccacctcttccttcccatgttgtgatgaatatgggtgtgcaaatatgtcttcaagttcctgctttcagttcttttagaggctgggcgcagtggctcacgcttgtaatcccagcactttgggagactgaggctggtggattacttgaggtcaggagttccagaccagcctgggcaacatggtgaaaccccatctatacttaaaatacgaaaattagctg

SEQ ID NO: 201607 - DNA, 601 bp, Human
tgtaggtacctcatatgagtggaatcataacaatatttgtccttttgtgtctggcttattccactaagcagaacatcaaggttcatccatgagattgcatgtgtcaaaatgtccttcctttttaaggctgaatgatgttccattgcgtgtatacattacattgtgcttctcccttcttctgtcagtggacattgggttctttccacctcttccttcccatgttgtgatgaatatgggtgtgcaaatatgtcttcaagttcctgctttcagttcttttagaggctgggcgcagtggctcacrcttgtaatcccagcactttgggagactgaggctggtggattacttgaggtcaggagttccagaccagcctgggcaacatggtgaaaccccatctatacttaaaatacgaaaattagctgggtgtggtggcgcacgcttgtaatcacagctacttgggaggccaaggcaggagaatcacttgaacccaggaggtggaggttgcagtgagccaagatcgcgccattatactccagcagtgtccgggcaacagagtgagactccatctcaaaaaaaaaaaaaaatcagttattttgggtacat

SEQ ID NO: 201608 - DNA, 601 bp, Human
atgatgttccattgcgtgtatacattacattgtgcttctcccttcttctgtcagtggacattgggttctttccacctcttccttcccatgttgtgatgaatatgggtgtgcaaatatgtcttcaagttcctgctttcagttcttttagaggctgggcgcagtggctcacgcttgtaatcccagcactttgggagactgaggctggtggattacttgaggtcaggagttccagaccagcctgggcaacatggtgaaaccccatctatacttaaaatacgaaaattagctgggtgtggtggcrcacgcttgtaatcacagctacttgggaggccaaggcaggagaatcacttgaacccaggaggtggaggttgcagtgagccaagatcgcgccattatactccagcagtgtccgggcaacagagtgagactccatctcaaaaaaaaaaaaaaatcagttattttgggtacataactaggagtagaattgctggatcatgtggtaattctgtttaattttttgaaagatttttttttttgaaccagtgtagtctaggggatgtgaccgcagcacctacctgggcctgggctgactgggacctaa

SEQ ID NO: 201609 - DNA, 601 bp, Human; identical to SEQ ID NO: 40344

SEQ ID NO: 201610 - DNA, 601 bp, Human; identical to SEQ ID NO: 40345

SEQ ID NO: 201611 - DNA, 601 bp, Human; identical to SEQ ID NO: 40346

SEQ ID NO: 201612 - DNA, 601 bp, Human; identical to SEQ ID NO: 40347

SEQ ID NO: 201613 - DNA, 601 bp, Human; identical to SEQ ID NO: 40348

SEQ ID NO: 201614 - DNA, 601 bp, Human; identical to SEQ ID NO: 40349

SEQ ID NO: 201615 - DNA, 601 bp, Human; identical to SEQ ID NO: 40350

SEQ ID NO: 201616 - DNA, 601 bp, Human; identical to SEQ ID NO: 40351

SEQ ID NO: 201617 - DNA, 601 bp, Human; identical to SEQ ID NO: 40352

SEQ ID NO: 201618 - DNA, 601 bp, Human; identical to SEQ ID NO: 40353

SEQ ID NO: 201619 - DNA, 601 bp, Human; identical to SEQ ID NO: 40354

SEQ ID NO: 201620 - DNA, 601 bp, Human; identical to SEQ ID NO: 40355

SEQ ID NO: 201621 - DNA, 601 bp, Human; identical to SEQ ID NO: 40356

SEQ ID NO: 201622 - DNA, 601 bp, Human; identical to SEQ ID NO: 40357

SEQ ID NO: 201623 - DNA, 601 bp, Human; identical to SEQ ID NO: 40358

SEQ ID NO: 201624 - DNA, 601 bp, Human; identical to SEQ ID NO: 40359

SEQ ID NO: 201625 - DNA, 601 bp, Human; identical to SEQ ID NO: 40360

SEQ ID NO: 201626 - DNA, 601 bp, Human; identical to SEQ ID NO: 40361

SEQ ID NO: 201627 - DNA, 601 bp, Human; identical to SEQ ID NO: 40362

SEQ ID NO: 201628 - DNA, 601 bp, Human; identical to SEQ ID NO: 40363

SEQ ID NO: 201629 - DNA, 601 bp, Human; identical to SEQ ID NO: 40364

SEQ ID NO: 201630 - DNA, 601 bp, Human; identical to SEQ ID NO: 40365

SEQ ID NO: 201631 - DNA, 601 bp, Human; identical to SEQ ID NO: 40366

SEQ ID NO: 201632 - DNA, 601 bp, Human; identical to SEQ ID NO: 40367

SEQ ID NO: 201633 - DNA, 601 bp, Human
tgaagcacactcctgccagccaccctgaccaccccttgctgcaggacgccctccgcatctcacagaacttcctgtccagcatcaatgaggagatcacaccccgacggcagtccatgacggtgaagaagggagaggtgagtgtggcaggggatggcttgggtccacccatcctgctgagctgggggcatgcagggcccctcgatctgaggtctggagcccttcctggtcctcagcagaccttgccttctgggattggtgagattggccgcacactcagtcctgtgtggaaggtgtctgggtrcagtctcaggggtgaccctgcaagcaccatgccctccaggtggcagccatcaccatgcctcactcagccacctctttccttttctgtcattgtgggttgtgtccagggacccctttttttttatcccccacagtcttgccagctcaggctccccagccaaggagacttgtgcaaaggaggtgagtaggaggatggcattttgtctgcctggaatcctcctacttccccctgagtgctttcattaaaaaacagttaacatcgggtttaaggattagaaagtggggttcgtggtttgtgtct

SEQ ID NO: 201634 - DNA, 601 bp, Human
ggggatggcttgggtccacccatcctgctgagctgggggcatgcagggcccctcgatctgaggtctggagcccttcctggtcctcagcagaccttgccttctgggattggtgagattggccgcacactcagtcctgtgtggaaggtgtctgggtgcagtctcaggggtgaccctgcaagcaccatgccctccaggtggcagccatcaccatgcctcactcagccacctctttccttttctgtcattgtgggttgtgtccagggacccctttttttttatcccccacagtcttgccagctcwggctccccagccaaggagacttgtgcaaaggaggtgagtaggaggatggcattttgtctgcctggaatcctcctacttccccctgagtgctttcattaaaaaacagttaacatcgggtttaaggattagaaagtggggttcgtggtttgtgtctgtgacgtgagactggttgaagcacttcacgtcttcctccgggaagactctccttccccttcccccccgtcactgatgtactctgtgtgcacatcatcgatgagcaggcatggcctgtgcctgtgccgctctgagccttcctaggtg

SEQ ID NO: 201635 - DNA, 601 bp, Human
cctcagcagaccttgccttctgggattggtgagattggccgcacactcagtcctgtgtggaaggtgtctgggtgcagtctcaggggtgaccctgcaagcaccatgccctccaggtggcagccatcaccatgcctcactcagccacctctttccttttctgtcattgtgggttgtgtccagggacccctttttttttatcccccacagtcttgccagctcaggctccccagccaaggagacttgtgcaaaggaggtgagtaggaggatggcattttgtctgcctggaatcctcctacttccycctgagtgctttcattaaaaaacagttaacatcgggtttaaggattagaaagtggggttcgtggtttgtgtctgtgacgtgagactggttgaagcacttcacgtcttcctccgggaagactctccttccccttcccccccgtcactgatgtactctgtgtgcacatcatcgatgagcaggcatggcctgtgcctgtgccgctctgagccttcctaggtgtggcctggcacataatgaggcagatgcattcccaggcaggtagcagctactgagaacagccaaggcgtgtaagctggggag

SEQ ID NO: 201636 - DNA, 601 bp, Human
gtggtttgtgtctgtgacgtgagactggttgaagcacttcacgtcttcctccgggaagactctccttccccttcccccccgtcactgatgtactctgtgtgcacatcatcgatgagcaggcatggcctgtgcctgtgccgctctgagccttcctaggtgtggcctggcacataatgaggcagatgcattcccaggcaggtagcagctactgagaacagccaaggcgtgtaagctggggagccagtgtccagggggaacagcttttgtcagaagcagcactgaggcgaggggagctgacccmcggcctcaggggtctcatgcagggacagaagctgtctggcccaggcaggacacaggctgggcgtgaacctgactgtagttgcctcagaaccacctcatggctgggtgcggtggctcacgcctgtaatcctagcactttgggaggcctaggcgggtggatcaggaggtcaagaattcgagaccagcctggccaacatggtgaaaccccgtctctactaaaaatacaaaaattaactgggcacggtggtgggtgcctgtaatcccagctactcgggaggctgaggcaggtgaatcgcttgaa

SEQ ID NO: 201637 - DNA, 601 bp, Human
ggccaccaggcaggcagctgtcagccccatctgccacacaccactttgggaatggtaccctgagtgtccagagtctaatccgagttgacctttagtgagggacttggtcaggtttctcctggtgggcctggcccaggaagggcatggaggaggagggagctgtcccttccattccgctctccggcttgtccaagccctggagctgggcagactcagagtcccatgccagcatcgtgaggaccgacccactgggtggcctagagcttctcccaactgggcccattccttgtctttgcagcasggtgggaacatggccccacctcatcgggcacctgggctgtcaaatgggcatgatttagtggcagtcctcgccatccgtgttggctccttggcagtctctgagcgcattgaaggcggaagtgggtccccggcaccttccagtggaggcgttgagcagtgcaagtgttccccagctgctcatcccatggctgggacctgggagtggtgggggatcagatcttgcttcttggagcaacaaccgggccctgcccttggttctcttccctggctcagggccccagaaggagagcaaacctgtgac

SEQ ID NO: 201638 - DNA, 601 bp, Human
ccaccaggcaggcagctgtcagccccatctgccacacaccactttgggaatggtaccctgagtgtccagagtctaatccgagttgacctttagtgagggacttggtcaggtttctcctggtgggcctggcccaggaagggcatggaggaggagggagctgtcccttccattccgctctccggcttgtccaagccctggagctgggcagactcagagtcccatgccagcatcgtgaggaccgacccactgggtggcctagagcttctcccaactgggcccattccttgtctttgcagcaggrtgggaacatggccccacctcatcgggcacctgggctgtcaaatgggcatgatttagtggcagtcctcgccatccgtgttggctccttggcagtctctgagcgcattgaaggcggaagtgggtccccggcaccttccagtggaggcgttgagcagtgcaagtgttccccagctgctcatcccatggctgggacctgggagtggtgggggatcagatcttgcttcttggagcaacaaccgggccctgcccttggttctcttccctggctcagggccccagaaggagagcaaacctgtgacaa

SEQ ID NO: 201639 - DNA, 601 bp, Human
ctgggacctgggagtggtgggggatcagatcttgcttcttggagcaacaaccgggccctgcccttggttctcttccctggctcagggccccagaaggagagcaaacctgtgacaaacctgtgggcagtccacacagatctaagtggatgttggatttgcttctcctaagcctccacgtgctgggtgggttcctgccaggttcgccctaccctcctgagatgcctgctctttctcttctaccgactattcttttatgagcgctctgacctcctgggaagtgagtgtgggcgtcctttttccyatggcttctcctgtgcctagtctgctccctgcaactgcagctgccatttagcattcctagagacaaggaagggccttctcagtgctcggatcattggaatccactgctttggggaattaaggaaaacgcgatgttgtctagaagttgacacctaggccctcgttcctgcatccgtccccatgggggccaacttccacgcttacccatggtcatgtctcggggccaccaaggaggaagtgtaatttaagaagggctgggtgcggctgggcgcggtggctcacacctgtaatcctagtactt

SEQ ID NO: 201640 - DNA, 601 bp, Human
cttggagcaacaaccgggccctgcccttggttctcttccctggctcagggccccagaaggagagcaaacctgtgacaaacctgtgggcagtccacacagatctaagtggatgttggatttgcttctcctaagcctccacgtgctgggtgggttcctgccaggttcgccctaccctcctgagatgcctgctctttctcttctaccgactattcttttatgagcgctctgacctcctgggaagtgagtgtgggcgtcctttttcccatggcttctcctgtgcctagtctgctccctgcaactscagctgccatttagcattcctagagacaaggaagggccttctcagtgctcggatcattggaatccactgctttggggaattaaggaaaacgcgatgttgtctagaagttgacacctaggccctcgttcctgcatccgtccccatgggggccaacttccacgcttacccatggtcatgtctcggggccaccaaggaggaagtgtaatttaagaagggctgggtgcggctgggcgcggtggctcacacctgtaatcctagtactttgggaggccgaggcaggcggatcaccaggtcagaagt

SEQ ID NO: 201641 - DNA, 601 bp, Human
cctgtgcctagtctgctccctgcaactgcagctgccatttagcattcctagagacaaggaagggccttctcagtgctcggatcattggaatccactgctttggggaattaaggaaaacgcgatgttgtctagaagttgacacctaggccctcgttcctgcatccgtccccatgggggccaacttccacgcttacccatggtcatgtctcggggccaccaaggaggaagtgtaatttaagaagggctgggtgcggctgggcgcggtggctcacacctgtaatcctagtactttgggaggccraggcaggcggatcaccaggtcagaagtttgagaccatcctggctaacacgataaaaccccatctctactaaaaatacaaaaaattagctgggcgtggtggtgggcacctgtagtcccagctactcaggaggctgaggcaggagaatctcgtgaacctgggaggcggaggttgcagtgagccgagattgtgccactgcactccagtctgggcaacagagcgagattctgtctcaaaaaaaagaaaaaaaaaaaaaaagggctggttgcttcacaaaggcaggggcctggatctgcatcctc

SEQ ID NO: 201642 - DNA, 601 bp, Human
tgaacctgggaggcggaggttgcagtgagccgagattgtgccactgcactccagtctgggcaacagagcgagattctgtctcaaaaaaaagaaaaaaaaaaaaaaagggctggttgcttcacaaaggcaggggcctggatctgcatcctccccaggacctcgccctggtggaggggcacttgctcattgaggaggggtcacctgggtgccttagctgcaaagcaaggtggaggactaatgactctagaaaagtcaccgtgagtctgaccagcaccccttcactcagagctttctatccgargcacgttaagggaggtggcttgatggtggctaaggcaggatgatagatgcctgtgctttgcccctgcccctgccattcctggggcagatgctgctgatcagttgggcactccaagcctggacatccacctcggtatcccctggcactgcccaacgggtttgcagtccttgatgcagaaagaaagatgccagatgggcgaagccccgtcagggtccgctctccctcactgctaccagtgtactgatttggggacacccttttgcttccctgggtgtccgtgctctctgagggcaatgatgc

SEQ ID NO: 201643 - DNA, 601 bp, Human
aaaaggtttcacagcctgcgagggactttatgaaagtgaggggtggtggcctgcccgcatgctgccatctgtgtcggaggtgacgggcgagctcccctgacgacactagccaggaaaggggggcagaagctccaggctacttcctcttagaatttgcagccaggggcagggcctgaacttttctcagttctgcccatctcttagtttggtacatgacatggagtgtcaagttcccaaagggagaaagggactgtgcctctgcattctcatgacagttctgtggggtcagaggtgatctccsttttacagatgaggaaactgcgactcagagaggttgagtgtcttgcccagtcacacagccactaagtagctaagccaggatgcgagtgaggccatgggcccctggccgcctgtgtgcccctcgggtgtgttactctttggttcccttcctcctctgtgagccgataggacgtttccacccctcctcttgttcctgcactacctggaggtaggaaagaggaagagatgtcccttttagctccgcacactaccccatcccctgctgctgctgctgctgctgggagtgtgtcaaggggttggg

SEQ ID NO: 201644 - DNA, 601 bp, Human
gggactttatgaaagtgaggggtggtggcctgcccgcatgctgccatctgtgtcggaggtgacgggcgagctcccctgacgacactagccaggaaaggggggcagaagctccaggctacttcctcttagaatttgcagccaggggcagggcctgaacttttctcagttctgcccatctcttagtttggtacatgacatggagtgtcaagttcccaaagggagaaagggactgtgcctctgcattctcatgacagttctgtggggtcagaggtgatctcccttttacagatgaggaaactgygactcagagaggttgagtgtcttgcccagtcacacagccactaagtagctaagccaggatgcgagtgaggccatgggcccctggccgcctgtgtgcccctcgggtgtgttactctttggttcccttcctcctctgtgagccgataggacgtttccacccctcctcttgttcctgcactacctggaggtaggaaagaggaagagatgtcccttttagctccgcacactaccccatcccctgctgctgctgctgctgctgggagtgtgtcaaggggttggggctgtttctgtcttccctggc

SEQ ID NO: 201645 - DNA, 601 bp, Human
gaggaagagatgtcccttttagctccgcacactaccccatcccctgctgctgctgctgctgctgggagtgtgtcaaggggttggggctgtttctgtcttccctggcatttgatgtcaagaggaaagctgcttctgttggcctgggtgtttcgaggttctcctgcagtcactactgggcctcctgggaggtggcccattgctacctgctgagcctgggcaagtctggcatcgaggagaggcccaggtatgagccctctgcagggtcagccaccccagccccagacccccactgtggctcctrtaatctcattgcccttttcagccacatcccatggctccagggctgtgctctttggggaacagtgactttgggctgcattccaggtagctccctgatgctgaacggtggccggcaggtgctccagcttcctggcatcctggcccaagcacacctgggggccgtgagccacaggtgctgcccaagagaatgccctccttagccttcccaaaatgacaggatcaaaggatcccgcaggcacagtttctttccaggcctgggttctgagggctggtgggtggcgctcatttgtttaggtgaatt

SEQ ID NO: 201646 - DNA, 601 bp, Human
acagtttctttccaggcctgggttctgagggctggtgggtggcgctcatttgtttaggtgaattaacttcacagttagataaccaatccccactgctgggtgacttcccacgtggttgcctctctgtctactcggagccttggcaccatgtgctgctcagcaccccctccgcctgggctcggaagcatagcggacgatccagtttggatgttctgtttcccaagagccagccaggcattgacctccaatacccgttctctgcctgggattgcagaggcccctcttttaggaagaacacagwcagcagtccaaacaggagctgcaggaaggccctggaggagggaagtaccaccagtgcaggcttgaggctgagagatggtgaggctcgggcagaggagaaccaaggtctttcagttgatgattaaagagttggagaacaggctgggcatggtggctcacacctgtaatcccagcactttgggaggccgaggcgggtggatcacttgaggttaggactttgagaccagcctggccaacatggtgaaaccccgtctccactaaaaatgcaaaaattagccaggcatggtggcaggtgcctata

SEQ ID NO: 201647 - DNA, 601 bp, Human
gtggcgctcatttgtttaggtgaattaacttcacagttagataaccaatccccactgctgggtgacttcccacgtggttgcctctctgtctactcggagccttggcaccatgtgctgctcagcaccccctccgcctgggctcggaagcatagcggacgatccagtttggatgttctgtttcccaagagccagccaggcattgacctccaatacccgttctctgcctgggattgcagaggcccctcttttaggaagaacacagacagcagtccaaacaggagctgcaggaaggccctggagragggaagtaccaccagtgcaggcttgaggctgagagatggtgaggctcgggcagaggagaaccaaggtctttcagttgatgattaaagagttggagaacaggctgggcatggtggctcacacctgtaatcccagcactttgggaggccgaggcgggtggatcacttgaggttaggactttgagaccagcctggccaacatggtgaaaccccgtctccactaaaaatgcaaaaattagccaggcatggtggcaggtgcctataatcccagctactccggaggcggaggcaggagaattgct

SEQ ID NO: 201648 - DNA, 601 bp, Human
ttctctgcctgggattgcagaggcccctcttttaggaagaacacagacagcagtccaaacaggagctgcaggaaggccctggaggagggaagtaccaccagtgcaggcttgaggctgagagatggtgaggctcgggcagaggagaaccaaggtctttcagttgatgattaaagagttggagaacaggctgggcatggtggctcacacctgtaatcccagcactttgggaggccgaggcgggtggatcacttgaggttaggactttgagaccagcctggccaacatggtgaaaccccgtctscactaaaaatgcaaaaattagccaggcatggtggcaggtgcctataatcccagctactccggaggcggaggcaggagaattgcttgaacctgggaggcggaggtggccatgagctgagatcacgccattgcactctgcactccagcctgggcaacagagtgaaattccgtctcaaaaaaaaagagttggaaaacagttggagaagccagaccctgttggcaaagtttgcaaggggtgctacggagagggaggtgcccaccccaggggtgaagacaggatgggtggggttctcagctccac

SEQ ID NO: 201649 - DNA, 601 bp, Human
cataggaaactttctcggccagattggccatgggaggctttcttggggaccagagagtctgcagggagggcaagtcaagagcaggtgagagggagggaagggcgagcaggacccttgacctcattctcggctgcagtgtatattggcctgcctggtgaccctccttgctcctggtcccactgccaaacctctggagtctgccacatccctgcatagacagggccactgacaggcagtggcagccagttcagtggcactcagccaggtctccaggggtgtgcgctttgctctgggggcaggrtagcgggggctgaggccactggctgcctccagggcccccccaccagccagcagctggaagctccaccttggtcttcacttgggccgtcttccttctccacttcctcagctgctatgtgggcttctttggcaacttttccttgtctcaccagtcaaggccctgctgatttgttgatgatcagactgtagttcgtgtacctggggaagttttccagcatctccatggagccatggtctctgattcctggagcatgtcgtagtcggttcaggctgctgtaacaaagtatcatctgctgagagg

SEQ ID NO: 201650 - DNA, 601 bp, Human
acactcatcccatcacatggattccaccgcatgacctcatctacacctactcacctcgcaaaggccccacctccagataccagcccattggagttagggcctcagcataaattctgagggggacagaaactttcagccctaacagtatgcttcttccagactggccttcctgggaaggccctggataggctgtgcctggggttgggggtgatgttgcactggcaacagctggaggaggcagctggcctgggggaagtccccttagcaaggaggtgcccctcctcactcccaccagcctgawgcgaccccctcctcagaagacagggcacataatgtgacctcacagggcctcagtttccttgtgtgtagaaatcagggttatggtgcctgccttgtagagtcctggtgaggagtgagtggtgtgattcatgggaagctgtgactgtcacattcccacctgcagaggacatggcgaagggtgacagccccgtgtgaggccctgcaggtcgcagtttcatttaatcctcagaacataccaccagactggtctttctcaccccatcatgtttaaggaaacagaggctccaagaaatggaggagc

SEQ ID NO: 201651 - DNA, 601 bp, Human
actcatcccatcacatggattccaccgcatgacctcatctacacctactcacctcgcaaaggccccacctccagataccagcccattggagttagggcctcagcataaattctgagggggacagaaactttcagccctaacagtatgcttcttccagactggccttcctgggaaggccctggataggctgtgcctggggttgggggtgatgttgcactggcaacagctggaggaggcagctggcctgggggaagtccccttagcaaggaggtgcccctcctcactcccaccagcctgatgygaccccctcctcagaagacagggcacataatgtgacctcacagggcctcagtttccttgtgtgtagaaatcagggttatggtgcctgccttgtagagtcctggtgaggagtgagtggtgtgattcatgggaagctgtgactgtcacattcccacctgcagaggacatggcgaagggtgacagccccgtgtgaggccctgcaggtcgcagtttcatttaatcctcagaacataccaccagactggtctttctcaccccatcatgtttaaggaaacagaggctccaagaaatggaggagcat

SEQ ID NO: 201652 - DNA, 601 bp, Human
ccacctgcagaggacatggcgaagggtgacagccccgtgtgaggccctgcaggtcgcagtttcatttaatcctcagaacataccaccagactggtctttctcaccccatcatgtttaaggaaacagaggctccaagaaatggaggagcatagccagcatcatcgtcacagagaaggagaagggtgggctcgggacagtgaagatgcaggctgtcctggccacccttgctttctgcgggctcctgtggggatgatgattttagttattcaagaagacaggtggcgtttcttccaactggtgyttcccacctgggatgtgggggggctccccaaagggagtgttgtcctgccaactggggcctgctgtcccactgccctgccccgctctgaagcacacacagggacccatgcccacacggggttacttgcaccaggacacacacaggcctgacacgcacaggacatgcccttgcatgggaacacacacacagaaacatggagatgcacacagtgagacacacgggcacacacctacccaggccacaggcctgtgtggggttccacgcacgagggcacgctcaggcactcacactcacacaaga

SEQ ID NO: 201653 - DNA, 601 bp, Human
gatgtgggggggctccccaaagggagtgttgtcctgccaactggggcctgctgtcccactgccctgccccgctctgaagcacacacagggacccatgcccacacggggttacttgcaccaggacacacacaggcctgacacgcacaggacatgcccttgcatgggaacacacacacagaaacatggagatgcacacagtgagacacacgggcacacacctacccaggccacaggcctgtgtggggttccacgcacgagggcacgctcaggcactcacactcacacaagaatgaacacaccyggaaacatggagacacacagggacacacagacgcagagcacataggatcttcccctgtgcccttttcatacacagactcccatggccccggggagccaaagtgtggtaccgtccctgtcccggggccactgaggccctggccctctctgtcccacagctccagctgggactgtttgccctagttgagatgctgagccttggggacagtggtttccagccacgtggccttatgccggctttgggatgcagtcaggattgtgaccccggcccacccttgccgtgtgccctggaggacgactc

SEQ ID NO: 201654 - DNA, 601 bp, Human
ggctgggtgcccactaaacacttggcctctctgccacgaggttgtggactcctgagggtagaggcctgtgaatgttacccctctctttctgcgctgcctgggacagagggtggacctccctgaagctctgttttctcattaaggacctgcctacagcctgttgtggggattgggtcaaataattcaggcgatgtgctcgtgcagtgcgctggtcccagcgtggggaaggcttgctgcgacagcctctcctcctgtccctgtaccctcggcacagcgcccaaccctgtgaggtaccaggcakgggtgacttacctagacatgcccattcagcagccccttgagcaagaaggaccgacccttgcctttcagatgcagaccaagatgcagaaaggcacccttctcaggccgcaggtgtccaggcaggtgtcagaggtgcagcccgtgcacaccggggaccctatccatcctgtctagttgggaggactaggagttccacatgtgggaccctcagttcctgctgccttcagaaccaggcccaacccttgctgtgacctcgagggctgccacttttcagagtgcactgggcctgtctccacccata

SEQ ID NO: 201655 - DNA, 601 bp, Human
tggggaaggcttgctgcgacagcctctcctcctgtccctgtaccctcggcacagcgcccaaccctgtgaggtaccaggcatgggtgacttacctagacatgcccattcagcagccccttgagcaagaaggaccgacccttgcctttcagatgcagaccaagatgcagaaaggcacccttctcaggccgcaggtgtccaggcaggtgtcagaggtgcagcccgtgcacaccggggaccctatccatcctgtctagttgggaggactaggagttccacatgtgggaccctcagttcctgctgycttcagaaccaggcccaacccttgctgtgacctcgagggctgccacttttcagagtgcactgggcctgtctccacccatagaccatactgccacatctgtacctcgggcaccaatctctccccaccacaggggcctgtgcctgagatggtccctctacagaaatacctgctcctggcatggctggcttcttgccaattctggatctccagctgccaccccagagaggcactggcttccctgtttaaagagggtccccccatcacccatcttcacagcagactgtttgcttggctgtgtgc

SEQ ID NO: 201656 - DNA, 601 bp, Human
ttcagcagccccttgagcaagaaggaccgacccttgcctttcagatgcagaccaagatgcagaaaggcacccttctcaggccgcaggtgtccaggcaggtgtcagaggtgcagcccgtgcacaccggggaccctatccatcctgtctagttgggaggactaggagttccacatgtgggaccctcagttcctgctgccttcagaaccaggcccaacccttgctgtgacctcgagggctgccacttttcagagtgcactgggcctgtctccacccatagaccatactgccacatctgtacctygggcaccaatctctccccaccacaggggcctgtgcctgagatggtccctctacagaaatacctgctcctggcatggctggcttcttgccaattctggatctccagctgccaccccagagaggcactggcttccctgtttaaagagggtccccccatcacccatcttcacagcagactgtttgcttggctgtgtgccccttcagacccacacccattacctccccctctcccccatcctcccaccctcttccaaaggctgaacacacaggagggattgggaaatttgttgaacaaagaagt

SEQ ID NO: 201657 - DNA, 601 bp, Human; identical to SEQ ID NO: 40368

SEQ ID NO: 201658 - DNA, 601 bp, Human; identical to SEQ ID NO: 40369

SEQ ID NO: 201659 - DNA, 601 bp, Human; identical to SEQ ID NO: 40370

SEQ ID NO: 201660 - DNA, 601 bp, Human; identical to SEQ ID NO: 40371

SEQ ID NO: 201661 - DNA, 601 bp, Human; identical to SEQ ID NO: 40372

SEQ ID NO: 201662 - DNA, 601 bp, Human; identical to SEQ ID NO: 40373

SEQ ID NO: 201663 - DNA, 601 bp, Human; identical to SEQ ID NO: 40374

SEQ ID NO: 201664 - DNA, 601 bp, Human; identical to SEQ ID NO: 40375

SEQ ID NO: 201665 - DNA, 601 bp, Human; identical to SEQ ID NO: 40376

SEQ ID NO: 201666 - DNA, 601 bp, Human; identical to SEQ ID NO: 40377

SEQ ID NO: 201667 - DNA, 601 bp, Human; identical to SEQ ID NO: 40378

SEQ ID NO: 201668 - DNA, 601 bp, Human; identical to SEQ ID NO: 40379

SEQ ID NO: 201669 - DNA, 601 bp, Human; identical to SEQ ID NO: 40380

SEQ ID NO: 201670 - DNA, 601 bp, Human; identical to SEQ ID NO: 40381

SEQ ID NO: 201671 - DNA, 601 bp, Human; identical to SEQ ID NO: 40382

SEQ ID NO: 201672 - DNA, 601 bp, Human; identical to SEQ ID NO: 40383

SEQ ID NO: 201673 - DNA, 601 bp, Human; identical to SEQ ID NO: 40384

SEQ ID NO: 201674 - DNA, 601 bp, Human; identical to SEQ ID NO: 40385

SEQ ID NO: 201675 - DNA, 601 bp, Human; identical to SEQ ID NO: 40386

SEQ ID NO: 201676 - DNA, 601 bp, Human; identical to SEQ ID NO: 40387

SEQ ID NO: 201677 - DNA, 601 bp, Human; identical to SEQ ID NO: 40388

SEQ ID NO: 201678 - DNA, 601 bp, Human
tttgatcattttagacatgttgcttgaatagtacaagggcacaaggagctcagtaaaataacctggtcattgtagctctggacatccctgcagaaagggctgagtggcagctgtgatgagagggggtataagagccacaggggatccatcgaagaagcctttgcagagaccaagagtgccacgacccagcagagacaacaagagagggtgccaggcagtgtgcaaaaggttcaggtgccaggcagccacggaagctccggggaggcatgaagacatgagggttagattgtagcaggtcacstccaccaccctcactgtccatgaagatctggacttggggacactcacatgttcctggcgcacccacacacccaccccctcccctattcaggttcagaaattcctgctgcttgcttcttcccgcaccctcctccatttccccgccaagaagccatgcgcgcacacgcctcggtgtgaagcgcagattcaccaacagcaccgtcagggtgatggaggagagagttaacaccacgcacccacggcagacaactggagagctcggggagcagtttttcctccaagtccctctccctcctgtatc

SEQ ID NO: 201679 - DNA, 601 bp, Human
acaacaagagagggtgccaggcagtgtgcaaaaggttcaggtgccaggcagccacggaagctccggggaggcatgaagacatgagggttagattgtagcaggtcacctccaccaccctcactgtccatgaagatctggacttggggacactcacatgttcctggcgcacccacacacccaccccctcccctattcaggttcagaaattcctgctgcttgcttcttcccgcaccctcctccatttccccgccaagaagccatgcgcgcacacgcctcggtgtgaagcgcagattcaccaacrgcaccgtcagggtgatggaggagagagttaacaccacgcacccacggcagacaactggagagctcggggagcagtttttcctccaagtccctctccctcctgtatcaaccccaaggatcactcttttgtttccttttagatataattcattttttaaagagcggttttaggtttgcagcaaaatggagcagaaagaacagagttcccatgtacctcctgccccccatctcaattatggacatcccactccagggtgggacatgagttacagttgatgagcctgcattaacccatcattac

SEQ ID NO: 201680 - DNA, 601 bp, Human
tcttcccgcaccctcctccatttccccgccaagaagccatgcgcgcacacgcctcggtgtgaagcgcagattcaccaacagcaccgtcagggtgatggaggagagagttaacaccacgcacccacggcagacaactggagagctcggggagcagtttttcctccaagtccctctccctcctgtatcaaccccaaggatcactcttttgtttccttttagatataattcattttttaaagagcggttttaggtttgcagcaaaatggagcagaaagaacagagttcccatgtacctcctgcyccccatctcaattatggacatcccactccagggtgggacatgagttacagttgatgagcctgcattaacccatcattaccacccagagttcatagttgatgttaggtagggttcattcttggtgttacacatgttatgtgttctgacaaacgtggaatgacgtgtatccaccataataatatcttacagaatagtctcaccgccataaaagtgaacctgcatcgacagatcattatctttcagagtccatagaaatatctttttttgagggagagtctcacactgttggccagcctggaa

SEQ ID NO: 201681 - DNA, 601 bp, Human
tgatgttaggtagggttcattcttggtgttacacatgttatgtgttctgacaaacgtggaatgacgtgtatccaccataataatatcttacagaatagtctcaccgccataaaagtgaacctgcatcgacagatcattatctttcagagtccatagaaatatctttttttgagggagagtctcacactgttggccagcctggaatgcagtggcatgatcttggcttactgcagcctccgcctcccggattcaagcaattctcgtgcctcagccttacaagtagctgggatcacaggcatgsaccaccacgccatactatttttcgtatttttagtaggatggggtttcgccatgttggctagttagtctcgtactcctggtctcaagtgatctgcccaccttggcctcccaaagtactgggattacaggtgtgagccaccgtgcccagcccatagaaatatcttaacaagtaccctggcgattgtgaggcaggtggtgtggggatcaccctttgagatgctggtgtaaggagtttggattaagtttgaaaggcagtcggagcttctggaagcatccgggctgggccacggtctcatgccag

SEQ ID NO: 201682 - DNA, 601 bp, Human
aacaagtaccctggcgattgtgaggcaggtggtgtggggatcaccctttgagatgctggtgtaaggagtttggattaagtttgaaaggcagtcggagcttctggaagcatccgggctgggccacggtctcatgccaggggtgcttacaaggaatacttccatgtgtcccaggactaagggaggagggtctcaggcattggtccctctgggccagcaagggcagcagggagagccccggttcagaggacccttcagccataacattgacccgtttgttcacactggacttcccttctccctyggggctgcaggaatttgagatagagctggagggctcccagaccctgaggatactgtgctatgaaaagtgttacaacaagacgaagatccccaaggaggacggcgagagcacggacagactcatggggaagggccaggtccaggtgaggcagccatccctaccctcccctgcccgatgcatggcgtcctttttcatgcagcccctggggacactgagatggtcatggccttgcacccagggtggggtggggtgggcagctgtggctctgaaacatccatcgtgggagacctgagccggtgc

SEQ ID NO: 201683 - DNA, 601 bp, Human
tcccctgcccgatgcatggcgtcctttttcatgcagcccctggggacactgagatggtcatggccttgcacccagggtggggtggggtgggcagctgtggctctgaaacatccatcgtgggagacctgagccggtgcctgcatgtatcttgatgggtcttgacgtaccaccctctgtctgcgtgtctgttgcgtcggctcattcccaaaggaatttccattcaacttggttttgcagctggggcctcagttcctgcccggccttaggagaacccaaggtggaacagttagatggtgtcctrggctgaaattggcccatcctgtgccagtcttcttagaaaagcacaggggtcccagaggctgcctgcaagcacaggggtcccagaggctgcctgcttggcatcccctatctgtggtctagacccaatttctagggtatagagctgtatctctgaacagggtgcacacagacaggtctcctcccaggctaatctggaagcccccaggtgagaccgagaatgtgtccatacaggaccagcaagggggccctggttcttaaggagactgcctgggccctctgtccttcagaagcttgtctagcc

SEQ ID NO: 201684 - DNA, 601 bp, Human
tagtgctggtctcctttgagatccgaagtattttagcatcagtcaaatgacggtcatagtttgggtgatggtcacggctcaggttcttttttacacgtgcttgctttggttgttgttgttgttctttgttttcttgaggcagtatctggctgtgtctcccaggctggcgtgcaatggcaggatcatagctcactgcaacctcaaactcctggctgaagcaatctttgtgccctagcctcccaagttgttgggattacagtcgtgccccaccatgcctggctaagttgttttttgttttttkttttttttttttttttcgagacagagttttgctcttgttgcccaggccggagtgcagtggtgtgatcttggctctctgcaacctcccgggttcaagcgattctcctgcctcagcctcccaaagtgatgggattacaggcctgagccactgtgcctggccacatgtgctttcccattcggtccttgcagcagatctttgagagagctcatttgacactcaggagatgcttctctaacctgctcagaatcagggccctgggtattcagggaggtagagggagcagactgcaaagccagtcgt

SEQ ID NO: 201685 - DNA, 601 bp, Human
ggtctcctttgagatccgaagtattttagcatcagtcaaatgacggtcatagtttgggtgatggtcacggctcaggttcttttttacacgtgcttgctttggttgttgttgttgttctttgttttcttgaggcagtatctggctgtgtctcccaggctggcgtgcaatggcaggatcatagctcactgcaacctcaaactcctggctgaagcaatctttgtgccctagcctcccaagttgttgggattacagtcgtgccccaccatgcctggctaagttgttttttgttttttgttttttktttttttttcgagacagagttttgctcttgttgcccaggccggagtgcagtggtgtgatcttggctctctgcaacctcccgggttcaagcgattctcctgcctcagcctcccaaagtgatgggattacaggcctgagccactgtgcctggccacatgtgctttcccattcggtccttgcagcagatctttgagagagctcatttgacactcaggagatgcttctctaacctgctcagaatcagggccctgggtattcagggaggtagagggagcagactgcaaagccagtcgtgctccca

SEQ ID NO: 201686 - DNA, 601 bp, Human
ttttagtagagacggggtttcaccatgttggccaggctggtctcgaactcctgacctccagtggtccacccgccttggcctcccaaagtgctgggattataggcgtgagctactgcacccagcctcctcacctttaaatcttccccaaatatttgttcaaaacaaacatcactcattttgtgttcctgctgcaacagaccccctggggcctgcccctctccaaggctgttttttgttttttgagacagagtctggctctgtcgcccaggctggagtgcagtggcatgatctcggctcactrcaagctccgcctcctgggttcacgccattctcctgcctcagcctcccgagtagccgggactacaggcgcccgccaccacacccagctaatttcttgtatttttagtagagatggggtttcaccgtggtctcgatctcctgacctcatgatccgccctcctcagcctcccaaagtgctgggattacaggcgtgagccaccacgcctagctccaagactgtttaggggctacgtaagtttctctcctatgggcgcctctgccacatggaccatgtctcattcgtctcggaatgccccccagg

SEQ ID NO: 201687 - DNA, 601 bp, Human
ggattataggcgtgagctactgcacccagcctcctcacctttaaatcttccccaaatatttgttcaaaacaaacatcactcattttgtgttcctgctgcaacagaccccctggggcctgcccctctccaaggctgttttttgttttttgagacagagtctggctctgtcgcccaggctggagtgcagtggcatgatctcggctcactgcaagctccgcctcctgggttcacgccattctcctgcctcagcctcccgagtagccgggactacaggcgcccgccaccacacccagctaatttyttgtatttttagtagagatggggtttcaccgtggtctcgatctcctgacctcatgatccgccctcctcagcctcccaaagtgctgggattacaggcgtgagccaccacgcctagctccaagactgtttaggggctacgtaagtttctctcctatgggcgcctctgccacatggaccatgtctcattcgtctcggaatgccccccaggcacatcacagacccccctgcacgggtgaatggctgtgtggacgagacctacatggccctgagataatccttgaaatacaaatgaggattctcg

SEQ ID NO: 201688 - DNA, 601 bp, Human
ccagcaagacacataaatagagcaggagaaatgggagaagacaaaagtctatgacttgatagaatgttgccctctaaggagaatagacagggctaacatgatttagcaacctagaaaatttgcagatgaagagagatgcacctgtcatcctagcactttgtgaggctgaggagggcggatcatttgacatcaggagttcaagaccggcctgaccaacatggtgaaaccccgtctctactaaaaacacaaaaaaattagccaggcgcgatggcgcatgcctgtagtcccagctactcgggargccaaggtaggagaattgcttgaaccagggaggcagggatttcagtgagccagggtcgtgccactgcactccagcctgggggacagagcgagactatctcaaaaaagacagaaaaaacctgaagaaattcctaatggcagcaaggctccaatttccccagctctgccaactgtggtgactccctctctggcccaggatgtgcaggagcactgggactgtgtctcagggcccccgtccctgttgcgctgcactcggctaggctgcagactagccctccagcaatgtgtcccataccccgtc

SEQ ID NO: 201689 - DNA, 601 bp, Human
ctaacatgatttagcaacctagaaaatttgcagatgaagagagatgcacctgtcatcctagcactttgtgaggctgaggagggcggatcatttgacatcaggagttcaagaccggcctgaccaacatggtgaaaccccgtctctactaaaaacacaaaaaaattagccaggcgcgatggcgcatgcctgtagtcccagctactcgggaagccaaggtaggagaattgcttgaaccagggaggcagggatttcagtgagccagggtcgtgccactgcactccagcctgggggacagagcgaractatctcaaaaaagacagaaaaaacctgaagaaattcctaatggcagcaaggctccaatttccccagctctgccaactgtggtgactccctctctggcccaggatgtgcaggagcactgggactgtgtctcagggcccccgtccctgttgcgctgcactcggctaggctgcagactagccctccagcaatgtgtcccataccccgtcccatgaatcttggatggatgttgatgccttcaccttgaaaaatccctccctgaagatacagattcaatgtcccctgctctgtgaaggcttct

SEQ ID NO: 201690 - DNA, 601 bp, Human
ttgcagatgaagagagatgcacctgtcatcctagcactttgtgaggctgaggagggcggatcatttgacatcaggagttcaagaccggcctgaccaacatggtgaaaccccgtctctactaaaaacacaaaaaaattagccaggcgcgatggcgcatgcctgtagtcccagctactcgggaagccaaggtaggagaattgcttgaaccagggaggcagggatttcagtgagccagggtcgtgccactgcactccagcctgggggacagagcgagactatctcaaaaaagacagaaaaaacytgaagaaattcctaatggcagcaaggctccaatttccccagctctgccaactgtggtgactccctctctggcccaggatgtgcaggagcactgggactgtgtctcagggcccccgtccctgttgcgctgcactcggctaggctgcagactagccctccagcaatgtgtcccataccccgtcccatgaatcttggatggatgttgatgccttcaccttgaaaaatccctccctgaagatacagattcaatgtcccctgctctgtgaaggcttctctgtcccgtgacctcacttcccaagta

SEQ ID NO: 201691 - DNA, 601 bp, Human
cgggcaagtggttcctaaacccagctcatcagcaccattaaggggagcaaaaaaccagaccgggccaagcccccagcccagaagatcccgactcctgctgcccacagacaggcacatgagcagctttgctgaggactcctttccatcccagacccctgcccttggggcctgccagggacctctgccctcatggttggatctggacactcccgggatgctgcggcttctctacctgctgcaactgcctcacctcacgggagggtctctctacgcaacttctgagtcgaggtgcataagcagkgtgggggctgtaggcccctgtagctggctgcagagagccaagcgcctcccacacggtacagcacagaaggctcctggtgtcactgggaaaagcccagattcaaaaaggctgggctccggagtcatgcacatcctctctcaggtatccctgtgcagaaaacagtgtccacgggggagaaagaggccaggctggtgtcgcagagcgccaatggcatagtcaccaccactcctccgacttacttcctcctgggatcccacaaacaagccccccagctgggagcctggacctccagggaccagg

SEQ ID NO: 201692 - DNA, 601 bp, Human
tcctgggatcccacaaacaagccccccagctgggagcctggacctccagggaccagggcagccgccacctacttggcgtgagtcatgaatgcccttcacacagcaatcagattccttcctgtctagccatggttcccacccatcactcccactgacacagggaccaggggctggagccagatagtgcctgctccatcgcctcctcacaaacgacagataaggatgagaacagcagcaaacgctgaccccccacccgtgagagcataagtcactcaaccgtcaaggctgcatggccccccccaccccaatttaattcacctgtgagagggcaagtgcctggctcagcaatttctagtgcatgtaacagtacttgctttgtgccaatatgtattttactatatatatataaactctagatccattaaacaatgtattattacataacttatagaggtatgttttatgtctctgtctgggtactggagataccacagagaatgaactggacaaagccctgtcctccacgtttactttccagcagcagagacaaacataagccaaaataaagatcacgtcacaggggacgtgatgggagtcggag

SEQ ID NO: 201693 - DNA, 601 bp, Human
catcgcctcctcacaaacgacagataaggatgagaacagcagcaaacgctgaccccccacccgtgagagcataagtcactcaaccgtcaaggctgcatggccccccccaccccaatttaattcacctgtgagagggcaagtgcctggctcagcaatttctagtgcatgtaacagtacttgctttgtgccaatatgtattttactatatatatataaactctagatccattaaacaatgtattattacataacttatagaggtatgttttatgtctctgtctgggtactggagataccacaragaatgaactggacaaagccctgtcctccacgtttactttccagcagcagagacaaacataagccaaaataaagatcacgtcacaggggacgtgatgggagtcggaggaggtatggtcaggtaaggcggataccgtcatgaaggcaccaagaatcctcatttgtatttcaaggattatctgagggccacgtaggtcttgtccacacagccattcacccattcaggggggtctctgatgtgcctggggggcattccgagatgaatgagacatgcatggtccatgtggcagaggcaccaata

SEQ ID NO: 201694 - DNA, 601 bp, Human
atgaactggacaaagccctgtcctccacgtttactttccagcagcagagacaaacataagccaaaataaagatcacgtcacaggggacgtgatgggagtcggaggaggtatggtcaggtaaggcggataccgtcatgaaggcaccaagaatcctcatttgtatttcaaggattatctgagggccacgtaggtcttgtccacacagccattcacccattcaggggggtctctgatgtgcctggggggcattccgagatgaatgagacatgcatggtccatgtggcagaggcaccaataggakagaaacttatgtatgtagcctcttaaacagacttggagaggggcaggccccagggggtctcttgcagcaggaacacaaaatgagtgatgtttgttttgaaccaatatttggggaagatatgaagatgtaaacatcatgaaaatgtaagatcacatgagcaaattcttacacagattccacgggattcttcttgaagcacaccgccatcaacatggatagtgatacaggtcctccttgctctattgagagccacttttggaccctttatttttaacttttgtaccatgaaatgcatccatt

SEQ ID NO: 201695 - DNA, 601 bp, Human
ctattgagagccacttttggaccctttatttttaacttttgtaccatgaaatgcatccatttttataaccgaatgattttatagtaaatttacagagctgtacaacttttaccaacaatccagttttagaatatttctatcaccccaatttccttgttgccttttttttttttttttttttttaagacagggtcttgctctgttgcccaggttggagtacagtggtgcaaccacactcagcacaaccttgatgtcccaggctcaagtgctcttcctaccttagcctctcaagtagctgggwccacaggcatgcgccaccatgccaggctattttttttttttttttttttttttgagacaaggtcttgttttgctgcccaagctggtctcaaattcctaggctcaagtgatcctcctgccttggcctcccaaagtgctgagattacaggtgtgaaccaccgtgcccagcccctgttcccagttatagccactcccagacccaagccgatctgctttttgtctttagagatttgcccattcttcacatttcataaacgtggaatcatactagagtgggcttttttgactgatttcctccact

SEQ ID NO: 201696 - DNA, 601 bp, Human
aggagctaagtgaacaagcatttcctcctttggaaggtttactcatagccccctccctgcccctgctgagggtgggtgagaggatgtcctccggctgcccattggtgactcaatccagccacactgactacaaagcaagcagggcagtgctgggcccccagcagagccaccatgcaaagtggtcagtgatgcttcagggcagcacacagcacctgccccagttgggcttcggcctccctcagcccccaccccaccacttccctgggatggatgtgcacgatagttttctaggcagacctcyaggccaccatctgccaggcccgctgaccatagtcattctttcaaggctcctgccttacccagtccagggggagaggagcagcaacctggtccatcctcctgagaccactgcatgtgagcagacagacccctgcctgcccagtccccggccaggcagcaggcatgttcctcaccaagaccttgcaacccagggggaccctggacagcatccggagtgcctcggtttttcccttaagggaaaactgtttcccccttggtcatctgtttttccaaaccccagtcttttgcttgtttacttctc

SEQ ID NO: 201697 - DNA, 601 bp, Human; identical to SEQ ID NO: 40389

SEQ ID NO: 201698 - DNA, 601 bp, Human; identical to SEQ ID NO: 201530

SEQ ID NO: 201699 - DNA, 601 bp, Human; identical to SEQ ID NO: 201529

SEQ ID NO: 201700 - DNA, 601 bp, Human; identical to SEQ ID NO: 201528

SEQ ID NO: 201701 - DNA, 601 bp, Human; identical to SEQ ID NO: 201527

SEQ ID NO: 201702 - DNA, 601 bp, Human; identical to SEQ ID NO: 201526

SEQ ID NO: 201703 - DNA, 601 bp, Human; identical to SEQ ID NO: 201525

SEQ ID NO: 201704 - DNA, 601 bp, Human; identical to SEQ ID NO: 201524

SEQ ID NO: 201705 - DNA, 601 bp, Human; identical to SEQ ID NO: 201523

SEQ ID NO: 201706 - DNA, 601 bp, Human; identical to SEQ ID NO: 201522

SEQ ID NO: 201707 - DNA, 601 bp, Human; identical to SEQ ID NO: 201521

SEQ ID NO: 201708 - DNA, 601 bp, Human; identical to SEQ ID NO: 201520

SEQ ID NO: 201709 - DNA, 601 bp, Human; identical to SEQ ID NO: 201519

SEQ ID NO: 201710 - DNA, 601 bp, Human; identical to SEQ ID NO: 201518

SEQ ID NO: 201711 - DNA, 601 bp, Human; identical to SEQ ID NO: 201517

SEQ ID NO: 201712 - DNA, 601 bp, Human; identical to SEQ ID NO: 201516

SEQ ID NO: 201713 - DNA, 601 bp, Human; identical to SEQ ID NO: 201515

SEQ ID NO: 201714 - DNA, 601 bp, Human; identical to SEQ ID NO: 201514

SEQ ID NO: 201715 - DNA, 601 bp, Human; identical to SEQ ID NO: 201513

SEQ ID NO: 201716 - DNA, 601 bp, Human; identical to SEQ ID NO: 201512

SEQ ID NO: 201717 - DNA, 601 bp, Human; identical to SEQ ID NO: 201511

SEQ ID NO: 201718 - DNA, 601 bp, Human; identical to SEQ ID NO: 201510

SEQ ID NO: 201719 - DNA, 601 bp, Human; identical to SEQ ID NO: 201509

SEQ ID NO: 201720 - DNA, 601 bp, Human; identical to SEQ ID NO: 201508

SEQ ID NO: 201721 - DNA, 601 bp, Human; identical to SEQ ID NO: 201507

SEQ ID NO: 201722 - DNA, 601 bp, Human; identical to SEQ ID NO: 201506

SEQ ID NO: 201723 - DNA, 601 bp, Human; identical to SEQ ID NO: 201505

SEQ ID NO: 201724 - DNA, 601 bp, Human; identical to SEQ ID NO: 201504

SEQ ID NO: 201725 - DNA, 601 bp, Human; identical to SEQ ID NO: 201503

SEQ ID NO: 201726 - DNA, 601 bp, Human; identical to SEQ ID NO: 201502

SEQ ID NO: 201727 - DNA, 601 bp, Human; identical to SEQ ID NO: 201501

SEQ ID NO: 201728 - DNA, 601 bp, Human
aactctgccacttactggctgggagatctgactggcctcagtttcctcatctatccaatggaattaataatacaaagggtcggccaggcacggtggctcacacctgtaatcccagcactttggggggccgaggcaggcaggtggatcacctgaggtctggagtttgagaccagcctgaccaacatggtgaaaccccatctctactaaaaatacaaaaaattagccaggtgtggtggcacatgcctgtaatcccagctacctgggaggctgaggtaggagaattgcttgaactcgggaggckgaggttgcagtgagccaagactgcgccattgcactccagcctgggcaaaaagagcaaaactccgtctcaaaaaataaaaataaataataaataatacaaagggtactgaaaggactgaatgggttaatctctgcaaaggacttggaacgatgcctgccacgtaagtacccgctaaatgctggctgctatcatcactgacactttcatgctcaagtctggctcctgtaccctcttccccagcccactccctaagcaggcaggggcagtatcagtgtcaactttgtgaccctggttttgccc

SEQ ID NO: 201729 - DNA, 601 bp, Human
gaaaccaagtgttgggtcccaggaccccaagaggaatgtgtctcaaaagggctacaggtgacatccctgtcatgtgctgccagaggcatcattaggacagggggcattgagggagataggagagcagagtctagagccagacttgcccggggtttcgatcgtaactctgccacttactggctgggagatctgactggcctcagtttcctcatctatccaatggaattaataatacaaagggtcggccaggcacggtggctcacacctgtaatcccagcactttggggggccgaggcaggcrggtggatcacctgaggtctggagtttgagaccagcctgaccaacatggtgaaaccccatctctactaaaaatacaaaaaattagccaggtgtggtggcacatgcctgtaatcccagctacctgggaggctgaggtaggagaattgcttgaactcgggaggcggaggttgcagtgagccaagactgcgccattgcactccagcctgggcaaaaagagcaaaactccgtctcaaaaaataaaaataaataataaataatacaaagggtactgaaaggactgaatgggttaatctctgcaaag

SEQ ID NO: 201730 - DNA, 601 bp, Human
cccagacatgccaggcggggaaggccagggctgggatggagagaagaggcccagggagctgtaggactccaaagatgtgacagtaacgaacagtcagagcagggaggaaaccaagtgttgggtcccaggaccccaagaggaatgtgtctcaaaagggctacaggtgacatccctgtcatgtgctgccagaggcatcattaggacagggggcattgagggagataggagagcagagtctagagccagacttgcccggggtttcgatcgtaactctgccacttactggctgggagatctgacwggcctcagtttcctcatctatccaatggaattaataatacaaagggtcggccaggcacggtggctcacacctgtaatcccagcactttggggggccgaggcaggcaggtggatcacctgaggtctggagtttgagaccagcctgaccaacatggtgaaaccccatctctactaaaaatacaaaaaattagccaggtgtggtggcacatgcctgtaatcccagctacctgggaggctgaggtaggagaattgcttgaactcgggaggcggaggttgcagtgagccaagactgcgccattgc

SEQ ID NO: 201731 - DNA, 601 bp, Human
gaggtctgcactattctagtagtgcacccactgtctcaggaagcagtgaccacatcaaactgtctcccccacacctggagctcaaattccagaaggggcgacagacaccagagcaatcaataagtaaacaacactgtggattacaaagtgtccacaccagcttccctctggggacaagctgggctctcagagggtgcccctgctcccacctccttcatggagaatgtgagtcactccctccactcagttaggttggctccttgaactttcatctctagcaaacatactttcctctcccttyctagttgctaagtataggggaaaacacagcaaaacacagggacctggggcctgtgattttaaggaggcaagcagggaagtcctcccagagaaggtgatgtttgaaaaggaggtgaaagaggtcagggagtgagcacgtgattctgggaacagaggtggatcagacatggcccctctctgcagggagctaccagcctggggatgatggagtagggcagtggggaacatggggtaaacagaggatcccaatccagtctggcgagggctgatggaagcaaatctagggactgcagaagccccc

SEQ ID NO: 201732 - DNA, 601 bp, Human
agagtagaaaaatgaggcttagagtggtgaagcaatttcctcaaggtcacacagcaggaagtggacgcaggcgctgggcttggagtctgaggtctgcactattctagtagtgcacccactgtctcaggaagcagtgaccacatcaaactgtctcccccacacctggagctcaaattccagaaggggcgacagacaccagagcaatcaataagtaaacaacactgtggattacaaagtgtccacaccagcttccctctggggacaagctgggctctcagagggtgcccctgctcccacctcyttcatggagaatgtgagtcactccctccactcagttaggttggctccttgaactttcatctctagcaaacatactttcctctccctttctagttgctaagtataggggaaaacacagcaaaacacagggacctggggcctgtgattttaaggaggcaagcagggaagtcctcccagagaaggtgatgtttgaaaaggaggtgaaagaggtcagggagtgagcacgtgattctgggaacagaggtggatcagacatggcccctctctgcagggagctaccagcctggggatgatggagtag

SEQ ID NO: 201733 - DNA, 601 bp, Human
ggctgaggcagagttgcttgaacctgggaagtggaggttccagtgagctgagatcatgccactgcactccagcctgggcaacagagatagactccgtctcaaaaaataaaacaaaacaaaccactgtgtgccaggcactgttccaagggcttatttaattttcattacaactcaataaagtagatagtaccatcatccccattgtacagagtagaaaaatgaggcttagagtggtgaagcaatttcctcaaggtcacacagcaggaagtggacgcaggcgctgggcttggagtctgaggtstgcactattctagtagtgcacccactgtctcaggaagcagtgaccacatcaaactgtctcccccacacctggagctcaaattccagaaggggcgacagacaccagagcaatcaataagtaaacaacactgtggattacaaagtgtccacaccagcttccctctggggacaagctgggctctcagagggtgcccctgctcccacctccttcatggagaatgtgagtcactccctccactcagttaggttggctccttgaactttcatctctagcaaacatactttcctctccctttctagt

SEQ ID NO: 201734 - DNA, 601 bp, Human
tagaccagcctggctaacatagcaaaacctcgtttctactaaaaatacaaaaattagccaggcgtggtggctcacacgtgtaatcccagctactcaggaggctgaggcagagttgcttgaacctgggaagtggaggttccagtgagctgagatcatgccactgcactccagcctgggcaacagagatagactccgtctcaaaaaataaaacaaaacaaaccactgtgtgccaggcactgttccaagggcttatttaattttcattacaactcaataaagtagatagtaccatcatccccaytgtacagagtagaaaaatgaggcttagagtggtgaagcaatttcctcaaggtcacacagcaggaagtggacgcaggcgctgggcttggagtctgaggtctgcactattctagtagtgcacccactgtctcaggaagcagtgaccacatcaaactgtctcccccacacctggagctcaaattccagaaggggcgacagacaccagagcaatcaataagtaaacaacactgtggattacaaagtgtccacaccagcttccctctggggacaagctgggctctcagagggtgcccctgctccc

SEQ ID NO: 201735 - DNA, 601 bp, Human
tcacagtggctcacacctgtaatcccagcacgttgggaggctgaggcgggtggattacctgaggtcaggaggtctagaccagcctggctaacatagcaaaacctcgtttctactaaaaatacaaaaattagccaggcgtggtggctcacacgtgtaatcccagctactcaggaggctgaggcagagttgcttgaacctgggaagtggaggttccagtgagctgagatcatgccactgcactccagcctgggcaacagagatagactccgtctcaaaaaataaaacaaaacaaaccactgtrtgccaggcactgttccaagggcttatttaattttcattacaactcaataaagtagatagtaccatcatccccattgtacagagtagaaaaatgaggcttagagtggtgaagcaatttcctcaaggtcacacagcaggaagtggacgcaggcgctgggcttggagtctgaggtctgcactattctagtagtgcacccactgtctcaggaagcagtgaccacatcaaactgtctcccccacacctggagctcaaattccagaaggggcgacagacaccagagcaatcaataagtaaacaaca

SEQ ID NO: 201736 - DNA, 601 bp, Human
ttatgttttgaataaatgactaactaaacatccattactactactcccaataaaaacacttattgcagctggtcacagtggctcacacctgtaatcccagcacgttgggaggctgaggcgggtggattacctgaggtcaggaggtctagaccagcctggctaacatagcaaaacctcgtttctactaaaaatacaaaaattagccaggcgtggtggctcacacgtgtaatcccagctactcaggaggctgaggcagagttgcttgaacctgggaagtggaggttccagtgagctgagatcrtgccactgcactccagcctgggcaacagagatagactccgtctcaaaaaataaaacaaaacaaaccactgtgtgccaggcactgttccaagggcttatttaattttcattacaactcaataaagtagatagtaccatcatccccattgtacagagtagaaaaatgaggcttagagtggtgaagcaatttcctcaaggtcacacagcaggaagtggacgcaggcgctgggcttggagtctgaggtctgcactattctagtagtgcacccactgtctcaggaagcagtgaccacatcaaact

SEQ ID NO: 201737 - DNA, 601 bp, Human
ccagcctttctcctggggtcttgaaagaggccctgaaggttaagcttcatcagcttcctgtaaaatgtgcccctgaacaggacagggtgttactgagttgccaaatacctattaaaatgttagatacacgcacatacccagaaacatacacacagccggacacacatacacacacacacacacacacacacacacacacacacacgaatacactctgagcacagcatttgttatgttttgaataaatgactaactaaacatccattactactactcccaataaaaacacttattgcagctrgtcacagtggctcacacctgtaatcccagcacgttgggaggctgaggcgggtggattacctgaggtcaggaggtctagaccagcctggctaacatagcaaaacctcgtttctactaaaaatacaaaaattagccaggcgtggtggctcacacgtgtaatcccagctactcaggaggctgaggcagagttgcttgaacctgggaagtggaggttccagtgagctgagatcatgccactgcactccagcctgggcaacagagatagactccgtctcaaaaaataaaacaaaacaaaccactg

SEQ ID NO: 201738 - DNA, 601 bp, Human
cactctgttggctaggatggtcttgaactcctgacctcgtgatccacccacctcagcctcccaaagtgtgtgtttacaggcgtgagccaccaggcccagcctttctcctggggtcttgaaagaggccctgaaggttaagcttcatcagcttcctgtaaaatgtgcccctgaacaggacagggtgttactgagttgccaaatacctattaaaatgttagatacacgcacatacccagaaacatacacacagccggacacacatacacacacacacacacacacacacacacacacacacactaatacactctgagcacagcatttgttatgttttgaataaatgactaactaaacatccattactactactcccaataaaaacacttattgcagctggtcacagtggctcacacctgtaatcccagcacgttgggaggctgaggcgggtggattacctgaggtcaggaggtctagaccagcctggctaacatagcaaaacctcgtttctactaaaaatacaaaaattagccaggcgtggtggctcacacgtgtaatcccagctactcaggaggctgaggcagagttgcttgaacctgggaag

SEQ ID NO: 201739 - DNA, 601 bp, Human
agctaatttttgtatttttagtagagacagagtttcactctgttggctaggatggtcttgaactcctgacctcgtgatccacccacctcagcctcccaaagtgtgtgtttacaggcgtgagccaccaggcccagcctttctcctggggtcttgaaagaggccctgaaggttaagcttcatcagcttcctgtaaaatgtgcccctgaacaggacagggtgttactgagttgccaaatacctattaaaatgttagatacacgcacatacccagaaacatacacacagccggacacacatacayacacacacacacacacacacacacacacacacacgaatacactctgagcacagcatttgttatgttttgaataaatgactaactaaacatccattactactactcccaataaaaacacttattgcagctggtcacagtggctcacacctgtaatcccagcacgttgggaggctgaggcgggtggattacctgaggtcaggaggtctagaccagcctggctaacatagcaaaacctcgtttctactaaaaatacaaaaattagccaggcgtggtggctcacacgtgtaatcccagctactc

SEQ ID NO: 201740 - DNA, 601 bp, Human
tttgtgagacggagtctccctctgtcacccaggctggagtgcagtggcacgatctcggttcactgcaacctccgcctccctggttcaagcgattcttctgcctcagccccccgagtagctgggactacgggcacgcgccgccatgcccagctaatttttgtatttttagtagagacagagtttcactctgttggctaggatggtcttgaactcctgacctcgtgatccacccacctcagcctcccaaagtgtgtgtttacaggcgtgagccaccaggcccagcctttctcctggggtcttraaagaggccctgaaggttaagcttcatcagcttcctgtaaaatgtgcccctgaacaggacagggtgttactgagttgccaaatacctattaaaatgttagatacacgcacatacccagaaacatacacacagccggacacacatacacacacacacacacacacacacacacacacacacacgaatacactctgagcacagcatttgttatgttttgaataaatgactaactaaacatccattactactactcccaataaaaacacttattgcagctggtcacagtggctcacacctgta

SEQ ID NO: 201741 - DNA, 601 bp, Human
acgagagggtgtggctggtcggggttgggccccgagatggaaacacgttttctgggcctggagtttctatcctgtggggtcatctctaagaaaatgaatcccagataatgaatacaaaattgcccagcctctcctgggttttttttttttttttttttttgtgagacggagtctccctctgtcacccaggctggagtgcagtggcacgatctcggttcactgcaacctccgcctccctggttcaagcgattcttctgcctcagccccccgagtagctgggactacgggcacgcgccgccaygcccagctaatttttgtatttttagtagagacagagtttcactctgttggctaggatggtcttgaactcctgacctcgtgatccacccacctcagcctcccaaagtgtgtgtttacaggcgtgagccaccaggcccagcctttctcctggggtcttgaaagaggccctgaaggttaagcttcatcagcttcctgtaaaatgtgcccctgaacaggacagggtgttactgagttgccaaatacctattaaaatgttagatacacgcacatacccagaaacatacacacagccggacacaca

SEQ ID NO: 201742 - DNA, 601 bp, Human
gaaaacctgaagaaacaccaggcgctcccagacgagagggtgtggctggtcggggttgggccccgagatggaaacacgttttctgggcctggagtttctatcctgtggggtcatctctaagaaaatgaatcccagataatgaatacaaaattgcccagcctctcctgggttttttttttttttttttttttgtgagacggagtctccctctgtcacccaggctggagtgcagtggcacgatctcggttcactgcaacctccgcctccctggttcaagcgattcttctgcctcagccccccragtagctgggactacgggcacgcgccgccatgcccagctaatttttgtatttttagtagagacagagtttcactctgttggctaggatggtcttgaactcctgacctcgtgatccacccacctcagcctcccaaagtgtgtgtttacaggcgtgagccaccaggcccagcctttctcctggggtcttgaaagaggccctgaaggttaagcttcatcagcttcctgtaaaatgtgcccctgaacaggacagggtgttactgagttgccaaatacctattaaaatgttagatacacgcacat

SEQ ID NO: 201743 - DNA, 601 bp, Human
aagtgctgagattacacgtgtgggccaccgcgcccggcccacgcctggctaatttttttatttttagtagagatggggtttcgtcatgttggccaggctggtctcgaactcctgacctcaggtgatccgcccacctcggcctcccaaaatgctggaattacaggtgtgagccaccacgcccggcccaagagggattttataaagtgattttcgacagctcttcctgaacccctgacacagctcaaggacttgtgtggttctgtcctctaggcttttctgtcaagcgagtccctgggcacgygctagggcactcagcaagcaggacagccaaggccagggagccaccccagtgacagatcactaactcggcggggggcagacagagaactcgtccctgaggtgacatgtgagccccacgtgtgccctgtcagacaaggtggccttgctgagagcaggaggggcaagtgcgtggagcccaaagaggaaaacctgaagaaacaccaggcgctcccagacgagagggtgtggctggtcggggttgggccccgagatggaaacacgttttctgggcctggagtttctatcctgtggggtcatctct

SEQ ID NO: 201744 - DNA, 601 bp, Human
cacacctgtaatcccagcactttgtggggctgaggtgggtggatcacttgtggtcaggagttcgagaccagcctggccaacatggtaaaaccccatctctactaaaaatacaaaaattagtcgagcgttttagcacatgcctgtaattccagctagttgggaggctgagggaggagaatcacttgaacccgggaggtggaggttgcagtgagcagggatcacatcaatgcactccagcctgggtgacagaccagattctatctcaaaaaaaaaaaaagaaaagaaaaaaaaaatttttttwaaagcagcactgacccatgcagacaacgagtcaagggttttatatgcattaactcgtttgaccatcctagtagcctgtgaggttggttactgccattacctctcattttacagatgaggcaactgaggcacagagaggccaagtaccttggccagggtcactgagcatggaagtggcaggaccacgggtctaaccccaaatctgtcttgggaactgtgagactctgaaagaggctacgtgtgcccacggtgttaggagagccagtcttcctatttgttgtccactgcaggcaagagggat

SEQ ID NO: 201745 - DNA, 601 bp, Human
caggtcatggtggcgtgcacctgtagtcccagctactgaggaggctgaggtgggaggacggcttgaacccaggagggtcgaggctgcagcgagctgtgactgtaccactctagcctgggtgacagagctagaccttgtctcaaaaagaaaaaaaaaaagttttataattgaggtaaatcattcagcattaagtgctggctttctcttaaagagacgacatatccaccaatatcaaaaacagcctcaaagctgggcgtggcggctcacacctgtaatcccagcactttgtggggctgaggtrggtggatcacttgtggtcaggagttcgagaccagcctggccaacatggtaaaaccccatctctactaaaaatacaaaaattagtcgagcgttttagcacatgcctgtaattccagctagttgggaggctgagggaggagaatcacttgaacccgggaggtggaggttgcagtgagcagggatcacatcaatgcactccagcctgggtgacagaccagattctatctcaaaaaaaaaaaaagaaaagaaaaaaaaaatttttttaaaagcagcactgacccatgcagacaacgagtcaagg

SEQ ID NO: 201746 - DNA, 601 bp, Human
tgactcctgaggagaaagggtaagaactttccagacacacacacacacacgcacgcacacacacctgaggaaacaaactagctcatcttctcaattaagcttgagttgattttaagcttcaaaaacagtttagttatattacataagtcaggaaacaatggtagggctgaaaaatgatagcttgtttgttttttaaataatgatggctcatgcctgtaatcccagcaccttaggagactgaggaaggaggatcactggagcccaggatttcaagaccagcctgggcaacatagagagactycatctctaccaaaaaacaaaattagcaggtcatggtggcgtgcacctgtagtcccagctactgaggaggctgaggtgggaggacggcttgaacccaggagggtcgaggctgcagcgagctgtgactgtaccactctagcctgggtgacagagctagaccttgtctcaaaaagaaaaaaaaaaagttttataattgaggtaaatcattcagcattaagtgctggctttctcttaaagagacgacatatccaccaatatcaaaaacagcctcaaagctgggcgtggcggctcacacctgtaa

SEQ ID NO: 201747 - DNA, 601 bp, Human
ggccttttttcttaaaaaaaaaaacacaacataggagttgcccctttaagacagaaaagaacctcatccacccatcagtaagaggccccaagcttcttgctgtgagtcagggaggcttctgaagggcctcaagccacatcttgctcttgctctggcagaactcccagccctaagctcctgattcccaggctcctgactcctgaggagaaagggtaagaactttccagacacacacacacacacgcacgcacacacacctgaggaaacaaactagctcatcttctcaattaagcttgagttrattttaagcttcaaaaacagtttagttatattacataagtcaggaaacaatggtagggctgaaaaatgatagcttgtttgttttttaaataatgatggctcatgcctgtaatcccagcaccttaggagactgaggaaggaggatcactggagcccaggatttcaagaccagcctgggcaacatagagagacttcatctctaccaaaaaacaaaattagcaggtcatggtggcgtgcacctgtagtcccagctactgaggaggctgaggtgggaggacggcttgaacccaggagggtcgag

SEQ ID NO: 201748 - DNA, 601 bp, Human
tagacaacgtgaccagtgaccctgacctatttcacaaatgccactgcagtgtaagggtcagtgaccaatactgaccctgcctacacacacaccatactctgacattttctaccctttttcggaaaaatgccagccctctgcctggatgtcatgatcacacatggtcacaacctaatttggaaaacaccagcatgaaagacctctttgctaaacagacaagggaggtaagggaggtgggtggcaaaccccacccatttgcttctgcacatcatttttgtctctcctgggccccactgtgtgyctggctctgagctggatcctggggacaccatcatgtgccagggagagaggcttccggtgtagaccagggtgtagcgtgaaccactaaccactctcctattagtttctctcggctgccgtaacaaatcaccatatatttggtggcttagaatcttacagctctggaggccagaagtccaaagtcagtgtcaccagggtgagaccaaggggtctgcaggccccgggaggaacacgtttcttgcctcctccagcttctgctgacactccctggcttgtggctgcatcgctttatcttcaatgc

SEQ ID NO: 201749 - DNA, 601 bp, Human
tctcagcaaactatcgcaaggacagaaaaccaaacactgcatgttctcactcataggtgggaattgaacaatgagaacacatggacacaggaaggggaacatcacacaccggggactgtcgtggggtggggggaggggggagggatagcattaggagatatacctaatgctaaaggacgagttactgggtgcagcacaccaacatggcacatgtaaacacatgtaacaaacctgtacgttgtgcacatgtatcctaaaacttaaagtataataataaaaaataaataaataaataattttwaaaaaaaaaagcttttggaatcaactgtaaaaatggcaacccgcttgggcttccctctcctctgtggagagctttcttcttttgcttattaaactttcgctccaacctcaccttttgggtggtctatgctctttaattctcttggttgtgaaacgagctcggataacaccttagacaacgtgaccagtgaccctgacctatttcacaaatgccactgcagtgtaagggtcagtgaccaatactgaccctgcctacacacacaccatactctgacattttctaccctttttcggaaaaatg

SEQ ID NO: 201750 - DNA, 601 bp, Human
ttctcagcaaactatcgcaaggacagaaaaccaaacactgcatgttctcactcataggtgggaattgaacaatgagaacacatggacacaggaaggggaacatcacacaccggggactgtcgtggggtggggggaggggggagggatagcattaggagatatacctaatgctaaaggacgagttactgggtgcagcacaccaacatggcacatgtaaacacatgtaacaaacctgtacgttgtgcacatgtatcctaaaacttaaagtataataataaaaaataaataaataaataatttwtaaaaaaaaaagcttttggaatcaactgtaaaaatggcaacccgcttgggcttccctctcctctgtggagagctttcttcttttgcttattaaactttcgctccaacctcaccttttgggtggtctatgctctttaattctcttggttgtgaaacgagctcggataacaccttagacaacgtgaccagtgaccctgacctatttcacaaatgccactgcagtgtaagggtcagtgaccaatactgaccctgcctacacacacaccatactctgacattttctaccctttttcggaaaaat

SEQ ID NO: 201751 - DNA, 601 bp, Human
aaataccatttgacccagccatcctattactgggtatatacccaaaggattataaatcatgctgctataaagacacatgcacacatatgtttattgcgggcactattcacaatagtaaagacttggaaccaacccaaatgtccaacaatgatagactggattaagaaaatgtggcacatatacaccatggaatactatgcagccataaacaatgatgagttcatgtcctttgtagggacatggatgaagctggaaaccatcattctcagcaaactatcgcaaggacagaaaaccaaacacygcatgttctcactcataggtgggaattgaacaatgagaacacatggacacaggaaggggaacatcacacaccggggactgtcgtggggtggggggaggggggagggatagcattaggagatatacctaatgctaaaggacgagttactgggtgcagcacaccaacatggcacatgtaaacacatgtaacaaacctgtacgttgtgcacatgtatcctaaaacttaaagtataataataaaaaataaataaataaataatttttaaaaaaaaaagcttttggaatcaactgtaaaaatggc

SEQ ID NO: 201752 - DNA, 601 bp, Human
tgtaaactagttcaaccattgtggaagtcggtgtggtgattcctcagggatctagaactagaaataccatttgacccagccatcctattactgggtatatacccaaaggattataaatcatgctgctataaagacacatgcacacatatgtttattgcgggcactattcacaatagtaaagacttggaaccaacccaaatgtccaacaatgatagactggattaagaaaatgtggcacatatacaccatggaatactatgcagccataaacaatgatgagttcatgtcctttgtagggacrtggatgaagctggaaaccatcattctcagcaaactatcgcaaggacagaaaaccaaacactgcatgttctcactcataggtgggaattgaacaatgagaacacatggacacaggaaggggaacatcacacaccggggactgtcgtggggtggggggaggggggagggatagcattaggagatatacctaatgctaaaggacgagttactgggtgcagcacaccaacatggcacatgtaaacacatgtaacaaacctgtacgttgtgcacatgtatcctaaaacttaaagtataataataa

SEQ ID NO: 201753 - DNA, 601 bp, Human
ctggcactgtgcaggcccacagctgacggcgatgacctccttcaccagcttcttctccttgagccgcacagcctcctccaccgcgatctcacagaaggggttcatggagtgcttcacaccatccgtgaccacaccggtcctgtcaggcttcactcggatctgcccagcaggaggggaaggggtggggtcaggaggaaacaggcaagaaggtgggggcctcagcgccaaccctctcccaggctggatgaggacaacgacagcctggaaaggggcagggccttgtccggggtcacacagctcyagggacagaactgggttagagtttgtaggcaggggcaggtcaccctgtctccttctctcatccagccattcctgggtaccagggacatctgacttgatcatccctactgttgtcactgctcctctcaggcctgaaagagtgtttctcaaatttacagtatttatggtaacccacagtgagaggtacattttactgtatctccaagtgtatataaatacataatacactgatacataaatacaaatgaggagaagaaaaggaaaaaccagttaggtagacagttaagggtggtcctcagag

SEQ ID NO: 201754 - DNA, 601 bp, Human
ctgctcatagaactcccatagctccccagtgccctccaaaattctcaagtctttgtttcaagcccaggcctgtctcctgaacctgcatcgatgtctcctgggctcttcacactccccttgtaggatcctcctctaacctcctgttcttcctgggtttcctacctgtgttaccaaggcagacccaggcactgtccttgcctcctccctgccctccctccccatgctaagcccagtctctcctgccacatcatgtctctgctctgtcctgtcacctttggctgaggcctcattctcccccacrtgaccatcacctcggcctcccagcctctaaactcacccaaaaggatctttcttctttttttctttttgagacagagtctcgctctgctcccaggcaggagtgcagtggtgcctggagtgcagtggtgcgatcttgtatcactgcaacctccgcctcccaggttccagtgattctcatgcctcagcctcccaagtagctgggattacaggcaggtgataccacacccggctaatttttatatttttagaagagatggggtttcaccatgttggccacgctaatctcaaactctcgacctca

SEQ ID NO: 201755 - DNA, 601 bp, Human
ataagcagccacttgtccagggacatgtggggccatctggcatccctgtcgtcaagtctctgccctctgtataaagcctctcaggagtcccaccctatgtggcccctgggcagctgcatgaacagggtctgggccagcaaggacattctagccccagcccagtgattggttcagggaggggcacatgactcaagctgcaccaaagaagagtcagccctgggagtttgctggggcccttgggaaagatgctcctttctttctgctggggtcactgggctggtgggatctgagcctggagatrcagacagtgaagacaaggtagaggggagcctacagctcatatgtgaccctggatcaagctgtgcctgaagcccctgatttacgtgagataataaattcgctttctggcttaagccagtttgagttgtgaatctgcttcctagaacaaacagcatcctgaccagttcatccggcatttccccagctggaggccctggccccaggaactgtccctggcccaggacaggtaggacatcggagtctgagaacgaccagcaatgcagggggctgcaaaggccatgcttccagcacctcggcctct

SEQ ID NO: 201756 - DNA, 601 bp, Human
aggcatgagtcaccgcagccagtcgggttggcaaaccttttctatggtggaacagatgtagtaaatatctcaggctctgcaggtcatacggtctctgtcacggtgactcagcgctgctgttgtagcacacaggcagccataaataatatgtaaatgaatgtatgtggtgatgttccaataaagctttatttacaaatcagaggtcgctctgggccatagttcactgacttttggtctagaacgatcccctcacttgggcccagagataagcagccacttgtccagggacatgtggggccayctggcatccctgtcgtcaagtctctgccctctgtataaagcctctcaggagtcccaccctatgtggcccctgggcagctgcatgaacagggtctgggccagcaaggacattctagccccagcccagtgattggttcagggaggggcacatgactcaagctgcaccaaagaagagtcagccctgggagtttgctggggcccttgggaaagatgctcctttctttctgctggggtcactgggctggtgggatctgagcctggagatacagacagtgaagacaaggtagaggggagcctacag

SEQ ID NO: 201757 - DNA, 601 bp, Human
aagcaattctcctccctcagccccctgagtagctgagactacaggcgcacgccaccacacccagctaatttttaaatttttagtggagacgaggtttcaacatgttgaccaggctggtctcaaactcctcctgacctcaagtaatccacctgcctcggcctcccaaagtgctgggattacaggcatgagtcaccatgcctggccccagcctgcatttctattggactggcagagatggggactggggaacctggagttgagcgggtgggcatgagtatttcacgtaggatggcaaggaagkcccctttgaagaggtgatacctcagcagagacctcaaggaggggaacaagaaagccatgaggcaatctgagggaacagtgttccaggaggagagaacagcaaatgcaaaggccttgaggcagaaatgaagtttgagggatgagggcctggccctcagcaggtgctccccactccagtctcacctgtggccagtcaagaaatccagctgtcatctgccctgtctggttacagtcatcatcgatggcctgaatggggagagacagaagactgtatgacaatcagtggagctcatggaccatt

SEQ ID NO: 201758 - DNA, 601 bp, Human
gttcaagcaattctcctccctcagccccctgagtagctgagactacaggcgcacgccaccacacccagctaatttttaaatttttagtggagacgaggtttcaacatgttgaccaggctggtctcaaactcctcctgacctcaagtaatccacctgcctcggcctcccaaagtgctgggattacaggcatgagtcaccatgcctggccccagcctgcatttctattggactggcagagatggggactggggaacctggagttgagcgggtgggcatgagtatttcacgtaggatggcaagraaggcccctttgaagaggtgatacctcagcagagacctcaaggaggggaacaagaaagccatgaggcaatctgagggaacagtgttccaggaggagagaacagcaaatgcaaaggccttgaggcagaaatgaagtttgagggatgagggcctggccctcagcaggtgctccccactccagtctcacctgtggccagtcaagaaatccagctgtcatctgccctgtctggttacagtcatcatcgatggcctgaatggggagagacagaagactgtatgacaatcagtggagctcatggac

SEQ ID NO: 201759 - DNA, 601 bp, Human
tgtgctgtaaatataaaatacatgctgaattttgaagatttagtacaaagaaaatccaaaaaacgtaaaatacagatggtccctgacttgtgatggtttgaattaagatttttcagttttccgatgatgtgacagtgataaacattcagtagaaaccatactgccagtgtccgtacaaccattccgtttttttagttccagtacagtatttgataaattacatgggatatttagcactttattataaaatgtgctttatgttagattattttaccccactgtaggctaacgttaagtgttktgacatgtttaaggtaggctgggctcagctatgatatttggtagattaagaatattaaatgcattctctcagttataatattttcaatttatgatggatttatcaggacgtaaccccattgcttgtagagcatatgtatcttaatatttttatgttgattacatgttaaaataatattttagatataatggggtgagataaaatataattttgtctgtttctttttacttttttatgtagctgtgaaaaattttaaatttgtctatgtgccttgcttctttttttttttttttttttgag

SEQ ID NO: 201760 - DNA, 601 bp, Human
aggggccaaggcgggtggatcacttgaggtcaggagttcaagaccagcctggccaacatggtgaaaccctgtctctactaaaaatacaaaaattatccaggtatggtgatgcacgcttgtaatccgatctactcgggaggctgaggcaggagaatcgcttaaattcgggaggcggaggctgcagtgagccaagatcgcgccactgcactccagcctggggacagaacaagactccacctcaaaaaaataaaaataaataaatactgagaattcaagacacattatcatgattgtggtgatratttcatggatgtaacacatatcaaaacttaaattttggagggctgaggtgagcagcttgcttgagcccaggagttaaagaccagcttgggcaacatagtgagacccccatctctatctaaataaaagagtttaagaaaagcaaacttaacaaattgtgcaacttagatatgtgcggtttattgtaggtaaataacgaagctgttttaaaaaaaaacaaaaacaaacaaacaaacaaaaaaacacagatacccaatgcagttactggaaatgcagttactagaaaacttttaagtttgtt

SEQ ID NO: 201761 - DNA, 601 bp, Human
taaatttaaatactgataatttggccaggcgcagtggctcatgcctgtaatcccagcactttgaggggccaaggcgggtggatcacttgaggtcaggagttcaagaccagcctggccaacatggtgaaaccctgtctctactaaaaatacaaaaattatccaggtatggtgatgcacgcttgtaatccgatctactcgggaggctgaggcaggagaatcgcttaaattcgggaggcggaggctgcagtgagccaagatcgcgccactgcactccagcctggggacagaacaagactccacytcaaaaaaataaaaataaataaatactgagaattcaagacacattatcatgattgtggtgatgatttcatggatgtaacacatatcaaaacttaaattttggagggctgaggtgagcagcttgcttgagcccaggagttaaagaccagcttgggcaacatagtgagacccccatctctatctaaataaaagagtttaagaaaagcaaacttaacaaattgtgcaacttagatatgtgcggtttattgtaggtaaataacgaagctgttttaaaaaaaaacaaaaacaaacaaacaaacaa

SEQ ID NO: 201762 - DNA, 601 bp, Human
gcaagaagggcgcacgttggagaagctagtcagacagtggtaaatgctttgaagataaaacaggataatggttttgaatgtgttgtcccatccagtagccactggctgcgtgtggctgtccagccagtgcagctgaggaatgaatttttacattttatttaaatttaaatactgataatttggccaggcgcagtggctcatgcctgtaatcccagcactttgaggggccaaggcgggtggatcacttgaggtcaggagttcaagaccagcctggccaacatggtgaaaccctgtctctacyaaaaatacaaaaattatccaggtatggtgatgcacgcttgtaatccgatctactcgggaggctgaggcaggagaatcgcttaaattcgggaggcggaggctgcagtgagccaagatcgcgccactgcactccagcctggggacagaacaagactccacctcaaaaaaataaaaataaataaatactgagaattcaagacacattatcatgattgtggtgatgatttcatggatgtaacacatatcaaaacttaaattttggagggctgaggtgagcagcttgcttgagcccaggagttaa

SEQ ID NO: 201763 - DNA, 601 bp, Human
ccccccgtgaggcccctccgctgggcagacaacagaactgtgtgtgtccacaccagtccttaaaccaccttctgggaccccgtcctctagccaggtccctttgcctctcagtcctgaatcaacatttcctcccctggtaactgatgccacctacactcctctttgtctaacgacctttgtccctgtccacttattaactggacacatttttcaggtcttagtgtgaacatcacctcccttcattcacaacctcctcctagtgcccttatgaacctgcccctggagacacactgtgaacacraccagtgaagcaccagcttgggtgggctcatattctgccagggaagacaaccagtcaccagggaaaaacacacacacacaaatgagatcatttccaatcagaaggaataagaagaaaataagacacatgatatgagagcaagaagggcgcacgttggagaagctagtcagacagtggtaaatgctttgaagataaaacaggataatggttttgaatgtgttgtcccatccagtagccactggctgcgtgtggctgtccagccagtgcagctgaggaatgaatttttacattttatttaaa

SEQ ID NO: 201764 - DNA, 601 bp, Human
gggaggcgaatgtgccctggggagggacagtgtaggaggagagtgggtgaggctaattcaggtccgacccgagcagtctgcttatgccactactgagtacacgcatggactagtgaatgaatgagggagcgaacaatgcagggtcccatgaggtttagaatcgagcttgtacacctgggagagggtctctttcctttccctgagagccacggtgtatgtcctgatgtcccatgtcctgatgctgccagtgaggcctccctgccttcctgacagggaacatgtactgagtgctgagccctgygctaagcaactgatgtatcaagtcatcgaatcctcgcaggaactttatgaggtaaatgttattatccccactttacagatgagagaaactgaggcagcaagatgctgagttacacgcccactgccacccacagctggtaaatccaaaagctgacaatctggctcccaacggccccccgtgaggcccctccgctgggcagacaacagaactgtgtgtgtccacaccagtccttaaaccaccttctgggaccccgtcctctagccaggtccctttgcctctcagtcctgaatcaacatttcc

SEQ ID NO: 201765 - DNA, 601 bp, Human
tcgttgagcctcaggtcagctgtcaccacagctggcagcttcaggcgcagggtctccaggcccccatcgatctcccgctccactttcaacttgtccccctccagcatcacctgggaggcgaatgtgccctggggagggacagtgtaggaggagagtgggtgaggctaattcaggtccgacccgagcagtctgcttatgccactactgagtacacgcatggactagtgaatgaatgagggagcgaacaatgcagggtcccatgaggtttagaatcgagcttgtacacctgggagagggtctytttcctttccctgagagccacggtgtatgtcctgatgtcccatgtcctgatgctgccagtgaggcctccctgccttcctgacagggaacatgtactgagtgctgagccctgcgctaagcaactgatgtatcaagtcatcgaatcctcgcaggaactttatgaggtaaatgttattatccccactttacagatgagagaaactgaggcagcaagatgctgagttacacgcccactgccacccacagctggtaaatccaaaagctgacaatctggctcccaacggccccccgtgaggcccct

SEQ ID NO: 201766 - DNA, 601 bp, Human
ggaactcctgccacccttcctgccacctccttcccatgggtgccaggcctgcagaccagtcccatgggctgaaccctctggacccacccactggccaggacacgcgaaacttctcacagggccacacctggtgtggacaactcctgctggctagggggccctggggggcccaactactgcagcagtcctcctttaggtaaccaaatcaggaagcccttcactggctgcaacagagtggcaaacccatccttttggtagtaatgactcagtggacttttggttgagatggcatgctgaaggytcccaataggctgagatgatgcactgaaccctccctatagactgagatgatgcgctgaaccctccctataggctgagatgatgcgctgaaccctccctataggctgagatgatgcgctgaaccctccctataggctgagatgatgcgctgaaccctccctataggctgagatgatgcgctgaaccctccctataggctgagatgatgcgctgaaccctccctataggctgagatgatgcgctgaaccctccctataggctgagatgatgcgctgaaccctccctataggctgagatgatg

SEQ ID NO: 201767 - DNA, 601 bp, Human
gcgctggggcgggtcctccacactgatcacagagagcttggaggtcaggtccacacccaggtccccaggcttgatcacctcgatcttcttcttcttggctttctgcacatgggaagccattgttcacagggctgtggaactcctgccacccttcctgccacctccttcccatgggtgccaggcctgcagaccagtcccatgggctgaaccctctggacccacccactggccaggacacgcgaaacttctcacagggccacacctggtgtggacaactcctgctggctagggggccctgggrggcccaactactgcagcagtcctcctttaggtaaccaaatcaggaagcccttcactggctgcaacagagtggcaaacccatccttttggtagtaatgactcagtggacttttggttgagatggcatgctgaaggttcccaataggctgagatgatgcactgaaccctccctatagactgagatgatgcgctgaaccctccctataggctgagatgatgcgctgaaccctccctataggctgagatgatgcgctgaaccctccctataggctgagatgatgcgctgaaccctccctatagg

SEQ ID NO: 201768 - DNA, 601 bp, Human
cgccggccgtgcgctggggcgggtcctccacactgatcacagagagcttggaggtcaggtccacacccaggtccccaggcttgatcacctcgatcttcttcttcttggctttctgcacatgggaagccattgttcacagggctgtggaactcctgccacccttcctgccacctccttcccatgggtgccaggcctgcagaccagtcccatgggctgaaccctctggacccacccactggccaggacacgcgaaacttctcacagggccacacctggtgtggacaactcctgctggctaggrggccctggggggcccaactactgcagcagtcctcctttaggtaaccaaatcaggaagcccttcactggctgcaacagagtggcaaacccatccttttggtagtaatgactcagtggacttttggttgagatggcatgctgaaggttcccaataggctgagatgatgcactgaaccctccctatagactgagatgatgcgctgaaccctccctataggctgagatgatgcgctgaaccctccctataggctgagatgatgcgctgaaccctccctataggctgagatgatgcgctgaaccc

SEQ ID NO: 201769 - DNA, 601 bp, Human
cactgtcgcactccctctttctctctgcctcccagggaacatagacatacacaagtttgtagcaagatacgcagatacagaaatacggacatggcacgtctcacctacatgtacttgggatggccgctcacacagggcaatgtatacacagacctgcacactcagcctcacatgctcactgtcccctacacacatatggtcactgtcaggcacatggatacacacatgaaatcatgcacacacagttccccaacacacgtggtcacacatatggcagtagttttccccacatggctgtatccacacacacacacacacacacacacacacacacacacacacacctgtctcatcgcagtgggtctggccgggctctctcttctctccggcttgctctcccagcctctctgtggccagagagctggaggggggtcatttgaagaccagcgcaggcgggggcgggagcgagcgctgacgtcagtcaggctaagctgggccaggggctctgaggtcacggcccagccgggcagctccacccgcttcccgctattactcccacccccctcagccagacgggcctcccttcccaggcccccatgtc

SEQ ID NO: 201770 - DNA, 601 bp, Human
actgagttttaaattttatttaattttaattcatttaaatttaaaaactcttacttgattcggttattggaaagattttaaatatgtctggaacaagttgcatctacgatgccccttttataattgtaaatcttataaaatctaaacacagattaggtatttccagtgaaaaggtagcatctaagtgagaagtgctatgaacacactggattttgaaggccaagtctggggaaaagaaagtaaaatagctcattaacatttatgtattgattacatattgaaatgatcatatcttatatgyagcaggggtcggcatgctaagacctgctgcagcctgcaggctaagaatttgtgtgtgtgtttttagatggtttttgaaagccaaaagaagaataatagtttgtggagcatgaaaaatatgaaattcaaatttcagtgtccttaaaggaagttttatttgcatacaaccacattcatttgtttatacatcatctgtggctgattctacatttaccacatcgaagttgagtactttcaaaagagaccagatggcccccaaaagcctcaaatatttaatattgggccctttatttaaaaaaat

SEQ ID NO: 201771 - DNA, 601 bp, Human
agaagctaggaccacaaggctggagtcactatgccttgctaattaaaaaaaaaaaaaattagaggaggggtctcactatgtctcctaggccccagtctcccaaagtgctatgaatacaggcatgagccaccaagcccagcctgattttgtttcttccaatacaacttttttccacgttttgaaatctcttaaatccgtgaggatgattgcatgcgatggagtgtcacaatttaattactagggcgtttccctcctctttcttagtggcacatacaatgaggatttatctcccaatcaaagktttcttagggttgagacagtaataataataacacatactaaaaaaccaaaatgctgtgtaccagtccctgctctaagcctttaagatgaatgaatttattttaatctttacaacagcgctgtaaggtaggtactgttattattatccccgttgtacagatgaggcaactgagtcacacagaggttcagcaatttgcccaaggtcgtccctggaaagcagaggaacctggatttgaaccctaggaactgaatctctaaacctctagccctcgggagagccctgggggacagatagtgctct

SEQ ID NO: 201772 - DNA, 601 bp, Human
ccgggccccaaaattattttcattaacgaaaataattggagcaaatagctatctaggcttcatgctgattagattccttcttttcattattatttatttttatagacagggtcttgctctgtcgcccaggctggggtgcagtggcaccatcatagctcactgcagcttctaactcctaggctctggcgattctctcacctcagtctcccaagaagctaggaccacaaggctggagtcactatgccttgctaattaaaaaaaaaaaaaattagaggaggggtctcactatgtctcctaggcyccagtctcccaaagtgctatgaatacaggcatgagccaccaagcccagcctgattttgtttcttccaatacaacttttttccacgttttgaaatctcttaaatccgtgaggatgattgcatgcgatggagtgtcacaatttaattactagggcgtttccctcctctttcttagtggcacatacaatgaggatttatctcccaatcaaagttttcttagggttgagacagtaataataataacacatactaaaaaaccaaaatgctgtgtaccagtccctgctctaagcctttaagatgaa

SEQ ID NO: 201773 - DNA, 601 bp, Human
cctaagtgctgggattacaggcatgagctacctcgccgggccccaaaattattttcattaacgaaaataattggagcaaatagctatctaggcttcatgctgattagattccttcttttcattattatttatttttatagacagggtcttgctctgtcgcccaggctggggtgcagtggcaccatcatagctcactgcagcttctaactcctaggctctggcgattctctcacctcagtctcccaagaagctaggaccacaaggctggagtcactatgccttgctaattaaaaaaaaaaamaattagaggaggggtctcactatgtctcctaggccccagtctcccaaagtgctatgaatacaggcatgagccaccaagcccagcctgattttgtttcttccaatacaacttttttccacgttttgaaatctcttaaatccgtgaggatgattgcatgcgatggagtgtcacaatttaattactagggcgtttccctcctctttcttagtggcacatacaatgaggatttatctcccaatcaaagttttcttagggttgagacagtaataataataacacatactaaaaaaccaaaatgct

SEQ ID NO: 201774 - DNA, 601 bp, Human
gccccggccttcctaagtgctgggattacaggcatgagctacctcgccgggccccaaaattattttcattaacgaaaataattggagcaaatagctatctaggcttcatgctgattagattccttcttttcattattatttatttttatagacagggtcttgctctgtcgcccaggctggggtgcagtggcaccatcatagctcactgcagcttctaactcctaggctctggcgattctctcacctcagtctcccaagaagctaggaccacaaggctggagtcactatgccttgctaattaaaaaaaaaaaaaattagaggaggggtctcactatgtctcctaggccccagtctcccaaagtgctatgaatacaggcatgagccaccaagcccagcctgattttgtttcttccaatacaacttttttccacgttttgaaatctcttaaatccgtgaggatgattgcatgcgatggagtgtcacaatttaattactagggcgtttccctcctctttcttagtggcacatacaatgaggatttatctcccaatcaaagttttcttagggttgagacagtaataataataacacatactaaaaa

SEQ ID NO: 201775 - DNA, 601 bp, Human
gaataaatgaacgaatgatctccatattggataaagggatagatggatggatgaaagaatgagtgaaggaaagaatctctccactgcatggatgaaagaataaagaaagggagagagtcattcaaatctgtacattgaaggaaagaccccaggaaagtgggatttgggtgttcgggtcacgagtgggctgaaggcgcctctactcacctgcacgtagtccaccgaatctccgagcgccttgaaggctgtgtacatgacctcgcgcttgccgccccagcgctgcgccacgcacacgcacctrcgagtcctcaccagcgcctccactgccagccgcccaggatcctccgcctccacctcccgataggctccggcgcccaccgcgcccgccgccgcgggttcccagggctggtggtagttgccgtcccacacgtacgtggcggggtcctcgtcagcgaagacctcgcggaacatgtcgaccatgtagaggtcctcggcgcggttgccatccaccaccatgaggacgcgcagccgcgcgcgcgggtacagcagggcgcgggcggacgccaggcactggcgcaggtacgcggggtcctcctggtag

SEQ ID NO: 201776 - DNA, 601 bp, Human
cccgagtagctgggattataggcattcgccaccatgctcggctaatttttgtatttttagtagagacagggtttcaccatgttggccaggctagtctagaactcctgacctcaggtgatccgcccacctcagcctctcaaagtggccggctggaagggcttaattttacattgaatggatggataactgaatcagtggatgaatgaacaaatgaatctctatattgaatggatggatagatgaatggatgagtcaagaatgagtgaaattgtctcttcctggaatgcgtaggtgaatgaaraaaggaaagaatgcctctacattgaatgggtaaatgaatgaataaatgaacgaatgatctccatattggataaagggatagatggatggatgaaagaatgagtgaaggaaagaatctctccactgcatggatgaaagaataaagaaagggagagagtcattcaaatctgtacattgaaggaaagaccccaggaaagtgggatttgggtgttcgggtcacgagtgggctgaaggcgcctctactcacctgcacgtagtccaccgaatctccgagcgccttgaaggctgtgtacatgacctc

SEQ ID NO: 201777 - DNA, 601 bp, Human
ggaggggaaaggaaggagggaagaaggaaagaagaaagggaacaaatctccacatttaatagataaatgaatgaataaatgagtaaatgatctccatattggatggatagatggtatatccatgagtgagtaaagaaaaagaatttctacactgaatgaagtaaggaagaacttttatttatttatttatttgagacggagttttgctcttgttgcccaggctggagtgcaatggtgcaatctcggctcaccgcaccctccgcctcccgggttcaaaagattctcctccctcagcctcccragtagctgggattataggcattcgccaccatgctcggctaatttttgtatttttagtagagacagggtttcaccatgttggccaggctagtctagaactcctgacctcaggtgatccgcccacctcagcctctcaaagtggccggctggaagggcttaattttacattgaatggatggataactgaatcagtggatgaatgaacaaatgaatctctatattgaatggatggatagatgaatggatgagtcaagaatgagtgaaattgtctcttcctggaatgcgtaggtgaatgaaaaaa

SEQ ID NO: 201778 - DNA, 601 bp, Human
gatgaatgagataaataaatgaaattaatctgtatattgaatacatagatagatggctgagtggttgaatgaaagaatctcaacactgaaggaggggaaaggaaggagggaagaaggaaagaagaaagggaacaaatctccacatttaatagataaatgaatgaataaatgagtaaatgatctccatattggatggatagatggtatatccatgagtgagtaaagaaaaagaatttctacactgaatgaagtaaggaagaacttttatttatttatttatttgagacggagttttgctctygttgcccaggctggagtgcaatggtgcaatctcggctcaccgcaccctccgcctcccgggttcaaaagattctcctccctcagcctcccgagtagctgggattataggcattcgccaccatgctcggctaatttttgtatttttagtagagacagggtttcaccatgttggccaggctagtctagaactcctgacctcaggtgatccgcccacctcagcctctcaaagtggccggctggaagggcttaattttacattgaatggatggataactgaatcagtggatgaatgaacaaatga

SEQ ID NO: 201779 - DNA, 601 bp, Human
tgaagaggcaagctactgctaccatgagttctatggctgcaagaaagtgaattctgccaaccaacaaatacatacgcttgaaagataaccccaagccttaaaaaagacccagctccagctgacaccttgattgcaacctggtgatatcctgaaaaaaggatccagttgagctgtgctgactctgggctcatagaaactatgagataataaatgtgtttcgttcaagctgccaaacatatggtaacttgttatgcagcaatggaaaactaatataatgcattagaattgctacaccaggccrggtgtggtggctcacacctgtaatcccagcactttgggaggctgaagtgggcagatcacctgaggtcaggagtttgagaccagcctagccaacatggtgaaaccctgtccctgcaaaaatacaaaaattagccaggcatgatgacaggtgcctgtaataccagctactggggaggctgaggtgggagaatcacttgaacccaggagacagaggttgcagtgagccgagattcaaccattgcactccagcctgggcaacggagtgagattccatctcaaaaaaaaaaaaagattgctacac

SEQ ID NO: 201780 - DNA, 601 bp, Human
agcttgagcccaagcagcatcctcactgccagcttccagttttatcccatccccaattcctgccctgctgcatctttgttcccaaccccagtcacatcctcagccccatccggcttcccttctccctttccaccccatccacagccctcccaatctctgcccctgcttacctagaggaccgctgatgcaggatacacagtggaagtagctctgacaagcccgctccacattgaaggctacccagtatcgcaggctgcttaggaagctgacccaggagtccagagggttaaggatccgcacrtccccaccaacagcccctacccgggggtcctcgtccagtacccgcacgagctccagcagtgccatggggtccaaccttgtgtccgagtcacagacctgtaaggtggaaggggccaggatcagcacagacccctgcatcaggctgatgcttgagaggaaggcatcaaggggtgcaatgcagctggggcactctgcaaccgatctgaacataattttgagattttttaaagtcattttcaatgtgtagtcacagtttaacatgtactccaagatgcacatccttgtatgaacatgaacaata

SEQ ID NO: 201781 - DNA, 601 bp, Human
tcccctgtgtcacttggcatcctcagtggcctccctgcttccgaccttgccttttgtagtctgtacccaaaacggctgccagagggatcccattacaacgtgtcacttctctgcttaaaaccctcccatggctccctcatcttagtcagagtccttagacctataagcctttcatgagtggaccactccttaactctccatcctgctctcctaatactcccccagttcagtgctccagccacactattctcagccttgagccccatcctacctcaggcactccacttaacacttcaccccsaaccccaaaacttcctatccaccacccttgcccggcattatttatctccataacacatatcatgaacatactgtatgttctacttatttatttcttgtgtgtctccccaactgatgtaatcaattggtgtcctgtctgcctattgctgtatccccgcagcttaaacattctaggcacctagtgaatatttgttgagtgaattaatgcatggattcccttggattatcccaagtttcctctgggtatttcagtggacctggctttgcagaaatcactctcccctgaacttcacttggtcta

SEQ ID NO: 201782 - DNA, 601 bp, Human
aggagaggataagaaaggaaaaagaataaaatggtggaaatctagtttcctttccaatgattctctcctatcgtagcgcgcgctcgctgtggaatgcttttggccatgtagtgttcttgttgggcaccatagctgttttatttcccctctccattcttttcattgatatataggaaatactcctactgaggaatctagttgtaaaaccttatctcacctattacatcagaagaaaattgttataaaaactgaacaccaaatgaaacaaaattttaaaaggtgctcatcgtaacaccttcaytgtacccatgcagtacgggttctgatacttgtactcgagatgtttagggctaggaggacccatagggatcctctaatgtcaacatctcattttacccatgaataagaaatggagacttagagcagttaagtgacttgacacaatcagtgttaatttggtgaaacctggtgggcatttccttgcaacattagtaaaaaataactttcttcattattctgtatgtatcttttctttccaatatccttttaaagcgtgaaatatagaatagaatgttacaggttgtattctttaaaatgttac

SEQ ID NO: 201783 - DNA, 601 bp, Human
ttggtgaggatggctaggtgcagtggctcatgcctgtaatctcaggactttgggaggccgaggctggcgggtcacctgaggtcaggagttcgagaccagcctgaccaacatggtgaaaccctgtctctactaaaaataaaaaaaattagctgggtgtggtggtgggtgcctgtaatcccagctactcgggaggctgaaccctcgcttgaacctgggaggcagaggttgcagtgagccgagatcgtgccattgcatgccagcatggcaacagagcaagactccatctcaaaaaaaaaaaaagaaaagaaaagaaaaaagaaaaaaaaatggtgattatgtgaacagagttctattcctataacaattaggtataaattttagaagaaaaatgttgaaatcctttgtcaatgacgcaggttaattctggcttctaattttggatagggtttctagctttgcccttttctctaaaagaggctgaggcagaagaattgcttgaactgggaggcagaggttgcattgagctgagattgcgccactgcattccagcctgggcgacaagagccaaactctgtctcaaaaaaaaaagaacctaattata

SEQ ID NO: 201784 - DNA, 601 bp, Human
gctaggtgcagtggctcatgcctgtaatctcaggactttgggaggccgaggctggcgggtcacctgaggtcaggagttcgagaccagcctgaccaacatggtgaaaccctgtctctactaaaaataaaaaaaattagctgggtgtggtggtgggtgcctgtaatcccagctactcgggaggctgaaccctcgcttgaacctgggaggcagaggttgcagtgagccgagatcgtgccattgcatgccagcatggcaacagagcaagactccatctcaaaaaaaaaaaaaaaaaagaaaagaraaaagaaaaaaaaatggtgattatgtgaacagagttctattcctataacaattaggtataaattttagaagaaaaatgttgaaatcctttgtcaatgacgcaggttaattctggcttctaattttggatagggtttctagctttgcccttttctctaaaagaggctgaggcagaagaattgcttgaactgggaggcagaggttgcattgagctgagattgcgccactgcattccagcctgggcgacaagagccaaactctgtctcaaaaaaaaaagaacctaattatacattaaaaacaa

SEQ ID NO: 201785 - DNA, 601 bp, Human
ttctttaaaatgtatagtgtgctctacttttataatttaaaaaataaaggttttaaaaatatttttattaacaggaaaacagagaatgcctctctggttctgtctgggtatcaccaagttccccagattgtgccaggctctaagtcataataagaatgaccacctactgagaacctatgatgtgccaggcactgtcctagtcacttaaatatactattcctttttttttttttttttttttttttgagacagagtcttactctgttgcccaggctggagtgcagtggtgcgatctcggctsattgcaacctccgcctactgggttcaagcaattctcctgcctcagcctcatgagtagctgggactataggcgcacgctgccacgcccggctaattttttgtattttagtagaggcggggtttcaccttgttgaccagactggtcttgaactcctgagctcaggcagtccggccttccaaagtgttgggattacaggcgtgagccactgcgcccagccaaatatactattcttaacgctaaatgtcctaagtagatataactgtccccattttagagatgaggaaattcaggtacagataa

SEQ ID NO: 201786 - DNA, 601 bp, Human
tatgatgtgccaggcactgtcctagtcacttaaatatactattcctttttttttttttttttttttttttgagacagagtcttactctgttgcccaggctggagtgcagtggtgcgatctcggctgattgcaacctccgcctactgggttcaagcaattctcctgcctcagcctcatgagtagctgggactataggcgcacgctgccacgcccggctaattttttgtattttagtagaggcggggtttcaccttgttgaccagactggtcttgaactcctgagctcaggcagtccggcctyccaaagtgttgggattacaggcgtgagccactgcgcccagccaaatatactattcttaacgctaaatgtcctaagtagatataactgtccccattttagagatgaggaaattcaggtacagataaagtcacttaacagtgcacacaagtagtaaggctggaattcaaactcgggcttctctggctccaaaaggctgagctcttcattagaccagtccccttgcccctcgatgccctgtgtaacccactagaagagtgggtaggaggaaagccatcaatcccggagcaccagggagacaca

SEQ ID NO: 201787 - DNA, 601 bp, Human
caaagtgttgggattacaggcgtgagccactgcgcccagccaaatatactattcttaacgctaaatgtcctaagtagatataactgtccccattttagagatgaggaaattcaggtacagataaagtcacttaacagtgcacacaagtagtaaggctggaattcaaactcgggcttctctggctccaaaaggctgagctcttcattagaccagtccccttgcccctcgatgccctgtgtaacccactagaagagtgggtaggaggaaagccatcaatcccggagcaccagggagacacacraaaggcccagactccgggactgaagaactgctgctgacaaaaatagttataaacattcctgtccatttgggatcattgtgggttggtattagaacaagctggacatcctaatgttccaggcaagcagaagctctctgcttcagaccgtatactttctaataatgtaactagccaaagctagtcataaaaattctgaatcactggtcaagaaacacattttctcatcatcccctctatagccacccctccaacattttcccctgatgattgaattctaaggttccctcacccctgcttttc

SEQ ID NO: 201788 - DNA, 601 bp, Human
acccaaagacagaaggtagattagtggttgccaggggctgggggagggcagaatggggagggatcgctagcaggtacggggcttcttgtcgggtgatgaaagtgttctgaccagctacagggagccaagatcatgccactgcactccatcctgagtgacagagcgagaccctgtctcaaaaaagtaaataacgtaaaatggcaaagcttatgtgaattacatctgaatagtaagctttcagatgtttaaaaaaaaaaagagagagcaagctaacttgaaaggtaagctattagcccagttracacatttgtcctgaacttttccctgtagtatcgcttaaatgcacatcatcaaggaagtccttttaaaagagtgtcagttggaaacatttacattgagacagaggacttcaatatttaattgcatggcctgggtctccagggaggaggttgcttaaatatgagcatttgttttacttcaaagttaaatacaattctgtgggtgacctgtccatgtcacagtttctccatgcaactgagacagtttagggggaaagaaatcatccctatctgataacagatttactaggattttttttttt

SEQ ID NO: 201789 - DNA, 601 bp, Human
aagacagaaggtagattagtggttgccaggggctgggggagggcagaatggggagggatcgctagcaggtacggggcttcttgtcgggtgatgaaagtgttctgaccagctacagggagccaagatcatgccactgcactccatcctgagtgacagagcgagaccctgtctcaaaaaagtaaataacgtaaaatggcaaagcttatgtgaattacatctgaatagtaagctttcagatgtttaaaaaaaaaaagagagagcaagctaacttgaaaggtaagctattagcccagttgacacmtttgtcctgaacttttccctgtagtatcgcttaaatgcacatcatcaaggaagtccttttaaaagagtgtcagttggaaacatttacattgagacagaggacttcaatatttaattgcatggcctgggtctccagggaggaggttgcttaaatatgagcatttgttttacttcaaagttaaatacaattctgtgggtgacctgtccatgtcacagtttctccatgcaactgagacagtttagggggaaagaaatcatccctatctgataacagatttactaggatttttttttttttttt

SEQ ID NO: 201790 - DNA, 601 bp, Human
cagcacctgccctgatctttaacttttttcttttcaacatccacccatctctatctgtcactttattttatttatttatttttttcttgtgagatagagtcttgctctgtcacccaggctgcaatgcagtggagcaatcctggctcactgtaacctccgcctttggggtcggggtgcaagtgattttcctgcctcagccttctgagtagctgggattacaggtgcctgccacctagtatccaaaaagggcttattgaacgtgcagtgaaacgcctggctaattttcgtattttcagtcacracgggatttcactatgttggccaggctggtctcaaactcctgatctcatatggtcctcccgctttggccccccaaagtgctgggattataggtgttagccactacacccaacctctacctttcactgatgtctactaattatttagtctacgagcaaaccttattggaagtgaatgagatattaagtatttattacagtaggaaaacctgttttattcttggaaagaaaaaaatttagagggagataaagaaaagtggagaaaaacaaacaaaattaaaaaaaaatctttggagcctgga

SEQ ID NO: 201791 - DNA, 601 bp, Human
tattcaaatcatgccttaggggcacagggaagggagtcagagactgccccgcctgtgattttgatacaagtagacagatgatctgagagaacagcctctggtctagatgatttcagtggaaaagaagaagaaagatccatgtggaaactttgtaaacgttttatgacgggaaaagacaagtgtagcatttaggtaaagaagaccagcacagagaaaaccatttatcattctaacataaaatgatcaaccaagagctcaaatgtgatgtaatgtgagataacagaatgaggtggaaaatggsctagcaggggaattcaaaaacagcaaatcatggcattgcagaatgaataaaccaattttacaccataagaagcagaatcttcgctataaaatatggaaattgcttgagaaatcacgcagcctgcatattcatgagcattagtgctccccgtgtttcttttggatttttcgcgtcttctcttcctggagctccacctccttcccgtgctcgatctttggccccaaccccaaaaggatgttttcttttcctggtatcttactgtagccagttccacaggttggggaaaggaagccctcttaa

SEQ ID NO: 201792 - DNA, 601 bp, Human
ctgaggggaggtgactgctgcctctaacatatacttaggaactcctatttttcatctccactagccctggtttgagattttttttttttggagatggagtttcgctcttgttgcccaggctagagtgcagtggtgtgatctcgcctcactgcaacctccgcagttcaggtgattctcccgggttcaggtgaacctgaacctgaacttctcccgcagttcaggtgaacctcccgggttcaggtgattctcctgcctcagcctcccaagtagctgggattacaggcatgagctaccatgcctggctaattttgtatttttttagtagaaacggagttttaccatattggtcaggctggtctcaagctcctgacctcgggtgatctacccacctcggcctcctaaagtgcagggattacaggtgtgagccactgcgcctggctgaagttatttttatttatttatttatttattttttgagacagagtttcactcttgttacccaggctgtagtgcaatggcatgatctcggctcaccgcaacctccacctcccgggttcaagtgattctcctgcctcagcctcccgagtagctgggattacag

SEQ ID NO: 201793 - DNA, 601 bp, Human
aacctccgcagttcaggtgattctcccgggttcaggtgaacctgaacctgaacttctcccgcagttcaggtgaacctcccgggttcaggtgattctcctgcctcagcctcccaagtagctgggattacaggcatgagctaccatgcctggctaattttgtatttttttagtagaaacggagttttaccatattggtcaggctggtctcaagctcctgacctcgggtgatctacccacctcggcctcctaaagtgcagggattacaggtgtgagccactgcgcctggctgaagttatttttatttatttatttatttattttttgagacagagtttcactcttgttacccaggctgtagtgcaatggcatgatctcggctcaccgcaacctccacctcccgggttcaagtgattctcctgcctcagcctcccgagtagctgggattacaggcacccaccaccacgctcagctaattttttgtatttttagtagagatggggtttctccatgttggtcaggctggtcttgaactcccgaccttaggtgatccacccgcctccacctcccagagtgctgggattacaggcatgagccaccgcgc

SEQ ID NO: 201794 - DNA, 601 bp, Human
actgtaaattctttgaggtaaatacattgatttatatgttgcttgtatcctctattgccttcaagtggttatgtgcattttattgtgcaattgctagatactttgtttctctcagcgtcagtgttttactttgtaaaatgagggtgctataattcttgacctctgagggctactgggagctttaaatgagatgatatatgtaaaacacatgaggaactctctcacatgtagtcaaccttcaatatgtttcagatattgctattattatgggcattttttttgttattgagagtaaattaaygattgagttttttctttattttgaggagtcttgctttgttgcccagattggagtgcagtggtgcaatcttggcttgctgcaacctccgcctcccaagttcaagcaattttcctgcctcagcctccctagtagctgggattacaggcacctgccaccaaacccagctaatttttgtatttttagtagatatggggtttcaccatgttggccaggatggtctcaagctcctggcctcaagtgacctgcccgcctcagtctcccaaagtactgggattatagatgtgagccactgtgcccggc

SEQ ID NO: 201795 - DNA, 601 bp, Human
aaactgttaaatttcctttgggcactgatcactctccgaggcgatggtgtttatttctttgtgtttataggcagtctctcccttccacaccagagtgtaggcattttgtttagcttgctcatcatggtctttctgatgcctagaaggatgtctgccacatagcagctgttcaataaatattgtggaatagatgagaaaaaatgtatgcagagaaaaaattagaagacaggagacatattacaaaccccatggaggaacaataaatcactagattcttccttattaggaacgtaaaaatatkatttaaaataggtgataatagggccagtgatagccaacagggttaagtactgttgtaaacactaagctaagtgctgtacaggcagtcacttatttaatcctcacgatacccctatgagacatttgcggtccttcccattttacagatggagaaactgtgacacacagagatttaataacttgcacaaaggcacagctaatgagtggagaagcagggagttgaactttaaccatctgtctccaaaacccatttgaatccctttgctttactctgtcaaggtgatcatagcaatgtagcaca

SEQ ID NO: 201796 - DNA, 601 bp, Human
ggcagtcacttatttaatcctcacgatacccctatgagacatttgcggtccttcccattttacagatggagaaactgtgacacacagagatttaataacttgcacaaaggcacagctaatgagtggagaagcagggagttgaactttaaccatctgtctccaaaacccatttgaatccctttgctttactctgtcaaggtgatcatagcaatgtagcacaacaaaggacagctgggttcagtgtcagagtctagcccatgctagagccagagagacgacatgtgcagtgggaagaacatgyggacaggggtccagagaatagttgctcatgctagagtgaccaattagtggcttacccactccagatggctgtcttctgcagggagtatctcaatccccaaattgagacctgagacctgggacctggaacctggccttagctgatctctgaggttctttccaatattaaagttttcaagccccaaagaagaatagttgaaaattactttgcctccccaggctacaaggtgacatagatcaaaaaattttattagcctcctgtgttagtgtttatgtttacaataaagtcctcactaatttg

SEQ ID NO: 201797 - DNA, 601 bp, Human
gagttgttgtctgtcttgtcttcctcctctcccattttagtctggcttcattcttattatttcactgaaacgctcgtcaaggtccacaaagaccatgtccatccatctcactgctcctgtcagagtcattttctgcagccttccctcctgcctctatttgataagtccccagtgtttcactccagctgaggctgtgcttccaagcccaagagctaactctagctacctattcagcgtcttcccttgaatgtgtcttagccatctcaatcttaaaacaactaaaatagaactcctgatgttttacagaccagttctccttcctctcaaactctctgaatgctacatcaatttcttggcttaaaccaaaaatctgggagttggttatgtttcttttcttttctgccacatccagtgtatcagctagccctgttggttttacctccatagtgtatatcaaatctgcccacttctcaccatctcctctgccactgtcatgcctggactgttggaaaggcctcctgactccaccccctgcttccattcttgccccctccttcttgtctctctgtagcacatcagattacatccttaccttccatgg

SEQ ID NO: 201798 - DNA, 601 bp, Human
tatatctacagcatgatttttttttttttttgagtcagagtctccctctgtcacccaggctggagtacagtggcatgatcttgggttactgcaactttgcctctcactgaagcagtcccactacctcagcctcctgagtagctaagactacaggtgtatgccaccatgactggctaatttttgtattttttgtagagatggggtttcaccatgttgtccaacctggtctcgaactcctgggctcaagtgatttgcctgccttggcctcccaaagtgctgggattacaggcatgagccaccrcacgtggccaacatgatcttaactatgtaaaagtgcatagaaaaagctagtatgaaataaaactaaaatgttaattatgcatttcaagttgacatgattacagataatttttcttttagattttttttttttttttttgagacaaagtctcactttgtcatccaggctggagtgcagtggctagatcttggctcactgcaacctctgcctcctgggtacgagcgattctggtgcctcagcctcctgagtatctgggattacaggtgcgcatcaccacatctggctaatttttttgtattt

SEQ ID NO: 201799 - DNA, 601 bp, Human
cgtgaaaaagtactcactaatatgattatgtctgaatgttggagctatagatgatatttcctttatttatttatttatttatttatttattattattattattattattatgagatgggatcttgctgttgcccaggctggagtacaatggcgcgatctcggctcactgcgacctccgtttcctgggttcaaacattctcctgcctcagcctctcacgtagctgggattacaggtgtgagtcaccacacctggctaatttttgtagagacggggtttcaccatgttggccaggctgatctygaactcctgacctcaagtgatccacccgcctcagcctcccaaagtgttgggattacaggcatgagccaccatgcccgactgattttttttccttttttaaatgggtatttactttgtcatgggaaataaaaactatttttttttaagtttataaaattacatcagtgagaggaaactctaactcctagaaagttaggttagggtatgggaggtacaagtgagcatgtgtccccgtgggcttctggtccataggaaatatggtttcttctgtattctgtacttctggagctccttttggag

SEQ ID NO: 201800 - DNA, 601 bp, Human
ggaatgagtgaatgattccccccggtcccccactgtagatatttatctgcaacagtctgaaggtagcctgtctatattgcttctggttttatggtcacccatcatgttttcttattcactgtgggttgttttgttgtctagttgtggaagatatcaataagcgcagagagccgctccccagcctggaggctgtgtatctcatcactccatccgagaaggtaaaccttccaccagaggaggactctggctaaggttagatggactggcttgggatttatgtggcacagactgtctgacattkctaggttaagcacgcatttaacacactgctctgtttaagcatgcaatccacaatggggtggggtcgggggtggtgtttatgcagtgagaagtgatgaatgtattaagcgttcttaaacacagcagctgtgcagaaaaccagagcctgtgttccgtggccctggatcattctagttttcccccttgcactccctcttcaggtaggacccactctgtctaattagcagtccacctccagactttggtattttatgctttcattttattttatcaatatccagttactgttcacatttacctg

SEQ ID NO: 201801 - DNA, 601 bp, Human
tagatagaatctgcatcattaccctagaattagttttcttatgttttgaggattttatgctcagatcctagcggagaagcagagggagatgaattgacctggacagctacagagtataaaacagtaagaattcacccagagatcttctctctagggataaactcccacagcactcaccactgagaaagtggaaaggatatagcagaagaaggattttggccgggtgtggtggctcacgcctataatcccagcactttgggaggcctaggcgggtggatcacctgagatcagaagttcgagrccagcctggtcaacatggtgaaaccccatctctacaaaaatacaaaaattagctggatatgacagcaggtgcctataatcccagctactcgggaggctgaggtgggagaattgcttgaacccaggaggcagaggttgcagtgagcaagatcacgccattgcactccagtctgggtgacagaatgagactccatccaaaaaaaaaaaaaaatcctgataaaatgaagagcccactgtacatgtgcagctgttaaatgaaccagcaaatggacaggaaagccaactgtcttttgtcatactt

SEQ ID NO: 201802 - DNA, 601 bp, Human
caggaagggcttaggctgccaaggcattgtgccgtggtaaccaagagcttggtggtgccacggatcatgggttcacccatcctgtgacctcattgtctcctggaagttgtggccatagaaaaacaccttccggttgctgtcccagtgcctggcttccctccactgttggtaatcatggacaaagccagccggcagttaagaaatgggacctaggtggcatctcctgactgacctgtgggagctcaggctggtagcagggctgctgcagtgctgagactggccaggaagcaggcagccgccrccccagcatcaggtcaggtggggcccagggagtgctgtcagacccagccatggggaagggttcaaaggttctcacattgttctggccatgccagctgaaatgtcactctccaacaaacacaacaaaacaagacccaagagaatgtgaactgagggaagtgagaatcatgggagtcaggctgggagcctgatcgtggcaaaaggttcactgactggtcagggcccccagtggaagtgcggcagtttatctgaagctgcttggaaagacatctgtttccacttagatcattctggataaaag

SEQ ID NO: 201803 - DNA, 601 bp, Human
ctttgtcagggaatacaaggacaatgccctgctggctcagctaatccaggacaagctcgatgcctataaagctgatgatccaacaatgggggaggtaagtctggcttggaccacgtggttctctttaccaaggaccgcagtgtttgtgtgacagtcccagagacagcttggttctgttgccacagagcatgtgtcagtgctgcttttcctggggactggcttccagtgaaatgcctgaagcccctggggcagggccatctacatgtgttcatcgtggccagggtgaccaacttgttctgtwtgccagggctttcctggttgcagctctgaatggcccaagtcccgggaaacccccagaagcataatagcaaaccagaaaatcgacagacacacgcttcagagctcattcagcattcactggtttttacacatgctctgtgtacagccctgtgcgttttacacatggatagatattcactggtttttacacatgctctgtgtacagccctgtgcgttttacacatggatagagtcatgtaaccatcttacaatcaagatacagggctgtttcctcaccaccttgattttaaaactgaaaggc

SEQ ID NO: 201804 - DNA, 601 bp, Human
agtggtttcaaaatgaagattctaaaaatatgagtgaatctcggttctccctgttggtagctataatttgtgcctcctccagctgttcacgatttcccatgtgattggtgctgagggcctattgcaggcagctgctggaagctatttaggcgccacacattgaggatgacatcccagtgcctttccagagggacagatgtgatctttgcctttcccctataaataactaaactcatgtatgacctgacttcatgccctggaccagacagctcaggtggagcttgtatcagctgacccaaargattttaagacagaatttcaaattggttgactttgaagagagctttgaatctctcctacccgaggaattgcagcccgggtcagtgctgccacagcaagcctggctgacaggtccaatgttgtgacggcacttgtgaacatctggcagctgagggtggtgagctgctgctgctgtaagctgaagagggttcgatgaatgttgtggagacagtgcactccacctgagtcccgtctccattctaggtatgagaccagcggcatcggggaggcacgggtgaaggaggtgctcctggacgaggac

SEQ ID NO: 201805 - DNA, 601 bp, Human
tcttgcctcagacctggccaggttctttggctcaggcatcatttcctcagggaaaccctccccgggtccctacccagactaggcagatgcctgtgccacgtgcacccacactacctggtgagtcccctcgaagggccctgatctctgcagtgctttggctcctctcctggatgctctgattctccgtgaattagagattctttttttttttcttttgtccttgtatctccagcacctaatagttcctggtatatagtagtaattcagtaaatttttgttgggtaaatggatgggattagawggcccacacagaaagcacacagacctgtcttgcccattgggtgcagattcccaccctctgtgacctccctgtgctcctcccgtccacgtagccacagtctttctgccaggaggaagtgcaaacttgatgctaaggctgcttgagctgaggatgaagaaaagcagtgaatagaaggattttttttcctcagcaagaattagctctcaacagctttctagtccaataagcatagaataaaatataactgctagacttcagagttcagttcccaacctataagacaatcatatttggatcaaa

SEQ ID NO: 201806 - DNA, 601 bp, Human
tccccagagtgagccatctgagagagagagtgctaggaggaagtcacaataccttttatgtcccgatcctggatgccatgcattatcagttcctccacattgtttgttagaagcaagctactaattccagcctacagttaaggagggaatgaagctctgcctcctaaaaggaggagtatcaaagaatctgtggacacattgtagtaataaaaccatcattggctgggtgtggtggctcatgcctgtaatcccagcactttgggagaccgaggtgggcagatcacctgagatcaggagttcragaccaacctggccaacatggtgaaaccctgtctctactataagtacaaaaattagccgggcgtggtggcacgtgcctgtaatcctagctactcaggaggctgaggcaggagaatcacttgaacccaggaggcaaacgttgcagtgaaccgaggttgcaccactgcactccagcctgcgcaacagagcaagactctgtctcaaataaaaaccatggtgccacctaccctcataaaggatttctcctttgtcttaactcttttagaatgtggtttgtccctctcttttgacatgtaacact

SEQ ID NO: 201807 - DNA, 601 bp, Human
gttgtgaaagctgagatgtcttggaaccaaaccataacaggggtccccgccattttatctgtcttgtctcagggtctgtctggcctcacctttggacagcttagcctcagtgtcccctgtgaagatgagaatatgacacttagagctagcagtttggccacctttgagtcttctgcactgggttggttcagagccaagtcagggcaggttgtctgggaggcctggaccacgtgatgtgctctagaagaggtggggtgaagcctccaggacccttgcagaggactctgccatgaaccttgcmtgtcacagccccactgtgtgcttgtcttctataggcacagcactaacaaagctagggttgcaaatattctccctctggaatcttatagacaaaactgttctagtgccaccagaccatagccctgtaactagcaggagtttggcatttttaaacccttgttcacaagagggatcaaaatgagaatggagatgtgcattcattcagtgcaactgtgctgctgaaatccaatacggcatgctccaagcagtatgccctcctctaataggcagcaaactactgtttcaactgcctggagttttt

SEQ ID NO: 201808 - DNA, 601 bp, Human
agtggcgcgatctcggctcactgcaagctccgcctcccgggttcacgccattctcctgcctcagccttccgagtagctgggactacaggcacccgctaccacgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggctgagttttttctttttaatggcacttacatacttgacctatgtttgcccttttttatracttttttttttttttttttttgagatagagtctcactctgtagcccaggatggagtgcagtggtgagattttggctcgctgcaacctccacctcccacattcaagcaattctcctgcctcagcctcctgagtagctgggattacaggtgcacaccaccacgcccggctaatttttgtatttttagtagagacggggtttcgccatgttggccagactggtcgtgaactcctgacctcaggtgatctgctcacctcagcctcccaaagtgctgggattacaggtgtgagccaccaagccc

SEQ ID NO: 201809 - DNA, 601 bp, Human
cagcatcccgttcctctctgattcatccctcacacctcctccctcgctcactctgcatcagccatgccagcttcctcgcacttctcaaacagtcaggcttacgtctgcctcaggaccactgcacttgcttttccctctgcctgaaattatctgtccccagatatgtctgcatgggctgggcacagtagctcacacctgtaatcccagaactttgggaggccaaggcgggtgaatcacttgaggtcaggcatttgagaccagcctggcgaacatggtgaaaccctgtctctactaaaaatayaaaaattagctgggcatggtggcggacgcctgtagtcccagctactcaggaggctgaggcaggagaattgcttgaacccaggaggcggaggttgtggtgagctaagatcgcatcactgcactccagtctgggtgacagagcgagactccatgtcaaacaaagaaaaaatatgtctgcatggcttgcctcttatctcctttggtctttaatcaagtgttaccttctccaatcttccctcaccaccctgtttaaaattgcagtgcatcagcgttcacagctttactcatgcagtccaagtgt

SEQ ID NO: 201810 - DNA, 601 bp, Human
gagtggccgtgcttccagcggaaggcgccgccgcatcgcacctcaactccattccacgctttggtgtcgcattctgtcatagactcccttgacccacaaaacttagtctttaggtaactgtggacagcagaagctaggggcaaagggttccctccttggtctgccctgctgcatctctcaatggaaggcagcctcatgaggtaggaagtgcctgatcccagggtccggcagactcaggctcagattcctgctctgcaaactgcaagtgggggaccttgagcaagtggttcgagctctccarccatttccttactcagcaaaacaggatcagtcatactcattcacagccttgaactaggcccaagatgaggtctgtcagtctcctggcattggcctcatgcccaggcaggaatgggcagtgaatggcagtcaatcgctgccctgtcaggtggagatggacagacagctgtgagcaggtgctgcctgaaactactgcctgaccgctggactctgcccagggctcccccagccacctccaaccactttctaggtctgccatgccctttctcgtatttcctgttcgtttcccaaaagagaggaa

SEQ ID NO: 201811 - DNA, 601 bp, Human
gtagccccggtgataaagctctctgctccctgcttgcatatgtattgcatgaatgtagtgagtaattctgagcccaaacacagcttttctggacagaagctgtcacagccaggctttgggtgtaaatcttccccttcatctttagacctgacttgaggttccatatatcgggaggtgggaacctgggggtatgcagttgcccatgaagattcatggaggggcctcgcgcagacagctgacgtccgctgtgtggcctcccctgctttgtgcatgccagcctccttgctaccatgtgtgttcrtgcgcgcttgtgtgtgtgtgtatgcatgcgcacacatgtgtgtgtgtcttgctttctcatacctcattggctgcataaaatgtaggcctaagttggcatgttcctgtgacgtacctttgttcaagcagtcagctggcctctgttctcccacaggttctactcacattcttactcccaccaaatttctcatggacctgagacaccccgacttcagggagtcctctagggtatcttttgaggatcaggctccaacaatggagtgagagccaaagaaacaaagtaaaagcagcttattacaga

SEQ ID NO: 201812 - DNA, 601 bp, Human
tgctattcaagcatccacctgcccatcccctcccctcccaggggccacagggtcccgagaatcaagagcctggaggcactgcttctggacctgtctgtgccacccaccctgagcaagcacctgactgctctggccttcacgtgtcccatgtgtaggatgagaagggtgggccggatcacagttttccaaacctggctaatgatcatactcacctgggctgctctttaaatgtacacattttctggcgccgccctgcatattctgagtcagtaggtctgcttcagccaaactcaagaatgaytggaccagctagcctgcaagaacacttttggttttcagattctgtccgtgtagaaagaaggattttgtcccatcagagcttgcggtgtctggcccacagctttgaaaacatgtagacagtcatgtagatgggcctcaacttagtttttagagaccactgtttacatttcataatcgtccagttatagggactaaataggaccctcagagcaatagggcccacttgctgctttattctggaaaaccaacatggtcagccatctgtggattcaaaatgagaactgtgcaaaatgtggattat

SEQ ID NO: 201813 - DNA, 601 bp, Human
actcttcagagtttggggcaagccttgtaatatgcgtcctttctcctcatttgtacagcagcctttggcctcttttaggactagcaggaggagtggtgaggtcacagaaatgagtggacttcaggggaaaggagtgctataaaaaagcccagggacacactcctgaaacctgcatcgcatttgctgaaggggcctcaggtctgcagaatgatgagtcagctttccagcgcagggcccctacaggctgcgtgcacagggcatcatgccgaggacaagttcctcactcagctgggagtgggcmgctggggcctgaactgcagagaaagggatgttggaagaacagagacggctttccaagtttctgctagtctggagtgaccaggaagggctgcagttccagcagtcttcggtcagctgagcgagtagttagtggtcaaaggcatagggaccctggtattggagtcatgcccagtgagccagccaaagccttcttttgcctgcccttggggtggaaatccagcatccggtggtttccgctcccctgctcccatgaaggcccattcctttgccacgtctccagggaggcacattttcaagtacg

SEQ ID NO: 201814 - DNA, 601 bp, Human
ctcttcagagtttggggcaagccttgtaatatgcgtcctttctcctcatttgtacagcagcctttggcctcttttaggactagcaggaggagtggtgaggtcacagaaatgagtggacttcaggggaaaggagtgctataaaaaagcccagggacacactcctgaaacctgcatcgcatttgctgaaggggcctcaggtctgcagaatgatgagtcagctttccagcgcagggcccctacaggctgcgtgcacagggcatcatgccgaggacaagttcctcactcagctgggagtgggcasctggggcctgaactgcagagaaagggatgttggaagaacagagacggctttccaagtttctgctagtctggagtgaccaggaagggctgcagttccagcagtcttcggtcagctgagcgagtagttagtggtcaaaggcatagggaccctggtattggagtcatgcccagtgagccagccaaagccttcttttgcctgcccttggggtggaaatccagcatccggtggtttccgctcccctgctcccatgaaggcccattcctttgccacgtctccagggaggcacattttcaagtacgt

SEQ ID NO: 201815 - DNA, 601 bp, Human
tggcccaaagtcacccagctgagaagaggtgaaacagactcacacccatgtctgatctgggtttttaacaatgatcctgcagaaaccgtcagctcacaggagggataagctctgggcactccaaaggggagagggataagagctccggtggtccagacacagcttcgtggaggaggcctgggagctgggctaaggggcctgggaggggaagagctgaatgaaatgcaacagccgaaagtgcttgggaaatgcctgcaaatgccggcagtctgatgcacgcagagcctgaaccaggggcctsggagctgaggctcagagtgggcccagacacaggcacccagacccagtgcacaagataaaaacggtctgtaacactggggcctgatagagaggcactgagcagaattagctaccctgccctctgacctcatcaccctgtggccagaggaacatcatgcttggtctactcaccctggagctcattgtctgagaccgtctggtcccccaggacctgcccactctcccaggtcagcagcagccccacaaacagcagcagagtcttcatcatgcctccaattctggagtctttgcacgcctctgc

SEQ ID NO: 201816 - DNA, 601 bp, Human
taaaaagtggtcatcatttcaatgtatgtgcatttcaaaacatcacgtcatataccttaaatatacacaatttttatttgttaattatatctcaataaaatggggggtggggggagtgtcatgagatcaagatagtggcccaaagtcacccagctgagaagaggtgaaacagactcacacccatgtctgatctgggtttttaacaatgatcctgcagaaaccgtcagctcacaggagggataagctctgggcactccaaaggggagagggataagagctccggtggtccagacacagcttygtggaggaggcctgggagctgggctaaggggcctgggaggggaagagctgaatgaaatgcaacagccgaaagtgcttgggaaatgcctgcaaatgccggcagtctgatgcacgcagagcctgaaccaggggcctcggagctgaggctcagagtgggcccagacacaggcacccagacccagtgcacaagataaaaacggtctgtaacactggggcctgatagagaggcactgagcagaattagctaccctgccctctgacctcatcaccctgtggccagaggaacatcatgcttggtcta

SEQ ID NO: 201817 - DNA, 601 bp, Human
tgagctgggtgcagaagaaacttggcaaggaaaaaaaaaaacccagaagtgtcagctttgcagcatcaaaatataaaatattgttattttggacacaaatctttctagagttcagtttaaacagatatgtgtatttctttgttccaatgcagtgccaggcgacaggaataagaagatgagtaaatgagtaaggtatagcactggtgacaaatgcagcgaaacactgtgtcacctaagtgctacttcactggtgtttatcccatgccaagcactgcgccaaacacttcatgtgcagtttacrtaatgctccagccccccgccgtgcccacttcgcagagggagacatgggaagtgtgatatgataaagggtcaaagtgttcatcaggtaggaggagtatgttctggaggtctaacatacaggtggtgcttatagttaataacaccatatcataactggaaatttgctaagaaagtagattttaagtcttcccaccgtcccaccataaaaagtggtcatcatttcaatgtatgtgcatttcaaaacatcacgtcatataccttaaatatacacaatttttatttgttaattatatctcaataa

SEQ ID NO: 201818 - DNA, 601 bp, Human
ggcagaatgaggcgagaggaagaggtggcctcaggaccctggaatgagctggatggccagaaaggcccgttcagttcaggggctgtcaaggctgggacccccactcctgccagcaggcagcagcatggccccagccttgccctggcacaggctcccatcacaggctccttgctgactgcaccctactgcttagaaatgcagaccatgggagccggcacacccagagttatgcccagccactgccatgtgcccctggagaatgagctgggtgcagaagaaacttggcaaggaaaaaaaaaaacccagaagtgtcagctttgcagcatcaaaatataaaatattgttattttggacacaaatctttctagagttcagtttaaacagatatgtgtatttctttgttccaatgcagtgccaggcgacaggaataagaagatgagtaaatgagtaaggtatagcactggtgacaaatgcagcgaaacactgtgtcacctaagtgctacttcactggtgtttatcccatgccaagcactgcgccaaacacttcatgtgcagtttacataatgctccagccccccgccgtgcccacttcgcagaggga

SEQ ID NO: 201819 - DNA, 601 bp, Human
atgtttctttatgaagtagtccagaactctagcaagacgtggggtgctgtgtgcctgccttaaccctaaccatatcacccctattagataagcttcctgaaggttggacgccacgcctgtctgggcccctgccgccaccccatccagagcctgcttggaactagcatgtgatcagggcttagaaacatctattgaaatgaatctgggcattaggccctgggccaggctcataacaaaaccagatccaagatctcactccctgatgctttcagaagcaaatgaaccttccctgcttcttaaytgcagcctcagcatcagctgacacagcctgggaggactgcgggtcaccatggcaacccagcagggcaccgcgcagtgaccccctccctcccctccagtgggatggtcaaggcagggaggcggtagcggctcctcctgacctctttcttcttcttggcttcttctaggttgctgagcagtgtcttgcgctcttcgtttgttttttctatgagagtctttatctgtttcaccccgttgacagcattttgaatttccttattgacgtacttacttccctgattggacatttctgcaagagaag

SEQ ID NO: 201820 - DNA, 601 bp, Human
gtgagaggaggtttgtaggatactcttaaggagacttgatttcttaaataagttgttcattgaattatagtgttttagttttgttgaatcattaagcacaggctagacctgctatatccactactgggcttaagatgtttctttatgaagtagtccagaactctagcaagacgtggggtgctgtgtgcctgccttaaccctaaccatatcacccctattagataagcttcctgaaggttggacgccacgcctgtctgggcccctgccgccaccccatccagagcctgcttggaactagcaygtgatcagggcttagaaacatctattgaaatgaatctgggcattaggccctgggccaggctcataacaaaaccagatccaagatctcactccctgatgctttcagaagcaaatgaaccttccctgcttcttaattgcagcctcagcatcagctgacacagcctgggaggactgcgggtcaccatggcaacccagcagggcaccgcgcagtgaccccctccctcccctccagtgggatggtcaaggcagggaggcggtagcggctcctcctgacctctttcttcttcttggcttcttctag

SEQ ID NO: 201821 - DNA, 601 bp, Human
aaacaaactatggttcatataaagggtagatggtacatcattacaaaggatgtttatagtccattttgaatattatatgttaaaaattcataattttaaatatagccactgtcaaaaaagcatagaagaaaataataggaaaaatagatcaaatgttaacagtgacttgtccttgggcaaaaggattatggaaaaacttttccttttctacttttctatattaaagtctctatgaatgagtgtgttagtcttcaaaaaaaaaaaaatagcctatccacaccccagagttaggtgaggtctytgtcctgctccatcatcccctgtcccctgctgggcaaggacaacccacctcccactgagccaagacacaagcgccacccctgctacctacttccttgccttctggctcacctactcctcaactaagaagtagcaggctcttttctccaaatgtatgtgatgtgctttattataaaaccagaattgttgaatgtcaaactccagtgataaccacaaaaatgtgagaacaagtcatgccccttccccaggagctatttgaggattctcatagaatggtgagaactgatactaaggccaagaa

SEQ ID NO: 201822 - DNA, 601 bp, Human
tcagaaccaacccagatgcttaaaagagacagattaaacaaactatggttcatataaagggtagatggtacatcattacaaaggatgtttatagtccattttgaatattatatgttaaaaattcataattttaaatatagccactgtcaaaaaagcatagaagaaaataataggaaaaatagatcaaatgttaacagtgacttgtccttgggcaaaaggattatggaaaaacttttccttttctacttttctatattaaagtctctatgaatgagtgtgttagtcttcaaaaaaaaaaaaatagcctatccacaccccagagttaggtgaggtctctgtcctgctccatcatcccctgtcccctgctgggcaaggacaacccacctcccactgagccaagacacaagcgccacccctgctacctacttccttgccttctggctcacctactcctcaactaagaagtagcaggctcttttctccaaatgtatgtgatgtgctttattataaaaccagaattgttgaatgtcaaactccagtgataaccacaaaaatgtgagaacaagtcatgccccttccccaggagctatttgaggattct

SEQ ID NO: 201823 - DNA, 601 bp, Human
tccccttcccacctggcttaaagaatccactcatccttcaagatccaactgttccctaactcctagaagcttcccaactcctggaacccatgtggacaccacctctctctctgatcacctactcaatgactaccctctcactgaagcctcatttcctattctctgcttctggtgtttaaatttcatcttccaaagcaggctgcagactccctgaatcttacctttctattgcaaccatgcctcctggcgtgcaaagggaatggcaggcattcagcaccaaagccacaccagctatcaaaaytctctaacgggcccttgccacttgacccaataattctgtaagaatctgtctcaggccaggtgcggcagctgacacctgtaatcccagcactttgggaggccgaggcaggcatattacttggggtcaggagtttgagaccagcctggctaacatggtgaaactccatctctactaaaaatacaaaaattagctggtgtggtggtgcacacctgcactcccagctacttgggatgctgaggcaggagaatcgcttgaacctgggaggcggaggttgtagtgaaccaagatcaaaccactgca

SEQ ID NO: 201824 - DNA, 601 bp, Human
ggcttacactcttcccagagggccatcatggtctcattgcacactcctgggagctccttcagctttgtctctgattccctggtctcatttagggcatcctacaggaagacacaaggctggctgagccacacagagaccacaggctcatgcactcaaagagctgctgggtgccaggccctctgccccagggcaggccttcccataggctggccacccagcatgcaagtgcctacccttgctccagttcaagcttcccctcattcgcccacctggaatccccttcccacctggcttaaagaayccactcatccttcaagatccaactgttccctaactcctagaagcttcccaactcctggaacccatgtggacaccacctctctctctgatcacctactcaatgactaccctctcactgaagcctcatttcctattctctgcttctggtgtttaaatttcatcttccaaagcaggctgcagactccctgaatcttacctttctattgcaaccatgcctcctggcgtgcaaagggaatggcaggcattcagcaccaaagccacaccagctatcaaaattctctaacgggcccttgccacttga

SEQ ID NO: 201825 - DNA, 601 bp, Human
caaggtaggaggattacttgagcttaggagtttgagaccagcctgggcaacatggccaaaccccatgtttacaaaaaaaaaatacaaaaattagctgggtgtggtggtacgtgcctgtagtcccagctacttgggaggctgaggtgggaggatcacctgaacccaggaggtcgaagctgcagtgaaacatgatcacatcactgtactccagcctgggtgacagagtgagaccctgtctcaaaaaaaaaaaaaaattcttaaatccttccacataagtggacacagggctctgccatcccaygaagcagtttattatgtcatccagctaagcactgctgcatgagttttctaagagaaggcagatacctggcctacatccttttgatgactccactctctctactcatgccagacattaccaatggagcatggcactctgggcaagccagccaatgctaatcaattgcatctggcatgcggaatgaagcatatttcactaggctcccctccttccccactcagagccttggccactcatgtgtccccttttcacctggcggccaaccaggcctgagccacttctgcagacgcgtgcgtagaa

SEQ ID NO: 201826 - DNA, 601 bp, Human
agacagggtctcactatcttggccaggctggtctcaaactcctggcctcaaatgatcctcccgccttggcctctcaaagtgctggcatcacaggcatgagccaccatgcccagctcagtttttttcctctttaaataaggataatatcacccttgtgatattgctggagaaaaatcgagatgacacccgctgagccctcggcatggttctcagcatctaacgagttgctcaaaaggccatgagcttccaccccttctcacctcgtatgaattctgttggcgggtgctggaaggccgggctrtggaagtggatgtccatggcctgctgagcctcgtgtatcatctcaaggaagggctggaacatggcgtggaagttcaggggctcgtacggagagaagggcatcaagctgcggacgatgcgggacttgggaaagaagaagtgaggcctccggtggggcaggctgaagggcaggtagtggtaggtatcctggggctcccgggtgaagaacctgtcctggaagagctcgtctatgatgctggacgcgcggctgaagtggtcctgcatgacatccagcatgtgcgtctgctgccggtcgttctcc

SEQ ID NO: 201827 - DNA, 601 bp, Human
tccgcaggcagcccgtggagttgtggcggatctcccggcacacagtccggtcatcgtcgccttctggggacacacgagggaagaagagtcagtcatccagccatgcagagatggactccactgattcctattgttatttttatttattttttaatttacagacagggtctcactctgttgcccaggctggaatgcaatggtgcaatcatagctcactgcagcctccaacttccaggctcaggtgactctcttgcctcagcctcccgagtagctgagactacaggtgtgcaccaccacaccyggctaattttttaagtttttatttttgtagagacagggtctcactatcttggccaggctggtctcaaactcctggcctcaaatgatcctcccgccttggcctctcaaagtgctggcatcacaggcatgagccaccatgcccagctcagtttttttcctctttaaataaggataatatcacccttgtgatattgctggagaaaaatcgagatgacacccgctgagccctcggcatggttctcagcatctaacgagttgctcaaaaggccatgagcttccaccccttctcacctcgtatgaa

SEQ ID NO: 201828 - DNA, 601 bp, Human
gcgcttgggaacagaatcaccggggagtcccagggggatgacttttttcaacaagcttttttcaacatggggccgaccaggtggagggcacttttgcatctctaacgacatctcaccgacttcagggacagcctcgcatcatcatctcattctaagatgaggaaccgaagctgcatgaggctcaggacctgccccgggacacagctcaaaggctgcagagctggaatccaaacgcttatctgtctgactccataaaggcagcaccagtgaggccccagtgaccccaggacacaagggatcaggggggacggcttgtggtctggaccccgactcacccacagacaagatctcccggcacttgtcacactggtccttcatccgcaggcagcccgtggagttgtggcggatctcccggcacacagtccggtcatcgtcgccttctggggacacacgagggaagaagagtcagtcatccagccatgcagagatggactccactgattcctattgttatttttatttattttttaatttacagacagggtctcactctgttgcccaggctggaatgcaatggtgcaatcatagctcactgcagcct

SEQ ID NO: 201829 - DNA, 601 bp, Human
tgagacccgtgacttctgtggccagaggctgcgaggggccccaggagagaacacagcgccctaggattgaagcccagctcgcccatgtcggggtcaatcttggataagttattaacctttctgtggctcagtttcctcagagggtcattctgaggaaatgaggaaatgtatgtcgagtgtttagaacagtgcctggcctctggtcagttttgttaaacaaaacacatactgtctgcaatgtcataatctgcagaggaaaatgaagatgcctactgcgcttggcgcttgggaacagaatcamcggggagtcccagggggatgacttttttcaacaagcttttttcaacatggggccgaccaggtggagggcacttttgcatctctaacgacatctcaccgacttcagggacagcctcgcatcatcatctcattctaagatgaggaaccgaagctgcatgaggctcaggacctgccccgggacacagctcaaaggctgcagagctggaatccaaacgcttatctgtctgactccataaaggcagcaccagtgaggccccagtgaccccaggacacaagggatcaggggggacggcttgtggtc

SEQ ID NO: 201830 - DNA, 601 bp, Human
taatggtgccactgcactccaggctgggtgatagagagagaccctgtctcaaaaaaaaaaaaaaaaatcaacagcgctgaaattgagaaatcctcatctagagttcccaggcagtacgtgcttatatggttgcaagcaccttaaataacagtaggcagtcctcttcagtgtagactatttagctcagcttagagaattattcttaccaataattctctaagaatctatctcaggtcaggcacagtggctcacacctgtaatcccagaactttgggaggccgaggcgggcagattacttgasgtcaggagttcaagaccagcctggccaacatagtgaaatgctgtctctactaaaaatacaaaaattagctgggtgtggtggtgcacacctgcactcccagctacttgggaggctgaggcaggagaatcacttgaacccaggaggcggaggtcgcagtgagccgagatagagccactgtacgccagctataatcaatgactgataagactggcgctggctgcactctcaactgtaatcaatgactgttaagattggcgccagacctgagcccagcctgggcaacagagtaaaaatcagcat

SEQ ID NO: 201831 - DNA, 601 bp, Human
tgaggtaggaggatcacttgagcccaggagttagagaccagcttgggcaatgtagcaagaccccatctctactaaaaataaaaaaattagccaagcatggtggagcacacctgtagtctgttactcaggaggctgaggcaggaggatgacttcagcccaagaggtctaggctgcagtgagctgtaatggtgccactgcactccaggctgggtgatagagagagaccctgtctcaaaaaaaaaaaaaaaaatcaacagcgctgaaattgagaaatcctcatctagagttcccaggcagtacrtgcttatatggttgcaagcaccttaaataacagtaggcagtcctcttcagtgtagactatttagctcagcttagagaattattcttaccaataattctctaagaatctatctcaggtcaggcacagtggctcacacctgtaatcccagaactttgggaggccgaggcgggcagattacttgaggtcaggagttcaagaccagcctggccaacatagtgaaatgctgtctctactaaaaatacaaaaattagctgggtgtggtggtgcacacctgcactcccagctacttgggaggctgag

SEQ ID NO: 201832 - DNA, 601 bp, Human
acctggagggattcgtcgagctcccgccgcagcttagcctgggaggggttgttggtggaacagtctgcccagagatggaagaaacgcaagtgagaagtgtgaagggaaggctacaaagggatagaaccatgaatgaatggaagttagcacatgcagcgggaacaaaagcagtgcttccctaagggaagggccacaaactggaattgtccacgacaaaataaaggttttgcctcagaatgtgaatctagacactgcttccgtcatccagaaagtcttttgggttttttgtttttgtttttgkttttttgagacagagttttgctctgttgcctaggctggaatacagtggtgagatctcggctcactgcagccttgacttcccaggctcaggctgtcctccaacctcagcctcctgagtagctgggactataggcacatgctaccatgcccagctaatttttgtattttttgtagacacggggtttctctgtgttgtccaggctggtctcgaactcctgggctcaacccatctgcccaaaaagtgctgggattactggtgtgagccaccacgcccagcctgagaagccttgctctggaaaaa

SEQ ID NO: 201833 - DNA, 601 bp, Human
tcagcgacctggagggattcgtcgagctcccgccgcagcttagcctgggaggggttgttggtggaacagtctgcccagagatggaagaaacgcaagtgagaagtgtgaagggaaggctacaaagggatagaaccatgaatgaatggaagttagcacatgcagcgggaacaaaagcagtgcttccctaagggaagggccacaaactggaattgtccacgacaaaataaaggttttgcctcagaatgtgaatctagacactgcttccgtcatccagaaagtcttttgggttttttgtttttgkttttgtttttttgagacagagttttgctctgttgcctaggctggaatacagtggtgagatctcggctcactgcagccttgacttcccaggctcaggctgtcctccaacctcagcctcctgagtagctgggactataggcacatgctaccatgcccagctaatttttgtattttttgtagacacggggtttctctgtgttgtccaggctggtctcgaactcctgggctcaacccatctgcccaaaaagtgctgggattactggtgtgagccaccacgcccagcctgagaagccttgctctg

SEQ ID NO: 201834 - DNA, 601 bp, Human
cgcaggaaaggcccgcctgcttaccggtgctttttgcggtattcctgcagcgctttctccgccacggtctccataaatttagggttcttcctggagacttctacagggaccgtcacagtgatgggatcagagtcaaagagcttcacgaccacctcagtgacaccggaaggaacgtccgagtcagaagtgtgggaagccacctaaatggaacaagagaaaagggaagagctgaaacactgtggtcaaaatgcatgcgctctgcaacagaagtcaggcttctgataaggaagtcctcctgctyctccaaggaaacctagagagctgaccccatgcttcttatacatctagacgtaagtacagctcagtggacagaacggacctggttcacagacactcatgtgttggggcaaatgtcatctgcaaatgaccagcccagggagcaccccaaagaataaaagtggtttccaaacatttgctttagaagcagcccttggtcagagtagggtagaaaaggaatccagagggcctggagggaagaaagaaaagaaaaagaagagttcccagtactagaaataagttttatttgattttttaactttat

SEQ ID NO: 201835 - DNA, 601 bp, Human
agaaacggccagacccaggaaatcggagccgtgggtgctgtgcacatgcccggagctcgccagccttccgcggggaagaggggttctatttttggagtaaatttgacactatagggtgtttctccctctttgtcctctcaacatattcagacaggggaggctgggggaggctaggggtgacggtgtgagggcacagccaggctgctgcctctaaagctcaggttagggagccacggggtttcagctcctgcccccgctccccgctccctcccgggcccttccgcagccccaggggttatartctcacccccagcccaccctgactctcctgcagccactccttgcacctgagaggtcatcttctgaatcaagccctggctggaggaaagcaagggtgttctggggcacaggggagctcgtgtgtatgtgtgtgtgtgtgtgtgtgtgtgtgtgtgtgtgtagttaacactggccattctggtatcttgagaagccgcctcctgagtgccactcaagggttaagttcagagctgcctctgcctgctgtcaggctgcgcgtgggcaccgctttgggtgggtgagcgtggagcggcatatgggt

SEQ ID NO: 201836 - DNA, 601 bp, Human
ttggagtaaatttgacactatagggtgtttctccctctttgtcctctcaacatattcagacaggggaggctgggggaggctaggggtgacggtgtgagggcacagccaggctgctgcctctaaagctcaggttagggagccacggggtttcagctcctgcccccgctccccgctccctcccgggcccttccgcagccccaggggttatagtctcacccccagcccaccctgactctcctgcagccactccttgcacctgagaggtcatcttctgaatcaagccctggctggaggaaagcargggtgttctggggcacaggggagctcgtgtgtatgtgtgtgtgtgtgtgtgtgtgtgtgtgtgtgtgtagttaacactggccattctggtatcttgagaagccgcctcctgagtgccactcaagggttaagttcagagctgcctctgcctgctgtcaggctgcgcgtgggcaccgctttgggtgggtgagcgtggagcggcatatgggtgatgttctgcaagccctgccacctgccctaagcctcgaccacatgacactggcatctccctataccccaaactgggagcaaaatccaagtc

SEQ ID NO: 201837 - DNA, 601 bp, Human
gacaaggtgagtgtggcatggcctctgctcaccagggcagtgtgggataccgggtggttgagggagggctgccaggggaaggtgcagggtactatccaaccctgcactagagggctgtggggggagccagtcagcaatggccaggagggcgtcctggcagaagtgactccaaattgagagctgaaggatgactagaaattagcacaagagaagaggggaaagaacagcaagtgcagagactggaggctaaaagcagcaggaggctggaagcagcgggcggcatccaggaaaatgaaagtarctgggcttgttgggaacctagagcgtgcaggggcgaggggaagctgcaggggtgagtggagactgctctagaaggctttggaaggcctgccaggctgccatggcaacttctgttggagcaacacttgggacctggagccaggcaggagacttcccagcaggaagagattgccagatttagccaataaaagcacgggacactcagatttgaatttcagataagcactcaatggttttttttttcactacaaatatgtctcatgaactacatggaacatacttatactcaaacattattcac

SEQ ID NO: 201838 - DNA, 601 bp, Human
agatctgggttcaaatccatgtagaccggtgagcttctctgaccctcagaatcctcttttctgaaatgagggcaggagtatctgtttgtgcaggtggttgggaggatccctgataatgtatgtaaattgcctagtgagtactaaaggaaacatggtacatattgaattttgcaacaccttcacagggttgagcaaagcaacagccacagagtgcttgggttcatttacttccacaagtgagcacttggaggtctcaggtgaaatacatagtagggttcatgcttccagtgagaactcgtgrggttagcccttgggttggggacagagtctgcattatgtttttagctttgctactcccttcccatatgacctgcttcaaggggtggagatataacactcttcttgagggatggtgggtgggcagagagtgactcaaagtagaattaactgaagggaaatgtgaatgaattaaagtagagaatccagataaaatattcagcgcagacaaatgcgccatgaaatttggctgtcatgattcccagttttaggatgagttccttattagaaaagtagcgctaagagatagaggaagtgaaggtgc

SEQ ID NO: 201839 - DNA, 601 bp, Human
tgaaacgttcaaatgagcctgcacttggacatgtgtcttgaatatttgcaagatcaaggttatgataagtcctgcataaaaagacacgtgtcattccctgaggatggctgtagagcccatgcacattctcagggaaacagcattccacattgagtgaaccttgatgtgagggcagtttggggaccaagcaggtcgttcagaaggcatagcccttctcataactctagccaggatggacctaattcattctagactaggcagtgtccaacttagagaagatcttcaaggaaggagcccttgygtgcaacctttttttttttttgagatggagtctcactctgttgcccaggctggagtgcagtggcgcgatctcagctcactgcaacctctgcctcctgggttcaagtgattctcctgcctcagcctcccgagtagctgggattacaggcacgcaccaccacgtccagctaatttttgtatttttagtagagacggggtttcgccatgttggccaggagggtctcaatttcttgacctcatgatctgcctgcctcagcctcccaaagtgctaggattacaggtgtgagccaccgcgtctggc

SEQ ID NO: 201840 - DNA, 601 bp, Human
attccacattgagtgaaccttgatgtgagggcagtttggggaccaagcaggtcgttcagaaggcatagcccttctcataactctagccaggatggacctaattcattctagactaggcagtgtccaacttagagaagatcttcaaggaaggagcccttgcgtgcaacctttttttttttttgagatggagtctcactctgttgcccaggctggagtgcagtggcgcgatctcagctcactgcaacctctgcctcctgggttcaagtgattctcctgcctcagcctcccgagtagctgggaytacaggcacgcaccaccacgtccagctaatttttgtatttttagtagagacggggtttcgccatgttggccaggagggtctcaatttcttgacctcatgatctgcctgcctcagcctcccaaagtgctaggattacaggtgtgagccaccgcgtctggctgtatgcaatctttctagcatcatgcatccttcagagacacaaactcccacctgtatcagcctgagtcttcccattgcagatccggccatgtttcatcgtgcagaggaccctggagaaagtccaagtcccttggcacttag

SEQ ID NO: 201841 - DNA, 601 bp, Human
ttttgtatttttagtagagacggggtttcgccatgttggccaggagggtctcaatttcttgacctcatgatctgcctgcctcagcctcccaaagtgctaggattacaggtgtgagccaccgcgtctggctgtatgcaatctttctagcatcatgcatccttcagagacacaaactcccacctgtatcagcctgagtcttcccattgcagatccggccatgtttcatcgtgcagaggaccctggagaaagtccaagtcccttggcacttagctctccatagtgacgacagtagctccatgtrccccaaatactgctaggacaaaggaaactgatggtgaggctagggaggggagggaggctaccctggggctaccctgcatggtaggtcactcagtctctagtttcccctgcctgggacccatatgtctcaggaccatgtgaccctggcctcccaggtaaatggccacattgggggatggagtagaggtgcagagctgcgacgtgcccggggctgaaagtgtggtgatgaagataagttttgctggcttgaggatgaagagtttccttgtagagtacgggtcagttccagggttaaggagaa

SEQ ID NO: 201842 - DNA, 601 bp, Human
agaaagagcagggatagtggtgactctgcaacactgatatgccttatctgtccaagcagtcggatggtcaagagctcaggctcagtcagtctgcctgggttccagcccaggtttggtaccccctgagtgacgttaggtaggtgagttagccctagcttcctatttgcaagatggagacaataacagggctttgggtgagggtggcatgagatagtgtacattagagagatattcaaaatacagctactaaaacctgagtacagatcaaacagaacagacaccaccattactctgagcagcktcagagaggcccccttccatgccaggctcaccccgtcagtgcatcttgtggagtctgggggtggaagaaacaggcctttggagggctgtagcgtggacatatccaacgaggatggactgtttcgatatttcaacaacccagatgcacccgcttaataatagcatcttatgcacccactgaataataatagcgtcgaagtacaataaaacattcagtcccataattaggcagatgatatgcatccaataagtatgagctctctggtatctttacacatatggccatatctgagctggcggg

SEQ ID NO: 201843 - DNA, 601 bp, Human
gacagtttattaagaagagcagacttgaggctgcatgttccgacacacttttcacccagatgcagcgggcaggttggtgtgaatgcagagtttaattttcaggagaccctccaggtaggccacagggggcctgcaggggtggacgctgctctgagtttagtggtcttcgtggcctcttaccttttcccagcactaaggtggttgctgcttttatgaggcagccagttagtgtgactaaaaccaagatcagcaatggccaatacctgcgggaggcaagccttcccgtttcctagcttggctrtgttcgctaacatcttccccctctccagttctctctcttccttttatgttctgaaatccacccacacagaatctggtaagatcactcactagagacaggagggctcaaagaatccacctcgcccagggtttagagctcggtaccaggtttaattcacatctcctgcatttgtcttcctttaaattggaccaattctcccaataattgtgggggcagacccccttttaatgccctttctttcttgagggccttgcacctgattctgtgagaacctgccccccacaagccatagcagtccca

SEQ ID NO: 201844 - DNA, 601 bp, Human
tgttcgctaacatcttccccctctccagttctctctcttccttttatgttctgaaatccacccacacagaatctggtaagatcactcactagagacaggagggctcaaagaatccacctcgcccagggtttagagctcggtaccaggtttaattcacatctcctgcatttgtcttcctttaaattggaccaattctcccaataattgtgggggcagacccccttttaatgccctttctttcttgagggccttgcacctgattctgtgagaacctgccccccacaagccatagcagtcccamtggttcatatgggggtgattgatggggaggggtgtactgggaattctgacctgagtttgggttttgctcttctgggggttcccttctcacctttctcacctgggacggaatggcccctgtggtggttctgaccacttggagcaccatcattttctggtttttttttttcttttctttttttgagacaaagtctcacttgggtgcaggggcatgagccaagactacaggcacatgccaccacacctggcttattttctttctacaacctctacctcctgggttcaagagattctcctgcct

SEQ ID NO: 201845 - DNA, 601 bp, Human
cctgcatttgtcttcctttaaattggaccaattctcccaataattgtgggggcagacccccttttaatgccctttctttcttgagggccttgcacctgattctgtgagaacctgccccccacaagccatagcagtcccactggttcatatgggggtgattgatggggaggggtgtactgggaattctgacctgagtttgggttttgctcttctgggggttcccttctcacctttctcacctgggacggaatggcccctgtggtggttctgaccacttggagcaccatcattttctggtttytttttttcttttctttttttgagacaaagtctcacttgggtgcaggggcatgagccaagactacaggcacatgccaccacacctggcttattttctttctacaacctctacctcctgggttcaagagattctcctgcctcagcttcccgagtagctgagattacaggcacccaccaccatccctggctaattcttttatttttagtagaaacggggtttcaccatattagccaggctggtctcgaactcctgacctcaggtgatccactcccctcagcctcccaaagtgctgggattact

SEQ ID NO: 201846 - DNA, 601 bp, Human
aattggaccaattctcccaataattgtgggggcagacccccttttaatgccctttctttcttgagggccttgcacctgattctgtgagaacctgccccccacaagccatagcagtcccactggttcatatgggggtgattgatggggaggggtgtactgggaattctgacctgagtttgggttttgctcttctgggggttcccttctcacctttctcacctgggacggaatggcccctgtggtggttctgaccacttggagcaccatcattttctggtttttttttttcttttctttttttgagacaaagtctcacttgggtgcaggggcatgagccaagactacaggcacatgccaccacacctggcttattttctttctacaacctctacctcctgggttcaagagattctcctgcctcagcttcccgagtagctgagattacaggcacccaccaccatccctggctaattcttttatttttagtagaaacggggtttcaccatattagccaggctggtctcgaactcctgacctcaggtgatccactcccctcagcctcccaaagtgctgggattactggtgtgagccaccacaccct

SEQ ID NO: 201847 - DNA, 601 bp, Human
tcacctgggacggaatggcccctgtggtggttctgaccacttggagcaccatcattttctggtttttttttttcttttctttttttgagacaaagtctcacttgggtgcaggggcatgagccaagactacaggcacatgccaccacacctggcttattttctttctacaacctctacctcctgggttcaagagattctcctgcctcagcttcccgagtagctgagattacaggcacccaccaccatccctggctaattcttttatttttagtagaaacggggtttcaccatattagccaggctggtctcgaactcctgacctcaggtgatccactcccctcagcctcccaaagtgctgggattactggtgtgagccaccacaccctaaattaatgtactgatttagggtttctgatttctaaattaatgtactatgtccatcccactgctctgggaacctcaagtgcttttctatgttctctggcagtatttggagtcaaaacccaacccctctcacccagctccatgtacccagtccccgcccccaggtcccaccccaggtaggttatgagagatctgatgctgctgcactttgcacctc

SEQ ID NO: 201848 - DNA, 601 bp, Human
aatgccagccccatgcacttcaccagtcctacttactcctttaaggctcagtcggtgacccacccttttggaggacatctgagctccccatggcagcttctgggcttctttgcatcctgggatctcccagaatctatttttcaacctgatgctacattcctccacagcagggagatgccttttattttgttcttcttccttataccgtcaaattccaaggatagaaaattgcatttccctgggcctgtgaaaagggatccctccctccctgcacactcatgcctggctcacacggagtgarccagacagcgcttcctcattccccgcagtgggtgtcgcaacagccagttgcaactagaataggggccacatcccgagtctcttgaattcttgccctgtggttaggatgcccttcttgcctgtcctgaaggtggagatttcctacagccgagagagagggagtcagcagtctagggcaggaactccatcatttctttattaaaccactcctaactctctctaatctctgtgagtcttgcctttcccttttctctcctcctcctactgttgagtacaactaggccaggctgaatgagaggag

SEQ ID NO: 201849 - DNA, 601 bp, Human
catatcccaccacatgctatggggtgagtcccctgggtaagcctgttcaagcctcctgttttttatttgtatgtgcaatcagggggtgtggggactttttagcaaagctttcttcaaagcagatcttaggcaagagcccaatataaaccaggcaaaaatattcctatccagggttgaagtgagaaggcgaggtacctaccaggcccttgagtcccctccatggatctcctggggtgcaggtcatctggaattctttccgggtctcaggctcgtgaggtgctcattgtgtatgtgtcatggragctggagaatggctgtaggtgcaaatggacttggaaaagaacaatgtcaaagtcgtaagtccagcctggggcatggcaggtttatgtatgtgtgagtggcgggaggggctgtagatttgaactccctgaaagaagatatgtgtaattcttaccaaagagtaaatgcatatgtttatgaaagaaagttcattgctatcatctggctctccaaggcacctgtgaccccaaaagattaagaacatctctcataagatattatcatccgttctacaaacctttcataaaaatgacctcaaact

SEQ ID NO: 201850 - DNA, 601 bp, Human
taagtccagcctggggcatggcaggtttatgtatgtgtgagtggcgggaggggctgtagatttgaactccctgaaagaagatatgtgtaattcttaccaaagagtaaatgcatatgtttatgaaagaaagttcattgctatcatctggctctccaaggcacctgtgaccccaaaagattaagaacatctctcataagatattatcatccgttctacaaacctttcataaaaatgacctcaaacttgagctcctttttaattcagacaaactaggccataagccctgttgaggaaagaaccktatctgtatggagagtcactgttacatcccaaggacacagcctggtacctgacacacagctggcattgagtacgtacaatgtgtgcctgatataaggcagctctgttctcccaataaggagggctgctaaaaaaaaattaaaaagcttattttcatatgtaaactttgtaggataatgttgaatagattattttagcgatacattttcaatcacatgctaataacaatacattaacttaaatactgctttcccccaactctcccagtttaggaaacattgtaactgttcactcccatctc

SEQ ID NO: 201851 - DNA, 601 bp, Human
tgatccaaaaggagtttatttacttatttattttttatttttgagacggagtctctctctgtcacccaggctggagtgcagtggcacaatctcggctcactgcaccctctgccttctggattcaagcgattctcctgcctcagccccacgtccccaccacccgtcccccctccccccgccactgccagttttttaataaccgctaattaatacttattgatgaatagtagttttttgagatacaattcacataccgtaaaattcaccttttaaaaatgtgcaattcaatgagttttagtaygttcacagagttgtgcaaccatcaccgctttttttctttttttgacaagagtcttgttctgttgcccaggctggagtgaatggcatggtatcagctcactgcaacctctccctcctgggttcaagtgattctcctgcctcagcctcccaagtagctggaattacaggcacctgccatcatgcctggctagtttttgtattttttagtagagatggggtttcaccatgtcggccaggctagtcttgaactcctagctcaagtgatccacccgcgttggcctcctaaagtactgagattaca

SEQ ID NO: 201852 - DNA, 601 bp, Human
cccgtcccccctccccccgccactgccagttttttaataaccgctaattaatacttattgatgaatagtagttttttgagatacaattcacataccgtaaaattcaccttttaaaaatgtgcaattcaatgagttttagtacgttcacagagttgtgcaaccatcaccgctttttttctttttttgacaagagtcttgttctgttgcccaggctggagtgaatggcatggtatcagctcactgcaacctctccctcctgggttcaagtgattctcctgcctcagcctcccaagtagctggrattacaggcacctgccatcatgcctggctagtttttgtattttttagtagagatggggtttcaccatgtcggccaggctagtcttgaactcctagctcaagtgatccacccgcgttggcctcctaaagtactgagattacaggcgtgagctactgcgcctggccctccatcactgctatctaattgcagaatattctcgtcactccaaaaagaaacccccgtaccataagcagtcacaccgtgttctccactcccccgtcccctggcaagactaatctactttctatttttatggatctg

SEQ ID NO: 201853 - DNA, 601 bp, Human
ggcaagactaatctactttctatttttatggatctgccttttctggtcattccatataagtggaattgtacaacactgtggcctttcgcgacggctgctttcacttagcacaatgttttgaaacttcctccatgttgtaacatctattagtacttcgtttcgttttgattgatatttattgatgagtaacattttgttgtgtggatatgccatattttgtttatctcttcattagtaaacatttggattgtttccactttttgaccattgtaagtactgctgctataaacattcacatacragtttttttgtggacatatgttttcatttctctgagctatagacttaagagtggagttgccgggtcctgtgataactctgtttaacattttgaggaactgttgaatggtttttcacagcagctgcctcattttttattcccatcagcagtacttcttggttctaatacctccacgttctcgccaacacttgttgttgtctgtaatttcgttgttagccatcccagtggggatgaagtagtatcttactgtggttttcagttgcgtttccctgataattaatgatggtgaacatcttttca

SEQ ID NO: 201854 - DNA, 601 bp, Human
tgattgcaggccttggtccagagttgtaagtcaccagagtgggacctttaggcttgtgacatgataacaaggattttcttgggtgggccccccagctcttcattgctctttccatcagcacaaaggcttctgggttgctgatgttttgtgtggtggccctggaggtctctccttctaccttctctggggtgagacagtctgatccatctcagaggccacactcaccacctactgcacagagacacagccccctccccatcctttaccattggtcctttcttaagaaaatgtgtcagctggyaaatggtactctggagtttggggtaagagagagaaagaggaagaatactgggcaagaaggtaagaaaggaagctgtggcctgacatgggcacagagacatgggcgaaagcttgagagatgacctttaaaggctcagaccccggaaagggaagaagttgggacaatggaaagactggcagggtggtaacatagcaggcaggctctggcgtagttgactctggattgtgtatggttggagttggggatcagggggtcagggacagtacacagcaatgtggacatacatggcctggactcctt

SEQ ID NO: 201855 - DNA, 601 bp, Human
gaaatgaggggcatcagagagattcagataagaacaagatgcacaaaagctcatccactcccaaaagagctgagtgagtggaggactccctggccccaggatgcggccacttcagtggagggtgttctgaggggagatgtgtgtcatgaccaaggcgggcagtccttggactcactgcagcccttcagcatagcatggagtcagtggcatcagaatcacttgcagggctgtgggggggttttgtgtgttttttgtttctgacagggtcttgctctgttgcccagcctccagtacaatagcrtagttatacctcaatgcagcttctacctcccaggctaagcaatcccctccacctcagcctccctagtagctgggactacaggcacccaccatcacactcagctaattttaaaatattttttgtagagatggagtcttgctctgttgcccaggctggtcttgaacccctggggtcaagtgatcctcctgtcttatcctcccaaagtgctgggattacacaggtatgatccaccccacctggctgcagggctttcaaactgggctccaactccatagtttctgccacagtgcatctggggag

SEQ ID NO: 201856 - DNA, 601 bp, Human
attcattggacatgtgccttccccacttacactatagtcctgaggatggagtcctggctcctttatcccccctcagtgggtcacatagaagatgtattccatccatatctgctgaattgcagtgagaagggcctgagaaacaaaccaaagcaaaccgagacctgtttacattggcccttgctggacaccagctctcgaaacgcacctaccaaggcctgggtgatggggaggaggaggcgtttgtgaagccacccctgagctgatgtggccgagtgccagggtccgatgtgctcatcaaccktgaaaataatttgattactgatctgtatcgctcagggatctaccacccccagagctgtattaagaatgttttcctcaggcaacaaatatgcgggctttgacatccaagtcagcctcaggaatttcattttatgattgatccttctttgtttgtttgttgtttgtttgtttattttttgctcgttcttgtacatcttccagatccaccttcttcttctggatctctcagttgacatacagccaagccctcccactgctcccttcccctctcaaatcatttccaaacatggttcctcttcct

SEQ ID NO: 201857 - DNA, 601 bp, Human
ttcttcttctggatctctcagttgacatacagccaagccctcccactgctcccttcccctctcaaatcatttccaaacatggttcctcttcctcaagcctgactcaaggtcttgctcttttactttgttacgaaagtcacaaatgactttgaaatgaagccactggtgttttccaggcagatggggtcccctaacctggggaccccatgtagtccccaaagctctggagtgttccagataactgtctgggaatgactgcccttttatgcttttttatacctgtctaatgacatatcacccyggaggggatgcccagctcacagaatgcaccttcagccagtctcagcccaatgccacagaggtgtgcttgacaaccccattcaacctttaccttattcattcactgttaccatgtcgcctgccttctgacctttctcctttaaaaaaatttctttcgccaggcgtgctggctcatgcctgtaatcccagcacttttggaggctgaggcaggtggatcacgaggtccactctcagattgagagcatcctggttaacgtggtgaaaccctgtctctactaaaaatacaaaaaattagccaggt

SEQ ID NO: 201858 - DNA, 601 bp, Human
cagctcacagaatgcaccttcagccagtctcagcccaatgccacagaggtgtgcttgacaaccccattcaacctttaccttattcattcactgttaccatgtcgcctgccttctgacctttctcctttaaaaaaatttctttcgccaggcgtgctggctcatgcctgtaatcccagcacttttggaggctgaggcaggtggatcacgaggtccactctcagattgagagcatcctggttaacgtggtgaaaccctgtctctactaaaaatacaaaaaattagccaggtgtggtggtgggcrcctgtagtcccagctacttgggaggctgaggcaggagaatggtgtgaacccaggaggcggagcttgcagtgagccgagatcatgccactgcactccagcctggatgacagagcgagaatccgtctcaaaaaaataaataaataaaaaataaaaaaataaaaattttttcatcagtgctgtaactaaaggaaaatgcactaagtttggagaaaggactcctagactcagttcctgcctatattttactctttagggaaatggcacacccctcagcccatgtatttgtgcgccctctcccac

SEQ ID NO: 201859 - DNA, 601 bp, Human
tcctccttgcttttatttctccctcttttcccagagcaatgaacaaattataccaccccagcttcctcgggcctcatcttctaactgcaatgatttagtgagcacatgtttctaaatagttttcttcttaggaggacttctgttaccatctcctcttcatcttttatacatttaaacacatgccacatccttggggcagagctgcccatgttgacatctgggccacagcgaggacctgcctatccctggggaatggtggggctgctctgagtgaggggcttagcagcctggaggacaaccyctcttggagaatccccctgattcccctgtaaaggcaagctgagccaggagtggggtgtggatgattctgtttgtgaatcctgggaagtacttgccttccccagcctgcagatatgacatttggatgatgggacccagtaacctatttgtgcagacttctatgctgactttctgatcaaaggaggagatgagaggtaggcagcttctatgacacatgggtgattccaggcatggaaaacatacgaaacctataacattaatgggaaggcgagtcaggtgaaaatgtgtatatgtgccccag

SEQ ID NO: 201860 - DNA, 601 bp, Human
gtcccaacacctcattccaattgttggataactcatggctggaaagttctttctttcactgagccaaactgtctgaagctcacgctcctttggtgctgaactgcacttggcaatagcccagaatgatgactgttttgcagtttgacagccctcagtgatagggagctacccaccgcattatcccctgatctaggcttaacatcaagagttacttctcctcttctttgcatgaggtgggttttcagatgtcgtgcctttctggctctccacttctggatcaatgattctgttgccatcttaraaagtcatggctaggctggacactatggcttatgcctgtaatccaagcactttgggaggccaaaacgggtggatcacttgaggacaggagttcgagaccagcctggccaacatggtgaaaccccatctctactaaaaaaaaaaaaaaaattaaccaagcatggtggcatgcgcctgtaatcccagctacttgggaggctgaggcaggagaatcacttgaatccaggaggcagaggttgcagtgagccgagatccacccacctcggcctcccaaaatgttgggattacaggaatgagccac

SEQ ID NO: 201861 - DNA, 601 bp, Human
aaactgtctgaagctcacgctcctttggtgctgaactgcacttggcaatagcccagaatgatgactgttttgcagtttgacagccctcagtgatagggagctacccaccgcattatcccctgatctaggcttaacatcaagagttacttctcctcttctttgcatgaggtgggttttcagatgtcgtgcctttctggctctccacttctggatcaatgattctgttgccatcttaaaaagtcatggctaggctggacactatggcttatgcctgtaatccaagcactttgggaggccaaarcgggtggatcacttgaggacaggagttcgagaccagcctggccaacatggtgaaaccccatctctactaaaaaaaaaaaaaaaattaaccaagcatggtggcatgcgcctgtaatcccagctacttgggaggctgaggcaggagaatcacttgaatccaggaggcagaggttgcagtgagccgagatccacccacctcggcctcccaaaatgttgggattacaggaatgagccactgtacctggccattcttatgttagtttgctcaactgtcatcagaaagtaccacagactgggcagc

SEQ ID NO: 201862 - DNA, 601 bp, Human
cctcagtgatagggagctacccaccgcattatcccctgatctaggcttaacatcaagagttacttctcctcttctttgcatgaggtgggttttcagatgtcgtgcctttctggctctccacttctggatcaatgattctgttgccatcttaaaaagtcatggctaggctggacactatggcttatgcctgtaatccaagcactttgggaggccaaaacgggtggatcacttgaggacaggagttcgagaccagcctggccaacatggtgaaaccccatctctactaaaaaaaaaaaaaaaattaaccaagcatggtggcatgcgcctgtaatcccagctacttgggaggctgaggcaggagaatcacttgaatccaggaggcagaggttgcagtgagccgagatccacccacctcggcctcccaaaatgttgggattacaggaatgagccactgtacctggccattcttatgttagtttgctcaactgtcatcagaaagtaccacagactgggcagcttcaacaacggagatttattttctcccggtactggaggctggaagtccaacatcaaggtgtcagcagggctggtttcttctgag

SEQ ID NO: 201863 - DNA, 601 bp, Human
tggctctccacttctggatcaatgattctgttgccatcttaaaaagtcatggctaggctggacactatggcttatgcctgtaatccaagcactttgggaggccaaaacgggtggatcacttgaggacaggagttcgagaccagcctggccaacatggtgaaaccccatctctactaaaaaaaaaaaaaaaattaaccaagcatggtggcatgcgcctgtaatcccagctacttgggaggctgaggcaggagaatcacttgaatccaggaggcagaggttgcagtgagccgagatccacccrcctcggcctcccaaaatgttgggattacaggaatgagccactgtacctggccattcttatgttagtttgctcaactgtcatcagaaagtaccacagactgggcagcttcaacaacggagatttattttctcccggtactggaggctggaagtccaacatcaaggtgtcagcagggctggtttcttctgaggcctctctatttggcttgcaaatgccatctgttgcctgtgtcctcacatggtcatccctctgtgtgtgtctgtgtcttaatctcctcctcttataaaggcaccagccata

SEQ ID NO: 201864 - DNA, 601 bp, Human
cacagctcctaactcattcactcatgcatgctcgctctctctctaacacacacacacattgatcctgtggtcaccatagcacagccctgtatctacctagtaatggcagaccaagacagcacttgaacagatgaggcaactagggtagggctgttcccaggggaggctgttcaggaggcacgatttctactgctcagctgcatgaaggttaatagcctggagtgccaactccgtaaaccttatcagtcacttagacctgactatgggtggctctgtaagatatttcccaagagcaggggamaaagagcctcagcagaaatgggcctgctattgaagatgaagcagggaaaggcaggtgtcacacccctgtttattgtcccagcactcttttagttgcagatgacagaaacccaaaagagaggattcaccttggctcacatacccaaattaagggaagattcaggaagcagctgaactcaggtgtggtgggaatcaggacctcatcccagaacctcagacatctctgtgtctgcccctctgcctctgcttctgtctctcacatctctggctgtcattacatgttggcttaattctttcagaa

SEQ ID NO: 201865 - DNA, 601 bp, Human
aactccgtaaaccttatcagtcacttagacctgactatgggtggctctgtaagatatttcccaagagcaggggaaaaagagcctcagcagaaatgggcctgctattgaagatgaagcagggaaaggcaggtgtcacacccctgtttattgtcccagcactcttttagttgcagatgacagaaacccaaaagagaggattcaccttggctcacatacccaaattaagggaagattcaggaagcagctgaactcaggtgtggtgggaatcaggacctcatcccagaacctcagacatctctgkgtctgcccctctgcctctgcttctgtctctcacatctctggctgtcattacatgttggcttaattctttcagaacaacttgtgccaaaagaaaggaacttggtggctaatggtgtctgagctcccagccatagccctatcacccagagaaaagcccttttccccaagctaaagtaaaaatgccaaagaataactctgattagtttggctaagatcgtgtgtccatttctggactaacccccacagccaaaagggtggggtactgtgtttgcttcctcttgattaatgtgccccatcctgt

SEQ ID NO: 201866 - DNA, 601 bp, Human
ctcccaagcagggaaaggagacgttgcagacagatgaaacaattgaggtcacctgcaatctatgtgcaagcagtttttgatttgcggccggcaggtatgttgactgttgggaggactgttaaacttggaaaacaggaaaatagtgacatccgaagtgcttgaaaaatggcagcgtgtaattatagctgggaacaaaataaaactttgcagaaagaacaggtagtgagggtgtgaagtatatgtcaataaatcatttacataccgctgggctgtttgatgattgttattctatgaaggtaamtgagcttgccttccttgtctcattggcctgcttgtaggatctcaccaaccaatttgtgtgtttgctccttgttctgtctctcctgggctggaacccaatgtcaatattagggatggtcttccgacggaatcatccctgattttcaaggatgatatttttattatactgcttatgtctagagctgaaaaaccaccttgctcttcagtcttgagggaatgatgttcttacagtaaacgactctttttgattctgcctcttaactccccagactatactttgttcttattcaaaaggagcatt

SEQ ID NO: 201867 - DNA, 601 bp, Human
attcaaaaggagcattagctctaatactctgctacaggctgtctaataacaacctcccaaagatgtccgcatcctaatcccagaacttgtgcgtgtgctaccttacatgccaaagagactttgcagatgcaattaagttaaggatagtggaatggggagattatcttggattatccggttggacctaatgttatcacaagggtccttttaagagagaggcaggaaggtcagagtaagagaaggcagtgcaacaacagaagcagaagtcagaaagagggagggaagagagagagaagagagmcaagagagagattgtaaggcactatgctgctggttttgaagatggaggaaggaaccgcgagccaaataatgtagcctctaggagctggaaaagacaagaagaaggattctcccctagcaccccagaaagaagtcaaccctgctggcaccttggttttaggacttctgaccaccagaatggtaagataaattagtgttgttttaagccactaaattggtggtaatttgttacagcaatagtaggcaaccaatacagctacctttctggagagcaacttggcagcatgtactaagaaatatg

SEQ ID NO: 201868 - DNA, 601 bp, Human
atcagatctgtagaaatacacttatatatttagaagtttgaggctacgcatggtggctcatgcctgtaatcccagcactttgggaggccgaggccagtgaatcacaaggtcaggagtttgagaccagcctggccaacatagtgaaaccctgtctctactaaaaatacaaacaattagctgggcatggtggcaggcacctgtaatctcagctacttgggaggctgaggcccgagaattgcttgaacccgggaggcagaggtagcagtgagccaagatcatgccattgtactccagcccaggmgacagtgcaagactgtctcaaaaaaaaaaaaaaagttccagtattatctagaatactagaatagtaacaccttggagccgtctgagagccctactggtggctctatctctattataattataacactgttcaagtaagaaaacatggcccccttagtgatgacagtccctctctatgtggcttccagcaatgtgttatgatcgcaggttggggtggcctgtattaggaaaagactgtgatgacagctttgctgttgatctattgattcaacaaatgcttactgaccgtattgggccctgg

SEQ ID NO: 201869 - DNA, 601 bp, Human
gaccagcctggccaacatagtgaaaccctgtctctactaaaaatacaaacaattagctgggcatggtggcaggcacctgtaatctcagctacttgggaggctgaggcccgagaattgcttgaacccgggaggcagaggtagcagtgagccaagatcatgccattgtactccagcccaggagacagtgcaagactgtctcaaaaaaaaaaaaaaagttccagtattatctagaatactagaatagtaacaccttggagccgtctgagagccctactggtggctctatctctattataattayaacactgttcaagtaagaaaacatggcccccttagtgatgacagtccctctctatgtggcttccagcaatgtgttatgatcgcaggttggggtggcctgtattaggaaaagactgtgatgacagctttgctgttgatctattgattcaacaaatgcttactgaccgtattgggccctgggccagagctgagggcaaagagtaaaggacatctatgggattgtaaggaagctgcaagagtctggccagggagatggttatcaacacagagacttcacagaatacttggtgttttacttaaa

SEQ ID NO: 201870 - DNA, 601 bp, Human
tactccagcccaggagacagtgcaagactgtctcaaaaaaaaaaaaaaagttccagtattatctagaatactagaatagtaacaccttggagccgtctgagagccctactggtggctctatctctattataattataacactgttcaagtaagaaaacatggcccccttagtgatgacagtccctctctatgtggcttccagcaatgtgttatgatcgcaggttggggtggcctgtattaggaaaagactgtgatgacagctttgctgttgatctattgattcaacaaatgcttactgacygtattgggccctgggccagagctgagggcaaagagtaaaggacatctatgggattgtaaggaagctgcaagagtctggccagggagatggttatcaacacagagacttcacagaatacttggtgttttacttaaaacttgaaggattgataagaatgaactgcagctgaaaagccaatgaattcatggaatgcagtatagatcctcactgctcacgaggaattctgaaggctctgatgaactgcagctgaaaagccagtgaattcatggaatgcagtatagatcctcactgctcaccagg

SEQ ID NO: 201871 - DNA, 601 bp, Human
tcctctgatacccaggtggcctccatagctttagtgcccacacactgctttagatttttccggatatttctgacacctgagaatttcttctttaccactcggatgtgattaagatgtctttgttatggtttattcagcatgccatgcatatgaagggggaagggcccagtcgacattaggtctgtctattacaggactgaaaaatcatacatccccatgttctcacattggcaaaagctcactttcatttattcagtcaacaaatgtcactgagtcaactagaatctaggtctagggtgaygcataaagagacacagtcctccctgagctcccagaacttaacacccagaatgggagatgggctggaatcagacagcccaaggaatccatgcgcgatgccggcaagcgccgcagagaaggaaagtcatgctgatgctgatgggagacggctgatgctcagaggaggcctggcctgggcaggggtcagggagggatagagacagggagctgtcacagaggccagaggacagcccaagagcattcagtgtttctggtgcccttcctccttccaggtccctccctccttccagccccgttcctc

SEQ ID NO: 201872 - DNA, 601 bp, Human
caggtccctccctccttccagccccgttcctccaccatggaagccaatgtgacttgtgagctagctggctcctgaaccggtggcagaaccccatggcgatgcaatcataaaggggtgggggtgggtgagagggcaggatttcctggggtacgatgccccaatacactgtgaactaccaaatgacacgtatattctgtgaactttcaaaaaaggatgtgaaagacttctgtgcaaacatttcacctgggatcttttcactagcaagatggggagaaaaagccaaaactgcatttctctcgcyctctgggtctagatgtggggatttcttctccttccagatgacagccaggaagggcccccaattattctcgaaataaaacgtgtcggtctttcgaaatggtcagtggggtgatgtctgggtcccaggaaagaaagaaacataggatttgtgctttttgttgatatgaagttaaggggtacaagtgagagtgattttgttacatgggatacattgcatagtagtaaagtctgggcttgtagtgcaaccatcacccgaatactgtttattgtacccattaaataatttcctatccctcacccc

SEQ ID NO: 201873 - DNA, 601 bp, Human
caatgtgacttgtgagctagctggctcctgaaccggtggcagaaccccatggcgatgcaatcataaaggggtgggggtgggtgagagggcaggatttcctggggtacgatgccccaatacactgtgaactaccaaatgacacgtatattctgtgaactttcaaaaaaggatgtgaaagacttctgtgcaaacatttcacctgggatcttttcactagcaagatggggagaaaaagccaaaactgcatttctctcgccctctgggtctagatgtggggatttcttctccttccagatgacarccaggaagggcccccaattattctcgaaataaaacgtgtcggtctttcgaaatggtcagtggggtgatgtctgggtcccaggaaagaaagaaacataggatttgtgctttttgttgatatgaagttaaggggtacaagtgagagtgattttgttacatgggatacattgcatagtagtaaagtctgggcttgtagtgcaaccatcacccgaatactgtttattgtacccattaaataatttcctatccctcacccccttcccaccctcctgagtctccaatgtctattattccacactct

SEQ ID NO: 201874 - DNA, 601 bp, Human
atttcaccatgttggccaggctggtctcgaactcctgacctcaggtggtctgcctaccttggcccttcaaagtgctgagatttcaggcattagccaccatgcctggccaacagaatctattttaaagaagagttcacttcctgatttcaggagtaatctactgagcacctcgtgtgtgccaggcaccgatccaggcagaggcgcatggcctgggaagtaccaatatgacgcttgagctagggacactcatatgttctgcaaggggaacagggtgttatgtggattgcataagaaagcatayatgcattgcttaaccccatgcctgatacatacaaagcacttgataaacagtagttgctattgtgactatattcaacactagaaatatgatataaatgtggtcagtgagccagaagaggagtttcatttgataaaatcttcagtttcttcctcaaaggcgtaactgtcttttaattaaagggagtgtattagtccaagttccccagagaaacagaacagacaagatgtagagatgtctataaagagatttattataaggaattggcacacaggagtatggagactggctagtcccaagatc

SEQ ID NO: 201875 - DNA, 601 bp, Human
actgagcacctcgtgtgtgccaggcaccgatccaggcagaggcgcatggcctgggaagtaccaatatgacgcttgagctagggacactcatatgttctgcaaggggaacagggtgttatgtggattgcataagaaagcatatatgcattgcttaaccccatgcctgatacatacaaagcacttgataaacagtagttgctattgtgactatattcaacactagaaatatgatataaatgtggtcagtgagccagaagaggagtttcatttgataaaatcttcagtttcttcctcaaaggcrtaactgtcttttaattaaagggagtgtattagtccaagttccccagagaaacagaacagacaagatgtagagatgtctataaagagatttattataaggaattggcacacaggagtatggagactggctagtcccaagatctgcagtcggcaggctcaagacccaggaagagttaatgtttcagtttgattctgaaggcaagaagaagctggtgtcccagttggagggtcctcaggcaggaggaattccttcttactcagcaggggggtcagccttttgttctatttaggcctttaactg

SEQ ID NO: 201876 - DNA, 601 bp, Human
ggagtgtattagtccaagttccccagagaaacagaacagacaagatgtagagatgtctataaagagatttattataaggaattggcacacaggagtatggagactggctagtcccaagatctgcagtcggcaggctcaagacccaggaagagttaatgtttcagtttgattctgaaggcaagaagaagctggtgtcccagttggagggtcctcaggcaggaggaattccttcttactcagcaggggggtcagccttttgttctatttaggcctttaactgattgtatgaggcccattctcrttagggaggtcgatccactttactcagtctaccaactcaaaagctaatctcatgcaaaagcaccctgacagactcacccagaataatgttcaaccaaatatctgggtactccatagcccagtcaagttgatacagaaaattaaccatgacagggagcaatggccagaggacatcatagttgagatagcctagaggagagctgaggacacctgggctgtgctggcaaccaccctgttctggagggaagggtaaccctagctgaggttgggacagaggatgcaaactagtggtcctggaact

SEQ ID NO: 201877 - DNA, 601 bp, Human
cttcactcatgcaagttaccactgctgctgcttttggagaaaagacacccaggcctaaacatcagggtcctgcccctgccacagtggggagcccatggcagcagcatgctgtgttctctctgtgggagcacagcagggaggcagcatgagtctgtgttcaaagcacacatcagacatcttactccctagtccccacacagacttctccaacaagctgctgtctaaagtgttctccctgaccagagtcttcacatagttctttgcctggggaggggacttgggtagtggtgggaaaactctkccccctccaactagaaagtagctaaacaactggagagaattggccttgggcaagcagctaggagaggacccgttgctcctccctgcctctatattgtgtaagtttatcccgacatttaaaacttagagctgggtgtggtggcacacacctatagttctagctgcttggggggctgaggcaggagaatcacttgaggccagaagttggaggttacaatgagctatgatcacactactgcactctagcctgggtgacacagcaagactctgtttctaaaataaattttttttaaaaaaaatt

SEQ ID NO: 201878 - DNA, 601 bp, Human
tgggttggtttgcatatatgaaaggcagctgtcagaaactggctggctctgggagaagcagtccctccagggtcagtggggccccatgtcaaagcatcaaatgtagaaaccagaaaacgtggttattacaaagcctggcccacatgcccttgagagctgaggggatcagtttgcccaagtgcaccagatgcaaagcactgcactatgtgatgtctgcaattcctttcagccttgagatgctgtaaatctaatagcatagtgagctggaaatgacttgggagttcagccttatcttctctttgaacagaagggacctgagtccaaagagctgaaccaacttgattagtctcatgatggattataaagtggggactggaactcaaggctttcccaccatcctgtgaggctggaaggggctgatgggagtggcatgacatcttcatccatgtgatctcacaatcatgaggaggacatgggctcaggagtgccaaggctgcagcatagggagtttctggggcagaaggaagatgtgggcagtagcacagtccctgccagaccagtgaggccctcctgagtccccttaccctgtccttgacatgta

SEQ ID NO: 201879 - DNA, 601 bp, Human
agtatgaaatattcatatgcaagactgttggaagaacgtccctctcacctaatcccctcacctaatcccctcactttttagatgagaaaagctgaggtcagatagataaggtgatgtctccaagttatccgagtgttgctctggggtttaagttgcacatgattcaagagtataaaatcttacagcttatctgtgtgtgtgtgtgtgtgtgtgtgtgtgtgtgtgtgtgtgtgtgtgtgtacacaaggcaatcagaatattctgtcaatagaagcagaaaagtagaacttggttccttctrgggctcctgaaaactggggtgtagacataacccccacactctactcccacctgcttcatcttatcccccaccccaagtggagctaggggagagcagcacacagttcccctcctcactggctgtctcctccctgctgcctcttgtctgtggtgaggctgtggagaagtgggttgctgttcttttttctgacttcctgtgtgcttcagaaacctcaatgaacaaagagctaaaggaagaaagggccccggcaccgttatgccaaacatagactcacatccgacacgggggagctggatgccc

SEQ ID NO: 201880 - DNA, 601 bp, Human
ttcctctctgcaaccactgttttttgtttgcttttggagacagggtctcattctgtcgcccaggctggagtgcaatggcacagtcatagctcactgagctttgaactcctaggccacctcacccacctgggtagctgggactacaggcacatgccaccatgccggggtctttttaaaaattttttgtagagataggagtcttgcctgtggcccaggctggtctcaaacttctgggctcaagtgatctacctacctcggcctcccaaagtgctaggattacaggcgtgagccaccacacccrgcctaccacagctgttttaatttctctgttttccttcagtgtacaactcagctgtaaccataggagcacatttccatagataatttgcatataatctctggaatcttcatattcccttaattgaatatgcctaagtagtctcctcattacttaccttttagcacatgcaagttaatttacgagtgagtctctccatccaggtgagaacagcatcgcagggaaaaatctgtgcattttatttttgagatggtatctaaaaaaactggactgcaatggcgtgatcttggctcactgcaacct

SEQ ID NO: 201881 - DNA, 601 bp, Human
ggtctttttaaaaattttttgtagagataggagtcttgcctgtggcccaggctggtctcaaacttctgggctcaagtgatctacctacctcggcctcccaaagtgctaggattacaggcgtgagccaccacacccagcctaccacagctgttttaatttctctgttttccttcagtgtacaactcagctgtaaccataggagcacatttccatagataatttgcatataatctctggaatcttcatattcccttaattgaatatgcctaagtagtctcctcattacttaccttttagcacrtgcaagttaatttacgagtgagtctctccatccaggtgagaacagcatcgcagggaaaaatctgtgcattttatttttgagatggtatctaaaaaaactggactgcaatggcgtgatcttggctcactgcaacctctgcctcctgggctcaagcgattctcccacctcagcctcttgagtaactgggattataggctcccgtcaccatgcccagctaatttttttgtattttagtagagacggggtttcaccatgttgcccagggtggtttcgaactcctgagttcaggcaatctgcccg

SEQ ID NO: 201882 - DNA, 601 bp, Human
gtctttttaaaaattttttgtagagataggagtcttgcctgtggcccaggctggtctcaaacttctgggctcaagtgatctacctacctcggcctcccaaagtgctaggattacaggcgtgagccaccacacccagcctaccacagctgttttaatttctctgttttccttcagtgtacaactcagctgtaaccataggagcacatttccatagataatttgcatataatctctggaatcttcatattcccttaattgaatatgcctaagtagtctcctcattacttaccttttagcacaygcaagttaatttacgagtgagtctctccatccaggtgagaacagcatcgcagggaaaaatctgtgcattttatttttgagatggtatctaaaaaaactggactgcaatggcgtgatcttggctcactgcaacctctgcctcctgggctcaagcgattctcccacctcagcctcttgagtaactgggattataggctcccgtcaccatgcccagctaatttttttgtattttagtagagacggggtttcaccatgttgcccagggtggtttcgaactcctgagttcaggcaatctgcccgc

SEQ ID NO: 201883 - DNA, 601 bp, Human
tcaccatgcccagctaatttttttgtattttagtagagacggggtttcaccatgttgcccagggtggtttcgaactcctgagttcaggcaatctgcccgccttggcatcccaaagtgctgggattacaggcatgagccactgcacctggccctgtgcttttttgatgttgtttttgttattgttgtttattattgtttggacgacacattgctgagctttctgtccataagctcctattctcagggacttgctactcacatcatgatccacaggagactctcggggtcacgtctttctctrcccagccctggcttcctggtgctgtgttcatgtctgattttggatccctgagacctttttctcctacctttcttctgaaaggatagcagtcattttgtgaccttgctcaggaaattttcagctgggttttccctttgtattttatttgatgtttttcaccagggaggaaaactcctgctaccatgtgagttgtgccaggggagacttgccagagaagagctgcctgcagggggatttctcgctaccacatgcagggtttccctactttggaagcctcgtggctggaattttaaaggccaa

SEQ ID NO: 201884 - DNA, 601 bp, Human
tcaggaaattttcagctgggttttccctttgtattttatttgatgtttttcaccagggaggaaaactcctgctaccatgtgagttgtgccaggggagacttgccagagaagagctgcctgcagggggatttctcgctaccacatgcagggtttccctactttggaagcctcgtggctggaattttaaaggccaaagttcccccaaattttctgaacgctgaatgattgaaaacacctattttttttttctctttttacccaagcgccttttttcccaataaagggcttgggtaacgacaasaaactaaaactgaaaccacaactctgctctaaaataagagactcagagacacccaggaagggcctgcctttgagacttgtcactccctgagatccatcgtggcaccaaatgtttgccgagctccgccctgggagggaggcctgcagcctgggaactgggagacctgggtcccagtggagaggcctcaccatgtagtaagtctctctcgattcagttctcacagtgagttgagggccaagccagccattcttcagcctcaccgggtgggtaccagaatcacctgagatgttaggaaggtgg

SEQ ID NO: 201885 - DNA, 601 bp, Human
tacttcagattggctaagagagttgatttttttaattttagtaattttttaaatttatgcataataactgtacatatttatggggtacagaatgatatttgaatacatgtatactctgtgtaataatcaaatcagagtaattaccatattcatcatggaaagcatttatcatttctttgtgttgggaatatccagaatcctctcttctatttaaaaatatacaataaattattgactctagtcaccctacagagctacagaacattagcacttagtcctcctatctagctttaatttggtrtccattaaccaacctctctccatccaccttccaccctgcccttcccagcctattataaccacgattctgtctacttctgtgagctcaacttttttagctcccacctatgggtgagaaaatatagtatttctctttctgtgcctgacttatttcacttaacataacatcctccaggctcatccatgttgttgtgaatgacaagattttattctttttcatggctaaatagcactccatctgttgatgggcacttcggttgatttcctgttttggctattgtgagtagtgctgcaatcaatg

SEQ ID NO: 201886 - DNA, 601 bp, Human
ctttctgtgcctgacttatttcacttaacataacatcctccaggctcatccatgttgttgtgaatgacaagattttattctttttcatggctaaatagcactccatctgttgatgggcacttcggttgatttcctgttttggctattgtgagtagtgctgcaatcaatgtggacgtgcagatatctctttgacataatgatttaatttcctctggaaaaaatccctagtagtgggattgctagatcatatggtagttctagttctatttgtagtttttttgaggaatctccatacggttcyccgtaatggttatactaatttacattcccaccaatagcgtttaggagttctcttttctcaacatcctcaccagcatttgttattttttgtctttttgataatagccattctaactgggtgagatgctatctcattgtagttttgattcatatttcccttatgattagtgatatcgagcatattttcatttatctgttggccatttctatgtcttctttgtttttctgagacggagtctcactctgttgcccaggctggaatgcagtggcatgatctcggctcactgcaacctttgcctcc

SEQ ID NO: 201887 - DNA, 601 bp, Human
gagatagggatctagtttcattcttctgcatatggttattcagatttttcagcaccatttattgaaaacactgtctttttcccaatgtatgttcttggcatctttgttgaaaatcagttagctataaatatgtggatgtatttctgggttctctattctgtttcatttgtctgtgtgtctgtttttatatcagtaccatgctattttggttactttagctttgtagtatttttgaaatcaggtagtgtgatgcctccagctttgctctttttgctcagaattgctttggctatttggggtmttttttgattctacatgaactttaagattgtcttttctatcatatttctgtgaagaatatcattggtcttttgatgggggttgcatggaattcgtagagcgctttaggtagtatggtcattttaacaatattaattattccaatccatgaacatggaacatttttccattttgtgtgtgtgtcctcttctaattcttcccacccccccactctcccaacacacgccgagatggagtcttgttctgtcacccaagctggagtgctgtggtgcaatcgtggctcactgcaacttctgcctcc

SEQ ID NO: 201888 - DNA, 601 bp, Human
ctgggttctctattctgtttcatttgtctgtgtgtctgtttttatatcagtaccatgctattttggttactttagctttgtagtatttttgaaatcaggtagtgtgatgcctccagctttgctctttttgctcagaattgctttggctatttggggtattttttgattctacatgaactttaagattgtcttttctatcatatttctgtgaagaatatcattggtcttttgatgggggttgcatggaattcgtagagcgctttaggtagtatggtcattttaacaatattaattattccartccatgaacatggaacatttttccattttgtgtgtgtgtcctcttctaattcttcccacccccccactctcccaacacacgccgagatggagtcttgttctgtcacccaagctggagtgctgtggtgcaatcgtggctcactgcaacttctgcctcctggttcaagcaattctcctgtctcagcctcccaagtatctgggattacaggcacgtgccaccaggcctggataatttttgtatttttagtagagacggggtgtcaccacgttggccaggctggtctcgaaatggctggtctcg

SEQ ID NO: 201889 - DNA, 601 bp, Human
ggtgtgagccaccgcgcctggcctcctctgtttctttcatcagtgttttatagtttccatcataaaggtctttcttggttaaaaaatatcctctcttattaaaattattcccagttattttattatgatttttgtagttatcataaatgagattgtttagttttgttttagataaggtctcactctgttgcccaggctggagtacattggcaccatcatagctcactgcattcttgacctcctgggctcaactgatcctcccacctcaaccttctgagtagctggggccacaggtgtgcaycaccacacctggctaatttttttttttttgagacagagtttcactcctgttgcccaggctggagtgcaatggtgtgatctcggctcaccacaaccttcgcctcccaggttcaagcgattctcctgcctcagcctcccgagtagctgggattacaggcatgagccaccatgcccagctaattttttgtatttttagtagagacagggtttctccatgttggtcaggctgatctcgaactcccgacctcaggtgatcctcctgcctcggcctcccaaagtgctgggattacaggcatgagcc

SEQ ID NO: 201890 - DNA, 601 bp, Human
tgccaacatgcatgtaaacagggtgaagaacccagggaccaagcgctgtctgaggttgtttctcatctaacagcaacgttttaccattagaacccagagccccagaggaccttactctgggggtgtctatggaatgaggcctccttcttaggtaggtctgtactctgaattatagccagaatcttcatcactgcagggcatagcggtaaagagcccacacctgtagccccttctgactccactcaaatcacagttctgctctcgacttgctgtgtggcctttgggaagttactctgctcawcctcggagacctcatccatgggacagggggtaatggtacctagcttttgggtttttcttaggatggactgggctcattgtgcatggaaagtgctagcccagggttgggctacggaagcactctgttacctgctgctgtttctcagaagtgagccctttggcatggagagctggaggaagaggacgaatgctcaaggtctcagggctggagaggaaatcatgatcatggggtggcaaaggacctcaaggcactgccagacactctgggctcttggagaactgttcagagttggcgataact

SEQ ID NO: 201891 - DNA, 601 bp, Human
gccctttggcatggagagctggaggaagaggacgaatgctcaaggtctcagggctggagaggaaatcatgatcatggggtggcaaaggacctcaaggcactgccagacactctgggctcttggagaactgttcagagttggcgataactttctgtaatcctaggcatctcttctcttgtcacatttcattgagatatctgtctatcctatttaacccaagcctgattttggataggatccagaaatctaggtgaatttcaggggcctggttgcttcctcatctagcttggtggtaagaagytcagcccctctctgtgggccatgtggagagtacagaaaataaaactgtatcagggccgggcgcgatggcccatgcctgtaatcccagcactttgagaggctgaggtgggctgatcacttgaggccaggagttcaagaccagcctggccaacatggtgaaacctcctctctactaaaaatacaaaaaatagctgggtatgggggcgggcacctataatcccagctactcgggaggctgaggcatgagaatcacttgaacccgggaggcagagtttgcagtgagccaagatcatgtcactgc

SEQ ID NO: 201892 - DNA, 601 bp, Human
tttatggtggttccttaaagttgtttttattagcattttcaactgctgagggcttttctgtctatttttaattttctcaagtcttttcacacacaggtggcatcctgtttgcttgaaggggcattaaaattgctgttttatccaatttgcattaaaatgaaaactaaatacatctacagattggggctcggtcatgttgaatggttttgaggtctgtttacataaagcaaatgtttggcgtatactaggtttgcaaagagtggcagactagggggttggcaggtgaagcttgttcaagacratggttttgttggttttaaggtgttgagagatggtgggctacatctgtacagttagacttgggtttatactttctagttaaaaaaagtacctgaggtttttttttttttaatcacctacttttttttctgtttattacatgtatcataaaatataccttaatcaagtcctacatatccatgactatatacatattaacatgtcaaaagtctgcattcctttccatacatgtatgaggaatttgtgtttgagcagaattctgggggctacatcagaaaagcaggttcatctgggctgtact

SEQ ID NO: 201893 - DNA, 601 bp, Human
cagcctgtgaggatttcaagaactttttttgatcctctgttaaagccataatctctcccaatcctgtgctcaacttgatgcttcttgtttaataaccacaagctccttcatacccaattaaaaggcgtgaacaggaacaattaaaacaacagtctgccatccaggttaatgcagacatttgattagcagtctttagaagaaaccatttgaccaactaggaattcacctgctatcatctgacctccttgttaaactctcaagaaaatggggaagaactcagacaaattgaagcattgattcmtcatggtaccaaatttctccgctcagcaaccaactttgtgacccactcagagggggacatgagatttgcaggagttggaggttgagagggaaggaaaaagctgagatcatgatttgaagaggagaagttggaggataacttggtttggggttaaagatgacaaagagtgtggttttgaaaataacaactttcagaggactggagagtaagagaaaagaagctcttgggaggaaggggcacatggtaagatgctatgcccccatgcaccttgtacattgttgtcttgaagtactgggtggt

SEQ ID NO: 201894 - DNA, 601 bp, Human
aacaagtgggacatcaactgtcagaggtggcttgaggccagggaccctgagatctgccctttttgcccagtctgtcgctgttcagacagtggtgtgctggaaccaactctcacaagccaatggtgtccatttctccccaactcccctttcagtgccatcatgctggtggcttggaatcagccacaatgaaagtatttacaccagagaaattggcaagtgctacaaatcaaggcatccttctctcagattgccagtggccacacacacaccaggcacttattctcgctgcccctgtggcctyccagctcacacctgtgctgtatccttgtgccagatttatatttttaaaatgaaaatctgcttttccatggatgatgttcaaaaatttcttagcagattgccaccttctggtctcatttcccaatgacccctcacccaccctcttcaccagccctacaggcagcatgtcatggggtttcctgatctttctgggtcactttttcctaagatcctgaggcccagtaggcaggttctcttctgtgatcatctggtcccatgcttagagttctattagagaccgtagcaggctgtggctgttttt

SEQ ID NO: 201895 - DNA, 601 bp, Human
ctgaggcccagtaggcaggttctcttctgtgatcatctggtcccatgcttagagttctattagagaccgtagcaggctgtggctgtttttgtgtgttttgttccgttttatcttttttctttttactggattatgatctaatagatggggaccttcttccctcttctgtttatcttcatagctccaggtctgctatggttcctgaaacataggaaggcagagagaggagggaaggaaggaaagaagaaaggagggagggagggaaggaaggaaagaaggaaggaagacaggagggaagacmggaagacactccagccaaaaggcattcatgacctggcaagtaaggagcacaatgagtataatttttgaagaactaagagaagaatggagcccagaagtcaaataggagataagaaaaatctggctagctgcagggatcaaaggctttgaggggaggagaggttcctttagcaagaaagcccagggtaatgcatccctgttgctcccctcctgccccgcaagacccccccaagccagctggcctctgagctggcaggagctggcaacagggggactcccagtgggtaatgggtgcgggggt

SEQ ID NO: 201896 - DNA, 601 bp, Human
catccctgttgctcccctcctgccccgcaagacccccccaagccagctggcctctgagctggcaggagctggcaacagggggactcccagtgggtaatgggtgcgggggtggggagctgaaaacgtggtaaagtctcaacaaatgcgttttgtattacattcaattatagctggcaataatcacaacctttctggttctttcctccgcaaggtaatggggagaaagccttggagaggagggaggtgatttagcaaatgctggactggagggccctggagcaggcagaatgctggccctgcrggaactgagggctgagagggctctggttggggagggggcactgtgaggagccagcagggcacagccttgcccagaaacctaggaccagctccctgagactgcagggtcattgccaattagttaagtggctgcactcagcaggcctttgggataggaaagggctgcgttctccatcttgttgatgtggaaacagcaaggggaagtgattcagaggcggagtggaaataaagtgtgtgtctcgtgacattgtgacttctgctagatccaaagggctgcacttgactgtctcctgggaagctt

SEQ ID NO: 201897 - DNA, 601 bp, Human
agggctgagagggctctggttggggagggggcactgtgaggagccagcagggcacagccttgcccagaaacctaggaccagctccctgagactgcagggtcattgccaattagttaagtggctgcactcagcaggcctttgggataggaaagggctgcgttctccatcttgttgatgtggaaacagcaaggggaagtgattcagaggcggagtggaaataaagtgtgtgtctcgtgacattgtgacttctgctagatccaaagggctgcacttgactgtctcctgggaagcttccttccayggacaggcgcctgtggtgctttcgagacaggcaatggggctgtgcaggagcagaggagagggaggcatgatctgtggaggtggggcaggtgcatggaggaaggcagggctgggtgaaaaggcagcctcagtgcacggagcactggaggtagaaggggctgccacagccacctgatcctgcacttaggaggtcagtttagattttttaaaagtcaggtttaaaggccaggcatggtggctcatacctgtaatcccagcactttgggaggttgaggaggaaggatcacttgaggccgggagt

SEQ ID NO: 201898 - DNA, 601 bp, Human
ctggttggggagggggcactgtgaggagccagcagggcacagccttgcccagaaacctaggaccagctccctgagactgcagggtcattgccaattagttaagtggctgcactcagcaggcctttgggataggaaagggctgcgttctccatcttgttgatgtggaaacagcaaggggaagtgattcagaggcggagtggaaataaagtgtgtgtctcgtgacattgtgacttctgctagatccaaagggctgcacttgactgtctcctgggaagcttccttccatggacaggcgcctgtsgtgctttcgagacaggcaatggggctgtgcaggagcagaggagagggaggcatgatctgtggaggtggggcaggtgcatggaggaaggcagggctgggtgaaaaggcagcctcagtgcacggagcactggaggtagaaggggctgccacagccacctgatcctgcacttaggaggtcagtttagattttttaaaagtcaggtttaaaggccaggcatggtggctcatacctgtaatcccagcactttgggaggttgaggaggaaggatcacttgaggccgggagttcaagaccagcctgg

SEQ ID NO: 201899 - DNA, 601 bp, Human
gatgtggaaacagcaaggggaagtgattcagaggcggagtggaaataaagtgtgtgtctcgtgacattgtgacttctgctagatccaaagggctgcacttgactgtctcctgggaagcttccttccatggacaggcgcctgtggtgctttcgagacaggcaatggggctgtgcaggagcagaggagagggaggcatgatctgtggaggtggggcaggtgcatggaggaaggcagggctgggtgaaaaggcagcctcagtgcacggagcactggaggtagaaggggctgccacagccacctkatcctgcacttaggaggtcagtttagattttttaaaagtcaggtttaaaggccaggcatggtggctcatacctgtaatcccagcactttgggaggttgaggaggaaggatcacttgaggccgggagttcaagaccagcctgggcaacatagagaaaccctatctctatacaaaataaaaataaaaaattgaactaggcatggtggcatgtacctgtagtcccagctacttgggaggccaaggcaagaggatcacctgagtccaggagtttgaggctgtagtaagatatgatcacatccct

SEQ ID NO: 201900 - DNA, 601 bp, Human
ctgtggaggtggggcaggtgcatggaggaaggcagggctgggtgaaaaggcagcctcagtgcacggagcactggaggtagaaggggctgccacagccacctgatcctgcacttaggaggtcagtttagattttttaaaagtcaggtttaaaggccaggcatggtggctcatacctgtaatcccagcactttgggaggttgaggaggaaggatcacttgaggccgggagttcaagaccagcctgggcaacatagagaaaccctatctctatacaaaataaaaataaaaaattgaactaggcwtggtggcatgtacctgtagtcccagctacttgggaggccaaggcaagaggatcacctgagtccaggagtttgaggctgtagtaagatatgatcacatccctgaactccagcctgaacaacagagcaagcccctatctctaaaaattaataataattaaaattaaatttcagaattaaaaagtgggtcttagtattatgtttctaattctctcttcttccaagtcacagacacttaaaaaatgtatgtgccaaggagtttgcagaagtaatggaagtaacctctgatactccagaaaattc

SEQ ID NO: 201901 - DNA, 601 bp, Human
acaacagagcaagcccctatctctaaaaattaataataattaaaattaaatttcagaattaaaaagtgggtcttagtattatgtttctaattctctcttcttccaagtcacagacacttaaaaaatgtatgtgccaaggagtttgcagaagtaatggaagtaacctctgatactccagaaaattctgcaggataagtaatagtgacctcatgccccaatggaggaaactgaggcctacagagattatcttgtccagatcacacaacgggtccatggcagagactcaaggctgccatgttgycacactcacgtaatggcccagttgtatggcttaccagccctgaagaaagtggtttaaatccaggtttgaatgagttaaatgtacgcgccttctccctgacatcatacggcctttctgactaatgggcccctttccactctctctcaaatcaggaacagaacctttttttttttttcttgaggtgaagtttcgctcttttcccccagtctggagtgcaatggtgcaatctcggctcggtgcaatctcggctcactgcaagctccgtctcccgggttcaagggattcttttgtctcagcctc

SEQ ID NO: 201902 - DNA, 601 bp, Human
agacacttaaaaaatgtatgtgccaaggagtttgcagaagtaatggaagtaacctctgatactccagaaaattctgcaggataagtaatagtgacctcatgccccaatggaggaaactgaggcctacagagattatcttgtccagatcacacaacgggtccatggcagagactcaaggctgccatgttgtcacactcacgtaatggcccagttgtatggcttaccagccctgaagaaagtggtttaaatccaggtttgaatgagttaaatgtacgcgccttctccctgacatcatacggcytttctgactaatgggcccctttccactctctctcaaatcaggaacagaacctttttttttttttcttgaggtgaagtttcgctcttttcccccagtctggagtgcaatggtgcaatctcggctcggtgcaatctcggctcactgcaagctccgtctcccgggttcaagggattcttttgtctcagcctcccgagtagctgggattacaggcacgtgccaccacacccaactaatttttgtatttttagtagagaaggggtttcaccatgttgatcaggctgatctcaaactcctgatttc

SEQ ID NO: 201903 - DNA, 601 bp, Human
gtatgtgccaaggagtttgcagaagtaatggaagtaacctctgatactccagaaaattctgcaggataagtaatagtgacctcatgccccaatggaggaaactgaggcctacagagattatcttgtccagatcacacaacgggtccatggcagagactcaaggctgccatgttgtcacactcacgtaatggcccagttgtatggcttaccagccctgaagaaagtggtttaaatccaggtttgaatgagttaaatgtacgcgccttctccctgacatcatacggcctttctgactaatggkcccctttccactctctctcaaatcaggaacagaacctttttttttttttcttgaggtgaagtttcgctcttttcccccagtctggagtgcaatggtgcaatctcggctcggtgcaatctcggctcactgcaagctccgtctcccgggttcaagggattcttttgtctcagcctcccgagtagctgggattacaggcacgtgccaccacacccaactaatttttgtatttttagtagagaaggggtttcaccatgttgatcaggctgatctcaaactcctgatttcaagtgatctgcccac

SEQ ID NO: 201904 - DNA, 601 bp, Human
cagaaaattctgcaggataagtaatagtgacctcatgccccaatggaggaaactgaggcctacagagattatcttgtccagatcacacaacgggtccatggcagagactcaaggctgccatgttgtcacactcacgtaatggcccagttgtatggcttaccagccctgaagaaagtggtttaaatccaggtttgaatgagttaaatgtacgcgccttctccctgacatcatacggcctttctgactaatgggcccctttccactctctctcaaatcaggaacagaacctttttttttttttcttgaggtgaagtttcgctcttttcccccagtctggagtgcaatggtgcaatctcggctcggtgcaatctcggctcactgcaagctccgtctcccgggttcaagggattcttttgtctcagcctcccgagtagctgggattacaggcacgtgccaccacacccaactaatttttgtatttttagtagagaaggggtttcaccatgttgatcaggctgatctcaaactcctgatttcaagtgatctgcccacctcagcctcccaaaatgctaggattacagtcgtgagccactgcacccag

SEQ ID NO: 201905 - DNA, 601 bp, Human
ggacgtaaatgctgcttcagttccccctcctgcaggcaggtcaatgtcttgccattcaggaagagcataatttattttcttcctgaagatcttaagaactcagagattgtccatcctcctgtagtaccctttgcagattttggccaagaagttcttacagacaatcagaagttttcctgttttaatttgagcccatttcttgtgtttgttattctttgactttgattgtggcagatttgggggccaggaggcaaaccgaagcccaggatggctcagagccagggttttcactggtgccacrggatgtagtctcctctgactctgctccgacggtctggggcagaccaggaagcagggaggacagaatgccagggcttggagagccaggaaggtctggagaaaggggcagagtttttggctcatgagttgagcatcagaggattttgtgatcattaaaggccagagataggctattgacgagtagttcaaataatcagacaatatttagaggcgtgaacaagttctatcatcaagaagaagagctggagtcagcagattgttctcatctcttcccaactcagcattcagtggtgatgtgcat

SEQ ID NO: 201906 - DNA, 601 bp, Human
gtctgggtgggctgcattgggtctgatgtacagtgtgaatctttctctttggtcaggaccgatatgggagttggctcctgagtgggctagaccctgcccagccaggctgcggaatgggaggacaactatcagggtgtggtttctcattgctacatttttttcttaatagactatttttagagaagtttttgtttcacagcaaaattgagccgaaagtgcagagtgttcccacatgcaccctgccctgacacaagcaccgcttcccccactatcaacatccctcaccccccagagtggcgcrtttgtcacagtccatgaacctgcgtggacacatcatgatcgccaaagatgtccaggggcctcagggccataggctcactagatacagtatatcctgaagctgggacctgctgtatgtgtgttgcctccatagctgcatatacagtcacctgtcacttaagggtaaggctgcattctcagaaatgcatcattaggcagttgtgtgaacatcagagtacttagagaaacccagatgctacagtctactacacacctggactattgctcctacagacctgtacagcagattactgtactgaat

SEQ ID NO: 201907 - DNA, 601 bp, Human
taacttttttttttataagtagaaggagtatactctaaaataatgataaaaattatagtagaggaagtacataaaccagtcacataatctttattatcattatcaagtgttatgtaccacccgtaattgtatgtgctagacttctctattcctggcagtgtggcgggtttgtttataccagtgtcaccacgaacacatgagtcatgcgttgtgctctgaccttgccactgttatgatgtcactaggtgagaggaatttttcagctccattccactctttggggaccaccatcttatatgcrgtccaccattgcctgaaacatgattaaatatgccatattgtgctgtgtgagtatatttgcctgttgtctctctgactagagtgtgtgctctttagggaaaggcatgcttttctcatcttcataccctgtagcagggctgccactgttccctcctgtgtcccctgggccctgccatttcagtacaatcctctcttctacccacctgctgccagctctgcacctctgtgcctgaggactttctcagctctcccttgtgcagaactggctggatatgctggaacaatgactgtaagagtggtg

SEQ ID NO: 201908 - DNA, 601 bp, Human
taactcacttgatcactcttattagctgttttcccctccctgtcatcatttctctgatgtttcctggggttacctctcaaacgacttccccctggattccttgttgaaggtcaggggatccgggttacatcttcactacatagcagagtattgacacacaggacatgtccagcagatgtttgttggaaaatggtatggatacctctagaatagacagatacttccagaatatatatatatcttttagataagaatatatatatcttaaagcagattgcatattcttctctccataggtctyatgccacattttgctgcccttgtggactctgagcttggtgctgcctgttgtctgcctgcccctgacctgaaggacatgcccagctccttctctcatccttgcctctcttttgcatcttcgtaatacatattcactttttaaaaaaggaatggctctttgaagctaatggctatctaaatctttcttttctattgtccagcacagtgtgaataaatacatacaggctatgattccacttttcaaatgtgtgactccatgttcgtgttttaacattgtcaactccatcattttgcccccaac

SEQ ID NO: 201909 - DNA, 601 bp, Human
acatgcccagctccttctctcatccttgcctctcttttgcatcttcgtaatacatattcactttttaaaaaaggaatggctctttgaagctaatggctatctaaatctttcttttctattgtccagcacagtgtgaataaatacatacaggctatgattccacttttcaaatgtgtgactccatgttcgtgttttaacattgtcaactccatcattttgcccccaactcctggtcaaggaatttccctccctctaaaatcacagtctcttcttagaaaggggatatttttctttaagaagrggtttcaggataagagctaagctcgttctagaacagtggtttccaacccaggccaaacgttagaaaagtcctgggaaacgaatatgtcaatgctcagcccagaccaatttgacagcagtgtctgaggttagggcttggtttagggtttctgaaagcttccctagtgattatgtggagctaaggccgatgccatccatctagagctagaatatccacttcttcctttgggcattccctgctttagatcagtgggagataaaccctactctactgagttgtattggacctagaggccaggac

SEQ ID NO: 201910 - DNA, 601 bp, Human
cttttcaaatgtgtgactccatgttcgtgttttaacattgtcaactccatcattttgcccccaactcctggtcaaggaatttccctccctctaaaatcacagtctcttcttagaaaggggatatttttctttaagaaggggtttcaggataagagctaagctcgttctagaacagtggtttccaacccaggccaaacgttagaaaagtcctgggaaacgaatatgtcaatgctcagcccagaccaatttgacagcagtgtctgaggttagggcttggtttagggtttctgaaagcttccckagtgattatgtggagctaaggccgatgccatccatctagagctagaatatccacttcttcctttgggcattccctgctttagatcagtgggagataaaccctactctactgagttgtattggacctagaggccaggaccaatgttgctgattcaaggtgaactacagattcctaggattcttatcatctacatctgtgtcaacccaggctgtctgcagaactgggctgggttttctagagtcccagctcagctccttcccatgtgcagcatgcccttccctgcggggctgctgggcagag

SEQ ID NO: 201911 - DNA, 601 bp, Human
tttgtgtctgtcttggagctcggtgggtgctgtccctggggccatgaggtatgtgggcctgtgtggggctctttcagggctgaccctctgctgtctctgcaggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaraacttcaaactggtcaaatgcactgtccagacggagatccgggtaagtgtgaagtgtctgccctgtccatctgtctgtccctctgtcttcttcctgggcagctgagcagctctcctgcagcctcgcagctctcccatatccacccctgggtggaagaggtgaggtggcatcagagagatgtgctcagcctgcatcaccaggcctgctctccagatgttcccatactacttctctaggagcctgggaaacacatgttgtagcctttgcttgaaccccagataatttgtttggcctctgatt

SEQ ID NO: 201912 - DNA, 601 bp, Human
gtggggctctttcagggctgaccctctgctgtctctgcaggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggtaagtgtgaagtgtctgcyctgtccatctgtctgtccctctgtcttcttcctgggcagctgagcagctctcctgcagcctcgcagctctcccatatccacccctgggtggaagaggtgaggtggcatcagagagatgtgctcagcctgcatcaccaggcctgctctccagatgttcccatactacttctctaggagcctgggaaacacatgttgtagcctttgcttgaaccccagataatttgtttggcctctgattcaattcatttcaacttattaagtatttatgatacttgaagctctgcaagggacttaaaagct

SEQ ID NO: 201913 - DNA, 601 bp, Human
tgtctgtccctctgtcttcttcctgggcagctgagcagctctcctgcagcctcgcagctctcccatatccacccctgggtggaagaggtgaggtggcatcagagagatgtgctcagcctgcatcaccaggcctgctctccagatgttcccatactacttctctaggagcctgggaaacacatgttgtagcctttgcttgaaccccagataatttgtttggcctctgattcaattcatttcaacttattaagtatttatgatacttgaagctctgcaagggacttaaaagctgctgtcctcraagagtttacactctgatgaaataggaattagagatacacaagtgattgcattaaaaatagaacaaaactggtataagccttgtgtgctgagcatgtacaggaaggcactggtggggcacttagaggatgacaatgaagtagaggtgctttgagccaggtggagggttaacaggtgccctgcctggcaacacgtccttttgctcactcctacccagaatcacaacatctgttttgcaggtccaggtacccaccttcatcagggcacctggacaccaggatgccagttcaccttaaccaaa

SEQ ID NO: 201914 - DNA, 601 bp, Human
ctgtgtggagcctgggccaatccctctacacacattattccattaaatcttcccagcatccccatgagtagatacactgaggacatacctttcctctgcccagagcacccctttctgatgatgggagggaaatccagattggttctcaggttgcttagtgggtaatttgaacaaaggaagcaggaacttttgggaaagctaatcaggtctgaggacatgggatgagccatctccagctcatagccaacctttcccatgtcctgaaagccagtgtccctaaactccatgaatgtttcctttsgttagtactgctgtgccctggccacatcatcctggctgccttccgtctgctatagcacacgctgtgcttccacacaccagagcagagtgtaattgattatgtcactgtcatggccagttatcaccattgattacagtttgattggctctctctgtttcctgtaactgatttgattagggccttgtttgctcatctttctgatataaaggcacaattgtgtcctgagagtaagccctggtcatcttcctccaggaggatgttttcctctctctttatccacttcatgagtcttcctttggg

SEQ ID NO: 201915 - DNA, 601 bp, Human
cttaaataggctgatatgcctggtaaatcactaagaagggccacagaggtgatattttcttaaataaacaatttcttatttgcctaaaaaaccctccttttaaaccactagatctctggccaatcatttagggaactttttcccctaaactctgacagcagagaaaaaaggattgaattaaaaaaaaaaaaaaaaacctggccaatgggagatgggttaggaggctgtggtcatactgcaaaaggaaaatgatgaggacctggactaagagaatggtgttgggaatagagataaatcaacrtaattgagtacatctaaggagacagagtcaatagaatttgatgattaactagatatagggagggaaagaaaggaaggagaaaaggatgactcaagcttttgcttgggcgactaaatgggtgttggtactattcattgagatccagacagagaaagggagggcattctgagatttcagctttacatgtgttgtgtttaaagtgtttatgaaacacccccacggaggagcgtgggtctggagctcaggagggagaaagaatctagagacaagattcgggtgtcattatgcaatggatgccat

SEQ ID NO: 201916 - DNA, 601 bp, Human
agatctctggccaatcatttagggaactttttcccctaaactctgacagcagagaaaaaaggattgaattaaaaaaaaaaaaaaaaacctggccaatgggagatgggttaggaggctgtggtcatactgcaaaaggaaaatgatgaggacctggactaagagaatggtgttgggaatagagataaatcaacgtaattgagtacatctaaggagacagagtcaatagaatttgatgattaactagatatagggagggaaagaaaggaaggagaaaaggatgactcaagcttttgcttgggcractaaatgggtgttggtactattcattgagatccagacagagaaagggagggcattctgagatttcagctttacatgtgttgtgtttaaagtgtttatgaaacacccccacggaggagcgtgggtctggagctcaggagggagaaagaatctagagacaagattcgggtgtcattatgcaatggatgccatgcaaatgggtaggcttacccacaaggaatgagtagaacagaagaaaaacagatccagcacgaggtcaggcgttcgagaccagcctggccaacatagtgaaaccccatct

SEQ ID NO: 201917 - DNA, 601 bp, Human
aaaaaaggattgaattaaaaaaaaaaaaaaaaacctggccaatgggagatgggttaggaggctgtggtcatactgcaaaaggaaaatgatgaggacctggactaagagaatggtgttgggaatagagataaatcaacgtaattgagtacatctaaggagacagagtcaatagaatttgatgattaactagatatagggagggaaagaaaggaaggagaaaaggatgactcaagcttttgcttgggcgactaaatgggtgttggtactattcattgagatccagacagagaaagggagggcrttctgagatttcagctttacatgtgttgtgtttaaagtgtttatgaaacacccccacggaggagcgtgggtctggagctcaggagggagaaagaatctagagacaagattcgggtgtcattatgcaatggatgccatgcaaatgggtaggcttacccacaaggaatgagtagaacagaagaaaaacagatccagcacgaggtcaggcgttcgagaccagcctggccaacatagtgaaaccccatctctaccaaaaaattagctgggtatggtggtgtgcacctgtaatcccagctactca

SEQ ID NO: 201918 - DNA, 601 bp, Human
tggccaagagtgagactgacatggactcacactaatgaatgaaccttctcaatctgaagcatatgctcctacaggaaaacataggtcttgtgagaacaggtcaccatcatcatctccatggctacaaccttcatttaagctactgtcatcactcatttgattcactgtaatagccacataacatcttcccacatccgttcttgcctttctccaaagtattttccattgtgtatcccaagttatctctaaaaagcacaaccttatgtcactcctaggttgtgagagcaagactgggtttacrtgcagaggagcagctttgctgtgtagtgcctgtgtggggatgcagtgtccagttgggagtctaagcccaacttccttgtctgggaccctcttggagcagcccttcttctctctgcttcctgacttctttttgcagtctcctttcctagcttggctttatcctttgatggagttttctacttccatctttgtatcttcctttcctcattttcccagtactcagaatgctgccagccctttcaaatttgccaagcacatgtccttccccaagaacacttctgagatcctgacacccccacat

SEQ ID NO: 201919 - DNA, 601 bp, Human
ttctcttcttctcaagccatatgtcctgatttgtctcatccccagtttctatacattgcccagggatgactatccacagtgcccctgtcctgccagtctcaaatgtatcatgatatgggtgacaatgacacaataatgacatggtcaccttcgtctaaggccctgctctctcctctccctgcctggcacactgaccggctgactcatggtgttttctccctccagcttcctccagttgacccactcttttcatgtgctcatctctgcctatcacaagaccatcttttctcacccaggaagrcattgagcagaagcagagatattcatctggggtatggtgttgttcagaggtgccgatggagtcctctctctcagccagtttctaccaagctggaaacctaggttcaagattcatccttgttttgtcctgaagcatcaccccactcagaattcacattcacatcctcaggaggggcagaggctgcagccatcctgtgccctccccacccagtctggatgcatccctcccacccgcagcagggactccaggttgcaggggtggccttgggcattgcttgcctggtgcatgaggaaggctgtc

SEQ ID NO: 201920 - DNA, 601 bp, Human
ttctaccaagctggaaacctaggttcaagattcatccttgttttgtcctgaagcatcaccccactcagaattcacattcacatcctcaggaggggcagaggctgcagccatcctgtgccctccccacccagtctggatgcatccctcccacccgcagcagggactccaggttgcaggggtggccttgggcattgcttgcctggtgcatgaggaaggctgtccagttccaaatgcagcctggtccacacacacctgtcctcaccaccacccgtgtgcattcagtgatcatacaatcccttcyagaaatccccagaggcagactgcagatgtcagaacccattgactttccccttcgctccttaaacccatcacacactcatcccagttagctttgagtttaatctattgttactcaaccagacacaaggtgcacagggtgttatggactggatatttatgtcccctcacccccaattccatatgctgatgccctaacacccagtgtaatggtgtttgaaggtaggggtattgaaaggtaattgggcttaggtgaggtcatgagagtgggggccctataatgggattagtgtccttataaaag

SEQ ID NO: 201921 - DNA, 601 bp, Human
tgcaggggtggccttgggcattgcttgcctggtgcatgaggaaggctgtccagttccaaatgcagcctggtccacacacacctgtcctcaccaccacccgtgtgcattcagtgatcatacaatcccttccagaaatccccagaggcagactgcagatgtcagaacccattgactttccccttcgctccttaaacccatcacacactcatcccagttagctttgagtttaatctattgttactcaaccagacacaaggtgcacagggtgttatggactggatatttatgtcccctcaccccsaattccatatgctgatgccctaacacccagtgtaatggtgtttgaaggtaggggtattgaaaggtaattgggcttaggtgaggtcatgagagtgggggccctataatgggattagtgtccttataaaagaggaagaggctagattcctctccctctccccctccctcccttcctctctttctcttcctctctctctctctctctctctctctctctctcttagccatgtgaggacagaaggagaaggtgtacttctgtaaatgaggaagctcacaccaggagccaaatctgctgtacctt

SEQ ID NO: 201922 - DNA, 601 bp, Human
cccagtgccgcagtatttaaaaaggtatattcacaaggaccttctgcaccccctccctgtttcctgtgtgtgctctgcaggccagcccgcccccacacagacacctacagaggccagcacaaggtagacacgcaggttccgggcctttgtggatctccacgcccacattcattgcatccacaaattggcagtcaggtgcctgggctttcatttctatttttaatctggtagttgcattgctgaatgtccttgttagagacttttatcacgtcaaaatgaatgctttcagggtgttaagttwtgctcacttgtattattttgttcttcaatcacttattttagaatgatcccttacatgtgttgcaaactcagaaggtatataaccagtgtatcagttttctatggctgccactgcaaattatcacaaacctggtggcttacaatagaaatgattctctcacatttctggaggccagaagtcctaaatcaaggtgtcagcagggactcagttctcctgaaggctctaggggaggatctctccttgcctgtcccagcttctggtagctctaggcattcgcagcttatggatacttcactccaa

SEQ ID NO: 201923 - DNA, 601 bp, Human
ctgcaggccagcccgcccccacacagacacctacagaggccagcacaaggtagacacgcaggttccgggcctttgtggatctccacgcccacattcattgcatccacaaattggcagtcaggtgcctgggctttcatttctatttttaatctggtagttgcattgctgaatgtccttgttagagacttttatcacgtcaaaatgaatgctttcagggtgttaagttatgctcacttgtattattttgttcttcaatcacttattttagaatgatcccttacatgtgttgcaaactcagaakgtatataaccagtgtatcagttttctatggctgccactgcaaattatcacaaacctggtggcttacaatagaaatgattctctcacatttctggaggccagaagtcctaaatcaaggtgtcagcagggactcagttctcctgaaggctctaggggaggatctctccttgcctgtcccagcttctggtagctctaggcattcgcagcttatggatacttcactccaacttctgcttccatcttcacgtggacttctcctctctctgtgtctcttttctgtatcttttacaaggatgcttat

SEQ ID NO: 201924 - DNA, 601 bp, Human
ttgcctgtcccagcttctggtagctctaggcattcgcagcttatggatacttcactccaacttctgcttccatcttcacgtggacttctcctctctctgtgtctcttttctgtatcttttacaaggatgcttatcattggatttggggccactcagtccagagtgatctcatcttgagatccttaacttaattacatttgcaaagccccccatttttttttccaaatgaggtcacattcacagattctggggttaggacatggacatatcttttgggggccaccattcaacccattatgaycttcaattcagatcatagtatctgtcactggtacctccattcaggcacacacagaccagtgtacccagatgtacagcagtgagtgggccttttgtccatttaaaagctttaattatgtcattttggggtatgtgcagaagaaaatagagactcaccgaatgtgtgagtcagctcttctccccaggagccgttccacacctcctggaagttggcagcgggaaatgtgtaggggccctttatagttggcacattgtcatggttctcacgatgattggggctggggcttggcatttggtgggt

SEQ ID NO: 201925 - DNA, 601 bp, Human
cctgcccctcctgctctgaggcaggcactgcatgtcaccggaaagaatggtatagtaactgctttaaaagatattttagtagggggactttggggggaaaaatctgtgaaggccacctggtactctcccaactgatctttattgttcttcatccctcctcaatctcagcgtggcatcaagaacgcttcatacggtttatgggtaaatcagaatttttgacagaatggtctcatttttaacagaacatttttatttttcagagacacttatattctgctcaatatagtgagcggaaagaaarggccttctaaagaaaaggccttttgttaaccttttcagccttttttctgccttctcagaactctacttcccgtcttcacacacagcagaaggtgcaagggaagagcctgctatccaggccctgggaacataaaacccttcatgattctcttgctccaaacaggaggaagtcatttttctttgccctgggaacataaaacccttcatgattctcttgcttgaagcagaaggaagtcatttttctttgcattgttcatcccagtcactggcatggccggatcagccgtggtcatgacctgat

SEQ ID NO: 201926 - DNA, 601 bp, Human
ctcaatatagtgagcggaaagaaagggccttctaaagaaaaggccttttgttaaccttttcagccttttttctgccttctcagaactctacttcccgtcttcacacacagcagaaggtgcaagggaagagcctgctatccaggccctgggaacataaaacccttcatgattctcttgctccaaacaggaggaagtcatttttctttgccctgggaacataaaacccttcatgattctcttgcttgaagcagaaggaagtcatttttctttgcattgttcatcccagtcactggcatggccrgatcagccgtggtcatgacctgatcatcctatgaggctccttgactgcacttcacccacctgctgctggtgctggctccagctcacaaagggcctcagatccctttcttcagggattgcttccttcaaccacctgtacccctctatagggctcagcctttggaagaatttagagccactactggacaggtgctcccgggaggtgggtctccccaggtgccagttcccacccagtcaggggagtcagaggaacctctggcccaaggaccccgaactccatttccagctcacatcttcatgt

SEQ ID NO: 201927 - DNA, 601 bp, Human
tcccgtcttcacacacagcagaaggtgcaagggaagagcctgctatccaggccctgggaacataaaacccttcatgattctcttgctccaaacaggaggaagtcatttttctttgccctgggaacataaaacccttcatgattctcttgcttgaagcagaaggaagtcatttttctttgcattgttcatcccagtcactggcatggccggatcagccgtggtcatgacctgatcatcctatgaggctccttgactgcacttcacccacctgctgctggtgctggctccagctcacaaaggrcctcagatccctttcttcagggattgcttccttcaaccacctgtacccctctatagggctcagcctttggaagaatttagagccactactggacaggtgctcccgggaggtgggtctccccaggtgccagttcccacccagtcaggggagtcagaggaacctctggcccaaggaccccgaactccatttccagctcacatcttcatgtcttaattctagacttcttgggttaatcaactcctcaggttgacttgacccttgagccatgttcatccttccccccttacccatcacaatgct

SEQ ID NO: 201928 - DNA, 601 bp, Human
cttccttcaaccacctgtacccctctatagggctcagcctttggaagaatttagagccactactggacaggtgctcccgggaggtgggtctccccaggtgccagttcccacccagtcaggggagtcagaggaacctctggcccaaggaccccgaactccatttccagctcacatcttcatgtcttaattctagacttcttgggttaatcaactcctcaggttgacttgacccttgagccatgttcatccttccccccttacccatcacaatgctagctaccattttttgagcacctgctcygcacctaccattgtgctaagctcttacgtgtctgtaacccacataaagccagtcagttgttctgaccttgaagccagtctcagtacagcatcacattccaacatatattagtctgccatctaaaaataactggaaatccatttaaatctttactgtaatctctttgagggagagaactgttggggctcagaaaacaatatccccaaatgaaggcctcagcagcagcctcagaagcaaaagtttttctctgactttctcctgccccctgtctctcagccccactctcccccgaggtgccat

SEQ ID NO: 201929 - DNA, 601 bp, Human
tcagcagcagcctcagaagcaaaagtttttctctgactttctcctgccccctgtctctcagccccactctcccccgaggtgccatagaaactaggattgtcttccccaaggtgggtcatagaaaccagaacctcttttcccccacagaaatccggccataaaacctaaaagtattccatgtaaaaacaggccataaagaaattatctgacctacattgttggactataggtcataaggccttgattccagagagggcctgccctgcacccagcaggaaggaacactgctcagagaggcccrgaagaatctagacagacaggcctgtctgggtttccccactcagcctgtcaacattagatcagacccttctcctccaatcatatttctacatgactgtccattgtttgctaaacctaagcataaaaatggacaatttctcctctatttttgggtcttcattctgaaggtacctgtgtatgcatattaagtaaatttgtatgccttttctcctttaatcaatctgcctcatttcagtgatttttttcagtgaacctttaggaagccaaaagccttggcccccacaggggatatcactggggg

SEQ ID NO: 201930 - DNA, 601 bp, Human
attgtttgctaaacctaagcataaaaatggacaatttctcctctatttttgggtcttcattctgaaggtacctgtgtatgcatattaagtaaatttgtatgccttttctcctttaatcaatctgcctcatttcagtgatttttttcagtgaacctttaggaagccaaaagccttggcccccacaggggatatcactgggggatcgctgtccagataggtagtaaaatttattaaaattctcataaccgtataccaattaaaagtaaaacaactgtctgtgtctgtctaacccaaggtcagwcatggagcattgttttagctctaactggtcaatgtctgtattagtctcctaggtctgctttaacaaagcaccacaaacagagtgatgtgaaacaacagaaaggtattgtatcacagttctggaggctagaaattaaagatcaaggtgtcagcagggccctgctccctctgaagtccataggggaacccgtcctttcctctccctggctggtgattcgccaatggtctttgacactccttggcctgcagctgcatcactcaaatcttgcaccatctccccgtgtgcatgtctctctctgca

SEQ ID NO: 201931 - DNA, 601 bp, Human
cccacaggggatatcactgggggatcgctgtccagataggtagtaaaatttattaaaattctcataaccgtataccaattaaaagtaaaacaactgtctgtgtctgtctaacccaaggtcagacatggagcattgttttagctctaactggtcaatgtctgtattagtctcctaggtctgctttaacaaagcaccacaaacagagtgatgtgaaacaacagaaaggtattgtatcacagttctggaggctagaaattaaagatcaaggtgtcagcagggccctgctccctctgaagtccayaggggaacccgtcctttcctctccctggctggtgattcgccaatggtctttgacactccttggcctgcagctgcatcactcaaatcttgcaccatctccccgtgtgcatgtctctctctgcattcacacttcccccttttttaaggacaccagtcattttagatgacagcccacccgaatgacctcattttaactcgattagtctgtaaacactctataaagtcctgcgctaaggcactagaggttaagatttcaacatatccttttggggaaccacaattcaacccatatggtatctta

SEQ ID NO: 201932 - DNA, 601 bp, Human
tattaaaatgttaagtatagtcatcttactaaaacaaacaaacaaaaaagaatactttgaaaagagtaaggagggtgaattgaattaagcctgggaagcagtttgcaagccactgtcccaggtggggttcctgggaagcagacctgggtgggaggcttgcattggaggaagcgtgttgatgggagctcccaaggcacacagctagtgggagggaagaaagcaggatggggcagaggaaaaagttgggctgcgatgcagccacagcaaaggcctcagcccattccactggagccttagagccagaagagctgtcccaaatcaggatgaaaggacataggtattatgtgtgttcaccagtcactcaatatggatggcccctaggaaaggtgtgaccttaggcaagggccactctttgagtgagagcaatcctggtggaggacagtgggggactcagctgtcatgttgttttcaaaaacccagccactaacatcaaacatgtttaataagcttattaagaaaaaagccaaaaagattaggtattttattagaaataggtgagcctgagaaaatagtgagacaatagagatcactgaagaaagtt

SEQ ID NO: 201933 - DNA, 601 bp, Human
aaggtagtttgaagtctttacgctatttgataaagcaactaaatcagtgttagccaagcaggaggaaaagctatagacattttaatgtttgcaagaaagcattcaaaggttcttaataaccaggctgtgagccatgggcagtcggagagcctggaagccctcctgtgggaagaagcaaaggtcttcctgtagcaaaaaacagtcctgggcttacccaaatagcaactgataaaattaagacagtttttaaaaatcatggcacatatggcaatctagtgaatagataatcattatatactggcattttttaaaagtgatttattaatagagaaagaaatattgactcagtggtagcggtcagggagctctgggtggagtgctgatcttgctgcccctactgtttgcttgagaagctgtttacatattagaatgataaagaagaggattcaggctgaggaaggcagggctcgtgcaagagccaatgcaggtgagagcatgtcaaatctcagcacttacctttctgttaccccaatctggccacccccctgaattcacaccatacctttcctcctacctatgaaatgtaaggagctccttgagg

SEQ ID NO: 201934 - DNA, 601 bp, Human
agcaactaaatcagtgttagccaagcaggaggaaaagctatagacattttaatgtttgcaagaaagcattcaaaggttcttaataaccaggctgtgagccatgggcagtcggagagcctggaagccctcctgtgggaagaagcaaaggtcttcctgtagcaaaaaacagtcctgggcttacccaaatagcaactgataaaattaagacagtttttaaaaatcatggcacatatggcaatctagtgaatagataatcattatatactgtcattttttaaaagtgatttattaatagagaaakaaatattgactcagtggtagcggtcagggagctctgggtggagtgctgatcttgctgcccctactgtttgcttgagaagctgtttacatattagaatgataaagaagaggattcaggctgaggaaggcagggctcgtgcaagagccaatgcaggtgagagcatgtcaaatctcagcacttacctttctgttaccccaatctggccacccccctgaattcacaccatacctttcctcctacctatgaaatgtaaggagctccttgaggcaagggcctatgtgtgtgcacgagagcccctat

SEQ ID NO: 201935 - DNA, 601 bp, Human
aaagcattcaaaggttcttaataaccaggctgtgagccatgggcagtcggagagcctggaagccctcctgtgggaagaagcaaaggtcttcctgtagcaaaaaacagtcctgggcttacccaaatagcaactgataaaattaagacagtttttaaaaatcatggcacatatggcaatctagtgaatagataatcattatatactgtcattttttaaaagtgatttattaatagagaaagaaatattgactcagtggtagcggtcagggagctctgggtggagtgctgatcttgctgccccyactgtttgcttgagaagctgtttacatattagaatgataaagaagaggattcaggctgaggaaggcagggctcgtgcaagagccaatgcaggtgagagcatgtcaaatctcagcacttacctttctgttaccccaatctggccacccccctgaattcacaccatacctttcctcctacctatgaaatgtaaggagctccttgaggcaagggcctatgtgtgtgcacgagagcccctatctctgttttgcatagtgagtatgtcatagacagttgctgatggtttgaatgaagaagccatt

SEQ ID NO: 201936 - DNA, 601 bp, Human
agtgcacttctagagttagctcagacttcacaggctgagggtgcatcctccacaagactccctccccttacaccccaattgcaagctccaggattcctaggccattcacacttctgaccaattggctacaagtttgggggtttctgctatcccagcaggttcaacagtttcctaaaacaactcacagaatgcaggaaagtgctatccttacagttttatcatataaatgagagccagccaaatgaagaaacatagaggacaggtctgagggaccccaaacaggaaggtttcatatcctcasaaggctttgccctccagacacaccaacaagatgtgcatcaccaaccaggaagttcacctgagctttggtgcccaggaatttattaggccttattatacaggcatcgttgattgattgattgattgatggaatcactggccacataattggactcaatctccagctccccttccctccctggaggtcaggctgataccatgtggctcaaagcttcaactctctgattacccggttggtctttccagcattgcagcccccatcctgaggctagcagggacccaccatgaatcacctcattag

SEQ ID NO: 201937 - DNA, 601 bp, Human
ctccagacacaccaacaagatgtgcatcaccaaccaggaagttcacctgagctttggtgcccaggaatttattaggccttattatacaggcatcgttgattgattgattgattgatggaatcactggccacataattggactcaatctccagctccccttccctccctggaggtcaggctgataccatgtggctcaaagcttcaactctctgattacccggttggtctttccagcattgcagcccccatcctgaggctagcagggacccaccatgaatcacctcattagtatagattcagktgtagtctgaggaacccacagtgaaggacaaaggccatcctaactcttgggaaattccaagggtttaaacaccccctctgcagaaccaaggacaaaaactcatcaaattctttatgatacaccatcagtaaccagcagtggtgacattggtggcaggtgctccctgtcccccaagaacttcaggtttgccccccaggaaagaatgcaccactggtaagaatctgcccagcaccaggcacctcccaaatagcacatttcatgcttagaaagctcccaaggtcttccttacctgaagctgaa

SEQ ID NO: 201938 - DNA, 601 bp, Human
ccaggcacctcccaaatagcacatttcatgcttagaaagctcccaaggtcttccttacctgaagctgaaatctatcttcctatgaagatatgttgggtgaagagtctcttaatgaatttcaaccccaaggacctcgagttaaattttcctccaccatgtctacaacagaaattggttgcttcttagaaggaaatctgaaaaaaaaattttgtgcaagcagagtcctggagagtttcaccaactagaatcattagctggatttagtctgacccctctcagagactatgggtaggggagaagstgcacggccgtgtctggcctgatacaaatcttattcaaccccttgatatggtgcctttacttctcaagtggctgggaatctccctcaccagagtctcttctttttattttgaaattatttcatactttttaaaaagttggaaaaaaaaaaaacaaggctaaggactcccatatagctttctcccagatcctcaatggtttaaatttattgttttctgtattgccagctcagtctcttcataagcaggcatacatgcatacacatacacaaatatgcccattatcgttattcttttttctg

SEQ ID NO: 201939 - DNA, 601 bp, Human
caggcacctcccaaatagcacatttcatgcttagaaagctcccaaggtcttccttacctgaagctgaaatctatcttcctatgaagatatgttgggtgaagagtctcttaatgaatttcaaccccaaggacctcgagttaaattttcctccaccatgtctacaacagaaattggttgcttcttagaaggaaatctgaaaaaaaaattttgtgcaagcagagtcctggagagtttcaccaactagaatcattagctggatttagtctgacccctctcagagactatgggtaggggagaaggkgcacggccgtgtctggcctgatacaaatcttattcaaccccttgatatggtgcctttacttctcaagtggctgggaatctccctcaccagagtctcttctttttattttgaaattatttcatactttttaaaaagttggaaaaaaaaaaaacaaggctaaggactcccatatagctttctcccagatcctcaatggtttaaatttattgttttctgtattgccagctcagtctcttcataagcaggcatacatgcatacacatacacaaatatgcccattatcgttattcttttttctga

SEQ ID NO: 201940 - DNA, 601 bp, Human
cccaaatagcacatttcatgcttagaaagctcccaaggtcttccttacctgaagctgaaatctatcttcctatgaagatatgttgggtgaagagtctcttaatgaatttcaaccccaaggacctcgagttaaattttcctccaccatgtctacaacagaaattggttgcttcttagaaggaaatctgaaaaaaaaattttgtgcaagcagagtcctggagagtttcaccaactagaatcattagctggatttagtctgacccctctcagagactatgggtaggggagaaggtgcacggccrtgtctggcctgatacaaatcttattcaaccccttgatatggtgcctttacttctcaagtggctgggaatctccctcaccagagtctcttctttttattttgaaattatttcatactttttaaaaagttggaaaaaaaaaaaacaaggctaaggactcccatatagctttctcccagatcctcaatggtttaaatttattgttttctgtattgccagctcagtctcttcataagcaggcatacatgcatacacatacacaaatatgcccattatcgttattcttttttctgaactatttga

SEQ ID NO: 201941 - DNA, 601 bp, Human
aaatctatcttcctatgaagatatgttgggtgaagagtctcttaatgaatttcaaccccaaggacctcgagttaaattttcctccaccatgtctacaacagaaattggttgcttcttagaaggaaatctgaaaaaaaaattttgtgcaagcagagtcctggagagtttcaccaactagaatcattagctggatttagtctgacccctctcagagactatgggtaggggagaaggtgcacggccgtgtctggcctgatacaaatcttattcaaccccttgatatggtgcctttacttctcawgtggctgggaatctccctcaccagagtctcttctttttattttgaaattatttcatactttttaaaaagttggaaaaaaaaaaaacaaggctaaggactcccatatagctttctcccagatcctcaatggtttaaatttattgttttctgtattgccagctcagtctcttcataagcaggcatacatgcatacacatacacaaatatgcccattatcgttattcttttttctgaactatttgagagcaagttgtagtattgctgccccatcaccggaatgctccagggtttatctcccca

SEQ ID NO: 201942 - DNA, 601 bp, Human
tgcaagctccacctcctgggttcacaccattctcctgcctcagcctcccaagtagctgggactacaggcatccaccaccacacccggctaatttttttgtattttttagtagagacggggtttcaccatgttaatcaggatggtcttgatcttctgacctcgtgatccgcccgcctcagcctcccaaagtgttgggattacaggcatgagccaccgcgcctggccgggctgtcactgcttctaagtcctttccataaatgaagctcagtttctctctctctctctctgtgtgtgtgtgtgtatctctttctatctataaaaccatgagtcacacctgcacttccaattccaatccttcacctccaaagatttcaaaaatgatgagataggttggctagactctctaggctccccatctccataagagtttcccattatcctcaatacatttacttctttgctcactcccccctttggttacttctttgctcactccccctgtttggttctttgctcactccctgtttggttacaatctcctaatcactccaaccatctctcttggcccaactcctttgacccctgaccttgccaccacctc

SEQ ID NO: 201943 - DNA, 601 bp, Human
gccgggctgtcactgcttctaagtcctttccataaatgaagctcagtttctctctctctctctctgtgtgtgtgtgtgtatctctttctatctataaaaccatgagtcacacctgcacttccaattccaatccttcacctccaaagatttcaaaaatgatgagataggttggctagactctctaggctccccatctccataagagtttcccattatcctcaatacatttacttctttgctcactcccccctttggttacttctttgctcactccccctgtttggttctttgctcactcccygtttggttacaatctcctaatcactccaaccatctctcttggcccaactcctttgacccctgaccttgccaccacctccaaaggaaggaaaaagaaaagaagatagaaaggtagagaaagagaaaaatagaatgaattttgctttgttttcccagtctggtttacagagcaccagtctgcgaaggagattgctgtgtcaaaataaggctaatattttgttgtttggggggctgtttttttgtttgtttgttttttagtatttaccttgggccaagcaccgttctatggagttttatctaa

SEQ ID NO: 201944 - DNA, 601 bp, Human
tctctctctctctctctgtgtgtgtgtgtgtatctctttctatctataaaaccatgagtcacacctgcacttccaattccaatccttcacctccaaagatttcaaaaatgatgagataggttggctagactctctaggctccccatctccataagagtttcccattatcctcaatacatttacttctttgctcactcccccctttggttacttctttgctcactccccctgtttggttctttgctcactccctgtttggttacaatctcctaatcactccaaccatctctcttggcccaactcctttgacccctgaccttgccaccacctccaaaggaaggaaaaagaaaagaagatagaaaggtagagaaagagaaaaatagaatgaattttgctttgttttcccagtctggtttacagagcaccagtctgcgaaggagattgctgtgtcaaaataaggctaatattttgttgtttggggggctgtttttttgtttgtttgttttttagtatttaccttgggccaagcaccgttctatggagttttatctaatttaatcctcataaaagcattccaaattggtactattattttgtccat

SEQ ID NO: 201945 - DNA, 601 bp, Human
atttacttctttgctcactcccccctttggttacttctttgctcactccccctgtttggttctttgctcactccctgtttggttacaatctcctaatcactccaaccatctctcttggcccaactcctttgacccctgaccttgccaccacctccaaaggaaggaaaaagaaaagaagatagaaaggtagagaaagagaaaaatagaatgaattttgctttgttttcccagtctggtttacagagcaccagtctgcgaaggagattgctgtgtcaaaataaggctaatattttgttgtttrgggggctgtttttttgtttgtttgttttttagtatttaccttgggccaagcaccgttctatggagttttatctaatttaatcctcataaaagcattccaaattggtactattattttgtccatattctagatgagaaaaccaaatccagagaagtttagtatgtacccaagcatatccagctgggtggtggtggtgggtggatggggcactgctgcagcctggcaccagggcttgtactcctggctattgctagtctgcatttcagttatccatgacttaaaaggtattctctgctcccc

SEQ ID NO: 201946 - DNA, 601 bp, Human
gttctttgctcactccctgtttggttacaatctcctaatcactccaaccatctctcttggcccaactcctttgacccctgaccttgccaccacctccaaaggaaggaaaaagaaaagaagatagaaaggtagagaaagagaaaaatagaatgaattttgctttgttttcccagtctggtttacagagcaccagtctgcgaaggagattgctgtgtcaaaataaggctaatattttgttgtttggggggctgtttttttgtttgtttgttttttagtatttaccttgggccaagcaccgttytatggagttttatctaatttaatcctcataaaagcattccaaattggtactattattttgtccatattctagatgagaaaaccaaatccagagaagtttagtatgtacccaagcatatccagctgggtggtggtggtgggtggatggggcactgctgcagcctggcaccagggcttgtactcctggctattgctagtctgcatttcagttatccatgacttaaaaggtattctctgctccccaaccctctcccatttgcagagaacacagatttgttaataaaatagcacaaatatttca

SEQ ID NO: 201947 - DNA, 601 bp, Human
atagcaagcacaaactaaaaggaaacctgctcttgagagctaaactgtgatgaatgagatctgcaagtttgtggctttttgcctgagagaactttccagtctggaatgggctccaggggcaaaaatctgcagccttactagcttaaagtgtcagaggatacaatatgagattggcagagcagcaagaagattagcagaaaatcatggagagagtaagccccaaaataaaacattaatttttaaaaataatttatagaagcaaatttataaactacttagaaataaatttaacaaaagaccyatacaatatatatgttgaaaatgataaaacattactaaaagaaaataaagaagacctaaataaatagagagatatgccatgttcatgtattacaggcatcaatgctgttaagatgccaattctggccaggtgcagtggttcatgcctataatcccaacactttgcaaagccaaggtaggaggatcacttgaggcccaagagttcaagtccagcctggtcaacatagcatgacccaaactctataaaaatttaaacattaaaaaaaaatgccagttctctccaattaagctatagatttaa

SEQ ID NO: 201948 - DNA, 601 bp, Human
agagctaaactgtgatgaatgagatctgcaagtttgtggctttttgcctgagagaactttccagtctggaatgggctccaggggcaaaaatctgcagccttactagcttaaagtgtcagaggatacaatatgagattggcagagcagcaagaagattagcagaaaatcatggagagagtaagccccaaaataaaacattaatttttaaaaataatttatagaagcaaatttataaactacttagaaataaatttaacaaaagacctatacaatatatatgttgaaaatgataaaacattaytaaaagaaaataaagaagacctaaataaatagagagatatgccatgttcatgtattacaggcatcaatgctgttaagatgccaattctggccaggtgcagtggttcatgcctataatcccaacactttgcaaagccaaggtaggaggatcacttgaggcccaagagttcaagtccagcctggtcaacatagcatgacccaaactctataaaaatttaaacattaaaaaaaaatgccagttctctccaattaagctatagatttaacacagtcccactcataatgcagcagactttttaaa

SEQ ID NO: 201949 - DNA, 601 bp, Human
aaatgataaaacattactaaaagaaaataaagaagacctaaataaatagagagatatgccatgttcatgtattacaggcatcaatgctgttaagatgccaattctggccaggtgcagtggttcatgcctataatcccaacactttgcaaagccaaggtaggaggatcacttgaggcccaagagttcaagtccagcctggtcaacatagcatgacccaaactctataaaaatttaaacattaaaaaaaaatgccagttctctccaattaagctatagatttaacacagtcccactcataatkcagcagactttttaaaaagaaagtggccagctgattctaacatttatgtggacatgcaaagacctagcccaataatctaggggatggggaacagcggaagacttaaccctatttgacttcaagatctcatgtaaagctacagtaatgcagacagtgtggttgacattggtacagtatagacaaagatcaatagaaaagaaatgagagttcagaaataaacctagatggccaaatgatttttgacaaagaaaagcaattcatttgggaagggaaagtcaacaaccaatgctgaacaaccgt

SEQ ID NO: 201950 - DNA, 601 bp, Human
ctaggggatggggaacagcggaagacttaaccctatttgacttcaagatctcatgtaaagctacagtaatgcagacagtgtggttgacattggtacagtatagacaaagatcaatagaaaagaaatgagagttcagaaataaacctagatggccaaatgatttttgacaaagaaaagcaattcatttgggaagggaaagtcaacaaccaatgctgaacaaccgtagatctatatttttgaaaatgaataccatatacaaaaattaattcacaatagatcacaaaactaaaaattaaaactrtgaagtttataaaagaaaacatagaatatcttcatgacctggaggcaggcaaagatttcttaggatacagaaaacgctaaccatgaaagaaaatgttgacaagttagactctgtcagaagacattgattaggcaatgcagaatgggcacactacagacctggagaaaatattcataaaatacatcatacaaaatacttttacctagaatgtataaaagcctcctacaactctcctgcaaatgaaaacacaacagaaaaaatggggaaaagattcaaacaaccactttacagaggaaggta

SEQ ID NO: 201951 - DNA, 601 bp, Human
acactacgcacccactgagatggctaatattaaaaagactgacaacaccaaatgttagtgaagatgtggtgtaacaaaagtctcatgtcacaggagaaatataaaatggaataatcctgacagttgctcataaagtcagacatacatctatctttgatccagtaattcctcttctcagcatttatccacaggaaatcacaatgtatagtcacaaaaatacttgcacattgatgttcatagtagttcaattcacaatagccaaaaattagaaatagtccaggtgttcggaagcagaagaccraatcaacatattgtgattcatttacaaagcagaacattaccgattgataagtaggaatgaatttctgatatatgcaacaacatgatggatctcagacattatgctgagtgaaaaaagacaccaaaaaagtgtatgctaaatgattccatttatacgaagttctagaacaggcaaaaccaattgaaagtggtgggggtagggtaaggttgactggagaggcgggaggtagtggggccatgagggtggactgagaagggatatgggggagttttctggggatctggaaagttctatacctta

SEQ ID NO: 201952 - DNA, 601 bp, Human
atgttagtgaagatgtggtgtaacaaaagtctcatgtcacaggagaaatataaaatggaataatcctgacagttgctcataaagtcagacatacatctatctttgatccagtaattcctcttctcagcatttatccacaggaaatcacaatgtatagtcacaaaaatacttgcacattgatgttcatagtagttcaattcacaatagccaaaaattagaaatagtccaggtgttcggaagcagaagaccaaatcaacatattgtgattcatttacaaagcagaacattaccgattgataartaggaatgaatttctgatatatgcaacaacatgatggatctcagacattatgctgagtgaaaaaagacaccaaaaaagtgtatgctaaatgattccatttatacgaagttctagaacaggcaaaaccaattgaaagtggtgggggtagggtaaggttgactggagaggcgggaggtagtggggccatgagggtggactgagaagggatatgggggagttttctggggatctggaaagttctataccttaattggtatgtgggttacacagttgtattcatgtgtcaaaattgtatagctt

SEQ ID NO: 201953 - DNA, 601 bp, Human
gtaggaatgaatttctgatatatgcaacaacatgatggatctcagacattatgctgagtgaaaaaagacaccaaaaaagtgtatgctaaatgattccatttatacgaagttctagaacaggcaaaaccaattgaaagtggtgggggtagggtaaggttgactggagaggcgggaggtagtggggccatgagggtggactgagaagggatatgggggagttttctggggatctggaaagttctataccttaattggtatgtgggttacacagttgtattcatgtgtcaaaattgtatagctwcaatttatgcattttaatgtatagaaattttacatttaaagaagaactgtaaaaaaataatagttgagtcacagctggggagtgggtggtgatattgatgaagcaagaaggcagaaggttggtaattgttgaggctgggtgatgcgtacatgggggtttattatactcttctgtttactttgtatatgtttgagatttttgataatcaacagcacaggagttctagccctgaggaaattagatattagccaagtaggtttcagctggagcaggagaggactgtaagttcaaaagcaccag

SEQ ID NO: 201954 - DNA, 601 bp, Human
agaggactgtaagttcaaaagcaccagtggtgggggctccaggagggacttgggagtgacgtgggggctctgagtaatgcattattccggatgacagtggacagagcagggcagaaggtcagggacaggagaaatgggtagagaggatgacaaaatggttaacttcacgggcttgcactcctcccccaaccagatgtccctctcactgtaggagtgccactgatcccagtcttcatcccctccagggcctcagttctgattcctgcactggttgttacaactgctcacaagtgcattctgkgcctctgtttccccatctatctcacagagcagtcgtcaccctctgtgacgggcattttctttcctaatggggaagggatttttcaggctgagggtcttctagtttcacaactccctggagtccagaagggctagcaagaggcagttagcccgagacagatgggtgcccaggcaagcaaataactgggcattccttcaaaccaggattatctaaatattagcatgacattttcctagtggagagagaaagaaatttatttacttctgagaaaaataatatgcctccttcttttcattccaa

SEQ ID NO: 201955 - DNA, 601 bp, Human
ggtgcccaggcaagcaaataactgggcattccttcaaaccaggattatctaaatattagcatgacattttcctagtggagagagaaagaaatttatttacttctgagaaaaataatatgcctccttcttttcattccaattaaggaactgattacagttgattgactaaattagaaactgtcttgggaggcatgttaagaaaatgtaaaatctaaataatcaaatgcccctcctctttttggtttgacagcaacctattatgcattatttggtctttaggctgatgtaggcttgatggcaygcacattgcagacatatccaacagagatacgtcggtgccttcgggtttttaaatttatatcccagaggacactctgctctgtcaggagtgagctcaattcaccaacaatatgtggaactacatgagaaacctaagttaaaatggcaccaaagtccgggcgcggtggctcacgcctgtaatcccagcactttgggaggccgaggcaggcagatcacttgaggtcaggagtttgagaccagcctggccaacatgataaaaccccatctctactaaaaatacaaaaattatccaggcgtggtg

SEQ ID NO: 201956 - DNA, 601 bp, Human
gaactacatgagaaacctaagttaaaatggcaccaaagtccgggcgcggtggctcacgcctgtaatcccagcactttgggaggccgaggcaggcagatcacttgaggtcaggagtttgagaccagcctggccaacatgataaaaccccatctctactaaaaatacaaaaattatccaggcgtggtggtgcctacctgtagtcccagctactcaggaggatgaggcaggagaatggcttgaacctgggaggcggaggttgcagtgagccgagatcacatcactgcactccagcctgggtgamagagcgagactccatctcaagaaaaaaaaaatggcaccaaagtgatttcagaactaggcagggccttacagatggacttctaggcagctgcccggttggcccacctgttaatccatctctggctctaggccaggaagctgtggcatcaggctgggagacaggcagtctattaacctccggttaacaagaaagcaggaacaagagggcacgtggtttcttgccagcactcatttcttgtgtccttgctcatgtggggattgtggcacttaatccttccaagtgaatcttgtccttatcttt

SEQ ID NO: 201957 - DNA, 601 bp, Human
ggcagatcacttgaggtcaggagtttgagaccagcctggccaacatgataaaaccccatctctactaaaaatacaaaaattatccaggcgtggtggtgcctacctgtagtcccagctactcaggaggatgaggcaggagaatggcttgaacctgggaggcggaggttgcagtgagccgagatcacatcactgcactccagcctgggtgacagagcgagactccatctcaagaaaaaaaaaatggcaccaaagtgatttcagaactaggcagggccttacagatggacttctaggcagctgyccggttggcccacctgttaatccatctctggctctaggccaggaagctgtggcatcaggctgggagacaggcagtctattaacctccggttaacaagaaagcaggaacaagagggcacgtggtttcttgccagcactcatttcttgtgtccttgctcatgtggggattgtggcacttaatccttccaagtgaatcttgtccttatcttttccagccccaccactccatgaatcagcttggcctagtagaaatcctcagtctagtgtcccaagattccaaatcccagttccattccgtggg

SEQ ID NO: 201958 - DNA, 601 bp, Human
cgtggtggtgcctacctgtagtcccagctactcaggaggatgaggcaggagaatggcttgaacctgggaggcggaggttgcagtgagccgagatcacatcactgcactccagcctgggtgacagagcgagactccatctcaagaaaaaaaaaatggcaccaaagtgatttcagaactaggcagggccttacagatggacttctaggcagctgcccggttggcccacctgttaatccatctctggctctaggccaggaagctgtggcatcaggctgggagacaggcagtctattaacctccrgttaacaagaaagcaggaacaagagggcacgtggtttcttgccagcactcatttcttgtgtccttgctcatgtggggattgtggcacttaatccttccaagtgaatcttgtccttatcttttccagccccaccactccatgaatcagcttggcctagtagaaatcctcagtctagtgtcccaagattccaaatcccagttccattccgtgggttgtgggacatatattagtttctccatcagccacacgggatggtaacacctgcttccctgtgttgtgtggattcaatgaaatcatgtc

SEQ ID NO: 201959 - DNA, 601 bp, Human
tgggaggcggaggttgcagtgagccgagatcacatcactgcactccagcctgggtgacagagcgagactccatctcaagaaaaaaaaaatggcaccaaagtgatttcagaactaggcagggccttacagatggacttctaggcagctgcccggttggcccacctgttaatccatctctggctctaggccaggaagctgtggcatcaggctgggagacaggcagtctattaacctccggttaacaagaaagcaggaacaagagggcacgtggtttcttgccagcactcatttcttgtgtccytgctcatgtggggattgtggcacttaatccttccaagtgaatcttgtccttatcttttccagccccaccactccatgaatcagcttggcctagtagaaatcctcagtctagtgtcccaagattccaaatcccagttccattccgtgggttgtgggacatatattagtttctccatcagccacacgggatggtaacacctgcttccctgtgttgtgtggattcaatgaaatcatgtctgcaaagggcctagcagtgcctggtgcaggagctcagtgatgctggctaaattgcaaaccactc

SEQ ID NO: 201960 - DNA, 601 bp, Human
cggttaacaagaaagcaggaacaagagggcacgtggtttcttgccagcactcatttcttgtgtccttgctcatgtggggattgtggcacttaatccttccaagtgaatcttgtccttatcttttccagccccaccactccatgaatcagcttggcctagtagaaatcctcagtctagtgtcccaagattccaaatcccagttccattccgtgggttgtgggacatatattagtttctccatcagccacacgggatggtaacacctgcttccctgtgttgtgtggattcaatgaaatcatgyctgcaaagggcctagcagtgcctggtgcaggagctcagtgatgctggctaaattgcaaaccactcagaaggtctgctgttcacatagtggatgttccgtaattattaattggttagattgtaatgaggtgcagaagcaaatttttgttattctctgcctctttgcattttctccttcacttctgctctctcagttcctctgtctctgcctcatttcacccatttgtcaatttatcagatagagcccattgtgtacaaatcttcccctaaatgctagagaatcagagacaaatcgaacatg

SEQ ID NO: 201961 - DNA, 601 bp, Human
atcagatagagcccattgtgtacaaatcttcccctaaatgctagagaatcagagacaaatcgaacatgaagacagaatcccaccctagagaatcccacttttcaggtctgtgtgagaattatgggagcccaaaggtgggcacccctgagtcatgcctctctcttctcctctgcaggagatcatcacctccatcctgctgagcgggcggatcgggcccaacatccggttggctgagtgctatgggctgaggctgaagcacatgaagtccgatgagatccactggctgcacccacagatgacrgtgggtgaggtgcaggacaagtatgagtgtctgcacgtggaagccgagtggaggtaggagtggattcctgggctctggaagtgggaaggagaggaatttagggtggggaggccctgggagtttctcccttagagcactcccctgcctcagaaacttctagcaaacctgagtggcattctaggcttagtcttcctccagtatccaatgcatgtattttccaggacctaacctgggcttcatagactatccccatcccagagccaacacctaaaggtaaccctaaacgggatgctgacagtg

SEQ ID NO: 201962 - DNA, 601 bp, Human
atgtcttgttgcaggtatgaccttcaaatccgctacttgccagaagacttcatggagagcctgaaggaggacaggaccacgctgctctatttttaccaacaggtaaaaagtactttatcttcttgccccgaggctcccattacacctcaaatgccaagcatgaaccgttctctcctagggagatggaaagacaaagcccagattatggagggcccaggctaggaagcttctcttgaagaaggtccttggtctatggtccgcggctccaaccctgcttttctctcagtatttaagcactggmtaaactgccccatgtgctcccagctcctcttggacttttctggtggcccaggagacctggctagtgaaacagcaagagcaggtccaagatgaatcctgcagtgcttactacacagctctgcagactgttgtccactaatctagctctgccattcactaatctgatagcctgggggacctcatttacttgcatgaagctgtttcctctgctgtaaaattattatgggaatcataataataatacctactttatagggttgttgtagggaccagatgatatcattggctgctaaattgactc

SEQ ID NO: 201963 - DNA, 601 bp, Human
aggtccaagatgaatcctgcagtgcttactacacagctctgcagactgttgtccactaatctagctctgccattcactaatctgatagcctgggggacctcatttacttgcatgaagctgtttcctctgctgtaaaattattatgggaatcataataataatacctactttatagggttgttgtagggaccagatgatatcattggctgctaaattgactctccaaagaaaaattcccttacacgtagcacttacctatttatttatttatttatttatttatttatttatttatttatttcaatgggttttttgggggaacaggtggtgttggttacatgaataatttctttaatggtgatttctgagatgttggtgcacccatcacccaagcagtgtgcactgtacccaatgtgtagtcttttatcactcaccccttcccactctttccccagagtctccaaagtcattcttatgcctttgcatcatcatggttagctcccccttatgagtgagaacatacaatgttggttttccattctggagttaattcacttagaataatggtctccaactccatccaggttgctgtaaatgccat

SEQ ID NO: 201964 - DNA, 601 bp, Human
acccatcacccaagcagtgtgcactgtacccaatgtgtagtcttttatcactcaccccttcccactctttccccagagtctccaaagtcattcttatgcctttgcatcatcatggttagctcccccttatgagtgagaacatacaatgttggttttccattctggagttaattcacttagaataatggtctccaactccatccaggttgctgtaaatgccattatttcattcatttttatggcccttgccaatttctatggtgtaaataccacccccctcctcagcctatttcaagctacyaataggatacctacttggcttacaaaacttctgaaaacttaataaccagctctcagcagctattttgagcatctcaaacttcctggacagaatgcgtatggagtgccaagcccagcaccaggtgcagagcaaagcgcagcatcagcaggagtggccattgctgttttctgtctgatattagttccttccaagatctccctcctggtttgccagagactgagctagacttttcttggcctgtgaatgacatttatcactacttaccaacagagctttggataaattactgacttcttgcaa

SEQ ID NO: 201965 - DNA, 601 bp, Human
gttttccattctggagttaattcacttagaataatggtctccaactccatccaggttgctgtaaatgccattatttcattcatttttatggcccttgccaatttctatggtgtaaataccacccccctcctcagcctatttcaagctactaataggatacctacttggcttacaaaacttctgaaaacttaataaccagctctcagcagctattttgagcatctcaaacttcctggacagaatgcgtatggagtgccaagcccagcaccaggtgcagagcaaagcgcagcatcagcaggartggccattgctgttttctgtctgatattagttccttccaagatctccctcctggtttgccagagactgagctagacttttcttggcctgtgaatgacatttatcactacttaccaacagagctttggataaattactgacttcttgcaaaatctcagttttcttctatccaaaatggggggcaggggaggggaatctgaacttcctgcctgtggagcagggagagaatgcctgtaaaagcacctcgaaaacctcacaggctcggcctgtggaggcacaagcaccctttcccctcgtgctc

SEQ ID NO: 201966 - DNA, 601 bp, Human
tagaataatggtctccaactccatccaggttgctgtaaatgccattatttcattcatttttatggcccttgccaatttctatggtgtaaataccacccccctcctcagcctatttcaagctactaataggatacctacttggcttacaaaacttctgaaaacttaataaccagctctcagcagctattttgagcatctcaaacttcctggacagaatgcgtatggagtgccaagcccagcaccaggtgcagagcaaagcgcagcatcagcaggagtggccattgctgttttctgtctgatmttagttccttccaagatctccctcctggtttgccagagactgagctagacttttcttggcctgtgaatgacatttatcactacttaccaacagagctttggataaattactgacttcttgcaaaatctcagttttcttctatccaaaatggggggcaggggaggggaatctgaacttcctgcctgtggagcagggagagaatgcctgtaaaagcacctcgaaaacctcacaggctcggcctgtggaggcacaagcaccctttcccctcgtgctctccatccctgctccatgcttgtttgt

SEQ ID NO: 201967 - DNA, 601 bp, Human
ttccttccaagatctccctcctggtttgccagagactgagctagacttttcttggcctgtgaatgacatttatcactacttaccaacagagctttggataaattactgacttcttgcaaaatctcagttttcttctatccaaaatggggggcaggggaggggaatctgaacttcctgcctgtggagcagggagagaatgcctgtaaaagcacctcgaaaacctcacaggctcggcctgtggaggcacaagcaccctttcccctcgtgctctccatccctgctccatgcttgtttgtggtgrggtgggtggctgtcactcagggaggcagaatgaggcccttaatcttctgaggcctctgtgcagggaagtgggaggtgagggtgcaagcctgatgcttgacctttctccccaccagctccggaacgactacatgcagcgctacgccagcaaggtcagcgagggcatggccctgcagctgggctgcctggagctcaggtatgtggccctgaggcctctgctgggagggcgctgtgctgagctctgggcaggcccgacctttccccatgtccaagatgggaagcaggaatgagtgtgtgggag

SEQ ID NO: 201968 - DNA, 601 bp, Human
ctgtggagcagggagagaatgcctgtaaaagcacctcgaaaacctcacaggctcggcctgtggaggcacaagcaccctttcccctcgtgctctccatccctgctccatgcttgtttgtggtggggtgggtggctgtcactcagggaggcagaatgaggcccttaatcttctgaggcctctgtgcagggaagtgggaggtgagggtgcaagcctgatgcttgacctttctccccaccagctccggaacgactacatgcagcgctacgccagcaaggtcagcgagggcatggccctgcagctrggctgcctggagctcaggtatgtggccctgaggcctctgctgggagggcgctgtgctgagctctgggcaggcccgacctttccccatgtccaagatgggaagcaggaatgagtgtgtgggagccaggaaggggagaggtggtgaccggcagcaggtgaggctctgaggggctgggtgttgggtcttcaggatggcaggggtagatgggccagccccctccctagtctcactctcctggcttccattgctgccactgctcttgcctgcaggctgctggcttcttccatctgtcaaccacct

SEQ ID NO: 201969 - DNA, 601 bp, Human
ccagctccggaacgactacatgcagcgctacgccagcaaggtcagcgagggcatggccctgcagctgggctgcctggagctcaggtatgtggccctgaggcctctgctgggagggcgctgtgctgagctctgggcaggcccgacctttccccatgtccaagatgggaagcaggaatgagtgtgtgggagccaggaaggggagaggtggtgaccggcagcaggtgaggctctgaggggctgggtgttgggtcttcaggatggcaggggtagatgggccagccccctccctagtctcactctsctggcttccattgctgccactgctcttgcctgcaggctgctggcttcttccatctgtcaaccacctttgctgctgttcaagcgattcatcagatgtttcttgagcaccagactagaatctgggggacattcgagcctagagatgtctatctgtgttgcccattgctgtatccccatctccagtaggcacttgatcaatatgtgtgatattagtacatcatccagagaggccctcacacttccatgttggggaggtgacagatgtgtatacaattaatcataatacgaggcagaatgagga

SEQ ID NO: 201970 - DNA, 601 bp, Human
cagtggaaggaaaagcatagactggagaatcgtgagcttggagggataagttggggctgatggtggaagacaccattgagacaatggcagtccaatgatatcattagaatgacattgttagaatgacataattagaatgacagtctaaaaaaataggccttattcttagctgccagggggtcattgccattcaggactgaggagggtgatatggctgacctgtgttctagccctgtcttgaccagggcagcaccattgagtttcaccatcccctgccttttcaccctctccttcccttctytctaccccttctctgtcttagagcagtggttttaacatctgcttgcaaatcataatcacctgggagcttaataaactggagacgtcctggccctacccttgggagatttgatttggcaggcctgggtgggaccttatcctaggcgtttttgaccagccccccaggtgacttgaatgccattagatatatgggttgatgggatgactttcaggatgactgccaaggaaatcgttggccaaggattacttcctgttttctagaactgcatttccggagccttatctgtgacctcatggttaa

SEQ ID NO: 201971 - DNA, 601 bp, Human
agcagtggttttaacatctgcttgcaaatcataatcacctgggagcttaataaactggagacgtcctggccctacccttgggagatttgatttggcaggcctgggtgggaccttatcctaggcgtttttgaccagccccccaggtgacttgaatgccattagatatatgggttgatgggatgactttcaggatgactgccaaggaaatcgttggccaaggattacttcctgttttctagaactgcatttccggagccttatctgtgacctcatggttaatagagagtagaactctgctgcygcttctacggagccagctgaggggcactggggaattctggccccattgtgattctcagtcagagagaatgctggggagtcctccggtggggccagtaggatgggaaagggagagtcccactttgatttcagcatctgaggcttttggtattagcgacagaataggtcaagggcagcttcgagggcttcacatttcgtgactttgtctcaagaagcaagggagcattcgagtcctctgtacagaggaggcctgtggtccctgcagctgcttagaaggcagcccagctcactgccattagta

SEQ ID NO: 201972 - DNA, 601 bp, Human
cctgtactgtctcatcttcccctctaaaattagacaagtcgaaaaagcttatctttacctttttatttatggatctcatacctgggatgctagcatcactttgagacacctatcacttgtcacctgtcaagcagtcatcacttagttgtaaaacagcaccacaaagacccattaacattctattttattttattatatcctccaatcatccccaaactattactggtggtggcctaagctccaggcactgcactaatgtattggaggacagggcaaggcatccgacatgactcctgtaggyagtcttgtcaagagtgtaactgctgatatctgctataaccaatgcaggatgatattctaaaagccacacttgttttgtgcaagagatgtattgtttcacatctcctgagtgtgaggaacagagtcagagagatgttcctattcttactggttgaccactgaaatgccgggtgtatgatatcagggagaggatatggaaaacacctattttgtaaaccaaatagaagatttgcaggtctaataatttttaaagttgaatgcagttatttgttatgatgagccattttaaagtcaagttaca

SEQ ID NO: 201973 - DNA, 601 bp, Human
cccattaacattctattttattttattatatcctccaatcatccccaaactattactggtggtggcctaagctccaggcactgcactaatgtattggaggacagggcaaggcatccgacatgactcctgtaggtagtcttgtcaagagtgtaactgctgatatctgctataaccaatgcaggatgatattctaaaagccacacttgttttgtgcaagagatgtattgtttcacatctcctgagtgtgaggaacagagtcagagagatgttcctattcttactggttgaccactgaaatgcygggtgtatgatatcagggagaggatatggaaaacacctattttgtaaaccaaatagaagatttgcaggtctaataatttttaaagttgaatgcagttatttgttatgatgagccattttaaagtcaagttacaactatttctcacccaaagagaattggacacacttcggaaaattaggccataaggcagaattttctagggctgtggctcttgcctaaaaatgtcccagagtgtggggctacctacaaatcatgggcaataaccccttgtcctattaacatcattgattaggtcacctg

SEQ ID NO: 201974 - DNA, 601 bp, Human
cctattttgtaaaccaaatagaagatttgcaggtctaataatttttaaagttgaatgcagttatttgttatgatgagccattttaaagtcaagttacaactatttctcacccaaagagaattggacacacttcggaaaattaggccataaggcagaattttctagggctgtggctcttgcctaaaaatgtcccagagtgtggggctacctacaaatcatgggcaataaccccttgtcctattaacatcattgattaggtcacctgcctatagatatacaacatctccaggaaaaaaaaaaattgtatcatttcctagcttaaaaaagaggtatgatgtatgcctgagatatgagattagtgaaatgaatcctccatggagtcatgtgtttcctgtgttactctgggcaagtcgattacccgctctctgcccagattccttcatctgtaaaataggaatgataatagtaacattatagtcacgttgtgttactataaaacacgttatgtttctatataacatttgttatactatataacatatatctgttagtatataacatatatatgctactatataacatatgctactatataacatat

SEQ ID NO: 201975 - DNA, 601 bp, Human
gtattcaataattatttattatattttacttacttttttctctttacccttcttttgtttgtttattttgaatagactttattttttagagaagttttagattctcagcaaaattgagcagaaggtacagagttcctatatacccccttccccacacatgcacagcctcccccactatcaacattctccaccagaattccccaccaaagtggtgcatttgttacaattgatgagcctacattgacacatcattattacctaaaacctgtagtttacattagggttcactcttggtattgtrtgttctatgggtttggctaaatgaataatgacctatatctaccattatagcattacgcagagtagtttcactgccctaaaatttgtccatactccacctatccatccctccttccctctaaccctggcaaccattgatcactttattgttgccatagttttgccttttccagaatctcatatagttggaatgatacctagttaattttattcatttattggaggtgctttataaatgccaaatgtttgatctaaataatgcctctaaatgaaagtttgaaattcagggcctctatgctag

SEQ ID NO: 201976 - DNA, 601 bp, Human
cagttgctccaagacattcccaagatgttcagttgctccaaatgttagaaacacccagattgtggcacatctgagtgattggacagttttgtcaatggtgactatataaatgatcttcgatgcctgagagaagggccatttgggacacagggagtggcctaagcaagctggattcaggagattggggtgaccttgatgtgctagctgagcttcctttaccctaataaaacatttttccattcactaccaccttgatcatgctaaaatgctcttattttttatgtgacttaattgttcagtrttaatttcaaaatgtgtttaccctttcatttagctaaccctgttttaaaaaatttaatatttaaatatcccagtcttccaaattctttcttcacaagtctcgaagttcatttattcattcaacaacagatcataagcctggagtggctttaggagaccactctccgtcgtggctgggaagcagatctcaccccgtgggtgggtgatgcatcctcctgcttggcacagtcttctcatttcccttttcagcgtagtaaactcttctatcttctggcacctttagaaaacatactgagcccgt

SEQ ID NO: 201977 - DNA, 601 bp, Human
cactactgctgacatttggggctggatacttctttgttagggaggattgggggtggacttcctgtgcattgaaggatgtttagcagtatccctggtctctacccacttgatgctggtagcaccaccaaccccctactccaactagctgtgataaccaaaactatctccagacattgcccagtgtttcaggctggggcacagagtgcaaaattgggaccatatttcttaagaggtaattacttattttgcttgacagtatattcaaagataccatttattaaaaattattaaggatatagcrttttacattttatatttttattagatatttcctctatgatttcatgccttgagtgtcttctttttaattcttttgagacggagtttcactcttgtcacccatgctggagtgcaatggtgcaatctcggctcactgcaacctccgcctcctgggttcaagtgattctcctgcctcagcctcccgagtagtacgtgccaccatgcctggctaatttttgtgtttttagtagagacaaggtttcaccatgttggccaggatggtctcaatctcttgacgttgtgatttgcccacctcggcctc

SEQ ID NO: 201978 - DNA, 601 bp, Human
gtaattacttattttgcttgacagtatattcaaagataccatttattaaaaattattaaggatatagcgttttacattttatatttttattagatatttcctctatgatttcatgccttgagtgtcttctttttaattcttttgagacggagtttcactcttgtcacccatgctggagtgcaatggtgcaatctcggctcactgcaacctccgcctcctgggttcaagtgattctcctgcctcagcctcccgagtagtacgtgccaccatgcctggctaatttttgtgtttttagtagagrcaaggtttcaccatgttggccaggatggtctcaatctcttgacgttgtgatttgcccacctcggcctccctaagtgctgggattacagtcatgagccaacacattcggcctaaccttcctattttctaaagacaatgaactgtctaaaagtcattgcttttgaatcataagttacttccctcactctgcttatattattagttgcacaaaacttttaccagatatttataaggatgcccgaattaaaggaacactgaatgactttaatataagatcaggagtaggataatgtctgcaaca

SEQ ID NO: 201979 - DNA, 601 bp, Human
ctcaccctctcctccacccctccccagaccagagccacatagggccgtctctaggtcccaaagccctctcacctcttcctgattggcccgcagtcctgtggtgggggtgagggggagtcacatgctgcctttttcttccttcttgcagaaaggaagtggggctggacttgtttttcccaaagcagatgcaggagaacttaaaggtgaggaaaccaatgggcgaggacctcttcgtgctgattcccgagactagagtgtaagggatgaggctggggctggggatactcagagaagccagggyatctgcgcggcctcgggcatttggacacaggaccactaaatgtacccaggggtcctctctggggctggggatccaactgttacatgcctgggctccggctccgtatcgaggccgtatcagctctgcggccccagtactgggaagctacccctcgccccctcaacctccttcgtagggttacggggagtctcccttgagacaatgggtatgggttttaggtcatagatcacagctgcttttggggcaaaggccctggggatcattttcgagcagtgggcagtctctcagcgagaccctaag

SEQ ID NO: 201980 - DNA, 601 bp, Human
ggggagacaaggcctcaatgattactcgcagagctcagcagtgttgctctttcagtgacaatataaggcatgattcccttggaagtcaggggacctgggtccagtcctggctccactgccagcttggcacatgatgttgagcaagtcctggctttctctagacctcattttctccttggcatagggaggggcttggtctagatcaagcctgtggtcccaggatggctttgaatgcagcccaccacaaattcgtaaactttcttaaaacatgttgagatttttttgtgcgatttttttttttaccttcatcaagtagtgttagtgtattttatgtgtggtccaagacaattcttcttccaatgtggcccagggaagccaaaagattggacacccctgaactagaggatccttctagccttaatagtgtttgattctctcttcatctcccagagaaactcccagttcctcctcaccccggctcccccatactgaccaatctgcatggcctagtcctggtagtgggatggtctgaagctcccccttcttttcccacagcccacctgcctggccgagttcaagcagatcaggtccatcaggtgcc

SEQ ID NO: 201981 - DNA, 601 bp, Human
ggacctgggtccagtcctggctccactgccagcttggcacatgatgttgagcaagtcctggctttctctagacctcattttctccttggcatagggaggggcttggtctagatcaagcctgtggtcccaggatggctttgaatgcagcccaccacaaattcgtaaactttcttaaaacatgttgagatttttttgtgcgatttttttttttaccttcatcaagtagtgttagtgtattttatgtgtggtccaagacaattcttcttccaatgtggcccagggaagccaaaagattggacayccctgaactagaggatccttctagccttaatagtgtttgattctctcttcatctcccagagaaactcccagttcctcctcaccccggctcccccatactgaccaatctgcatggcctagtcctggtagtgggatggtctgaagctcccccttcttttcccacagcccacctgcctggccgagttcaagcagatcaggtccatcaggtgcctcccgctggaggagggccaggcagtacttcagctgggcattgaaggtgccccccaggtgagtgtctctgggcactgggcacctggcagct

SEQ ID NO: 201982 - DNA, 601 bp, Human
agccttaatagtgtttgattctctcttcatctcccagagaaactcccagttcctcctcaccccggctcccccatactgaccaatctgcatggcctagtcctggtagtgggatggtctgaagctcccccttcttttcccacagcccacctgcctggccgagttcaagcagatcaggtccatcaggtgcctcccgctggaggagggccaggcagtacttcagctgggcattgaaggtgccccccaggtgagtgtctctgggcactgggcacctggcagctctgcagggggtataatggcagaytgggagctcttgctcagaccaaaagtctgtgacacacaggaagccaggagcttcctggctttggggatcgtgttaagaaaactgcaccaagttcttagacaaaaggtaccaggatgatgataaattgtaggaaaattcgggaaacaatttttttaatgtcaggagaagaaattgggaaggttttcaggtagtggaatgttcaaggtgaccagaaatcaggtataaatcacaggcctaagttataccaagagaacaaggatgcggacatcaagacctcaaaaacatgggtttttttgtttg

SEQ ID NO: 201983 - DNA, 601 bp, Human
atctcccagagaaactcccagttcctcctcaccccggctcccccatactgaccaatctgcatggcctagtcctggtagtgggatggtctgaagctcccccttcttttcccacagcccacctgcctggccgagttcaagcagatcaggtccatcaggtgcctcccgctggaggagggccaggcagtacttcagctgggcattgaaggtgccccccaggtgagtgtctctgggcactgggcacctggcagctctgcagggggtataatggcagattgggagctcttgctcagaccaaaagtcygtgacacacaggaagccaggagcttcctggctttggggatcgtgttaagaaaactgcaccaagttcttagacaaaaggtaccaggatgatgataaattgtaggaaaattcgggaaacaatttttttaatgtcaggagaagaaattgggaaggttttcaggtagtggaatgttcaaggtgaccagaaatcaggtataaatcacaggcctaagttataccaagagaacaaggatgcggacatcaagacctcaaaaacatgggtttttttgtttgtttgtttgtttgttttttacagtaaaac

SEQ ID NO: 201984 - DNA, 601 bp, Human
cttcctggctttggggatcgtgttaagaaaactgcaccaagttcttagacaaaaggtaccaggatgatgataaattgtaggaaaattcgggaaacaatttttttaatgtcaggagaagaaattgggaaggttttcaggtagtggaatgttcaaggtgaccagaaatcaggtataaatcacaggcctaagttataccaagagaacaaggatgcggacatcaagacctcaaaaacatgggtttttttgtttgtttgtttgtttgttttttacagtaaaacacccagagagacctcaggctgcgtctctctctcctttcacccatctgtgccctgccccattgcctccccttcctctttctttctttctttcttttttttagacaaagtctcactctgtcacccaggctacagtgcagtggtgcaatctcagctcactgtaacctccacctccacagttcaagagattctcctgcctcagcctcctgagtagctgggactacaggtgcatgccacaaggcccaactaatttttgtacttttagtagacacagggtttcaccatgttggccaggctggtctcaaactcctgacctcaggtgatct

SEQ ID NO: 201985 - DNA, 601 bp, Human
ttcctggctttggggatcgtgttaagaaaactgcaccaagttcttagacaaaaggtaccaggatgatgataaattgtaggaaaattcgggaaacaatttttttaatgtcaggagaagaaattgggaaggttttcaggtagtggaatgttcaaggtgaccagaaatcaggtataaatcacaggcctaagttataccaagagaacaaggatgcggacatcaagacctcaaaaacatgggtttttttgtttgtttgtttgtttgttttttacagtaaaacacccagagagacctcaggctgcatctctctctcctttcacccatctgtgccctgccccattgcctccccttcctctttctttctttctttcttttttttagacaaagtctcactctgtcacccaggctacagtgcagtggtgcaatctcagctcactgtaacctccacctccacagttcaagagattctcctgcctcagcctcctgagtagctgggactacaggtgcatgccacaaggcccaactaatttttgtacttttagtagacacagggtttcaccatgttggccaggctggtctcaaactcctgacctcaggtgatctg

SEQ ID NO: 201986 - DNA, 601 bp, Human
tcctggctttggggatcgtgttaagaaaactgcaccaagttcttagacaaaaggtaccaggatgatgataaattgtaggaaaattcgggaaacaatttttttaatgtcaggagaagaaattgggaaggttttcaggtagtggaatgttcaaggtgaccagaaatcaggtataaatcacaggcctaagttataccaagagaacaaggatgcggacatcaagacctcaaaaacatgggtttttttgtttgtttgtttgtttgttttttacagtaaaacacccagagagacctcaggctgcatatctctctcctttcacccatctgtgccctgccccattgcctccccttcctctttctttctttctttcttttttttagacaaagtctcactctgtcacccaggctacagtgcagtggtgcaatctcagctcactgtaacctccacctccacagttcaagagattctcctgcctcagcctcctgagtagctgggactacaggtgcatgccacaaggcccaactaatttttgtacttttagtagacacagggtttcaccatgttggccaggctggtctcaaactcctgacctcaggtgatctgc

SEQ ID NO: 201987 - DNA, 601 bp, Human
tttggggatcgtgttaagaaaactgcaccaagttcttagacaaaaggtaccaggatgatgataaattgtaggaaaattcgggaaacaatttttttaatgtcaggagaagaaattgggaaggttttcaggtagtggaatgttcaaggtgaccagaaatcaggtataaatcacaggcctaagttataccaagagaacaaggatgcggacatcaagacctcaaaaacatgggtttttttgtttgtttgtttgtttgttttttacagtaaaacacccagagagacctcaggctgcatctctctctcctttcacccatctgtgccctgccccattgcctccccttcctctttctttctttctttcttttttttagacaaagtctcactctgtcacccaggctacagtgcagtggtgcaatctcagctcactgtaacctccacctccacagttcaagagattctcctgcctcagcctcctgagtagctgggactacaggtgcatgccacaaggcccaactaatttttgtacttttagtagacacagggtttcaccatgttggccaggctggtctcaaactcctgacctcaggtgatctgcctgcctc

SEQ ID NO: 201988 - DNA, 601 bp, Human
tttgtttgtttgtttgtttgttttttacagtaaaacacccagagagacctcaggctgcatctctctctcctttcacccatctgtgccctgccccattgcctccccttcctctttctttctttctttcttttttttagacaaagtctcactctgtcacccaggctacagtgcagtggtgcaatctcagctcactgtaacctccacctccacagttcaagagattctcctgcctcagcctcctgagtagctgggactacaggtgcatgccacaaggcccaactaatttttgtacttttagtaracacagggtttcaccatgttggccaggctggtctcaaactcctgacctcaggtgatctgcctgcctcggcctcctaaagtgctgggattataggcatgagccactgtgcccagccccctcttccattttctcagtttctgcttctatttattgagcacctactaggtaccaggcatcgtgctatgtgctcagaggccaaaataagtgaggcctgggactggcctttggagagcatgggcgtacaggtgaaaggggtgacagagtgcagtctggactccagggcagggccccaggagaggt

SEQ ID NO: 201989 - DNA, 601 bp, Human
cacttctggcccaaggcctcactagctcccaggctaggagagaatggaattaggggctgggatgggaggagagtcccttgtaggaatagtgaggaggtcagtcacccatccaggtccctgtgtccccagctccaacctcctccttcctcctctcttcctagatggtgagaagcggaacagcctgccccagatccccatgctgtgagtacaatggggtgcagaggacagggccctgagctcagcctgtgctgctgagaggaataagaataaactgggagtccccacctccatagtttctggytttcaggcccaggagaaccctgaaaaaagatgatctttccctcccaataaatacctgcaggaatattcctatgccttcatgccacctggtgttatcctggggggttgctgctgtcccccaactccagcccccagcagcctgggctgtgctcccaggtcattgctaatttggacagactacttctccacagggggcaggaggagagggcgggccgaggctgcccaggggaacattaccggcctctgagctcacctggcttctgctctctcacctcctacagaaacctggaggcccggcggt

SEQ ID NO: 201990 - DNA, 601 bp, Human
ggcctctgagctcacctggcttctgctctctcacctcctacagaaacctggaggcccggcggtcccacctctcagagagctgcagcataggtgagctgcccgctgcatcctccacctgctccagttgcctcccgtctgcttgctccccactgcttgctctcgtgacattgccgagggtttcctccaagtgacagaaaaatgatcctctcccataacttctcagtgatggctttaaaatatcgtgaattatggctgggtgcagtggctcatgcctgtaatcccagcactttgggaggccaargtggatggatcatgaggtcaagaaatcaagaccatcctgaccaacatggtgacaccccatttctactaaaaatacaaaaattggatgggcatggtggcatgtgcctgtagtcccagctacttgggaggctgaggcaggaaaatagcttgaacctggaaggcggaggttgcagtgagctgagatggcaccactgcactccagcctgtcaacccagcaagactccatctcaaaaaaaaaaaatcatgagtagtaatcgctagtgtgtattgagtacttagtacatggcttaagcagcttggg

SEQ ID NO: 201991 - DNA, 601 bp, Human
ctgagctcacctggcttctgctctctcacctcctacagaaacctggaggcccggcggtcccacctctcagagagctgcagcataggtgagctgcccgctgcatcctccacctgctccagttgcctcccgtctgcttgctccccactgcttgctctcgtgacattgccgagggtttcctccaagtgacagaaaaatgatcctctcccataacttctcagtgatggctttaaaatatcgtgaattatggctgggtgcagtggctcatgcctgtaatcccagcactttgggaggccaaagtggrtggatcatgaggtcaagaaatcaagaccatcctgaccaacatggtgacaccccatttctactaaaaatacaaaaattggatgggcatggtggcatgtgcctgtagtcccagctacttgggaggctgaggcaggaaaatagcttgaacctggaaggcggaggttgcagtgagctgagatggcaccactgcactccagcctgtcaacccagcaagactccatctcaaaaaaaaaaaatcatgagtagtaatcgctagtgtgtattgagtacttagtacatggcttaagcagcttgggctgcc

SEQ ID NO: 201992 - DNA, 601 bp, Human
gccctaaataatgcaaatcgggaagcagagagcagggagttcagccaaggtgccctgggctctgtggccactctaaaacctgggctgggagcccgggacatgcctggcttctcctcctacccccttgggctccactggcctccagcagggagccccacacctgattcctggcggtgcccaccaagggcatcttgtccacggctgagcctcttcctgttgttccagagtcagacatctacgcagagattcccgacgaaaccctgcgaaggcccggaggtaggttctcgaccccgccacagckaccgtagtcaaggccctgtgaaatgacatggcaaggactctggtgacaccacagggaacattcttttcctcctttatcctcccttcgtgctagacttagacagtggcaaacctgagatgccttggatttgaaagctgagatttttttttctctccctatactgattgaccttttgtgtgcccatggagctgtgcggggattctagtaacgtggacctgggacctagccttcagagggagcagggtgatggctcttccctgggtctgagacagtggaacattctagacccccatttcccca

SEQ ID NO: 201993 - DNA, 601 bp, Human
tcagagggagcagggtgatggctcttccctgggtctgagacagtggaacattctagacccccatttccccagcccagtccctggatcttggctgaggtgttatagatctggtgacgcctggctttagagcctgcagacactcaggttccctaggggataccaccgatctctgtgatctgcgactgttttctctgtctgtgcaggtccacagtatggcattgcccgtgaagatgtggtcctgaatcgtattcttggggaaggcttttttggggaggtctatgaaggtgtctacacaaatcaygtgagttctaggatcttcccttacactcctcttccacatgtctgtagggtgagacagagctcgaatctgagcaggttggagttggcacagccttcatccacttggggccccttgtccctaagggcctcttgtccactgggcatggtggtatttattaaatactcaaagagtggtggagacaagagtcatttccaagaagggtagcaaaataccaggggtggagatataggcagaacctggagaagggtcagtattcttggtgggagaatacaaagggggaggcgggataaagacagttct

SEQ ID NO: 201994 - DNA, 601 bp, Human
tagagcctgcagacactcaggttccctaggggataccaccgatctctgtgatctgcgactgttttctctgtctgtgcaggtccacagtatggcattgcccgtgaagatgtggtcctgaatcgtattcttggggaaggcttttttggggaggtctatgaaggtgtctacacaaatcacgtgagttctaggatcttcccttacactcctcttccacatgtctgtagggtgagacagagctcgaatctgagcaggttggagttggcacagccttcatccacttggggccccttgtccctaaggrcctcttgtccactgggcatggtggtatttattaaatactcaaagagtggtggagacaagagtcatttccaagaagggtagcaaaataccaggggtggagatataggcagaacctggagaagggtcagtattcttggtgggagaatacaaagggggaggcgggataaagacagttctgagaaaaggtgaggcaggatctggagttagtgtcaaggccagtgatggggcagggtaaggctgaccgctgtggtaacgcttctagcaggcccaggggaagaaagaaagaggcagtaagaatgaa

SEQ ID NO: 201995 - DNA, 601 bp, Human
ctccttttcctcgtgaagcttactttctagcatgagagtcaaactggagacatcaattgtcaggacaaaggtggtgggaggatagatttgtttcttttgtttgtttatttgaagtggccatgcttttaagtcatcatttcaactataaaaacaaacactagagagtggagcctgcctgtgagaagcaagcaggcaaactagtttggggttgggagtgatggcaagaacacagggtaaactgagtcagcggtgtgtctcctgggaggaatgagagctcagctctggagtagcctacctgtgsgacacccttttccactggtgagctgctgggcaagttccttcagctctctgggtccggtctcctcccctgcaccaggggggtctgagggtctctatgtcatgactcagggtgtgtgaagctctcgtgcgatcctggtatcctaagtgccccatcagagttagctgtgctgccgctgccactcctgctataccaaagacctaaccagtcctgtggaaatgcagatgagagagaatacctgtgttcagggaagtggttggagtttatccttgaagaatcaccaggtgacagcctccctggcat

SEQ ID NO: 201996 - DNA, 601 bp, Human
tttaagtcatcatttcaactataaaaacaaacactagagagtggagcctgcctgtgagaagcaagcaggcaaactagtttggggttgggagtgatggcaagaacacagggtaaactgagtcagcggtgtgtctcctgggaggaatgagagctcagctctggagtagcctacctgtgcgacacccttttccactggtgagctgctgggcaagttccttcagctctctgggtccggtctcctcccctgcaccaggggggtctgagggtctctatgtcatgactcagggtgtgtgaagctctcrtgcgatcctggtatcctaagtgccccatcagagttagctgtgctgccgctgccactcctgctataccaaagacctaaccagtcctgtggaaatgcagatgagagagaatacctgtgttcagggaagtggttggagtttatccttgaagaatcaccaggtgacagcctccctggcatgggggacagtgtaggcaacagcacagaagtggagtgtagcagatgccaggaatctgagccaggcttcaagctggagatggatgaaggggtgatgggagacagagcccaacagcaagagggaagg

SEQ ID NO: 201997 - DNA, 601 bp, Human
acacctcctgcaaaccatctcacttagtgctcccacagccaaccctgtagaacattattattactctcattttcctgttacgaaaactgaggctcagatgagtcaggagcctgcccgcaatcacacaggcaccaagtgttggtgcgaggcttccatttccagctttactaaggagtggctcccctccctcctaagagaagacacttgtggtcccaatagcatgccatgactgccacctcttgatcctgcagcaccctgacaggggtctagcgagcaaggccttaggtcacttactgcagargtaggtcacttgtccctcgggcagaccaccatggtaggcaggaccccagggtgctggaggaggaggagggaccgcaggagctgctcctggtggagactgagtgctaatggcgatggtgcttctgggtgggagggactggtctcccccacccagggcctgacgctcccttacaccccagccgtgtgcatgtgggagatcctgagctttgggaagcagcccttcttctggctggagaacaaggatgtcatcggggtgctggagaaaggagaccggctgcccaagcctgatctctgtccaccg

SEQ ID NO: 201998 - DNA, 601 bp, Human
tcacttagtgctcccacagccaaccctgtagaacattattattactctcattttcctgttacgaaaactgaggctcagatgagtcaggagcctgcccgcaatcacacaggcaccaagtgttggtgcgaggcttccatttccagctttactaaggagtggctcccctccctcctaagagaagacacttgtggtcccaatagcatgccatgactgccacctcttgatcctgcagcaccctgacaggggtctagcgagcaaggccttaggtcacttactgcagaggtaggtcacttgtccctcrggcagaccaccatggtaggcaggaccccagggtgctggaggaggaggagggaccgcaggagctgctcctggtggagactgagtgctaatggcgatggtgcttctgggtgggagggactggtctcccccacccagggcctgacgctcccttacaccccagccgtgtgcatgtgggagatcctgagctttgggaagcagcccttcttctggctggagaacaaggatgtcatcggggtgctggagaaaggagaccggctgcccaagcctgatctctgtccaccggtcctttataccctcatga

SEQ ID NO: 201999 - DNA, 601 bp, Human
aacattattattactctcattttcctgttacgaaaactgaggctcagatgagtcaggagcctgcccgcaatcacacaggcaccaagtgttggtgcgaggcttccatttccagctttactaaggagtggctcccctccctcctaagagaagacacttgtggtcccaatagcatgccatgactgccacctcttgatcctgcagcaccctgacaggggtctagcgagcaaggccttaggtcacttactgcagaggtaggtcacttgtccctcgggcagaccaccatggtaggcaggaccccagsgtgctggaggaggaggagggaccgcaggagctgctcctggtggagactgagtgctaatggcgatggtgcttctgggtgggagggactggtctcccccacccagggcctgacgctcccttacaccccagccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccg

SEQ ID NO: 202000 - DNA, 601 bp, Human
cacacaggcaccaagtgttggtgcgaggcttccatttccagctttactaaggagtggctcccctccctcctaagagaagacacttgtggtcccaatagcatgccatgactgccacctcttgatcctgcagcaccctgacaggggtctagcgagcaaggccttaggtcacttactgcagaggtaggtcacttgtccctcgggcagaccaccatggtaggcaggaccccagggtgctggaggaggaggagggaccgcaggagctgctcctggtggagactgagtgctaatggcgatggtgctyctgggtgggagggactggtctcccccacccagggcctgacgctcccttacaccccagccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcaggtgagcatggagtgtgggctgtgggctgggggcccacc

SEQ ID NO: 202001 - DNA, 601 bp, Human
gctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcaggtgagcatggagtgtgggctgtgggctgggggcccacccggctgcaccagggagcaagaccagcacacagagaggtttgcaccacatctccctaaagaagacgggccagggtcaaggacrggaggctgaagccaggttcactgtcagatatgagctcagagataaggcagccgtggggaagcctgactcatctgggcatctgtcaacacagagcacagagccttgttcaaaggatgtgctcagaaaatattttctaggttagactcaaaagcctgagccagactctcatcgaagtgcctgtgctctttgtgatgttgaggcatcctacctgctttcctctcgccttgtctctcgactttgatctttcctcccagatagcaaggaagggagtgatctttgacctgttttcaagactatgac

SEQ ID NO: 202002 - DNA, 601 bp, Human
cctgcatgttttctgtggggcagggccttcaacatcatctgtaaaacctctggcttaaaaggcatctctgttcctctctatcccttcagtgagcctcccagttaattctagactcctgtgttggtcccttgtatgggaggtttgagaagtcaaaaggctgcaggataaaagtatttgaaggatgtaatttgggaggttaaaagccctggggggatggagctgggagtcctgattcactctgaggccttgagagccacagggagctgtgcaggtgtctctcctgggctgagaggtgttcccwtcatctcctgggctgagaggtgttcccatcagaggcatcgaccaggcctctgccacaagtggaggtgggagcaggtttctggtgtgatctggaaaacactgaaagactcagaagaccccaggttgcttcctcagaccaccacctgactcttcctccttagagttcagaagggatttgatcagtgtttcctaaccgttccagggaggaaaggcccttctaatgtcaaattttgagtgtctctgtgtaacaatagttatattttaaaaatcttttgctgaacaaaatgtagtgggctatata

SEQ ID NO: 202003 - DNA, 601 bp, Human
tcagaggcatcgaccaggcctctgccacaagtggaggtgggagcaggtttctggtgtgatctggaaaacactgaaagactcagaagaccccaggttgcttcctcagaccaccacctgactcttcctccttagagttcagaagggatttgatcagtgtttcctaaccgttccagggaggaaaggcccttctaatgtcaaattttgagtgtctctgtgtaacaatagttatattttaaaaatcttttgctgaacaaaatgtagtgggctatataatgcatttttattatacataataaaatayatacacacttgaaaatatagtatcaagtgtcacatattcagtagtatataatacttgctacccatatgaacatgtggattcatgggcagtaataattccagagtcctctggggtctgtgattccaggttaggagcactggattgggtaagaaaggtgagaggcgcgcacatggctagcctgggagtgaacccacatgcctcattagcacataccggggatgcgttgggggatgtttcatgagaaataggagatgtagattctaggccagggccatgaagttggctgggactttggaaatc

SEQ ID NO: 202004 - DNA, 601 bp, Human
caaattttgagtgtctctgtgtaacaatagttatattttaaaaatcttttgctgaacaaaatgtagtgggctatataatgcatttttattatacataataaaatatatacacacttgaaaatatagtatcaagtgtcacatattcagtagtatataatacttgctacccatatgaacatgtggattcatgggcagtaataattccagagtcctctggggtctgtgattccaggttaggagcactggattgggtaagaaaggtgagaggcgcgcacatggctagcctgggagtgaacccacrtgcctcattagcacataccggggatgcgttgggggatgtttcatgagaaataggagatgtagattctaggccagggccatgaagttggctgggactttggaaatctacataggggtttggtgccaatcacaagcccaggagggcaaaaggcctgaggagtggggctgcagtcaggctcctgctgcatgtttgggctgggactggctcaccaaggacgcttttccaccttggatccattcctgtgatcctcccaacctcagtgtggcctcagggcccatatccaagcctgtctcagggggc

SEQ ID NO: 202005 - DNA, 601 bp, Human
ataatacttgctacccatatgaacatgtggattcatgggcagtaataattccagagtcctctggggtctgtgattccaggttaggagcactggattgggtaagaaaggtgagaggcgcgcacatggctagcctgggagtgaacccacatgcctcattagcacataccggggatgcgttgggggatgtttcatgagaaataggagatgtagattctaggccagggccatgaagttggctgggactttggaaatctacataggggtttggtgccaatcacaagcccaggagggcaaaaggccygaggagtggggctgcagtcaggctcctgctgcatgtttgggctgggactggctcaccaaggacgcttttccaccttggatccattcctgtgatcctcccaacctcagtgtggcctcagggcccatatccaagcctgtctcagggggctctccccaggacactctgcagtgaagatcgaaacggaaatgggacctagcaaccttgcccaggcctctctgggcctccacgaagtacaaagaggagccccaaggagcgtctcactttgacctagtttctctccttatctgacgtgactccctg

SEQ ID NO: 202006 - DNA, 601 bp, Human
catgggcagtaataattccagagtcctctggggtctgtgattccaggttaggagcactggattgggtaagaaaggtgagaggcgcgcacatggctagcctgggagtgaacccacatgcctcattagcacataccggggatgcgttgggggatgtttcatgagaaataggagatgtagattctaggccagggccatgaagttggctgggactttggaaatctacataggggtttggtgccaatcacaagcccaggagggcaaaaggcctgaggagtggggctgcagtcaggctcctgctgcrtgtttgggctgggactggctcaccaaggacgcttttccaccttggatccattcctgtgatcctcccaacctcagtgtggcctcagggcccatatccaagcctgtctcagggggctctccccaggacactctgcagtgaagatcgaaacggaaatgggacctagcaaccttgcccaggcctctctgggcctccacgaagtacaaagaggagccccaaggagcgtctcactttgacctagtttctctccttatctgacgtgactccctgcagtgacgtttatcagatggagaaggacattgc

SEQ ID NO: 202007 - DNA, 601 bp, Human
acaaagaggagccccaaggagcgtctcactttgacctagtttctctccttatctgacgtgactccctgcagtgacgtttatcagatggagaaggacattgccatggagcaagagaggaatgctcgctaccgaacccccaaaatcttggagcccacagccttccaggaacccccacccaaggtaagccaagccatggcctcataagtcctgtgagtcaaagcaaagccaggtccctgtctgatccatgtcccccttactgcacaggcaggatgccccctacagccctttctcagtccttcamccagcatccaccatcactgtcagcgtgtcacatcagtgccctggcaggtggacttggagatagcagccaccttgtgggatagctgggtcaagaatcattcctcaaaagtgtcccctgaggggctgggcttctcttctaggtgttttcttaggaacaaatgagatccccctgaggacacatgggtgggaagtatcctgggtcttttaggtccagtccctacatctataccccgcatggccaccctgagctcaggagccagggccctgctgccattaggtgggtgggtctgagaggccgtgc

SEQ ID NO: 202008 - DNA, 601 bp, Human
cttaatgctatcacattgggggttcaggcttcaacatgcaaattgaaaagggggacaaatattcagtccataacaatgtctgatcccatctaaggccttttctcacttgtccctcttgcctggcatgtcccacccctccccgcgggcctggctcagcgttcatctcctccatgcagcttctgtgaatgcccaagcccctggtgagctcctacctctgcatgcctgtggctctggagctctgacttggtgggtgctcccacgtatagggaagcaacacatgcaccaatcattaaccctccarttagccatagccccgggagggcagtgaggtggcttctttgtaccttccaccactcagtagataatcagtgctcaataaatggatgcaaaatgagtttcatgacagctttgtccctcaactttccttcctttggaacaagcctgaggtgtctttgacctgatgttccccttggtgagttgtgttcactcaaggagagggacagagactgacccatctgtgttctctctccagcccagccgacctaagtacagaccccctccgcaaaccaacctcctggctccaaagctgcagttccaggta

SEQ ID NO: 202009 - DNA, 601 bp, Human
agctccatgggactccccaaagaggccccatccagaacctgggtggccattgaagagacagcagggttttacctgagctttctcccagctccattatccccaaccatgactctttcccaggctgtgcgtccctgaccctgaatgtctctgttctgtgtctctcttgcctctaggagagagggagtccagtctcctcttatttcttctcttgcatcccccagctcagagccactgctcaaaaattgatcccctcaaccaccagaaataatgtccatttagttggtgccctttatagaaaggyggtgtcccatggtcctatatttgttctcaaggaaatgcctgagtgccaaaacaagaccatctaaggactaatagataaatcctcttcacgtgaagagaaagcctgattcagaagatggaaaaatcgttctgaaaaaaaagagatatacccatgtgcaatatttaaaacagggagttaggtagggtggaacacacctgtagtcccagctactaaggagggtgagatgggaggattcattgagctcaggagtttgagaccagcctgggcaatatagtgagaccccatctctaaaaacaaata

SEQ ID NO: 202010 - DNA, 601 bp, Human
gctccatgggactccccaaagaggccccatccagaacctgggtggccattgaagagacagcagggttttacctgagctttctcccagctccattatccccaaccatgactctttcccaggctgtgcgtccctgaccctgaatgtctctgttctgtgtctctcttgcctctaggagagagggagtccagtctcctcttatttcttctcttgcatcccccagctcagagccactgctcaaaaattgatcccctcaaccaccagaaataatgtccatttagttggtgccctttatagaaaggtrgtgtcccatggtcctatatttgttctcaaggaaatgcctgagtgccaaaacaagaccatctaaggactaatagataaatcctcttcacgtgaagagaaagcctgattcagaagatggaaaaatcgttctgaaaaaaaagagatatacccatgtgcaatatttaaaacagggagttaggtagggtggaacacacctgtagtcccagctactaaggagggtgagatgggaggattcattgagctcaggagtttgagaccagcctgggcaatatagtgagaccccatctctaaaaacaaatag

SEQ ID NO: 202011 - DNA, 601 bp, Human
gtggtgtcccatggtcctatatttgttctcaaggaaatgcctgagtgccaaaacaagaccatctaaggactaatagataaatcctcttcacgtgaagagaaagcctgattcagaagatggaaaaatcgttctgaaaaaaaagagatatacccatgtgcaatatttaaaacagggagttaggtagggtggaacacacctgtagtcccagctactaaggagggtgagatgggaggattcattgagctcaggagtttgagaccagcctgggcaatatagtgagaccccatctctaaaaacaaakagtaatacaataaaattgtgatatacttattttttaattaaaaaaaattcaaggcaggcatggtggcatgcatccgtagtcccagctatgtgggaggctgaggcaagaggattacttgaggccaagagtttaaggctgcagtgagctgtgatcataccactgcatcccagcctgggcaacagagcaagagcctatctgaatttttaaaaaacaattcatacatatctgtataaattggtgtgttaaccacatcagtcagtctgtaatgcaactgaaacaactattttttgaagagtcctg

SEQ ID NO: 202012 - DNA, 601 bp, Human
aggctgaggcaagaggattacttgaggccaagagtttaaggctgcagtgagctgtgatcataccactgcatcccagcctgggcaacagagcaagagcctatctgaatttttaaaaaacaattcatacatatctgtataaattggtgtgttaaccacatcagtcagtctgtaatgcaactgaaacaactattttttgaagagtcctgaaggaagagccctggtctcagtgggtccgtaaccagcatggaccccactgtgtgcagagcatcttgggggaatgttggatgaatgagaggctgcrctgctccaccatctctctcggagcaatggaaggcccacgttttgttctttattaactcctggagagcaagccccattccctgtggtgctcatgcatagtttctttgtgctcgtgtttgtagcagctaattgtctaccttctcgctttgtcccgtgccttgtgcttctttgcttttcctgaataggttcctgagggtctgtgtgccagctctcctacgctcaccagccctatggagtatccatctcccgttaactcactgcacaccccacctctccaccggcacaatgtcttcaaacgcca

SEQ ID NO: 202013 - DNA, 601 bp, Human
gacacttagttcctgtttgtcactatttgtcaacagcctggggcagccatgccattgtgtctgcaggtgttgacatttaactggggatttttatggccttaaaatgtcctcatttttgagtatcagcctctgatcaacaaaacctattttatttttatcaattccatgattataaaatactcttatatgctggaatttgttttcctaaaataaggtctagctcagtggttctcagctaagttattttccctctgagaggacatttgacaatgtctggcagcatttttgttacaactggggwggtgctataggcatatattgtggggaggccagagatgctgctaagcatcgtacaatgcacaggaaattgccctggaaataaggacttgtctggctccaaatgtcagtagtgctgaggttgaggagccttggtctgactagtatttacttaaccccacgagaataagaacatcgtatagtttaacatcactgtcctcccagcacccagccctgccacatagtagttgcttaataaataattgttgaatagattaatgaataaatatttcagcaagaaacctaactcatggggaaacgtgtg

SEQ ID NO: 202014 - DNA, 601 bp, Human
tagttgcttaataaataattgttgaatagattaatgaataaatatttcagcaagaaacctaactcatggggaaacgtgtgattagaaattgaggttagtaattgaagctcagtgtgcactaagtaaaacatcccaatataaccacttttagaccatattgtaatattcaagtgtgttttgtagggcttagtgaggaaactcttttaagaggcttggtaggaattattgcttgctaaaagtagatagagataattgttagcatcttctgcaagtgacctgtatgcaaatggccacttcaaargcaaggaactgagggacctgccagcttagatgtcacagaagaatcctgccctagcaaaggcaactcctgggctttgtgcaatcaagaggatgccaataatattcctcctccatctgtccaggaggccagggtccccatgtgcagcacaacaagagcaaaatagtttagagacactgagcagatatttatacaaatgaaccgtgggggaagactgaatgaaaataggaagacatgcaatactttctgtttaggaactagcagctaaaattatgaataggtccaaagccccagaggtaagtt

SEQ ID NO: 202015 - DNA, 601 bp, Human
ttaagaggcttggtaggaattattgcttgctaaaagtagatagagataattgttagcatcttctgcaagtgacctgtatgcaaatggccacttcaaaggcaaggaactgagggacctgccagcttagatgtcacagaagaatcctgccctagcaaaggcaactcctgggctttgtgcaatcaagaggatgccaataatattcctcctccatctgtccaggaggccagggtccccatgtgcagcacaacaagagcaaaatagtttagagacactgagcagatatttatacaaatgaaccgtsggggaagactgaatgaaaataggaagacatgcaatactttctgtttaggaactagcagctaaaattatgaataggtccaaagccccagaggtaagttaaagcaagagttagattactagatctagggagaggaagcatttatcttctctctatcaaactatatttctttgaattttgtttttcattttatctattagttcatgaatttcttctaatcattggttaaataactcaagctatgattgcatttatcttatctctatagagctgtatttcatgaaattttgttccttattttat

SEQ ID NO: 202016 - DNA, 601 bp, Human
caagagcaaaatagtttagagacactgagcagatatttatacaaatgaaccgtgggggaagactgaatgaaaataggaagacatgcaatactttctgtttaggaactagcagctaaaattatgaataggtccaaagccccagaggtaagttaaagcaagagttagattactagatctagggagaggaagcatttatcttctctctatcaaactatatttctttgaattttgtttttcattttatctattagttcatgaatttcttctaatcattggttaaataactcaagctatgattgcrtttatcttatctctatagagctgtatttcatgaaattttgttccttattttatctcttagctcatgcatttctcctaacatttagttaaataacccaagctattatcttaataaagaatgtgtcttaataggaaggcatggttggtgggtgcatgctgttgcttgttctctcaggctctgctcattcatggacacacgtgggactgcacaccgtgaggctagaggcagcacccctgtctctcgaagcttccagacctgccaccttggtccttaggtggagatagcatcagaagggtgtga

SEQ ID NO: 202017 - DNA, 601 bp, Human
gcccttcttcggggggtttcctcttggcaccttgtgcagagccaccatccttgcccaccgcccagggcagggagcagcggagtctgtctgcattccctgcagcatcggccatgatttaattcagagcatgtggggcaggccagcttcccctccgctccctccaccccattcctctccctgcctagcaccctgcccttctctctctcagtggccacatccttaggcccctcctcagatcatccccctcctgcattagtttggaggagctggaaattctctcttcctcatttcctgctctgtyggaagctcccgtgggaaaagttaagcagtgccacctgcctgtcccagttcagattcatcttctgtaggcctgagggacagaggagagaaagtgagaggggcagctgagccctcaggctctctccagaagaccctgttgcaggcagggagggaagagccagcagtaagcccggggcctggaggggtggcattgaggaggaggatgatgacagccatcacagagaactggacacaagtcaggcatgggcctgggaccatttattatcttctgaggcacagggtgattaggtaacttgtccaa

SEQ ID NO: 202018 - DNA, 601 bp, Human
gccaccatccttgcccaccgcccagggcagggagcagcggagtctgtctgcattccctgcagcatcggccatgatttaattcagagcatgtggggcaggccagcttcccctccgctccctccaccccattcctctccctgcctagcaccctgcccttctctctctcagtggccacatccttaggcccctcctcagatcatccccctcctgcattagtttggaggagctggaaattctctcttcctcatttcctgctctgttggaagctcccgtgggaaaagttaagcagtgccacctgccygtcccagttcagattcatcttctgtaggcctgagggacagaggagagaaagtgagaggggcagctgagccctcaggctctctccagaagaccctgttgcaggcagggagggaagagccagcagtaagcccggggcctggaggggtggcattgaggaggaggatgatgacagccatcacagagaactggacacaagtcaggcatgggcctgggaccatttattatcttctgaggcacagggtgattaggtaacttgtccaaattcacacagctaataattggcaaagttcagatttgaacc

SEQ ID NO: 202019 - DNA, 601 bp, Human
ctggctttctttcctctggaacagtggttctcagccttggctgtccattaaaatcacccaaggagctttgaaactctctgcataggccaggtgccgtggctcacacctgtaatcccagcactctgggaggccacagcaggaggatcgcttgagcccaggaattcaagaccagcctgggcaatatagcaagaacccatctttactaaatttttttaaaaaagattagctggacttggtggcacgcctgctactcaggagactgaggcaggaggattgcttgagcccaggaggtcaaggcatyagtgagctatgactgtgccattatactccagcctgggcaacagaatgagatcctgtctcttcaaagaaaaaaagcctgcctgcaccctatgtccaggtggtggttctaatagtctgttgtgaggctaccactagtattccgttaaggctccctggctggaaactgccccagaagtggacagaggcaatgcaccccgggacagggcacaattattctaaagaagagtcctttccaatcgggctggtggtggagttggccacagtggtgcctgcccaggaaagaatcattccgtgcccctgg

SEQ ID NO: 202020 - DNA, 601 bp, Human
cattaaaatcacccaaggagctttgaaactctctgcataggccaggtgccgtggctcacacctgtaatcccagcactctgggaggccacagcaggaggatcgcttgagcccaggaattcaagaccagcctgggcaatatagcaagaacccatctttactaaatttttttaaaaaagattagctggacttggtggcacgcctgctactcaggagactgaggcaggaggattgcttgagcccaggaggtcaaggcattagtgagctatgactgtgccattatactccagcctgggcaacagartgagatcctgtctcttcaaagaaaaaaagcctgcctgcaccctatgtccaggtggtggttctaatagtctgttgtgaggctaccactagtattccgttaaggctccctggctggaaactgccccagaagtggacagaggcaatgcaccccgggacagggcacaattattctaaagaagagtcctttccaatcgggctggtggtggagttggccacagtggtgcctgcccaggaaagaatcattccgtgcccctggctctccccaactcactggccacctgcgtcttcccctcagtccatc

SEQ ID NO: 202021 - DNA, 601 bp, Human
aagcctgcctgcaccctatgtccaggtggtggttctaatagtctgttgtgaggctaccactagtattccgttaaggctccctggctggaaactgccccagaagtggacagaggcaatgcaccccgggacagggcacaattattctaaagaagagtcctttccaatcgggctggtggtggagttggccacagtggtgcctgcccaggaaagaatcattccgtgcccctggctctccccaactcactggccacctgcgtcttcccctcagtccatccagcccacagctaacctggaccggacygatgacctggtgtacctcaatgtcatggagctggtgcgggccgtgctggagctcaagaatgagctctgtcagctgccccccgagggctacgtggtggtggtgaaggtgagagcagggctgggttggggaggtggaggcggctcaagtccgccctggaaggaaaggggactgcgcttcctgttggctggcccagcagatcctcttagagcaagctgggccaggggaattgagtcccaggccactcgcgggggacaagcaccaccccaggagagctcttcccaggggaaacctggctctctc

SEQ ID NO: 202022 - DNA, 601 bp, Human
aggggacacaccttcctttcccccctcctattattgtttatctggttgccttgccgtctgtgttaagattaacatggatgtgtcatagaaatatcacttaaggtttctttatttaatctgattttctttatttaaataagaaacaatcactgaaaatcaaaacaagagtcttggtgctccatgagatggttcctgtagtagggagagtaaaggcccccaaagatgtccacatcctaagccctggcacctgaaaacatgccaccttccatggcaaaagagactttgcaaatgtgataaagtwaaggaccttgagattgggagattgttctcagttatcagactgagcccagtgttgtcacagggatcccaggatcaggggtcctgatcttacagggatctctgtgacaacactggctgggtgtggaaactcacatctataatgccaaccatttgggaggccaaggcaggtgaattgcttgagctcaggagtttgagaccagcctggtcaacatggcaaaaccatacaaaaattagctgggcgtggtggcctgtgcctatagtcccagctgctcagaaggctgaggtgagaggatagactgag

SEQ ID NO: 202023 - DNA, 601 bp, Human
gatatagaaggagattaatgttttcactgcatccattctgcagcccatggatcaaggagtaatttctactttcaacttctattatttaagaaatacatttctaaggccatagctgccatagataatgatttctcttatggatctggccaaagttcactgaaaatattttggaaaggatttaccattctagataatattaggaacatttgtgattcatgggaagaggtcaaaatatcattaaccatttggaagaagttgattccaaccctcatggatgattttgaggggttcaagccttcastggatggctgggtgtggtggctcacgcctataatctcagcactatgggaggccaaggtcggaggatcacctgaggtcaggagttcaagaccagcctggccaacatggtgaaaccccatctctactaaaaatacaaaaattagccaggcgtaattgcaggtgcctgtaatcccagctactcgggaggctgaggcagaagaattgtttgaacccaggaggcgggcattgcagtgagttgaaattgcaccactgcactccatcctgggcaacaggaacaaaactcagtctcaaaaaaaaaaaa

SEQ ID NO: 202024 - DNA, 601 bp, Human
cactgaaaatattttggaaaggatttaccattctagataatattaggaacatttgtgattcatgggaagaggtcaaaatatcattaaccatttggaagaagttgattccaaccctcatggatgattttgaggggttcaagccttcagtggatggctgggtgtggtggctcacgcctataatctcagcactatgggaggccaaggtcggaggatcacctgaggtcaggagttcaagaccagcctggccaacatggtgaaaccccatctctactaaaaatacaaaaattagccaggcgtaatkgcaggtgcctgtaatcccagctactcgggaggctgaggcagaagaattgtttgaacccaggaggcgggcattgcagtgagttgaaattgcaccactgcactccatcctgggcaacaggaacaaaactcagtctcaaaaaaaaaaaaaaaaaaaaaaagatcagattcgcattttagaaagtatgaggtatgaggggatgtttccatgaagggacggtcaggctgggcttacacagggttggctgggttctgagatgtctgtgatgtcagtccttgcagacctgactcgaccctgcacggg

SEQ ID NO: 202025 - DNA, 601 bp, Human
atttggaagaagttgattccaaccctcatggatgattttgaggggttcaagccttcagtggatggctgggtgtggtggctcacgcctataatctcagcactatgggaggccaaggtcggaggatcacctgaggtcaggagttcaagaccagcctggccaacatggtgaaaccccatctctactaaaaatacaaaaattagccaggcgtaattgcaggtgcctgtaatcccagctactcgggaggctgaggcagaagaattgtttgaacccaggaggcgggcattgcagtgagttgaaattrcaccactgcactccatcctgggcaacaggaacaaaactcagtctcaaaaaaaaaaaaaaaaaaaaaaagatcagattcgcattttagaaagtatgaggtatgaggggatgtttccatgaagggacggtcaggctgggcttacacagggttggctgggttctgagatgtctgtgatgtcagtccttgcagacctgactcgaccctgcacggggtgttgcattcagccctctcctaggtctgatttgcttccagggaacttctgattgctttggccagcatgcaggtggacacctctgtggc

SEQ ID NO: 202026 - DNA, 601 bp, Human
caggctgggcttacacagggttggctgggttctgagatgtctgtgatgtcagtccttgcagacctgactcgaccctgcacggggtgttgcattcagccctctcctaggtctgatttgcttccagggaacttctgattgctttggccagcatgcaggtggacacctctgtggcttccctatcctccaagcacagactttgtggcctctcaacctgtcctgtgtgatcttcctacagatcgagggcacccagaaactgctcaacaaagacctggcagagctcatcaacaagatgcggctggcrcagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccct

SEQ ID NO: 202027 - DNA, 601 bp, Human
ctgggttctgagatgtctgtgatgtcagtccttgcagacctgactcgaccctgcacggggtgttgcattcagccctctcctaggtctgatttgcttccagggaacttctgattgctttggccagcatgcaggtggacacctctgtggcttccctatcctccaagcacagactttgtggcctctcaacctgtcctgtgtgatcttcctacagatcgagggcacccagaaactgctcaacaaagacctggcagagctcatcaacaagatgcggctggcacagcagaacgccgtgacctccctragtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggct

SEQ ID NO: 202028 - DNA, 601 bp, Human
ctgaattcagattccgtttttctctaattgatttcttgaagaaaattctctattggttgcttttctttcctagattatgcttttagtctatccaaatacttcaggctagaatgtaggaacttagaagatacaaatcacaaagctgtctcctctagggatgctctctctttcaaataagtgacttaaacaacttatttttgttatcttgtgttatgtaattaatataccttttcctgggctttctctggctttttttttaaatggacattattcaagtattttttagaagtaaaaaaaaaaacagtacagtaaagtttttataacgtttattttgaagttgtcagagacacctttaatattagactggacaatatctttagtctttcttttgctttcttttgaagtttttatttgctaattgaaaagaatggaataataataataataataaataaataaataataataataaataatataaataaataaataaataaataaaataaataaataataaaaacatgtttttataagtgatggagtagtactttgccaagtgatgaattttaacactcattttgatgattcttccttatcaaag

SEQ ID NO: 202029 - DNA, 601 bp, Human
acttaaacaacttatttttgttatcttgtgttatgtaattaatataccttttcctgggctttctctggctttttttttaaatggacattattcaagtattttttagaagtaaaaaaaaaaacagtacagtaaagtttttataacgtttattttgaagttgtcagagacacctttaatattagactggacaatatctttagtctttcttttgctttcttttgaagtttttatttgctaattgaaaagaatggaataataataataataataaataaataaataataataataaataatatawataaataaataaataaataaaataaataaataataaaaacatgtttttataagtgatggagtagtactttgccaagtgatgaattttaacactcattttgatgattcttccttatcaaagccttggatgaaatgatgaaaatggaaattttgagtgcctgaagctgctagaattgcttttaaagtattgggtgtgccaattaagaaggtggaatatgaaactccatgtggcaaccgcaattgcatgaaactagactgtaatgggaactaaaaccttgtgcaaaattgcgggttgttactt

SEQ ID NO: 202030 - DNA, 601 bp, Human
tatcttgtgttatgtaattaatataccttttcctgggctttctctggctttttttttaaatggacattattcaagtattttttagaagtaaaaaaaaaaacagtacagtaaagtttttataacgtttattttgaagttgtcagagacacctttaatattagactggacaatatctttagtctttcttttgctttcttttgaagtttttatttgctaattgaaaagaatggaataataataataataataaataaataaataataataataaataatataaataaataaataaataaataaaataaataaataataaaaacatgtttttataagtgatggagtagtactttgccaagtgatgaattttaacactcattttgatgattcttccttatcaaagccttggatgaaatgatgaaaatggaaattttgagtgcctgaagctgctagaattgcttttaaagtattgggtgtgccaattaagaaggtggaatatgaaactccatgtggcaaccgcaattgcatgaaactagactgtaatgggaactaaaaccttgtgcaaaattgcgggttgttactttatcaggaagcaattttaagt

SEQ ID NO: 202031 - DNA, 601 bp, Human
aatggaataataataataataataaataaataaataataataataaataatataaataaataaataaataaataaaataaataaataataaaaacatgtttttataagtgatggagtagtactttgccaagtgatgaattttaacactcattttgatgattcttccttatcaaagccttggatgaaatgatgaaaatggaaattttgagtgcctgaagctgctagaattgcttttaaagtattgggtgtgccaattaagaaggtggaatatgaaactccatgtggcaaccgcaattgcatsaaactagactgtaatgggaactaaaaccttgtgcaaaattgcgggttgttactttatcaggaagcaattttaagtctatcaattatatttaggaaacaggctgctttaaatgaatggaaaaagtattggttcttctcacagatgacagaatagtaataagagcaatcccatgcgaattaagtggggatgatttctgctttggatattattttcttcatgcattcagtgttattacttgcaactccagttactttttagcaggtgaaaatggaaagagtttgtctgaacatgctgttgagg

SEQ ID NO: 202032 - DNA, 601 bp, Human
tgggagtggtagctcacacctgtaattccagcactttgggaggccgaggcgggcagatcacttggggtcatgagttcaaaatcagcctagccaacatggtgaaaacctgtctctactaaaaatacaaaaattagccgggcgtggtggctggtgcctgtaatcccagctactcaggaggctgaggcaggagaattgcttgaacccaggagacggaggttgcagtgagtcgagatttcaccactgcactccagcctgggcgacagagaaagactccatctcaaaaaaaaaaaaaaaaaaaaaagcaatcattaagcttttcatctagccattacttttgtacaggctctcattaattccacatagatggtctaatggtctactaaatagtattctaatcctccatcttgtctatctcttagccattctccatgataaaggatgaatggtctttcggaaacataaatgaaaccatgctgctttaaaaaaacaaacaaacaaaaagaaacccattaatgttttcccaaagctttgtggacacattgaagcttcttgtttcagcttctgccaacatttctcgctccagcaaactttcttctgcttc

SEQ ID NO: 202033 - DNA, 601 bp, Human
ccactgcactccagcctgggcgacagagaaagactccatctcaaaaaaaaaaaaaaaaaaaaaagcaatcattaagcttttcatctagccattacttttgtacaggctctcattaattccacatagatggtctaatggtctactaaatagtattctaatcctccatcttgtctatctcttagccattctccatgataaaggatgaatggtctttcggaaacataaatgaaaccatgctgctttaaaaaaacaaacaaacaaaaagaaacccattaatgttttcccaaagctttgtggacayattgaagcttcttgtttcagcttctgccaacatttctcgctccagcaaactttcttctgcttcccaaatatgacaagcttcttctttaacttttctgccaggttaatcttgactcatttcaagagaggcttgggtcagccagggcctactctaagaagtttctttagcccttatgttttcctatggagagcacacactagctttaagtcctgagggtacttaagatgatatttcaatgtttttgtactcttagtgcttggcatatggtgggtggtctacaaatttagaacaatgtagtga

SEQ ID NO: 202034 - DNA, 601 bp, Human
ctaactaagcgaaacaatgcacagcgtcaacagatcaaagcagcatatctccaggaaacaggaaaggtaagttagagtggtaaatttagatatttaatttcagcatagttatacttaaccatggattcggaagcacagttacctagttctttaaggttctaaccactgttttctcattacatctatgattgggattgcagtgtttatccactttgttgcaatttaatcaattttatcaaatttcctatttttatacattagtcatcttggtgtatattgtttgcagatgtggtgctctggkgacaaatttttaatttgaacgtaaacatcgagattgctgctgtcaataaagaatatggtctgattgaaatgtactaatatttaaactgaactgtttaatgcctaaattttatatataattctactttaaaaataagccttatgtcttttataccaaatatgagtagttttctaaagcaatgaaattagaaaactatataatttcagtatctgattatactgcttgttatttgagaagtacaaacctcaaagattggaaacatgaatatattattttaaaagtaattttacttctgttttc

SEQ ID NO: 202035 - DNA, 601 bp, Human
caaatgaaattagaatgaagaaaaacaaaaaaaaaaaacaaaaaaccctcagagctaaatgaagaaagaaatatgtaggtgctttggaaaaacaacaacaagacaaaactcagaaaaagtcctggcctttgagtgcaagatttagctctgggcctcttggaagtgaaggcgatggaaaagttatgacaattaccaaagttcaccatcttataatagtatactgatttctactgttaaatgtaagagaaatttagtgcacaggtctttatataagggaagatccatttgctgtggctcttacaactgctgtaggaagtgctatagttgtcaatcacatgccgtttctaataactgtcaacatttgcaaacatttcgccaaaatatataggaataccaaaatggccaggtaagttacattcctaggagaggatgaagtattcacgttatgattaattgggtatattgctttaaaaggtgtagccaaagttgttattctaaaaaattctttgagtcagttgccttgattttgctaaagctttctaaagaaaaggatgttttgcatgtatcttagtttgaatttaatattcagtgtttcagaaat

SEQ ID NO: 202036 - DNA, 601 bp, Human
ataaggcattgatcaggattatggtttcccgttctgaaattgacatgaatgatatcaaagcattctatcagaagatgtatggtatctccctttgccaagccatcctggtatgttttgattcctctaatgccatcccaacaaatgaaagttctttttgcaagatcttcaaggagaagagttgacttattgtatctataaatttaatatgtaagattaatttaatatattatggtgtatacttcatgagtaaattgaactttcactggtaaaatctactagtgagttctctactgaaatactrggtacatttttcaactaaagtcatggaaacatttagtttcccatgcataaattcagcaagcagaatattctagtgttccccctagggtagatagacattgtggtttattttgccattaatatttgtcagaggattagaaactccttattcaaaatatttatcttaattctatcacatgtaaaatgtttaaaatttatgttcaaattgtctcataagaatgttaaaaaataagacaaagaacagtcaagggttttggacttactgaaaggtagataacgattcaaatttaattaattagtc

SEQ ID NO: 202037 - DNA, 601 bp, Human
cattgatcaggattatggtttcccgttctgaaattgacatgaatgatatcaaagcattctatcagaagatgtatggtatctccctttgccaagccatcctggtatgttttgattcctctaatgccatcccaacaaatgaaagttctttttgcaagatcttcaaggagaagagttgacttattgtatctataaatttaatatgtaagattaatttaatatattatggtgtatacttcatgagtaaattgaactttcactggtaaaatctactagtgagttctctactgaaatactaggtacrtttttcaactaaagtcatggaaacatttagtttcccatgcataaattcagcaagcagaatattctagtgttccccctagggtagatagacattgtggtttattttgccattaatatttgtcagaggattagaaactccttattcaaaatatttatcttaattctatcacatgtaaaatgtttaaaatttatgttcaaattgtctcataagaatgttaaaaaataagacaaagaacagtcaagggttttggacttactgaaaggtagataacgattcaaatttaattaattagtcatattg

SEQ ID NO: 202038 - DNA, 601 bp, Human
tctatcagaagatgtatggtatctccctttgccaagccatcctggtatgttttgattcctctaatgccatcccaacaaatgaaagttctttttgcaagatcttcaaggagaagagttgacttattgtatctataaatttaatatgtaagattaatttaatatattatggtgtatacttcatgagtaaattgaactttcactggtaaaatctactagtgagttctctactgaaatactaggtacatttttcaactaaagtcatggaaacatttagtttcccatgcataaattcagcaagcaraatattctagtgttccccctagggtagatagacattgtggtttattttgccattaatatttgtcagaggattagaaactccttattcaaaatatttatcttaattctatcacatgtaaaatgtttaaaatttatgttcaaattgtctcataagaatgttaaaaaataagacaaagaacagtcaagggttttggacttactgaaaggtagataacgattcaaatttaattaattagtcatattggataactaaaatctacccagaaaatgtgagaaaattacaggcactatacatttctct

SEQ ID NO: 202039 - DNA, 601 bp, Human
atgtaaatatatgtatgacttcaaaggcagttaggatgaaaagtatgtagaaaacttcagtttggaggcatagttctacacattcatttgcacaatatccaaaccagagaaaatcaaaattaaatatgcaaatgaacaaccaagattatgtctgattaatttaaatacattcaaaagatgacaggaattaattttgcctcttggagaatactttatataatcccagggttatttggtatccatctaaattataccattctgaagactatgggcattttccgaaaacaaatatccttatatrtaaaacctatattctatcttatctaaagtttagtaattctaattaactggggcacatatgaaaaaacagagttactccagcaaggttatatgacatcttgtaaaaagtaaagaggatcatcacatacacacatggaccaaaatatcttaaactgaggtacctcaaatttaggtcctgacttttcaatgatgtaaaattaagaacagaaaccagaaaggagtagtcaagtacatctcttatcctttttcacacaaaggttcacatcccccaacaccagcaaatctttaccccacacatcaa

SEQ ID NO: 202040 - DNA, 601 bp, Human
tttcccaatcagctccttatagcacaactgtgttattgattaacacagttttcttcaaatacgttttaaatctctaatactaaaagactaaaaacgaaaggaaagagttttccagttttgcaaaatgactctcttcaatggcaaagggtaaagacaatcaaaagagaaaagtaatctttagggttataattgaaagctatacaactttcaataatgataaaattacaaaacattttaatttcaaaaacattcttaaatatgtacaaagtatacaggcttccagaaaatgtgtaacattattcacatttgcagaatacttactctttcaggttatcaaaagcttcttctagaagtgctttttccttactaagagataataactgagcctcccttttttccagcttttcattcagaaattcaactgtctggataaggcgaatacataaaagtcagaacgcttagctttaaaaaagaccatttttacatgcaggtgtatcactgtaacaaagaaaacagctttatctcataaaaacaatcaagaacagtattaggaacacagaagatccagaacaagaagaactcttaggcagctgagaggaga

SEQ ID NO: 202041 - DNA, 601 bp, Human
attctgaatcttcttgtatcacattttcccaatcagctccttatagcacaactgtgttattgattaacacagttttcttcaaatacgttttaaatctctaatactaaaagactaaaaacgaaaggaaagagttttccagttttgcaaaatgactctcttcaatggcaaagggtaaagacaatcaaaagagaaaagtaatctttagggttataattgaaagctatacaactttcaataatgataaaattacaaaacattttaatttcaaaaacattcttaaatatgtacaaagtatacaggyttccagaaaatgtgtaacattattcacatttgcagaatacttactctttcaggttatcaaaagcttcttctagaagtgctttttccttactaagagataataactgagcctcccttttttccagcttttcattcagaaattcaactgtctggataaggcgaatacataaaagtcagaacgcttagctttaaaaaagaccatttttacatgcaggtgtatcactgtaacaaagaaaacagctttatctcataaaaacaatcaagaacagtattaggaacacagaagatccagaacaagaag

SEQ ID NO: 202042 - DNA, 601 bp, Human
ttcaattctcaaaaggaagataacttttctctgacatataccttattaaaatagaacagttttaggcctattaacttttaagaaaaaaaaaggaaatttcccttgttaaatttattttaaaacacctcaaagaaaatctgttagaaagagaaaatgtcaccaatatctgacatgtaaaaataagagaagagtaaatacaatgtttcaattctgaatcttcttgtatcacattttcccaatcagctccttatagcacaactgtgttattgattaacacagttttcttcaaatacgttttaartctctaatactaaaagactaaaaacgaaaggaaagagttttccagttttgcaaaatgactctcttcaatggcaaagggtaaagacaatcaaaagagaaaagtaatctttagggttataattgaaagctatacaactttcaataatgataaaattacaaaacattttaatttcaaaaacattcttaaatatgtacaaagtatacaggcttccagaaaatgtgtaacattattcacatttgcagaatacttactctttcaggttatcaaaagcttcttctagaagtgctttttccttactaa

SEQ ID NO: 202043 - DNA, 601 bp, Human
tgtaaagtaatgcagccactgtggaaaagtttgccagttcctcaaaaagttaaatatatagagttaccatatgacctaaggatatatatctaggagaatttaaaatatatgttcacacaaaaatttgtgcatggatatttaaagcagcattattgataataaccacaaagtataaataacccatatgcccatcaactgatgatttgataagacaaagcctcacaaattttgtttttcctacttcatctgaggtccttggactcccacagatgttatgaatgagctcaggagttaaatggaktctctcaaaattatatgcaatatgtatgtgcatttttgctcttctcttctaagagggttcctagcttttataatactctcaaatgggtctaaaactcaaaaaaattaaacaatactggtatcacgtaagcattactttaacagttttaaaaaacacaactggttaaatttagcagaatccagtactctgaaatctaacacatgtatcactacattgtttgattcaaaccagctaattgtttaatttgtagaagcataaacaaatatttttaaaactactctaattcatcatccattgctt

SEQ ID NO: 202044 - DNA, 601 bp, Human
atacttcttggatttgtgttttggaaacctgtgacagtacctgctgaagttcaccgatctcatggcgtaaataatcctcctttctggcagccgcttgttctgtacgctgcaatgcaagcctaaggtcccccacctgtaggaggagaaacaatacattcacaaacaatggtacagtattatctataacttcccactaactacatattttgtgttgtgtcaacattgttcatgtatactatttcatactctccaatgaacttttacatatgattatcacatctctcattcatcaagcaattcyaaaactgtatgtatattcaatgtttacttagaaaagcattctgttaaggcaaagaaacgcaaacaaatatgtataaggcatagccattaccatacaatattggagaaaagacagtgcgtctataaatatttgccacatcacacagaaagtgataggtgctatacggattataaaagctgggggctccactcatatgcaggagcatacattataaactaccatagcctttttggaaaacattataatatgtttaaagaatcatcaaacttctcacatcctttcaccgggccatcctagtct

SEQ ID NO: 202045 - DNA, 601 bp, Human
gaattctaccagtgatgagaatcatatatgatctctacctcctacactactgcagacaagctacaaaggggtcagatttagcaatggacaagaaaaaaaaatcgagtgcagcagtctactaaaaatacaaaaaattagccaggcatggtggcagacgcctgtaatcccagctactcaggaggctgaggcaggagaattgtgtgaacctgggaggcggagcttgcagtgagccgagatcgcgccactgcactccagcctcagtgaaagagtgagactccatctcaaaaaaaaaaaaaaaaaagaactgaatgaaagaatgacatggaagtactttagccagtatctgataccattgtgtaatgggaaaaaatggtttgaaagagacataataaaggtattaaaaatacatgtagaaaaagagaaaatgtaaaaatctacatattagacacaaaatgtaactatcagatcaaatgaatttcaatttcataccattattctaattctataaacaagatggaagagcttctgcatcgagcataaaaactaaagcagttaccaagcctatcagaaagattcttctctaatttctcccacgacgatg

SEQ ID NO: 202046 - DNA, 601 bp, Human
gtgtttccaaaagggtaacattaagagtgattattttcagctaagaaaaaaagaaaaaaagctaacaggaaggactcaatagtgttggaactgttcaatatcttgactatggtaatggatatgtggtatagttgtttagaacttaatacacacacacacacacacatacacaaatgagtaccaataaaactttggaaatctgaataaaatcagtagattgtatcaatgtcaataccatggttgtgatattatacattaattttgtaagattttaatacttggagatattaggcaatgtgtrcaaaggacctttctatattatttcttataactgcacatgaatctacattatatcaataaaaattttcaattgaaaaaaagagcaatgggtaagattctgagatttaacctaggtaagaattcttgtattttttctccaccaaagtagagctagtaatacctctatttcacattttacactctgctccacagcatagctatggtctttttaatagcattccttggtatgtttgtcctgtggctttgcctatatgctagcacaataccacatattgctgagggtatgtagacttcagtctaa

SEQ ID NO: 202047 - DNA, 601 bp, Human
aaacccaaaatgtcatacactgtataattttatttatgtaacatttttgaaatgacagaattttagaaacagaggacagattagtgattgccagagatttgggacaagggaggaagggttgagagagtggtaggtgtgtttccaaaagggtaacattaagagtgattattttcagctaagaaaaaaagaaaaaaagctaacaggaaggactcaatagtgttggaactgttcaatatcttgactatggtaatggatatgtggtatagttgtttagaacttaatacacacacacacacacacatacacaaatgagtaccaataaaactttggaaatctgaataaaatcagtagattgtatcaatgtcaataccatggttgtgatattatacattaattttgtaagattttaatacttggagatattaggcaatgtgtacaaaggacctttctatattatttcttataactgcacatgaatctacattatatcaataaaaattttcaattgaaaaaaagagcaatgggtaagattctgagatttaacctaggtaagaattcttgtattttttctccaccaaagtagagctagtaatacctctat

SEQ ID NO: 202048 - DNA, 601 bp, Human
atgagatatcactacatgctgtctgagtaactaaaagaaaaaacagggacgacacaaaatgttggcaagggtgtgaagaaaccacattactcttacacagccactttgtaaacagtttggcattttcttaaaaacactaaacatgacctggcaattgcacacttgggcatttatctagagaaatgaaaacttaggttcacactaaaacctgtacatgaatattcacagtagctttatctgtaatagccagagcttggaatcagcctggacgtcccttgtgcagtgaatggttaaatatacrtggtacatactatggaataacactcagcaataaaaagactaaactaccgatacaaaaacaactgtgtgaacctcttcctgggaattacactgagtgaaaaaagccaaacccaaaatgtcatacactgtataattttatttatgtaacatttttgaaatgacagaattttagaaacagaggacagattagtgattgccagagatttgggacaagggaggaagggttgagagagtggtaggtgtgtttccaaaagggtaacattaagagtgattattttcagctaagaaaaaaagaaaaaaa

SEQ ID NO: 202049 - DNA, 601 bp, Human
ggccaggctggtcttgaactcctaacctcaggtgatccacctgcctcagcctcccaaagtgctggataacaggcatgagccacagcacccggccataatatcctattactaataaccctaactttaaatgctaaaagtgattacatttagttcttggtaccctgaagctaaaagccaacgacatactttgtttatttacttatttaatttattttttttttttgagaccgagtctcactctgtcacccaggctggagtgcagtggtgggatcttggctcactgcaacttccgcctcccggrtgtaagcgattctcatgcctcagcctccgagctgctgggattacaggcgcacaccatcacacctggctaattttatttttaggagagagtaggtttcgccatgttggccaggctggtctccacctcctgacctcaagtgatccgcccgccttggcctcccaatgtgctgggattacaggcgtgagccacggcgcccggcccaacaacatacttttaaaaagtgctttaggatgtcacggaactaccaaaaatatcactcagaaaccatgctcacctattgttctcatcctccagtttaca

SEQ ID NO: 202050 - DNA, 601 bp, Human
tcagtgacagacaattaaattcatttttaaaaagggcaagaggttttatatttcaagtcctagaaatcatagatctctttggataaactcaaaattactttgggtccactctgagcaggacactgattataatactagaattcatcactatgttgattttagacattaaaaaaatgatacttataaagcagggatgtccaatcttttggttccctgggcctcatttgaagaacaagaattgtcttgggccacacataaaatatactaacaatagctgatgaactaaaaaaaaaaaaaaaaatcatgaaaaaaatctcatgatgatttaagaaagtttgcaaatttgtgttgggcttcattcaaaatcatcctgggccacatgccaaccagggccacaggttggacaagcttgttataaagcatagctaaaattaaaaagcaatgattaatcacagcatctactaaatggttacaccacaaacaaacaaaaacaaaattcaataccttttcttttattgtttcttgagtaaaaatggctttcttcctttcttgttcaactttcattctttccatttctaactgactattcaacaatgtctaa

SEQ ID NO: 202051 - DNA, 601 bp, Human
atgacatatatttcagttattctaaattactacaagaacccagagaaataaaaatatactttaacgtagccccacctgtgtaggttgtatcgacagaggctttcatcactaccaaagaaattaattaggtccctgtatagcataccagctatacaaacatctgggattcagattagtctgatctactttttgccaattcaagttctttaatattttcatataactaaaagtatataatgggagttgaatttttacctacttctgagtgtattgtgtttaacactgaaaagaggtatcctgrttcaaaatgcttgagaccaggaatgtttcaaatttcttttttttttttttttttttcagattatggaataattgcattatgtacttactggttgagcatcccaaatctggaaatccaaaatgctcaattgagcttttcctttgagcagcatgtcagcactcaaagttttggatttgggggcatttcagatttcagagctgggatgctcaaacctgtaaaacatttcaatatttctgactgcataaagttttttaaaagccaaaaaggtaagatggaaggatgctccatcaacaactcatg

SEQ ID NO: 202052 - DNA, 601 bp, Human
tgatccaaatcctgaaaaatgtatttgtttacaatttttaaaataactacacagaacatctttaatatttatattgccataggagtcaacaatgaaaacactacaatttaaataaaagtatatactcatctcttttaaaaattaaactcacacttcagtctatgttgaactaaatagcaaaaaaaggaattaaagaaaaaaaccaagctagatggctatcaattttaccctatctctccactaaatctacaattctccccatatatgacttctctcccattaatgtaagcacacttgatayaaaatttagtctctttgttccatggtggtataagtattacccggcatttagcccacaccacaggaaagatcaaaagaaaacatattctcacttatggcttaacagtgtcttctaacatccagatgagacaattgtgatgatacatataacaacaatcaacaaaatattactaagatcatacaaagttcaatgttataaatgaagtgtagccaaatgaaatctagttcttttcctatactgggactaaacatgattgtgaaaattactttgaatatgtaaagatacaagcaagataaaaga

SEQ ID NO: 202053 - DNA, 601 bp, Human
acactgggccaaaccaagagtttgcacgttaatttatgggagtaacacaatatttctatttcaaaatactatctttttataaatacaaaagcacataaagatgtgctatacttttccctaccctgtaataaaaaaaagtgacatataagtgaacacttgccttaagacagacactatcagtccaaaattctacgcctctattatttagtacttacataattcttaacatgcaattaattatactcaaagctaagatgttcattccaactaaatttcaaaatttaagtaagcacacctataytcctatcaaaattaatttctcacagtagcactacaaaaggggagtatgtttcagaaagcattttaaatttttacatgaggtcatgaagttagatttttctcacaaaaattttcaacttatattacatgagaaatgttaagactcaaatattcaaacaaaatcagttgtgaatattcaatctcatattttaagaaaaatttagtttcacaaaacaattttattagtattttcattgtaagagcaaattaaaaaagaagcattctattagttttgaaacataaaactattagagcagttatt

SEQ ID NO: 202054 - DNA, 601 bp, Human
aagcacaagaaaatatggtgtgttatctaaagaaagacagaattaatactttcaattctttttcttttttttttttttatttttaatgctttcagttctgcccagcattaaaggagaaagttattcacatgagacactgggccaaaccaagagtttgcacgttaatttatgggagtaacacaatatttctatttcaaaatactatctttttataaatacaaaagcacataaagatgtgctatacttttccctaccctgtaataaaaaaaagtgacatataagtgaacacttgccttaagayagacactatcagtccaaaattctacgcctctattatttagtacttacataattcttaacatgcaattaattatactcaaagctaagatgttcattccaactaaatttcaaaatttaagtaagcacacctatactcctatcaaaattaatttctcacagtagcactacaaaaggggagtatgtttcagaaagcattttaaatttttacatgaggtcatgaagttagatttttctcacaaaaattttcaacttatattacatgagaaatgttaagactcaaatattcaaacaaaatcagttg

SEQ ID NO: 202055 - DNA, 601 bp, Human
ggaggctgaggcaggagaatcacttgatcctgggaggcagaggttaccatgagccaagatcacaccattgcattccagcctgggcaacaaaagcaaaactccatctgcggcagatggaaggggaaagagtaacagctgcttttttttttcctttttgagacagggtctcactgtgtcacccaggctggagtgcagtggcatgatcagagctccctgcagcctccacctccaggtgcagtcaagcaatcctcccacctcaacctcctgagtagctgaaaccaaagacatgtatcatcatgcmcagctaatttttttttcttttctttttttctttctttttttttttagagatgggttctctctatgttgcccagggtggtctggaactcttgggctcaagtgatcctcccgccttgacctcccaaagtgctgggattacaggcgtgagccaccttacctggccaacatctccttttgaataaagtgagcgaaactcacaaaacatgagataacacgaaaacatataaaactcttagaaaattccttatcagcagaaatacaatcatttaacagaagtaacaatcttaaattatcaggcaaa

SEQ ID NO: 202056 - DNA, 601 bp, Human
ggagctcacatcctaagccgccagctccaatgactagaactttacatgtatctaacaagaactggagagactgtaaagaatggaaaggcatattaaaagctgggtgataaccgcaaagactataaataaagcaacaaactttaaaatagtttctgatgtttccaggaaaaaatgccactaggataaagaggagactttgtatttgctcaattatttgaaatttgtgaattctattgaaccaggaattctaaaactctaatgatttcaggaagtttcaatgttaatttttctttttttttttcttttttttgagacggagtctcgctcttgtcacacaggctggagtgactgatgggatctcggctcactgcaacctccgcctcccagattcaggtgattctcctgcctcagcttctcgagtagctgggattataggtgtgcactaccacacctggctaattttttatttttagtagatacagggtttcaccatgtgggccagactggccttgaactcctgacctcaagtgatccgcccgcctcagcctcccaaagtttcttggattacaggcatgaggtgccgcgtccggccattaatgtt

SEQ ID NO: 202057 - DNA, 601 bp, Human
tttttcattcaactaaaatgtgagtcccaccaatgcaaacacctttctgtatttgttcaatgctgtatcttcagcatctaaaatggtgcttggcatatgggatggaggctcaataaatatttgctcaatcagtaatattagtatctttttttttttttttttgagacggagtctcgctctgttgcccaggctggagtgcagtggtgtgatctcggctcactgcaagctctgcctcccgggttcacgccactctctcgcctcagcctcccgagtagctgggactacaggcacctgccaccaygcccggctaattttttgttttctgtattttttagtagagacggggtttcactgtgttagtcaggatagtctcgatctcctgaccttgtgatccgcctgcctcggcctcccaaagtgctgggattacaggtgtgagccaccatgcccagtctagtatcatattcttttttgttagaatgagcctttagggggcttacaatgaattaaataagcaaaacaaggagtaaaattgaaaacccttagttttcttcttttgtgtaaaagattactataatgcaataaagaagaggtcactccttaa

SEQ ID NO: 202058 - DNA, 601 bp, Human
attcctttctctcacagcacaccaccaatccatcagctaatcctgttgattccatcttcaaaatatatccataatctgaccacctgtcaccacatccaatgctaccatcctgtttcaagtcacgttgtctcttgtctagaggactataataatctaattagtctctctgtttcttccccctctctgctcttcccttagtctattctcaatgcatcagcctcagtaacctaggtgaaaagccaatcaagtctctcattgcataaatctctccaatgacttcatgactcagagtaaaagcgasagcacttacagtaacctccaaagtcttttgtgatatccactccaagcccctccatctcccattatctgtctgatatggtctccaaaaatgctcccccaacccacttctgctctagcgatgatagcctccttgcagtccttgaacaaacaggagtgctccacttcacagctttgtacctgttattctctctaactagaatattcttcctacagataactgtatggctcatttgctcacctttgtactcaatagcacctttttgtaaaccttttcccttcacaccatttgacatactatata

SEQ ID NO: 202059 - DNA, 601 bp, Human
ctttctgaggtattaggctgggtgggtcacttcctccaccctaaaacatgttcttcagttggtcaccacactcatgagaatttaaacactttttaaaaattggtttccagttcattcagttttcttcctactttactggccagaattcggagtagccttgtgctttgttctggtgatctcagaccatcttgtaagatatagaccatctagcagacatctcagacttaacagtttccaaaaccaaacttgatcacccttgctcacaacaaccaaatctgttcttttccagatcttcctcatygcagtaacttcctcattgcagtaactccatctttccaggtgcccgcccctagagcaaaaaccttgttgtatcatcctcgattcctttctctcacagcacaccaccaatccatcagctaatcctgttgattccatcttcaaaatatatccataatctgaccacctgtcaccacatccaatgctaccatcctgtttcaagtcacgttgtctcttgtctagaggactataataatctaattagtctctctgtttcttccccctctctgctcttcccttagtctattctcaatgcatcagcctc

SEQ ID NO: 202060 - DNA, 601 bp, Human
ccataataatgccatgcattctgaacagtacaaccacattcaaatttagcagcagatgcaaaaaactgaaaaaaataagtctcaataactaacttttctggtcttggtcagtttacttcgatgatcaaataacttgacaataatttcctcatttttctgtccccctatataccaagagatcttcaagacttatccatatttgtgctttcaaagtcctgactgttctcaaactccacagaaactgtacttgtcaagttcaccaataacctccgtgttgctaactccaatgaccaattctcartctatctgaccttacctttctgaggtattaggctgggtgggtcacttcctccaccctaaaacatgttcttcagttggtcaccacactcatgagaatttaaacactttttaaaaattggtttccagttcattcagttttcttcctactttactggccagaattcggagtagccttgtgctttgttctggtgatctcagaccatcttgtaagatatagaccatctagcagacatctcagacttaacagtttccaaaaccaaacttgatcacccttgctcacaacaaccaaatctgttctttt

SEQ ID NO: 202061 - DNA, 601 bp, Human
atggtctacttcagtttttgttttttgggttgttttgtttttgtttttgagacagggtctcgctctgttgcccaggctggagtacagtggcatgaacacagttcactgcagcctccagatcctgagctcaaacgatcctcctacctcagcttcccatgcagcagggaccacaggtgcacacccggctaattttttaatttttttgtagagacgaaatctccctttgttgcccaggctggtctggatctcctgggctcaagcaatcttctcacctcagcctcccagtgttgggattacaggygtaagccaccatgcctggcctctacttctcttcttaaactcatctttaacaaatcactccttgatgttctctatattccatatatgcctaaggtaaccatccctctttgttccattccaattggttctggtttttctctcctcgactttccattttctttccccttgtaggaaaagctcaaactctttcccaactttattgctccagtcaccattcaaaccttggctcacaaatccctgccaatctctcactagggcctaatactccagcgagtattctcttctgacatcaactggagga

SEQ ID NO: 202062 - DNA, 601 bp, Human
tatatacccagaacaatttgagcactgtcagtaacagatgcaaacttcctaaatagagagagaaaaaaaaagtccttatctctgtgtatctttgactaacaaatatacacttttacctaaactactcaaacccctcaatattacatactaaattcatgaatgaacatttcttcatgtctggatacatggtctacttcagtttttgttttttgggttgttttgtttttgtttttgagacagggtctcgctctgttgcccaggctggagtacagtggcatgaacacagttcactgcagcctcsagatcctgagctcaaacgatcctcctacctcagcttcccatgcagcagggaccacaggtgcacacccggctaattttttaatttttttgtagagacgaaatctccctttgttgcccaggctggtctggatctcctgggctcaagcaatcttctcacctcagcctcccagtgttgggattacaggtgtaagccaccatgcctggcctctacttctcttcttaaactcatctttaacaaatcactccttgatgttctctatattccatatatgcctaaggtaaccatccctctttgttccat

SEQ ID NO: 202063 - DNA, 601 bp, Human
tgggatgcaagaaccttcatttaaccccttcttcctgtgtgtgctgattaagcagcaaattttgtgtcccctaagaagctgcatgaaaaagaaaaaaaaagaaaaaaaaaatttcactggaccgtatataaaatggaaaaaaaaaaaaaaaagaggctgtaaccacgtttttttcttttttctttttgagacggagtctcactcactctgtcacccaggctggagtgcagtggtgcgatctcggctcactgcaacctccgcctcccaggttcaagcaattctcatgcctcagtctctaggkaggtgagattacaggtgcctgccaccacaaccagctagtttttgtatttttagttttgccatgttggtcaggctggtctcgaactcctgacctcaggtgatctgcccgcctcagcctcccaaaatgctgggattacaggcatgagccaccatgcccggcaccaagtttttaaagaaagaataataccaaaagtgtcagctaaaattgcaaatgttactattacatcacagaagctgaatatataaggcctcaaaaggtcactcttaaaacaataaccacacatatagataggaaaggata

SEQ ID NO: 202064 - DNA, 601 bp, Human
tctcactacattgcccaggctggaatgcagtggctattcacagtatgaccacagcctactatagcttcaaactcctagtctcaagcaatcctcccaccttagcctcccaagcagccaggactctgtagtggtatgataaaagctcactgcttcctcagtgatctgcaccaccataccccaccttttacaggtcttgcttttgacgtggcctaagcactctccaccaaaccctaaagttctatcgttttatggttttttgtgttttttttttgtttttttgagatggagccttgctctgtcrcccaggctggggtgcagtagcgcaatttcagctcactgcaacctcagcctcctagggtcaagcgattctcccacctcagcctcctgagtagctgggagccactgtgcccggctaatttttgtattcttagtagagacggggtttcaccatgttggccaggctggtctcgaactcctgacctcaagtgatccacccacctcggcctcccaaagtgctgggattacaggcatgagccaccacgcctggctcattttatattttatatttacacctataatccattttgagttaattttgtat

SEQ ID NO: 202065 - DNA, 601 bp, Human
aaaaattattttaattttttagagatgatgtctcactacattgcccaggctggaatgcagtggctattcacagtatgaccacagcctactatagcttcaaactcctagtctcaagcaatcctcccaccttagcctcccaagcagccaggactctgtagtggtatgataaaagctcactgcttcctcagtgatctgcaccaccataccccaccttttacaggtcttgcttttgacgtggcctaagcactctccaccaaaccctaaagttctatcgttttatggttttttgtgttttttttttgtttttttgagatggagccttgctctgtcgcccaggctggggtgcagtagcgcaatttcagctcactgcaacctcagcctcctagggtcaagcgattctcccacctcagcctcctgagtagctgggagccactgtgcccggctaatttttgtattcttagtagagacggggtttcaccatgttggccaggctggtctcgaactcctgacctcaagtgatccacccacctcggcctcccaaagtgctgggattacaggcatgagccaccacgcctggctcattttatattttatatttaca

SEQ ID NO: 202066 - DNA, 601 bp, Human
atgagtcctccatcagatgctttacaagtattttctccagtctgtggcttttcttcatccgtttaagagggtctttcacacagcaagtttttaattttgatgaagttcagtgtatcaattttttccttttatggctcatgcttttacaaaaaattattttaattttttagagatgatgtctcactacattgcccaggctggaatgcagtggctattcacagtatgaccacagcctactatagcttcaaactcctagtctcaagcaatcctcccaccttagcctcccaagcagccaggactstgtagtggtatgataaaagctcactgcttcctcagtgatctgcaccaccataccccaccttttacaggtcttgcttttgacgtggcctaagcactctccaccaaaccctaaagttctatcgttttatggttttttgtgttttttttttgtttttttgagatggagccttgctctgtcgcccaggctggggtgcagtagcgcaatttcagctcactgcaacctcagcctcctagggtcaagcgattctcccacctcagcctcctgagtagctgggagccactgtgcccggctaatttttgt

SEQ ID NO: 202067 - DNA, 601 bp, Human
gacaatacatagaaaaaagggacaatacatgcttcctctagatttttaattcttgcctacaaataaagctatgaacaataatttcaattctagccctcagtcattcagacctctattccctttgaatgctaggcaagcaggagaacgaagctacagctagaaagaggtcaaaaaagaaacaaagcaaacagtggaggaatggcaatcagggaaccaagagccagactaagaaatctaatctggatttctagaaaatacccaaagtttcccagacccacataatggggatagacaaactgartgccccccactaaccaacccacccccaccaactcttcctttttccctacaggggcctgtatttgcatttttaagctctttattttgaaataatatagattcgcagtaagttgcacagatagtataggtaggtaccatgcacctttcccagttacatcttactatagtacagtaccaaaaccatgaacagaacattggtacaatgtgtgtttataattctgtcatttaaacacacatagatttgtgtaaccaccaccccaggcaacacacataactattcgaccacaataaagatctctct

SEQ ID NO: 202068 - DNA, 601 bp, Human
catacagaaaatttcaacagctttttcagttggtaaagattttactgtttttattttttgtggggaggagaaaaagtacgaattttttctacctttctcatttaactcagttttcaagttaccctaccaaatcctattaccagtcttcccatccctggaggctaaaaaggaaactccattcaaaactgattgtgggtgagtcaatatagcacttaatgttttaatagcacatgtgtgcaaaaacttgttttaatttttctaatgaatggagcaattgtttaataatttataaattatgcarcttctctaaagttaagataaatagtccactataaattttttaaaagcaatacagagaaaaaagggacaatacatagaaaaaagggacaatacatgcttcctctagatttttaattcttgcctacaaataaagctatgaacaataatttcaattctagccctcagtcattcagacctctattccctttgaatgctaggcaagcaggagaacgaagctacagctagaaagaggtcaaaaaagaaacaaagcaaacagtggaggaatggcaatcagggaaccaagagccagactaagaaatct

SEQ ID NO: 202069 - DNA, 601 bp, Human
taaaactgccctaaaaaataaagtttactaattaaaaaaaaaaagcacttgcagaaaacaatttgcacgttctaagaaaccaacaaaaaaaccacaagcactttttactgtaatcccacatacgttctcagagctccaattccttgagtgaactctcattcaggtaagcatagaaacttgtagctggtcatgtcagctaaaactagcattctcttttcagtctatcagcaacattactgaaaagccaacagtgagagaggaaagcaagtgaagaaatagccttgaaatagctagcaatatytgaatagctaccaactaaaaaattctaagaatctagtgagcattaatttcaagtaaaaaacttacgtcgatagaaagtgtcgttaaaatcttgaatcttgttgaaatgtctgaatacaagtaaaggaacttaagcagctaagttttaatttctaaaatgaatttgacaatgccataaggaacacactctgcatatatttacaacaagaaataagtaatcaatgttcacatcagtggaattcaaggaatctgactaaatgaacacaactctcctttctgacaaaacttttctgccattcct

SEQ ID NO: 202070 - DNA, 601 bp, Human
agtggatatgtaaaccaaaaagccccatccttggaaagatcattcttatccctggtatctttatttccctgaaataaatacaggtgaaaaccacatagattacagcttgacatcaatatacaactttgtaattctacttgatacctactccccaaataaaaaatacaaataaattatgaaagcagaatagtatcaaaacaatgtactcggttcatatctttcctcaaatagagcagaatttcatattttatctttcttcttagtgtaatttttaaaatacggccacttctaattaacaatyctaaatattaactagacttaataattaatccctaattccatgccaagatactataaaagaaatgcaggtgcttttttgattacctgtggtggataaagttccagcgtgcattcgatacaagcagtcattccaggcagaatcacccgggcatttcctttaaaaccttctgtccccccatctatcaaagggacaatggagcttggatctaagacaccatcttcataatttagaagagatatctaggaaaacaatttgaagggctttaaaggagaaggggataagaattcaaaagaagaagta

SEQ ID NO: 202071 - DNA, 601 bp, Human
tattttatgtaattctagattattaaattaggtttattacctccaaaaggctgctccttaggccactgcaacatccttacatactcaatacagtgttctggtagcctgggcatagatgcaatggtgcacatgggaaaattaacctaaaaccacagtttgtccttttcagtgaattttaaacgaattattttaaaatgcaacttccagttatgatctagttcttaacaatttcatacaatttgtttcaactcaaaatattgtataccattaaaaatgcctctcaaactataatacagattawctgagtcacttcacttaggctgacctgcctgtaaagacaggtttgccctacatttacaaggtataaaatttaagctttgttagactatgagaagaaaaatactgaacagattttctcaaatatgaacaccttgttatttttacctaatatttaagtataaagcaaaccaaaacaaaagcaagttcagagttaagtgaatcccaagtgaatactcataaaattgtttacatttattattcaaaatttcaagtgttctttaaagtggatatgtaaaccaaaaagccccatccttggaaagat

SEQ ID NO: 202072 - DNA, 601 bp, Human
tactccttgttgaggccctcattcaccagcctagaaagtacacaccaagccctggtaaaaggtaaagaaggatggatgagactacatattaaaatggggagtttacagtttctggttagaacacactgaattcgtttgttaattctaacaattagcaaatatgtgtaacacatgctccagacactgttctaggtgttgtgcatagtaacaatgaaaaaaagtatctgctcgtatagtgatttcattttgataggggagataacacaaaagtaaatacttggaacacctcagatattgaagwgttctatgaagaaaatgaggtatgtgttagactgagaatgatggatgcagtccattagagagaatggtcagggaaggcctccttggagaggtgataacttgagctgaaacctaagccatgagagagatccagccatgcaattacctgaagaaaaagctgtttgtaaacagcaatggcaatggtcctggtcctggggcaaggatgtaagatagtttaagtgtgaaatattctttgcataggagaatgaggctaccattaatcagttctgagcaattaccaaaaaaaatagaatggtgaatg

SEQ ID NO: 202073 - DNA, 601 bp, Human
gaaattaggcatgttaaaagtcagttataaatcagaacagataaatttacattggctcttcattaaaaaatacatattccaatttttaaaaactgagacagtaacaaattttacattgttttgtgtgattcatgtaatagagtaacactacatgtttttcttgtttatcagattaataaatggcctgcttcatatggaactaaaacatctctttactgcaggtaacttaagacataatgtaagacaaaaaatatgcaaagtctaataactggttctttttcgacagcttagttacacaacscatccaagaagatatcaaattcctacaacacaaaaaagctgcagcaacgtcaaaaactaaagaaagcaaaataaactaagtgatggccttttcttcctcacctgcaatgactgcatttgtggaagctactgcaggaatgattctttttactacccctgaaaaaacatatcaattaaaatatggtcatttctttaaaataaaagagttctcttaaattagaaggcatgattattaaataccattttctaaaacttgatttttcagactttcaagccagaaaataaatttaaccatgaaaca

SEQ ID NO: 202074 - DNA, 601 bp, Human
ggaaattaggcatgttaaaagtcagttataaatcagaacagataaatttacattggctcttcattaaaaaatacatattccaatttttaaaaactgagacagtaacaaattttacattgttttgtgtgattcatgtaatagagtaacactacatgtttttcttgtttatcagattaataaatggcctgcttcatatggaactaaaacatctctttactgcaggtaacttaagacataatgtaagacaaaaaatatgcaaagtctaataactggttctttttcgacagcttagttacacaayccatccaagaagatatcaaattcctacaacacaaaaaagctgcagcaacgtcaaaaactaaagaaagcaaaataaactaagtgatggccttttcttcctcacctgcaatgactgcatttgtggaagctactgcaggaatgattctttttactacccctgaaaaaacatatcaattaaaatatggtcatttctttaaaataaaagagttctcttaaattagaaggcatgattattaaataccattttctaaaacttgatttttcagactttcaagccagaaaataaatttaaccatgaaac

SEQ ID NO: 202075 - DNA, 601 bp, Human
taaaaatgaaacctattaccttgtggctattttaaaaacctcagtggcacacacagctgaagggaggagaaaatacaggtgctttaactcaatggaaattaggcatgttaaaagtcagttataaatcagaacagataaatttacattggctcttcattaaaaaatacatattccaatttttaaaaactgagacagtaacaaattttacattgttttgtgtgattcatgtaatagagtaacactacatgtttttcttgtttatcagattaataaatggcctgcttcatatggaactaaaacrtctctttactgcaggtaacttaagacataatgtaagacaaaaaatatgcaaagtctaataactggttctttttcgacagcttagttacacaacccatccaagaagatatcaaattcctacaacacaaaaaagctgcagcaacgtcaaaaactaaagaaagcaaaataaactaagtgatggccttttcttcctcacctgcaatgactgcatttgtggaagctactgcaggaatgattctttttactacccctgaaaaaacatatcaattaaaatatggtcatttctttaaaataaaagagt

SEQ ID NO: 202076 - DNA, 601 bp, Human
caaaacataaatttacatgcatattaaaaatgaaacctattaccttgtggctattttaaaaacctcagtggcacacacagctgaagggaggagaaaatacaggtgctttaactcaatggaaattaggcatgttaaaagtcagttataaatcagaacagataaatttacattggctcttcattaaaaaatacatattccaatttttaaaaactgagacagtaacaaattttacattgttttgtgtgattcatgtaatagagtaacactacatgtttttcttgtttatcagattaataaatgrcctgcttcatatggaactaaaacatctctttactgcaggtaacttaagacataatgtaagacaaaaaatatgcaaagtctaataactggttctttttcgacagcttagttacacaacccatccaagaagatatcaaattcctacaacacaaaaaagctgcagcaacgtcaaaaactaaagaaagcaaaataaactaagtgatggccttttcttcctcacctgcaatgactgcatttgtggaagctactgcaggaatgattctttttactacccctgaaaaaacatatcaattaaaatatg

SEQ ID NO: 202077 - DNA, 601 bp, Human
tgctcagagtgcgggacgaggagaatcgcggcccggggagaggtgacccaggggcccctcccttctctccagtgtagacccttgtctgagaccgagctatgtggggcgacctctggctcctcccgcctgcctctgccaatccgggcactgggacagaggtcggtgttgaacgcgcgggccccagggggagggaggggaccaacgggctccggcgctgacaccgcggcactcatgccctgtcccctttcagctgtttccagcatactgtgccccgtctgtcctcaggccagggcttcgctgmagccccggccactccctagtgcctggcccggtggtggccaggcagttggccgcgctgcttctcccgcagaggggacccccactgggggcgaaggcttggcctgccctcttcactgctgtatttccagacctgatgcctgcgtttgtgagagctctggatatatggttttcgattgaatgagtgaactggaggggcttccccttcttgtgttgctgaatctttctagctgccctgttggggcagggaggggcagacacacttcaggggctgcattgcccgaagggtgccacctttcccacc

SEQ ID NO: 202078 - DNA, 601 bp, Human
gcccggtggtggccaggcagttggccgcgctgcttctcccgcagaggggacccccactgggggcgaaggcttggcctgccctcttcactgctgtatttccagacctgatgcctgcgtttgtgagagctctggatatatggttttcgattgaatgagtgaactggaggggcttccccttcttgtgttgctgaatctttctagctgccctgttggggcagggaggggcagacacacttcaggggctgcattgcccgaagggtgccacctttcccacctctccatccccgtaactgggctgtcwtcaggccacagtaggattcttaccctctcccacccagaggaggccctcaatcctctcctctcccttccatttaggctgagtttgagaaagctgcagaggaggttaggcaccttaagaccaagccatcggatgaggagatgctgttcatctatggccactacaaacaagcaactgtgggcgacataaatacaggtatgcagagcgggggttggaagggcatctgctcatcaaagcaggctcagcagcccagactggaagtccctgggaacttcactctcaaactccctgaggccctactct

SEQ ID NO: 202079 - DNA, 601 bp, Human
ggggcagacacacttcaggggctgcattgcccgaagggtgccacctttcccacctctccatccccgtaactgggctgtcatcaggccacagtaggattcttaccctctcccacccagaggaggccctcaatcctctcctctcccttccatttaggctgagtttgagaaagctgcagaggaggttaggcaccttaagaccaagccatcggatgaggagatgctgttcatctatggccactacaaacaagcaactgtgggcgacataaatacaggtatgcagagcgggggttggaagggcatmtgctcatcaaagcaggctcagcagcccagactggaagtccctgggaacttcactctcaaactccctgaggccctactcttcaggtggggtatggtgatggttcctgaggtggaaaagaccatgttccggattctcagtgtctccagtagtaacagaattcaaatcctggttttagaaggtctttactggttatcaccagcagctactctctactagggaagaagcaaaggctgcagcttggaaaagacttgctgaaggctctcagctcagtagtatcattgttgagccgttcagcttctg

SEQ ID NO: 202080 - DNA, 601 bp, Human
ttgcccgaagggtgccacctttcccacctctccatccccgtaactgggctgtcatcaggccacagtaggattcttaccctctcccacccagaggaggccctcaatcctctcctctcccttccatttaggctgagtttgagaaagctgcagaggaggttaggcaccttaagaccaagccatcggatgaggagatgctgttcatctatggccactacaaacaagcaactgtgggcgacataaatacaggtatgcagagcgggggttggaagggcatctgctcatcaaagcaggctcagcagcycagactggaagtccctgggaacttcactctcaaactccctgaggccctactcttcaggtggggtatggtgatggttcctgaggtggaaaagaccatgttccggattctcagtgtctccagtagtaacagaattcaaatcctggttttagaaggtctttactggttatcaccagcagctactctctactagggaagaagcaaaggctgcagcttggaaaagacttgctgaaggctctcagctcagtagtatcattgttgagccgttcagcttctgccctagatgggcaggatcaaagttgg

SEQ ID NO: 202081 - DNA, 601 bp, Human
ccgtaactgggctgtcatcaggccacagtaggattcttaccctctcccacccagaggaggccctcaatcctctcctctcccttccatttaggctgagtttgagaaagctgcagaggaggttaggcaccttaagaccaagccatcggatgaggagatgctgttcatctatggccactacaaacaagcaactgtgggcgacataaatacaggtatgcagagcgggggttggaagggcatctgctcatcaaagcaggctcagcagcccagactggaagtccctgggaacttcactctcaaactscctgaggccctactcttcaggtggggtatggtgatggttcctgaggtggaaaagaccatgttccggattctcagtgtctccagtagtaacagaattcaaatcctggttttagaaggtctttactggttatcaccagcagctactctctactagggaagaagcaaaggctgcagcttggaaaagacttgctgaaggctctcagctcagtagtatcattgttgagccgttcagcttctgccctagatgggcaggatcaaagttggagcactttttggagcacttgacagcctggccaagcct

SEQ ID NO: 202082 - DNA, 601 bp, Human
gtccctaagtccctgaaacatgggtggatactgaggcaacagcgcagtgcattctgtgcaaggactcagggttatcatggcagcacagaagggaggtctcccctgcccctgctgaggaagaaggcgagcatggtccctatttccgcagtagctggggtggaagatggagcaggtgggctggctgccaaccagctggaagcaggaaatagtacccagaatgacagatcacaggcagtaccatatcaaaccctggggttcacatggagcacttagttgaagaaggtcttatggcgaaggtgarttttacagtgagttcgtaaactctgtccttccagggaggggaaggaaaggtgaagtgggggaggccagaggtgccaagatgcttttctgacaaacagtattttcacagagactggcctgtgcccgtactagagttaccgattttcacatgagtctagatagactggcataggaatctatcacttactgatcaaagaggtgtcatcggctctctctagggctgtactatacagccctattacacgattataaaacatgatagtccaaacacgatagtttagtataatagccagtagccaca

SEQ ID NO: 202083 - DNA, 601 bp, Human
ccgtactagagttaccgattttcacatgagtctagatagactggcataggaatctatcacttactgatcaaagaggtgtcatcggctctctctagggctgtactatacagccctattacacgattataaaacatgatagtccaaacacgatagtttagtataatagccagtagccacatatgactatataaattttaactgaggctgggcgctatggctcatgcctgtaatcccagcactttgggaggccgaagcaagcgaatcatgaggtcaggagtttgagaccaacctggctaacgtrgtgaaaccccatctctactaaaaatacaaaaattagctgggcatggtggcatatgcctgtagtcccagctacttgggaggctgaggcaggagaatcgcttgaacctgggaggtagaggttgtggtgagccgaggtcgcaccactgcactccagcctgggcaacagaacgagactctgtctctaaaaaaaaaaattttaactgaaaatagttaaataaaatcaagtttagtcttcattcacaggaaccacatttcagatgcccagtagtcatttcaggtacttggtgtggcaagtggctcc

SEQ ID NO: 202084 - DNA, 601 bp, Human
gctgtactatacagccctattacacgattataaaacatgatagtccaaacacgatagtttagtataatagccagtagccacatatgactatataaattttaactgaggctgggcgctatggctcatgcctgtaatcccagcactttgggaggccgaagcaagcgaatcatgaggtcaggagtttgagaccaacctggctaacgtagtgaaaccccatctctactaaaaatacaaaaattagctgggcatggtggcatatgcctgtagtcccagctacttgggaggctgaggcaggagaatygcttgaacctgggaggtagaggttgtggtgagccgaggtcgcaccactgcactccagcctgggcaacagaacgagactctgtctctaaaaaaaaaaattttaactgaaaatagttaaataaaatcaagtttagtcttcattcacaggaaccacatttcagatgcccagtagtcatttcaggtacttggtgtggcaagtggctcctgaattggacattgcaaatatacatgtacatttccatttccaccgcttggagagagctgtcgaggagtgctattctaggatcctgatgatgaccac

SEQ ID NO: 202085 - DNA, 601 bp, Human
aaatacaaaaattagctgggcatggtggcatatgcctgtagtcccagctacttgggaggctgaggcaggagaatcgcttgaacctgggaggtagaggttgtggtgagccgaggtcgcaccactgcactccagcctgggcaacagaacgagactctgtctctaaaaaaaaaaattttaactgaaaatagttaaataaaatcaagtttagtcttcattcacaggaaccacatttcagatgcccagtagtcatttcaggtacttggtgtggcaagtggctcctgaattggacattgcaaatatrcatgtacatttccatttccaccgcttggagagagctgtcgaggagtgctattctaggatcctgatgatgaccacaagggcagtttgtttcagctgtccctgggaacacttccctgaaagcgctcagggacattttctcaggcacagtgctccaggctacggactctgattgttccctgtggctttggggctgggcatcgtagtgaaataggacaacagggagatggtgagtgtgtttcccaactgcagatgacaacaggtctataagcataaagtcatcatataacttaaagaaacctta

SEQ ID NO: 202086 - DNA, 601 bp, Human
gtcccagctacttgggaggctgaggcaggagaatcgcttgaacctgggaggtagaggttgtggtgagccgaggtcgcaccactgcactccagcctgggcaacagaacgagactctgtctctaaaaaaaaaaattttaactgaaaatagttaaataaaatcaagtttagtcttcattcacaggaaccacatttcagatgcccagtagtcatttcaggtacttggtgtggcaagtggctcctgaattggacattgcaaatatacatgtacatttccatttccaccgcttggagagagctgtcraggagtgctattctaggatcctgatgatgaccacaagggcagtttgtttcagctgtccctgggaacacttccctgaaagcgctcagggacattttctcaggcacagtgctccaggctacggactctgattgttccctgtggctttggggctgggcatcgtagtgaaataggacaacagggagatggtgagtgtgtttcccaactgcagatgacaacaggtctataagcataaagtcatcatataacttaaagaaaccttaccctcggtgaaatctcccacagatcagcaagaaatagact

SEQ ID NO: 202087 - DNA, 601 bp, Human
tagacctatttaaccccatgacagagcctagaaggaacaggtgtaatagaagatggcatttatggcaagaaggttgatcaagttctccattagaatttgaaccagatctaatgccttttcttcccttgtttaagaacggcccgggatgttggacttcacgggcaaggccaagtgggatgcctggaatgagctgaaaggtaattgttctaatcaatttctctcatttgtgaaacccagtagtgaaagagtcttcattatgaagtgtaagggaagaggagagaaaacaaagtcaatggggcaygtgtgggaaaccagcctgacctgtgccagaatgggaaaaaaccgggccacctactttttctcctaacaccatttatgccttttctaaaagcaccatctctgagcaggagcatcatctagagaggaggggctgggaaccaggccactgaaaaatagtttgggaaatgatgtagttggcgtaggctttggatgtgttcagaataaggggtggtttcctgtctgcaactccctctcccctacaaggccaggcggtgaccccctaaccccagtggccctccccagttccttcctagccagaagg

SEQ ID NO: 202088 - DNA, 601 bp, Human; identical to SEQ ID NO: 120971

SEQ ID NO: 202089 - DNA, 601 bp, Human; identical to SEQ ID NO: 120972

SEQ ID NO: 202090 - DNA, 601 bp, Human; identical to SEQ ID NO: 120973

SEQ ID NO: 202091 - DNA, 601 bp, Human; identical to SEQ ID NO: 120974

SEQ ID NO: 202092 - DNA, 601 bp, Human; identical to SEQ ID NO: 120975

SEQ ID NO: 202093 - DNA, 601 bp, Human; identical to SEQ ID NO: 120976

SEQ ID NO: 202094 - DNA, 601 bp, Human; identical to SEQ ID NO: 120977

SEQ ID NO: 202095 - DNA, 601 bp, Human; identical to SEQ ID NO: 120978

SEQ ID NO: 202096 - DNA, 601 bp, Human; identical to SEQ ID NO: 120979

SEQ ID NO: 202097 - DNA, 601 bp, Human; identical to SEQ ID NO: 120980

SEQ ID NO: 202098 - DNA, 601 bp, Human; identical to SEQ ID NO: 120981

SEQ ID NO: 202099 - DNA, 601 bp, Human; identical to SEQ ID NO: 120982

SEQ ID NO: 202100 - DNA, 601 bp, Human; identical to SEQ ID NO: 120983

SEQ ID NO: 202101 - DNA, 601 bp, Human; identical to SEQ ID NO: 120984

SEQ ID NO: 202102 - DNA, 601 bp, Human; identical to SEQ ID NO: 120985

SEQ ID NO: 202103 - DNA, 601 bp, Human; identical to SEQ ID NO: 120971

SEQ ID NO: 202104 - DNA, 601 bp, Human; identical to SEQ ID NO: 120972

SEQ ID NO: 202105 - DNA, 601 bp, Human; identical to SEQ ID NO: 120973

SEQ ID NO: 202106 - DNA, 601 bp, Human; identical to SEQ ID NO: 120974

SEQ ID NO: 202107 - DNA, 601 bp, Human; identical to SEQ ID NO: 120975

SEQ ID NO: 202108 - DNA, 601 bp, Human; identical to SEQ ID NO: 120976

SEQ ID NO: 202109 - DNA, 601 bp, Human; identical to SEQ ID NO: 120977

SEQ ID NO: 202110 - DNA, 601 bp, Human; identical to SEQ ID NO: 120978

SEQ ID NO: 202111 - DNA, 601 bp, Human; identical to SEQ ID NO: 120979

SEQ ID NO: 202112 - DNA, 601 bp, Human; identical to SEQ ID NO: 120980

SEQ ID NO: 202113 - DNA, 601 bp, Human; identical to SEQ ID NO: 120981

SEQ ID NO: 202114 - DNA, 601 bp, Human; identical to SEQ ID NO: 120982

SEQ ID NO: 202115 - DNA, 601 bp, Human; identical to SEQ ID NO: 120983

SEQ ID NO: 202116 - DNA, 601 bp, Human; identical to SEQ ID NO: 120984

SEQ ID NO: 202117 - DNA, 601 bp, Human; identical to SEQ ID NO: 120985

SEQ ID NO: 202118 - DNA, 601 bp, Human
tgcacttctaaaactccatcctacagaaatggttaaccatgtagacaaagatatatacataaggatgttcactgaatcactagttataacagcaaaactttaggaaacaaacaaaatatctatcaatagaagaatggttacataaattacattacatctctaccatgaaatactacacaaaagtgttttcactcaagagagcagaagagtgacttggtctgttgcattttaaaatgatccctctaatatattgagggtggtctgtcataggatgcagaaggagcaatggcagatagagaakatctgttaagatgctattatagcaacgcagacaaggtattaatggtagtgagaagtgatctaactgtgtgtgtgtgtgtgtgtgtgtatacatacacacaaatatagacatacacatacacaaatttgctgactgactagatgagaaatatgagaaaaagaaaggaattaatgatggcccagagtttctggcctgagctggaacaatggaatatttctatctaacagatgaaaaaactaaaccacttagaggttaaaaaacctgtccaaagtcacaccaataaaatggtagagtcactag

SEQ ID NO: 202119 - DNA, 601 bp, Human
gaaagtgtagcccaaaattctccttacttctgaatctacttcctccgatccctgcctcctaggtactaatggttcagacttcatttcctctcccaagtattagagcaagttgtatctccaaagggatctaaggaagttctatgctgtgtccttaggtacctaggctatgaacccagggaatcttgtccctggtgtcccagtttagatatacagctctcaacatgggcagttatgtgggacccattccccaccacccttgccagggccccaagtttgtaaatggctaggaggattgctctcycatcatgtaagatgctctcctcccctgatttttacccagcttatccctctgcaatacaatctccaagccttggctccttggccagggccttgaaactcatgacccagtactttaacaactggaactgggtctatgacaacataatagatcaggatgaaagcgaattaagtaactcaaggagagaagagacagagagagagagaaaagagagggagagagagaaaaagagagatagaagtagtaaagaaaaaacagtgcaccctattcctttaaaagccagggtaaatttaaaacctataa

SEQ ID NO: 202120 - DNA, 601 bp, Human
tgtcgtcccgaactcccggcgttagctggttgagatcatggcgcagccgaagtctctactcaacagtcgcccgtgcatgcacccctacctttccttctgacccatacctcctgggtcccgaccatgactttcttgaaagtgtagcccaaaattctccttacttctgaatctacttcctccgatccctgcctcctaggtactaatggttcagacttcatttcctctcccaagtattagagcaagttgtatctccaaagggatctaaggaagttctatgctgtgtccttaggtacctaggctrtgaacccagggaatcttgtccctggtgtcccagtttagatatacagctctcaacatgggcagttatgtgggacccattccccaccacccttgccagggccccaagtttgtaaatggctaggaggattgctctctcatcatgtaagatgctctcctcccctgatttttacccagcttatccctctgcaatacaatctccaagccttggctccttggccagggccttgaaactcatgacccagtactttaacaactggaactgggtctatgacaacataatagatcaggatgaaagcgaatt

SEQ ID NO: 202121 - DNA, 601 bp, Human
ctggcagggtgtccactgcacttctgatccagcgaggcggcgcccattgccactcccagtcgggctagaggctcaccattgttcctgcacaggctaagtgcctggggttcatcctaatcgagctgaacagagctgtaacactcaccgcatgacccaagattccattccttggaatccgtgaggtcaagaacccgaggtcagagaacaagaggcttgccaccatcttggaagcagcctaccaccatcttaggagctctaagaacaaggaccccccagtaacattttggtgaccacaaagggrcctcaaaagcggtgagtaatattggaccactttcacttgctattctgtcctatccttccttagaattggaggaaaataccgggcacctgtcagccagttaaaaataattagtgtggctgccagacttaagactcaggtgtgaggctatctgggaaagggctttctaacaacgtccaacccttctgggttgggagcgttggtctgcctggaaccagcttctgctttcaattttcctggggaggccgagggccgactagaggcagaaagctgtcgtcccgaactcccggcgttagctggttg

SEQ ID NO: 202122 - DNA, 601 bp, Human
catcattctaatagtagaatccagcagtctctgaagagacccatcactcagatttacatttacttgagctactatattccctttctttgcttaagctagtttgaactaggtttctttcactcagtactgaaagaatcctgattaacatagcatacaatttagcagtatctataaatattttaacttggcatggtgatggttaattttacatgtcaacttgactgggttaagggatgcccagatagctgctaaaacatttctgggtatatccatgaagatgtttcaggaagacattaccatytgaatcagcagactgaataaacaagacttgccctcaccaatgtgggcaggcatcatgtaatccttcaaggacctaaaagaaaaaaaaggcagggaaccccctttgggtcccctcccattgtatgggagctctgttttcactctattaaatcttgcaactgcacactctctggtccgtgtttgttccagttcaaactgagctttcactcaccgtccaccactgctgatcaccgtcgtcgcagacccgctgttgacttctacccctccgatctggcagggtgtccactgcacttctgatcca

SEQ ID NO: 202123 - DNA, 601 bp, Human
atacaaagagtcggagcacactgtaggtccaaaaagtaaaacgtgctcaaaaaacaaacaatgggggcatgcaaaagagacaataggagccactctgaaagggcatcctatgaccaaaacaatatgagcaacaaaataaattacattgtattggattgtaacctaaagtacaggtataaaataagtaacaatgagttcatgcagatataaatgactaaatatataaattaacgggagagaagagataaatctcccatgtagaagaattccaaataatttatgtaaagactactccatcaargaagtagagtttaattcccacttctggagtgcaagccacccttagtgacttgcatacacactcatcttgggaaaaggaaataaaatctcctgtgtgattatatatgaagtaaagaaaataaaaggcacttctcacacaggtgagaaatactgaagtcaatttactactaacttgagatcttgaaatattttacctatagaaaaaaatatattaagctaactttaaaatcactggaccaggaagataacatttgaagttggattgaggctgcaactttgactctgctagaaataatatggg

SEQ ID NO: 202124 - DNA, 601 bp, Human
aggtgaggagagcagaatttattaaaggaaagctcccagctaaaaaagggggtcctgccaacaggttcccaccccacagattgaataccagaccaccacacatgagctgaagaggccaggctcctccccactgcataaggtgagaattcccagtggcttcaccccattcttccagtgcacaggcagccccttattctgagccactccacattgatttatttccctttctgtgcacgtgttaaggcacggaatttttcgcccccatgggcatgtttaggcaagccccctgtgcacaatgacstgggcagcatttggctgtctcctctctctatcagtagggcaggtaagagtaacaaataatttagaaaaatgaacaacacaagcattgaagcgtgcctagacttactatatattaaaccatgtcttaaagttagaaaaagtgaagtaatgtgctcctggtacaaatgcagaaaggaaggtacccatcagggaaaggaatcaacagaagcagtaagagactaagaaagatggtcactaaaaggtcagagacctagaccgatgttacattacagaagccaaggaactttctcttgtaaagtag

SEQ ID NO: 202125 - DNA, 601 bp, Human
cacacactgttttttggggggttttttcttttttttttttttgagacagagttattgttgtccaagctggagtgcaatggcgcaatcttggcttactgcaatgtccgccctcccggattcaagtgattctccagcctcagcctcccaagtagctcagattacaggcatgtgccaccacacccagctaattttttgtatttttagtagaaacgaggtttcaccatgttagccaggctggtctcgaacccctgacctcaggtgatccgcccgcctcggcctcccaaagtgctgagattacaartgtgagctaccacacctggcccttccacattatgtttttacaaacactaaggctctactttcctttttttaaatactatattggccaggcacggtattttgtattagtcaatacaaaagatttatttcttagtcaatacaaatttaccatttacaaaatggtaaattcactgccacagaaacaaaataaatcctactactaaaaataagtgatttaaagttatttactggtttgaattatctcccatcccttgcttcattaacataaaaaagtacaagttaactacatgttgaaatataa

SEQ ID NO: 202126 - DNA, 601 bp, Human
atgtaagaacaatataaggatactgatttcctcatctttaaaagctggaggtttaaatctattaatcaaatgtgactaataaaataacacattatataaatacatttaattatatgaaggtaaaaccagaaagataataagtatcctagtttcataattgcttacattaaagaattaaaagccaggtgcagtgcctcactcctgtaatcccagttcttcgggaggccgaggcaggcggatcacttcaggtcaggattttgagaccagcctggccaacatggtgaaacctcatcgccactamatgtacaaaaattagcctggcatggtggcaggcacctgtaagctcagctactcgggaggctaaggcacaagaatcccttgaaccctggaggtggaagttgcagtaggcagagatcgcaccactgcactccagcctgggtgacagagtgagactctgtctcaaaaaaaaaaaaaaaagtaattaaaagacattgtgttaaaacatagaaaggtggctgggcgcagtggctcacgcctgtaatcccagcactttgggaagccgaggcaggtggactgcgaggtcaggagatctagaccatcc

SEQ ID NO: 202127 - DNA, 601 bp, Human
gaacaaaatgcaaaatgttattcccactaacaatgcaaatataactgacaaaagttggaaaagcggggggagaaagagagttatgtaagaacaatataaggatactgatttcctcatctttaaaagctggaggtttaaatctattaatcaaatgtgactaataaaataacacattatataaatacatttaattatatgaaggtaaaaccagaaagataataagtatcctagtttcataattgcttacattaaagaattaaaagccaggtgcagtgcctcactcctgtaatcccagttcttygggaggccgaggcaggcggatcacttcaggtcaggattttgagaccagcctggccaacatggtgaaacctcatcgccactaaatgtacaaaaattagcctggcatggtggcaggcacctgtaagctcagctactcgggaggctaaggcacaagaatcccttgaaccctggaggtggaagttgcagtaggcagagatcgcaccactgcactccagcctgggtgacagagtgagactctgtctcaaaaaaaaaaaaaaaagtaattaaaagacattgtgttaaaacatagaaaggtggctgg

SEQ ID NO: 202128 - DNA, 601 bp, Human
ctaaatctaactagaaatagtaaataatgatcattgtttaatatagcattcattaaagaaaaagcttttttaagggacattttttaaatgtaattatcttagtgaatgctcttttagaaaaatgcttaatgtgactatgagttctagggaattaccataacaattctgtacaaattacaattataaacacaattttgtaccaaatgaaaattacagtgagttttatctctattagctagaaaatatactgtttcatttttttgtttgttttgttttgttcttaagatagggtctggctctkttacccacgatggaggacagtggcacattcacggctcactgcagcctcaacttcctgggctcaagcgatgctcccacctcaacctcatgagtagctgggattacaggcatgcaccacccacacagctcattttccattttttgtagagacaaggtcttgctatgttgcctaggctggtcttgaactcatgggctcaagtgatcctcccacttcagcctcccaaaatgttgagattataggcataagccaccacacccagcctagtctttcattttgaggctcagattttgacaataattc

SEQ ID NO: 202129 - DNA, 601 bp, Human
gttctccaatatagaagacagaagcttcatttggctgtttaaattttaattttaattaattaaaatggaataaaattaaaatttgagttcttcaatcaaaccagacaaacttcaagtgttcaagagccccatgtggctagtgaccatcataagggacaatgtagatataggacaattccaagttctattgggtaggactggtctagagattagaattgaattgaattgaaatttaacctagaatactaggtatacctgtcttcaagatacccatttagcattggaaacagagagccaggcratcagctgcaggtcttggagtaagtgtcaaagacagaaagataaggtgtaattctagaagctagaaaagtactgtgggttcctagaaagaaaaagaaagcagaatcatagtatctggtattaaaaaatggtatccaatagggaccagagaccaaggaaaaagattaaggatgaaataaaagaccgcatttcagaaggcagagctccaagtgtctggagtacacagagatatgggagaaagactttcccctcttcaatccaaacaggtaagactccaaacaggtagaagagaaaagccaga

SEQ ID NO: 202130 - DNA, 601 bp, Human
agagaagagacaagaaatagataaatccacagcagaataacaacacagtaattaggacagaactaagcttcatatactgtgtacctcttatggtatttattacagcctatcttgaattctggttattataatatcctcaattaaattgtaagcccatgatatcaggaactaagcctgatagtgtagaggcctgataatcacctaatcaatggaggataatgagaaaaattcagttgtgacttttaccatcctattgataagcaaaactagttggctaagctggtgtttctttgctccttcrcctttttatgtgagacccatctaggaccacatgttagggcaaaggagataaatatttcaaaaataaaacaggactactgttcagttaaggatgtatgaagaactgcactcattctgttgctctctagaactgttctccaatatagaagacagaagcttcatttggctgtttaaattttaattttaattaattaaaatggaataaaattaaaatttgagttcttcaatcaaaccagacaaacttcaagtgttcaagagccccatgtggctagtgaccatcataagggacaatgtagatata

SEQ ID NO: 202131 - DNA, 601 bp, Human
acacagacctggaggcataaatttaataaaacatgcaaaacctctaaactgtaaactacaaaatactactgagaaaagcaaagatctaaaaaaaaaaaaaaaagtagaatacaccatgttcatagatataaagattcactattttaaaaatatcaattctccccaaaacaatctaacgattcaatgtgagcccaatcaaaatacccaaaggtgctacaggtattgtcttaatagttggaaaaaaaaaaacaaaaactgattcatacagatgggaatgtaaagggccaaataaagccaaaamaatcatgtagaataaagccagaggactcatacaagcagctatcaaaactaataaagctggaataattaaggtagcatggtattggcacaggatagagaaagagactaataaaacaactgaaactgcagaaacagataccttcaacaaatggtcacttttatgacaaaggtgacaatggttttgggtccactgaatatccatatggggaaaaaaatcttcacccctgtcccacacaatacccaatttcagatggattgcgaattaaattccagattggatttagaaacaacaaaccttcta

SEQ ID NO: 202132 - DNA, 601 bp, Human
gattgctcctaactgaactttccctcatggtccagaaccaaatttccaaatacctgccaagtatttccatccagacattctatcagccccttaaaatcaacatgcctaacacagacctggaggcataaatttaataaaacatgcaaaacctctaaactgtaaactacaaaatactactgagaaaagcaaagatctaaaaaaaaaaaaaaaagtagaatacaccatgttcatagatataaagattcactattttaaaaatatcaattctccccaaaacaatctaacgattcaatgtgagccyaatcaaaatacccaaaggtgctacaggtattgtcttaatagttggaaaaaaaaaaacaaaaactgattcatacagatgggaatgtaaagggccaaataaagccaaaaaaatcatgtagaataaagccagaggactcatacaagcagctatcaaaactaataaagctggaataattaaggtagcatggtattggcacaggatagagaaagagactaataaaacaactgaaactgcagaaacagataccttcaacaaatggtcacttttatgacaaaggtgacaatggttttgggtccactg

SEQ ID NO: 202133 - DNA, 601 bp, Human
atacaagtttttttttttttttttttgagatggagtcttgctctgttgcccaggctggagtgcagtggtgcgatcttggctcactacaacctccacctcccaggttgaagcgaatctcctgcctcagcctccctagtagctaggattatagacgtacacctccatgcccagataatttttgtacttttagtagagatggtgtttcaccatgttagttaggctggtcttaaactcctgacctccagtgactagcctgcctcggcctcccaaagtgctgggattacacacatgagccaccacrcccggcctatacatgttctctattagtgaatttgttcaattctgaaacgttactgagcaaattcatctctaggcgaatgattgctcctaactgaactttccctcatggtccagaaccaaatttccaaatacctgccaagtatttccatccagacattctatcagccccttaaaatcaacatgcctaacacagacctggaggcataaatttaataaaacatgcaaaacctctaaactgtaaactacaaaatactactgagaaaagcaaagatctaaaaaaaaaaaaaaaagtagaatacac

SEQ ID NO: 202134 - DNA, 601 bp, Human
tgtaaagctattcccttgaaaatcatcatcaaattcaatggccttttctcagccttgaacctcctattcagttcctactgcctctggcattaaattccccatatttctctaacataaacttttttctccatgtcaacagcactgttgtggtgttacaactttctctaacaactcattcttcttagtttagttgttctatcctactatttcagaaatgtgatgactcaccaggattctgtcttcaatctctatttatttttttattcctttactttatacaagtttttttttttttttttttgagatggagtcttgctctgttgcccaggctggagtgcagtggtgcgatcttggctcactacaacctccacctcccaggttgaagcgaatctcctgcctcagcctccctagtagctaggattatagacgtacacctccatgcccagataatttttgtacttttagtagagatggtgtttcaccatgttagttaggctggtcttaaactcctgacctccagtgactagcctgcctcggcctcccaaagtgctgggattacacacatgagccaccacgcccggcctatacatgttctctatta

SEQ ID NO: 202135 - DNA, 601 bp, Human
caaacatgtcacagtgctgcagagattttgtttatggccagttttcgggccagtttatggccacattttggggggcctgttcccaacactccacttcgcagtttgttcctcatattgtctcttctccagttttttctcatcattccttctctactgggctccactgttcaacctgcagactagtttaggttttcctttccctaaaaataaaacaaacaaacaaaatatcttccaatctactgttttctctcactttctttttttaccactgaactacccccaaagactactcttcttgagyctacattcagtgatcccattttcccacaaatcactcattcattcattcaacaaatgtctacttagtgcctattatgtaccaggtaatattccaggtactagagatacagaagtgaacaagagacaaaaatacctgcctccatggaccttttaatcacttaatcaataactatcatgcaaattctactgccataattcatgtaaagctattcccttgaaaatcatcatcaaattcaatggccttttctcagccttgaacctcctattcagttcctactgcctctggcattaaattccccat

SEQ ID NO: 202136 - DNA, 601 bp, Human
tatttttagtagagacaaggtttcaccatgttggccaagctggtctccaactcctggcctcaggtgatccacctccgcctcagcctcccaaagtgctgggattataggcatgagccactgcacctggccccacaacagctttaaaaaaataactgaaaattaaaaaaagcaaaataaagaaattacaaatgaaattaccatattaaaaaaaagcctgaaaataatagtaataattttgggtggaggtcataaaaggaaaaaaatctgtttcatatcaaattcatacatcattatcagtgaytgttagcaaaaatcattctatagccagtccatgacttgaagattatcaggttgtcaacagtgatatatgaaggagagtgaaggtaagtttgttttccacaagttaggctgaccttataaaaattaaagtcaaaaaatgtgttttgattattaaatacaatatagatgacagaaaaattttcatttttttaaccttatgatgcaagttatgttttcacttttaatatcataaatatattaagaaatctgctatctgcaactattaaaaacatttcccaatgacaaaagtaaaacttacaca

SEQ ID NO: 202137 - DNA, 601 bp, Human
cagcacctgttatttttttactttttaataccagccattcttactgctgtgagatggtatctcatcgtggttttgattagtaagaaaaaagatttgaagaataagatttttttttcatttcaatcatacagttattctgtatctcccactatagtaggaggcaggaagtgggaatcaacacttctcagtcacaaaattagaaaggcacatttggataatgagtcacattagaaaacactaatacacatgaaacaatgggaatataaaaatccttaaaagtgtaaaacaagaaatgataagygtgcttattactgaagacaagtaacatgccattgatattgtactagttttatatattgaatttataccaaagcttatttcccctataagacactcagaagttctttaataaaaaattctccaccgagtgtggtggctcccgcctgtaatcccagcactttgggaggctaaggcgggtggaccacgagttcaggagatcgagaccatcctggctaacatggtgaaaccccgtctctactaaaaatacaaaaaaattagctgggcatggtggcacgcacctgtaatcctagctacttgagag

SEQ ID NO: 202138 - DNA, 601 bp, Human
atttctattcctctgggtatatacccagtaacgggattgctgggtcaaatggcagttgtgtttagctctctgaggaatcaccataccgctttccacaatggttgaattaatgtacactcccatcaactgtgtatacatgttcctttttctcctcaacctcgccagcacctgttatttttttactttttaataccagccattcttactgctgtgagatggtatctcatcgtggttttgattagtaagaaaaaagatttgaagaataagatttttttttcatttcaatcatacagttattctrtatctcccactatagtaggaggcaggaagtgggaatcaacacttctcagtcacaaaattagaaaggcacatttggataatgagtcacattagaaaacactaatacacatgaaacaatgggaatataaaaatccttaaaagtgtaaaacaagaaatgataagcgtgcttattactgaagacaagtaacatgccattgatattgtactagttttatatattgaatttataccaaagcttatttcccctataagacactcagaagttctttaataaaaaattctccaccgagtgtggtggctc

SEQ ID NO: 202139 - DNA, 601 bp, Human
ggattacaggcatgaggcactgcacctggcctatttaatctaaatattaattaaacatatatatatatacacacacacatatatatacacacatatatatatacacatatatatacacacatatatatacacacacatatatatatacacatatatatatatagttttgttttgttttgtttttgagacagagtctcactcttgttgcccagactggagtgcggtggtgcgatcttagctcactacaacctctgcctcatgggttcaagagattctcctgcctcagcctccccagtagctsggacaggtgcgtgccaccacaccgggctaatttttgtattttcagtagagacagggtttcaccatgttggctgggctggtctcaagctcctgacctcaggcctcccaaagcgctgggattagacatgagccactgacccaggctaaacactaataattgaaacttatgggactgcaagtcattaactgaattaggatagtcctccggaaggtatgatgtagtagaaggaagatcagaagtcagaaggcctgggtccaagccctgattctgccaggaaacgagtctagatctttgacaagg

SEQ ID NO: 202140 - DNA, 601 bp, Human
cctttcagcaacatggatgcagctggaggccattattctaagtgaattaacaaattaacaaaaaccaaatactgcatgttcttacttataagtggaggctaaacactgggtactcaaggacataaagatagcaacaacagatactggggactaatagagaggggaggcagggaacagggcaagggctgaaaagcgaactgttgagtactatgcccactgtctaagtgatgaggtcattcatatcccaaacctcagcatcatgcaatacacctatgtaacaaacctgcatgcataccctctraatctgaaataaaagttgaaattataaaaaataaaataaaatcacaaatctaattaaattatatatacgccattgtataaagatttttaaaagctaacctcactttttgtgaagattttgaaaatagcagtcatctccaaacttttcttgttggcaaataatgtattaaatatgctacatatgatgttgttacatgaccatgagagttttttaaatttctagaatacatttcggtggaaagatcatcatcaagacggaaaaggctgtcttctatttaaaagaatattccataaatgcacc

SEQ ID NO: 202141 - DNA, 601 bp, Human
aaggttggttccatatatgcaaatgaataattgggattcaccacgtaaagaaaattaaaaaccaaaactatatgatcatctcaacagatgtgagaaaagccttcataaaacccaacatcccttcatgataaaaacaaaacaaacaaaacaaaaccctcaacaaactaggcattgaaggaatgtatcttaataagaatcatctatgaccaacccacagccaacatcatactgaacaggcaaaagctggaagcattctcctagagaaatggaagaagacaaggatacccactcttaccactcytattcaacatagtactgaaagtccttgccagaacaatcaggcaagagaaagaaataaaaggcatccaaataggaaaagaagaagtcaaacaatctctcttctctgacaatatgattctataccaagaaaaccctgcagactccacaaaaaggctcctgaagctgataaacaacttcagtaaaatttcaggttacaaaatcaatgtataaaatcagcagcatttctatacatcaacaatgttcaagctgacagccaaatcaagaacacaactccatttataacagccaccaaaaaaaaatt

SEQ ID NO: 202142 - DNA, 601 bp, Human
tgattcacttgtgaggccgagatgggcagatcacttgaaggtcaggagtttgagaccaaattggccaacacgatgaaaccccatctctactaaaaatacaaaaaaattagctggccacaggggtgcgcgcctgtaatcccaggtactcaggaggctgaggcaggagaattgcttgaaccaggagggggaggttgcagtgagccaagatcatgccactgcactccagtctgggtacagagcaagaccctgtctccagaaatataaataaataaataaataaataaataaataaataaataaactgaattaataccaaccatactctcagaccacagtagaataaaaatagaaatcaataccaagaagatcttccaaaaccacacaattacatagaaattaacttgctcttggctgggcacagtggttcacgcctgtaatcctagcattttgggaggccaaggcaggcagattgcctgagctcaagagtttgagaccagcctggaaatgtggtgaaaccccatctctactaaactacaaaaaaaaaaaaaaaaaaaaaaattagccagacatagtggtgtgtgcctatagtcccagctactca

SEQ ID NO: 202143 - DNA, 601 bp, Human
aatccagaaacctatttaagatctttcccacctaatttcatttatccgaatctacagaaggcatgaaacatactgcccagctcccaaggaatatcattaattttaaggtgtttcagagttaacaggggtactacattatatggcttaattcaaactacacttataaggtgatgaggcgtgagcttagctgctgtgaccagaaggaccaaaaacattgttcatccaaaagataagatgaaggccaaaaaagaccatcatcatattgaacacacacacacacacacacacaggcgcgcgcgcrcgcgcaatccaaaatcattatattctggtctaataagaaatgttcagttctgtaacggacttaagatttgggatagagaaaggcaactaaaagttatcagtgcaacctcactgaaggtcaactaaagtaattagggctcttctgtttaaaaagacaaaacttaacggggtacacaagaaaatcctatgaaatcatgaaagttatacataaagtgggccccagatactcagattaaccaaaacccaaatattcaaactaaaatgtataagtttaagaggccggatggggtggctcacacct

SEQ ID NO: 202144 - DNA, 601 bp, Human
tatatcactattcaagaatgagataatagctcctatttgcagttatcccagacacagcagaaaaaaataggaaccttcccttccatgagtctctataaaaaaatacaaaaaaaaaaaaatacattaaaaacgcttctttgccaaagacagcagaagatagtgaagtaaatgccactaaatactgtttttcccattaggttttaaattcctaaaggatcgtgtgtatgtttcagcttcctcagtaagtttaacaggatctatttagtgctctctacataacaaaatggtcaattagtgttaytgactgattttgtagaaatcaaaggagaaaaaagggtctgccccctaaaatttcaactaatcttggaaaatccagaaacctatttaagatctttcccacctaatttcatttatccgaatctacagaaggcatgaaacatactgcccagctcccaaggaatatcattaattttaaggtgtttcagagttaacaggggtactacattatatggcttaattcaaactacacttataaggtgatgaggcgtgagcttagctgctgtgaccagaaggaccaaaaacattgttcatccaaaagata

SEQ ID NO: 202145 - DNA, 601 bp, Human
tgaagtttacacagaaaaaaattctacagagtaactgagacataaaaagcaaaccaaactgtggagttccttaaaaatacaactttggagtacttgtgaaaggaaaagaaaaaaaatcatttatatcactattcaagaatgagataatagctcctatttgcagttatcccagacacagcagaaaaaaataggaaccttcccttccatgagtctctataaaaaaatacaaaaaaaaaaaaatacattaaaaacgcttctttgccaaagacagcagaagatagtgaagtaaatgccactaaayactgtttttcccattaggttttaaattcctaaaggatcgtgtgtatgtttcagcttcctcagtaagtttaacaggatctatttagtgctctctacataacaaaatggtcaattagtgttactgactgattttgtagaaatcaaaggagaaaaaagggtctgccccctaaaatttcaactaatcttggaaaatccagaaacctatttaagatctttcccacctaatttcatttatccgaatctacagaaggcatgaaacatactgcccagctcccaaggaatatcattaattttaaggtgt

SEQ ID NO: 202146 - DNA, 601 bp, Human
cttttaaaatacaaaaagtagctgagcatggtggcacatgcctacaatcccagctacttgggtggctgagacaagagaatcacttgaactcgggagatggaggttgcagtaagcccagatcgcgccactgtactccagtctgggcaacacagcgagacagtctcaaaaaaaaaaaggaaaaagaaatgggaaaattcgttttcatgtgggtcacttcaccaagttaccactctctttcataatctatctgcttttgttcctttgagagtcctcaggtagtttctttttgaattttgaccayagttttttgtagtcattagagagaaagagagaggctgtagtggaattactccactgcatgttaagaacttcttagcatcactgaagtttacacagaaaaaaattctacagagtaactgagacataaaaagcaaaccaaactgtggagttccttaaaaatacaactttggagtacttgtgaaaggaaaagaaaaaaaatcatttatatcactattcaagaatgagataatagctcctatttgcagttatcccagacacagcagaaaaaaataggaaccttcccttccatgagtctctataa

SEQ ID NO: 202147 - DNA, 601 bp, Human
tcctgggtcttgttataatcctttgaagaacactagctttttggtttgtttatttcagcaagcatataacctagttaggttcaaactgcaatttctgttttaccttatacagtggttccaacgtcagctcagttctcaaaagccttgactttcctgctttaagcttggacccatgaatgtgccactcagggtctagcctgagactctgatgatagttcaaatcttactttcaacattttgggttggctgggtgctgtggctcacgcctgtaatcccagcactttgagaggccaaggcaggsagatcacctgagctcggagttcaagaccagcctaggcaacacggcaaaccctgtctctacaaaaaatacaaaaaaaaaaaattccaggcatggtggcgcacaaccgtagtcccagctactcaagaggctgaggcaggataattgcctgagcccagggaagtcgaggctgcagtgagtcatgatcatatcactgcactctgtgtgggcaacagaatgagatcctgtctcaaaaacaaaacaaaataaaaaacaatttgggtctatcttgtgcatttaaagcttggggtaagtcaggaatat

SEQ ID NO: 202148 - DNA, 601 bp, Human
agatggcccccaatcatcctttcctcctcctatttgtgcttttgtacagtctttccatattgaatcagggcttgtgtatgtgatctgcggaggtgacagccataatttcaatgaaccaggtcactgtgacttccgtcttgttctctcttagacctcttcctctgagggaatcagctaccatgccatgaggatactgcagccgtcctgtggggaggcttttatagagagaaaccgaggtttcctgccaacacccagccatatgagtgatccatgtcagtgagcctctgtggaagttgatccyctggctcctgtcaagcttgctaatgactgtagcttcatctgatatttaatgcaactataagagaaacctccaagcctgaactgcccaccaagctactcctgaatctctaaccaacagaaactccagaagctgcatggctgtgccacgccagtctgcacgctccagctgccagacagcatgtcttcccctttgttaataatttctaatggtttactttcaagttaatttactctttcctatatctttcatttggctatggagtccatgtagtaaatttttcattgcagattattgtatttt

SEQ ID NO: 202149 - DNA, 601 bp, Human
ggtacagctcaggccactgtttcagagggtacaagtcacaatggtggcttccacatggtcatggtgttaaccctgtgggtgcacagaatttaagagttgaggtttgggagactctgcctaggtttcagaggatgtctgaaaaagcctagatgcccagcataaagggccttctttctttgcattggtcttgcctctaccccataaacataccagaaagaggagggaaggagagagcctggaacactgaaatctaaagaaagttagtataagatgtttagatgaaggctggaggtggaaagascatgtttctcagggatatttgtacaaaataaaatgatggcatttccttgatcattactgaatatgaatgatgggtctatgggagttcactgtaccaatttctttacatttacatatgtttgaaaatttcaaaattaaaaaacagcaatttcagagataatgtgtgagacagctagcctccaagatggcccccaatcatcctttcctcctcctatttgtgcttttgtacagtctttccatattgaatcagggcttgtgtatgtgatctgcggaggtgacagccataatttcaatgaaccag

SEQ ID NO: 202150 - DNA, 601 bp, Human
gcagccttacccatcacaggcccagaggcctaggaggactgaatggtttcatgggccaggcccagtgccccactgtcctccacagccttgggacactagtccctgcatcctagccactcctgctatggctcaaaggggcccaggtacagctcaggccactgtttcagagggtacaagtcacaatggtggcttccacatggtcatggtgttaaccctgtgggtgcacagaatttaagagttgaggtttgggagactctgcctaggtttcagaggatgtctgaaaaagcctagatgcccagcwtaaagggccttctttctttgcattggtcttgcctctaccccataaacataccagaaagaggagggaaggagagagcctggaacactgaaatctaaagaaagttagtataagatgtttagatgaaggctggaggtggaaagagcatgtttctcagggatatttgtacaaaataaaatgatggcatttccttgatcattactgaatatgaatgatgggtctatgggagttcactgtaccaatttctttacatttacatatgtttgaaaatttcaaaattaaaaaacagcaatttcagagata

SEQ ID NO: 202151 - DNA, 601 bp, Human
attgtaatccccagtgttgaaggtggggcttggtgggaggtgactggatcatggggatgggtttctcataaatggtttagcaccatccccctcggtagtgtcctcacagtagggagttcttgtgagagctagttgtttaaaagtgtgtggcacctcccacactcactctcttgctcctgctcctgccatgtaagaagcagcctgctctcacttcgccttctgccatgattatgtttcctgaagtgtctccaaaagctgagcagacaccaacatcatggttcctgtacaacctgtggaactrtgggccaattaaacctttttctttataaattacccagtctcaggtatttctttatagcaatgcaagaacgaactaatacagaaaattggcactgaagagtggggcattgctataaagatacctaaaaatgtggaagcaacttgggaacttggtaatggcagagagtggaagagtttggagggctctgaagaagacagaaagatgagggaaagtttggaactccctgaagactggttaaatggttgtcaccaaagtgctgatagtgaataaaagtaaaggctgggctgacaaggtctcaga

SEQ ID NO: 202152 - DNA, 601 bp, Human
ggatggtctcaatctcctgacctcgtgatccgcccaccttgccctcccaaggtgctgggattataggcatgagccactgcacccagccaaaacgcagtttcttaataggaagtcttcccccagcattctcagccctgattcttatgcccaatactagttactaagagaaatatacttctagtgtgaagaaaagcaattcatccattctcacaatctggtaaacatatccaacctcttttgctcaagtgttgagctaacaaaacaaccttccatattgtctttaggaacactgggttgtccrttccagaaagaggaaataaatactataagtaacctgttgctgtttaccctgcccagctcttcttttgctgtgaataaataattgttctggtctaaaaatcagctgtaggagagttactatgggtcaattctctataccactgccatgcagcggacttttctgtgatgatgtgctattcggtagggtagctagccacacatgactcttgagcatttgaagggtggctagggaaactgaagaagtaatttataacgctacttaattttcattaatttaaatagccacatgtggctggtggct

SEQ ID NO: 202153 - DNA, 601 bp, Human
aggcacgtgccgccacgcctgactaattttttgtatttttaggagagacggggtttcagcatgttagccaggatggtctcaatctcctgacctcgtgatccgcccaccttgccctcccaaggtgctgggattataggcatgagccactgcacccagccaaaacgcagtttcttaataggaagtcttcccccagcattctcagccctgattcttatgcccaatactagttactaagagaaatatacttctagtgtgaagaaaagcaattcatccattctcacaatctggtaaacatatccamcctcttttgctcaagtgttgagctaacaaaacaaccttccatattgtctttaggaacactgggttgtccgttccagaaagaggaaataaatactataagtaacctgttgctgtttaccctgcccagctcttcttttgctgtgaataaataattgttctggtctaaaaatcagctgtaggagagttactatgggtcaattctctataccactgccatgcagcggacttttctgtgatgatgtgctattcggtagggtagctagccacacatgactcttgagcatttgaagggtggctaggg

SEQ ID NO: 202154 - DNA, 601 bp, Human
acttactgaaaatctacctaagaatatattggttcaattacaagtctcacatgaaagaaaatcgctcatatgccctttcgatagcacaaaaacaaattgtaattatgctcacatggccacttcaaagagcaaaatttctaagagatgcaaaaacaaaacacacaaaaaaaacaaaactaagtttgttaactcatgtctgtgaccaaggactactgtacaccatactgcttcacctttacttttctttttcttctttgatccggggagagactaggtctcccttacatttgttttatagcaktttgatttttctgaccatgcctttctgtgagtttatcctgtttgggtttaacaggcctcttaaatctgtaaatttatatctttatccaataataggaagtttttggcaattattaatttacatattttttctgtgcccaatctcctctccttctggattttaatgacatgaatgttagacctgttgatactgtcccttcgttccctgacgctcttgtttttttcttccatcttttttctcttttgtacttctgtgtggataatttctttaaatttgtttttaacctttaaatttgttaaa

SEQ ID NO: 202155 - DNA, 601 bp, Human
acctcataagtttgaggctgcggtgagcaatgattgcactactgcactccagcctgggcaacagagtgaaattctatctcaaaacaacaagaataaagaaaatccaaagctgttatttatcattttcatcaccttttggtgttaattgtactatttataaaagtagataaaagtttattagaatacaacaggtcaatagtgcaagaaagtccacaaatagtaaattaatagatttcagagaaatactagaaaatatacaaatgagaaaagggaagtcttttagccattaacacctgaagtyggataggtgttaattacaacaatcataccaaattaacactatcataacacattgttgctataaaaataaaatttttaaacttataccattaaacttactatctattaccaaatccctaaaaattagaatatcaaataattaattttggaaaattgaatcttctaagttacctggtaccagtattgtgaccaaatttgaattcttataactggtaaaagtgatataggaaattcgtgtatcactcattaagaaaagtaagaagggctaggcgtggtggctcacacctgtaatcccacacca

SEQ ID NO: 202156 - DNA, 601 bp, Human
ctcagtcctgggacttgcccacccctttcctggaaaattcattcatgaataattcaccccttgtttagcatgtaatcaagaagtaacaataagtataagcagctcagcagcctgtgctgctgctctgcctatgaaatagccattcttttgttcccttactttgttaataaacatgatttcactttactctatggacttgccccgaattctttcttgcacgagatccaagaaccctctcttgggtctagattgggacccctttccagtaacacatagattttggtatctgagggggatgagmctcaaggcataatttaccttaaattcctgccagctgtgagcctgtgaaatcaaacaagttatctacttccaaaattcaatggtgggacaggcataagacaaacattcccattccaaaagggagacatatccaagaagcaaagagtaataggacccaagtaagtccaaaattcaagaggattaccttgagactccaagataatcttccctgactccacttcagggcttcctggataaactgggatggaggctgagcctccactacctcaggaagctccacccctatgactttgctaggctc

SEQ ID NO: 202157 - DNA, 601 bp, Human
cgcattagcatgctagaagacactcccaccagccccatgacagtttaccaatgccatggaaacttcaggaagttaccctatagtataaaaagggggaaaccctcagtcctgggacttgcccacccctttcctggaaaattcattcatgaataattcaccccttgtttagcatgtaatcaagaagtaacaataagtataagcagctcagcagcctgtgctgctgctctgcctatgaaatagccattcttttgttcccttactttgttaataaacatgatttcactttactctatggacttgycccgaattctttcttgcacgagatccaagaaccctctcttgggtctagattgggacccctttccagtaacacatagattttggtatctgagggggatgagactcaaggcataatttaccttaaattcctgccagctgtgagcctgtgaaatcaaacaagttatctacttccaaaattcaatggtgggacaggcataagacaaacattcccattccaaaagggagacatatccaagaagcaaagagtaataggacccaagtaagtccaaaattcaagaggattaccttgagactccaagat

SEQ ID NO: 202158 - DNA, 601 bp, Human
taaggcattcttagtcacaggatgagacaggaggtccgcacaagatacaggtcacaaagaacttgctgatgaaacagcacttggtaaagaagctggccaaaccccatcaaaacgaagatggtgatgaaagtgacctctggtcatcctcattgttcattatatgctaattataacgcattagcatgctagaagacactcccaccagccccatgacagtttaccaatgccatggaaacttcaggaagttaccctatagtataaaaagggggaaaccctcagtcctgggacttgcccacccctytcctggaaaattcattcatgaataattcaccccttgtttagcatgtaatcaagaagtaacaataagtataagcagctcagcagcctgtgctgctgctctgcctatgaaatagccattcttttgttcccttactttgttaataaacatgatttcactttactctatggacttgccccgaattctttcttgcacgagatccaagaaccctctcttgggtctagattgggacccctttccagtaacacatagattttggtatctgagggggatgagactcaaggcataatttaccttaaattc

SEQ ID NO: 202159 - DNA, 601 bp, Human
ttacccattcaataaaaaagatcagtgaacaaaaatttgaccatgttaagcattttcattgctaaagttaaattttccactgtattttttctaatgaatataaagtaaccaaagttactcctcaggagtaaaaaacatgtaattggcattctgcattcagaataccgaaagtttcacaacttacttcaaaatagtttctactttactagttcttaattcttttctatttcacatatccgataaatacagcacacacccaatggcttattgcgacaaaaattctcaactgttcacaagtggrggaaaatgggggagcagtatcagaattgggaaaggggggataaattacaaagccttctaagagaataaagctaaataaatccttctgcctccaagtagtccatttagttggctggggaggaaaggaaaataggcaatgtttgattttttccccctgcttaggtttttcctaatttaggagcaggaagaagcaagaaaaattggcacaaatccctcaggttaggcaagggattaaggattactaaaattgagtaatagaactatagatagccctccacatcctaagagtcaaccaatggta

SEQ ID NO: 202160 - DNA, 601 bp, Human
cccattaaatgggggtggggtgcgcaggcagaggaatacttagtcttgcatttaaatattgtgacaggcaattattcagccagatacattttcaagactgtttaagacaagcaatacccagaaaatatgtttataatttacgtgacaaagattaagcaacagacctacatgtgatataaataacaatcaaaatctactttaacaacatattggaatttttatagaatgtttcttataatagctctttgaatgtaaatttgatcaaagaaagcaaaacatttatcatatgcagtgtaaacaytggctttacccattcaataaaaaagatcagtgaacaaaaatttgaccatgttaagcattttcattgctaaagttaaattttccactgtattttttctaatgaatataaagtaaccaaagttactcctcaggagtaaaaaacatgtaattggcattctgcattcagaataccgaaagtttcacaacttacttcaaaatagtttctactttactagttcttaattcttttctatttcacatatccgataaatacagcacacacccaatggcttattgcgacaaaaattctcaactgttcaca

SEQ ID NO: 202161 - DNA, 601 bp, Human
tcatttttctgccttaatgcactttaggtcttactgtgaccaaacacaaagtcatttttatgcagttatctgaacatatacatgacaagtaaatctgtttgcacagtttagttaatataacggtgagtttattttaccaacactgataatgccactaaaaatgtattgttactttactacagagaccattacattgtatagaccagttgtacaatcataaacgagtgacatttaatcaactaaatgcacaaatgacatttatgttctattatcccattaaatgggggtggggtgcgcaggsagaggaatacttagtcttgcatttaaatattgtgacaggcaattattcagccagatacattttcaagactgtttaagacaagcaatacccagaaaatatgtttataatttacgtgacaaagattaagcaacagacctacatgtgatataaataacaatcaaaatctactttaacaacatattggaatttttatagaatgtttcttataatagctctttgaatgtaaatttgatcaaagaaagcaaaacatttatcatatgcagtgtaaacattggctttacccattcaataaaaaagatc

SEQ ID NO: 202162 - DNA, 601 bp, Human
agcaagagaaggaaaagtagtgaagtgtgtttaaaagttattctttcttaccaatatgttgctgtagaatccaagcgtttgaggcacgagcagagagcatcctttcaacagctggtgcaagtgtcttccaattagtaaactccaaagtgaagataagggtgtcaatgctgactgagtcaatcctatgttagcaagatgttaatataatattagaaacaaaacatgccaagggttcgtacttgaaacaaacaccacatacctattcttacaaaatctcaatgaggagggcagacagaaaacyagggcatgttaagtatttatgtaactagaggcaagatcagaggatattaacaatcatctacaggttcctattaactgaattgactttctatgtagctgtctaagagatgacaagaggaacctcagagagagtaggaactttccttctcatgggtgacagcaccaatgacatcagtggatttgccattatttcctcccatttggactatcttgccaaatgtaaattgaccatccttacagacatataatttaataatcctaaaaggataaagcccaaacaccccaagttatccctaaactg

SEQ ID NO: 202163 - DNA, 601 bp, Human
agagaacataactccacagacattccaaagagaaaaattaagtttagcatttttctgaccacaaagtacagaataagcagatttttaggacctacttttgtgtatataatccttattaaaaataaaaggatatcataaaattaaaatatcagtaaacatctgcttttctttatatgttccttaggctaagattataaaatcaaatatgatttttactgaagggaattactagccatcccctaacaaccccatcttttcctcacataagaaaatgcaaattatgtctaatttgtgttcaccratgaatcttatcacttaaaattacaacacagctagagaagcaagagaaggaaaagtagtgaagtgtgtttaaaagttattctttcttaccaatatgttgctgtagaatccaagcgtttgaggcacgagcagagagcatcctttcaacagctggtgcaagtgtcttccaattagtaaactccaaagtgaagataagggtgtcaatgctgactgagtcaatcctatgttagcaagatgttaatataatattagaaacaaaacatgccaagggttcgtacttgaaacaaacaccacataccta

SEQ ID NO: 202164 - DNA, 601 bp, Human
cagggaaacacagaaataaaaagatcaagagagtttcctggggtcctttaaaggatcccttctaggatccagatccatttgtaacactctggatagaattatatatatctaatcattaaaggttcaggacgaactaaagccaagtgcttttatctataagaatttaattacttagacctgaccaggagttggcaaattttttgagtaagacatctattgctatgtggttaggctgatgtttctaagaggtatgtaagaggcacttgattaaaagattgttactgaaactgcaaccactcastaaattttacctggtatacatttcctttctgatgctagaaactttttgaagacaaatctgactcaatgattaaaagatgagaagcaagaaatgcgttgttacttttgtttataaactaccatggcaagttgctacttacttagggaggaaaaaggggaggaaagaataattttgaccaagtacatggcatctccaggacttgaaaagggctcaaataaaaaatgggagaaaaatatttccctagagatacatactgaatactgagtggagctaggaagctaggaattatctaagagttta

SEQ ID NO: 202165 - DNA, 601 bp, Human
tgtaatgactacgtaggaactgcttttactgaattgtactttggtatgataacaacagtccatgtaaaagaaagtcccaagaaaccacagctaccaagacattgtctaggaagctgtaacagcatccaagaaaatctattctgaggaatgggtttattttatcttatgaacccagtcacctagtgtcattgacaacagagctcagagccaaatgtacagcctatcaacagacaagtatcaaattcccattgctacgctttccctgactccattttttatccatctcctaccttttttttttcgtttttcttttccttctacttttaatttctgttttactgttttgtgataatatatatgtattatataaactgttttaaatccttttcaaaacaaagcagggaaacacagaaataaaaagatcaagagagtttcctggggtcctttaaaggatcccttctaggatccagatccatttgtaacactctggatagaattatatatatctaatcattaaaggttcaggacgaactaaagccaagtgcttttatctataagaatttaattacttagacctgaccaggagttggcaaattttttg

SEQ ID NO: 202166 - DNA, 601 bp, Human
ctgtccccccaaataaataaataaataaattaattaattaattaaattaaaaactgagttgagacatacaatatttagagagaactgctcaaaaggcacacaggccatccatttacagatattctaaaatctagctcttggtcaagtcatagcaacagaagtctaggtacctgaaccacactgtaatgactacgtaggaactgcttttactgaattgtactttggtatgataacaacagtccatgtaaaagaaagtcccaagaaaccacagctaccaagacattgtctaggaagctgtaayagcatccaagaaaatctattctgaggaatgggtttattttatcttatgaacccagtcacctagtgtcattgacaacagagctcagagccaaatgtacagcctatcaacagacaagtatcaaattcccattgctacgctttccctgactccattttttatccatctcctaccttttttttttcgtttttcttttccttctacttttaatttctgttttactgttttgtgataatatatatgtattatataaactgttttaaatccttttcaaaacaaagcagggaaacacagaaataaaaa

SEQ ID NO: 202167 - DNA, 601 bp, Human
aggcacagtgtctcatgcctataataccagcactttgggaggctgaggtggaaggatcacttgagcccaggaggagttcaagagcagcccgggtaacatggcgaaaccctgtctcaacaaaaaatacaaaaattagctgggcatggtgccacatggctatgatcccagctactcgggaggctgaggtgggaagattgcttgagcccaggaggtagaggctgcagtgagccatgatcatgccactgcactccagcctggtcaacagaacaagaccctgtccccccaaataaataaataaatwaattaattaattaattaaattaaaaactgagttgagacatacaatatttagagagaactgctcaaaaggcacacaggccatccatttacagatattctaaaatctagctcttggtcaagtcatagcaacagaagtctaggtacctgaaccacactgtaatgactacgtaggaactgcttttactgaattgtactttggtatgataacaacagtccatgtaaaagaaagtcccaagaaaccacagctaccaagacattgtctaggaagctgtaacagcatccaagaaaatctattctgagg

SEQ ID NO: 202168 - DNA, 601 bp, Human
ttactacaagtatgaatcaataacgttaaaaggagcaggggaggaatgttagaggatcttaatgtcttggagaaaatgttggcacatctgtgaagtgtagtatttaggaaaacaagtactaatatgcagtactcatggtgggacagcacggggaggcatggaaagggccagagtatgaagagcccttatatgccttgctagagtttgtcctttactctgggagaaatcgagttcttttacattctcttttttaaggggcatggtatattcaaacacattttatttaacagtgattttcagmataatagaggctgagcactcaggagtatactgaagtcaagtaagtcagaaatgatcattgcaatcaacaaaggcagtagaagaagagatggaataagaagaatggatttggaggataattacaaagtagaactgaccatatatggtaacctatcaactgtaactaatgtttctccagaaatggaagaactttctcatctacaattaaagcagctgcgcaggatcaccaaactaaggaactacttgtccacctttcccccaccagagaaaataaaaaatgtcatcatagaagacagtcttt

SEQ ID NO: 202169 - DNA, 601 bp, Human
tcataaacggtgtttactgaattgaggcatacccggttttttgagggttttgtcatgaagagatgttgaattttatccgatattttttcagcatcaattgaaatgatcatatgggttttgtccttcactttgttgatataacgtaccacactgattgatctgcatatgttgaaccacgcttgcatccctgggatagattccacttggtcatgacgaatgatcttttaaatgtgttgtagaattcggtttgctagtattttgttgagtatcaatattcatcagggatactggcctgtagtgktttttttttggttttgttttgttttgtttttgatgtgtctttgtctggtttgggtatcagggtaatactggcctcatacagtacatttggaaatatttcctcctctatttttcagaatagtttcaggaggattggtattagttcttctttaaatatttggtaaaattcagcagtgaagccatcaggtcctgaactttttttttgctgggaaatttttattacagcttcaatcttattacttgttattggtctgctcaggttttggacttcttcattgttcaatcttggaagattgtatgt

SEQ ID NO: 202170 - DNA, 601 bp, Human
acccaggctggagtgcagtggtgcgatctcggctcactgcaacctccacctctcgggttcaagtgattctcctgcctcaacctcttgagtagctgggattacaggtgcctaccaccacgcccggctaatttttgtatttttagtagagatggggtttcaccatattggccaggctggtctcgaactcctgacctcaggtgatccacccacctcggcctcccaaagtgctgggattacaggtgtgagccactgcgcccagcctgttcactgctggcataaataaatgcgccaatttttgtaygttgattttgtatcctgaaaacttattgaatctgttcatcagttctaataggtttttggtggagtctttaggtttttccaaatataaaatcatatcatctgcaaacaaggacattttgacttcttccattccaacttggatgccctttctttctttctcttgtctgactgctctaactaggacttccactactgtgttgaatcatagtggtgaaagtgggcatctttgtcatgttccagatcttagaggaaaagcttcaagtatttccccctttcactatgatatgagctgtgggtctgt

SEQ ID NO: 202171 - DNA, 601 bp, Human
tgcttttattttgagatggagtcttgctctgtcacccaggctggagtgcagtggtgcgatctcggctcactgcaacctccacctctcgggttcaagtgattctcctgcctcaacctcttgagtagctgggattacaggtgcctaccaccacgcccggctaatttttgtatttttagtagagatggggtttcaccatattggccaggctggtctcgaactcctgacctcaggtgatccacccacctcggcctcccaaagtgctgggattacaggtgtgagccactgcgcccagcctgttcaytgctggcataaataaatgcgccaatttttgtatgttgattttgtatcctgaaaacttattgaatctgttcatcagttctaataggtttttggtggagtctttaggtttttccaaatataaaatcatatcatctgcaaacaaggacattttgacttcttccattccaacttggatgccctttctttctttctcttgtctgactgctctaactaggacttccactactgtgttgaatcatagtggtgaaagtgggcatctttgtcatgttccagatcttagaggaaaagcttcaagtatttc

SEQ ID NO: 202172 - DNA, 601 bp, Human
actgatttcctctcttttgggtatatacccagcagtgggactgctggatcatatggtaggtctatttttagttttttgaggaaactccaaatactttctccccttctgtgggccgtctcttctctttgttgaccgtttcctttgctgtgcatcagaaacttttaaacttgatgtgatcccctatgtccatttttgttttggttgcctgtgcttgtggggtatttctcaagaaacctttgcccagttcaatgtactagagagtttccccaatgttttcttttagtagttagaggtcttaaastctttaatgcatttttatttgatttttgtatatggccagagataggggtctagttttattcttctgcatatggatatccagttttcccagcaccatttaataaagagactgtcctttccccaatgtatgttcttggcacctttgttgaaaatgagttcactgtaggtttctgtatttgtttctgggttctctattctgtttcattggtctatgtgtctgtgtttatgccagtaccaggctgttttagttactatggctttgtagtacaatttgaagtaaggtaatctgattcctccagtt

SEQ ID NO: 202173 - DNA, 601 bp, Human
aatcacagggtttgccctcatgttccgaatgtgtagattagagtgtcttgctgagtatggttcttccattagctaattatctcaaggcacactacatgttaaggacaaggctcactgttaaagtaaaggtgagactatattttaaatattttcttgataattttatatttgtcagttgcaattaggtggtagtcatttttattttagctctttttagctttttaaaatttttattattttattgtatatatttaaagtgtacaatgtgatgttttgtatgcttatgttgatatacctaccataatgaagtgattactacagtcaaacaaacattaatatacccatcatctcatatagttaccttgctggtgtgtgtgtgtgtgtgcatgtgtgtgcctaaaatttactatcttggtaaattaccagtacacaacacagtatttttaactatagttctcatgatctctagaacttcctcatcctacaaaactgcagctttataccctttgacctacatcttttcatttccccacaaccatcccgccttcaacccggtaacccaggtggtcatcatttttatcacataacatgcctggtaaat

SEQ ID NO: 202174 - DNA, 601 bp, Human
tttacttgtgttgtctctctcattgactataactaaaaccgctagaaaaaacacaaaaagcaagtacctgagaactctgaaaaacaagtaatagattaggacatgaagtcaaaacaataggaatggccagtataaaggaatgaccagtagaggcaatgaatggattaaatggaaaagcaccatctagtagtaacacctgtgctggcgctgaggtgccactattaactagctgtgtgaccctgggcaagtcatctaaatattctgactttcagttacctttccataaaatgagaataatgcytcatctacaaaatgggcataatgacacttccctgcatcaaaaggctgttgatgatgttcaagttggaacacatttgcaaaagcatttcataaagtgaaacaccacacaaatcccaggcaccacagaatctagtgatctccaaatgttttgattacacactaaattagtaaagtctctgaccacagaatccaatatatattttacatataaattacatgtatactattaaccaaacattatttgtactataaaataaaataagccaatataaaataagatatatactttaaataatttcat

SEQ ID NO: 202175 - DNA, 601 bp, Human
tcatcattaatatattgtctttctcgttggtatccatccttttgttcccagtttttcttaatttacttgtgttgtctctctcattgactataactaaaaccgctagaaaaaacacaaaaagcaagtacctgagaactctgaaaaacaagtaatagattaggacatgaagtcaaaacaataggaatggccagtataaaggaatgaccagtagaggcaatgaatggattaaatggaaaagcaccatctagtagtaacacctgtgctggcgctgaggtgccactattaactagctgtgtgaccytgggcaagtcatctaaatattctgactttcagttacctttccataaaatgagaataatgcctcatctacaaaatgggcataatgacacttccctgcatcaaaaggctgttgatgatgttcaagttggaacacatttgcaaaagcatttcataaagtgaaacaccacacaaatcccaggcaccacagaatctagtgatctccaaatgttttgattacacactaaattagtaaagtctctgaccacagaatccaatatatattttacatataaattacatgtatactattaaccaaacatta

SEQ ID NO: 202176 - DNA, 601 bp, Human
acccactatattttctacattcatctttagccttccctcaggccaatgttcaaacaacctatctgcctgaactacatttctctggttcctttgaaatgttttgcacatcaaatgcatttatctgacttctgagacacctactaccatttttattttcatcattaatatattgtctttctcgttggtatccatccttttgttcccagtttttcttaatttacttgtgttgtctctctcattgactataactaaaaccgctagaaaaaacacaaaaagcaagtacctgagaactctgaaaaayaagtaatagattaggacatgaagtcaaaacaataggaatggccagtataaaggaatgaccagtagaggcaatgaatggattaaatggaaaagcaccatctagtagtaacacctgtgctggcgctgaggtgccactattaactagctgtgtgaccctgggcaagtcatctaaatattctgactttcagttacctttccataaaatgagaataatgcctcatctacaaaatgggcataatgacacttccctgcatcaaaaggctgttgatgatgttcaagttggaacacatttgcaaaagca

SEQ ID NO: 202177 - DNA, 601 bp, Human
actttactatagcacaaaactatatctatatcatacacacccactatattttctacattcatctttagccttccctcaggccaatgttcaaacaacctatctgcctgaactacatttctctggttcctttgaaatgttttgcacatcaaatgcatttatctgacttctgagacacctactaccatttttattttcatcattaatatattgtctttctcgttggtatccatccttttgttcccagtttttcttaatttacttgtgttgtctctctcattgactataactaaaaccgctagaraaaacacaaaaagcaagtacctgagaactctgaaaaacaagtaatagattaggacatgaagtcaaaacaataggaatggccagtataaaggaatgaccagtagaggcaatgaatggattaaatggaaaagcaccatctagtagtaacacctgtgctggcgctgaggtgccactattaactagctgtgtgaccctgggcaagtcatctaaatattctgactttcagttacctttccataaaatgagaataatgcctcatctacaaaatgggcataatgacacttccctgcatcaaaaggct

SEQ ID NO: 202178 - DNA, 601 bp, Human
tttgttaaaatcaaaagcacacacaatgatcaaaataaacgtcacaattcttaattcattatgcttataaatgccaactttactatagcacaaaactatatctatatcatacacacccactatattttctacattcatctttagccttccctcaggccaatgttcaaacaacctatctgcctgaactacatttctctggttcctttgaaatgttttgcacatcaaatgcatttatctgacttctgagacacctactaccatttttattttcatcattaatatattgtctttctcgttggtwtccatccttttgttcccagtttttcttaatttacttgtgttgtctctctcattgactataactaaaaccgctagaaaaaacacaaaaagcaagtacctgagaactctgaaaaacaagtaatagattaggacatgaagtcaaaacaataggaatggccagtataaaggaatgaccagtagaggcaatgaatggattaaatggaaaagcaccatctagtagtaacacctgtgctggcgctgaggtgccactattaactagctgtgtgaccctgggcaagtcatctaaatattctgactttca

SEQ ID NO: 202179 - DNA, 601 bp, Human
cctatgaaagttttagtgatgcatagttatttccagacgtgttgccactaggctagaagatcaagccatgccttgaatttataatacgaaaaaggccacagaagctgtatgtaaaacatactttcatgaaaacctattaaaactatattttagttttgttaaatacatctccatgttcttggattatggcagtgattgtaacctagaaaatgacgtctgaaaccatgctacacttctaagtcacttttctgacccaatcatttttattcaatatgttaaacttagtttatccatagatctrttagcagatgagtaatatttaacttttaattcctatacagaattcctctattttgttcattttgttatatgtactggcagaacaatcaaaatagaagactacatgttgttatacaaagttttgttaaaatcaaaagcacacacaatgatcaaaataaacgtcacaattcttaattcattatgcttataaatgccaactttactatagcacaaaactatatctatatcatacacacccactatattttctacattcatctttagccttccctcaggccaatgttcaaacaacctatctgcc

SEQ ID NO: 202180 - DNA, 601 bp, Human
gagaaaatgacaagactgtttaatccagtgtgtgtttttaaagagaatttctacttatattcagttagagtttaacaggcatctgttaaattgaatctcttcattctgcacattcttaggaacatgaatacttactacacaaccagaaggaagataaaggatggctgtgcaacccggaggagagctgctcacatggagataagggatccttaatgatgctccagcttctcagagtggacagactacactggcttaaaattctatgggctgactgggaagattcctccagataccctaaaasttaatgtagtgctgaccagcttttctagattatgtgactacatcactggaggtctatctttaaagcttaataaatcatttgtttatgctaattatgtgtagaagcttaaccattagtgatcaagccacactagaccagttcgcatttgttaggagaagcgtaactgacttgcccactgagatgtggcacatcaacaacatagctgttgttaactagatctcaatgatttgactcccagtccagggttctttaaactatgataagctcaatataattctccaacatcttctaaaccactga

SEQ ID NO: 202181 - DNA, 601 bp, Human
gccagagcattcttgctgtagtccatttgcagaactgtgcagttcaattccatatccactaggtgatagtattgttccatctggtgcatcatgggcacttgaacagtggtggtcttgtctattaagaagctggaactgtcttctgtcttggatggatcaaaaggatttgcccactgggcttaaaatacaaagaaaagagaggtgtttattttaaaccggtatcagtaccaacaagaccttttccattagtgatttcatttagaaattaagatcaccacagagttaggtacctacagtcaaycagttttacaagtgactgaggatcaggcagagaaagtcatttgtcatggtctcccagttaacaggtggcagagccaggaatcatacccagggctgttgggctccacagtctgtattcaaaactactataccacactaagcccatcagagccatagtttcctcttccataaaaaggtataacgacatccaacacactagggagaagtgagaaaacagatctgttctgcaattttagccaatctatctatgtgtggtttgtggccgacaattgattactcctccaagaaatgtggctgacat

SEQ ID NO: 202182 - DNA, 601 bp, Human; identical to SEQ ID NO: 20675

SEQ ID NO: 202183 - DNA, 601 bp, Human; identical to SEQ ID NO: 20676

SEQ ID NO: 202184 - DNA, 601 bp, Human; identical to SEQ ID NO: 20677

SEQ ID NO: 202185 - DNA, 601 bp, Human; identical to SEQ ID NO: 20678

SEQ ID NO: 202186 - DNA, 601 bp, Human; identical to SEQ ID NO: 20679

SEQ ID NO: 202187 - DNA, 601 bp, Human; identical to SEQ ID NO: 20680

SEQ ID NO: 202188 - DNA, 601 bp, Human; identical to SEQ ID NO: 20681

SEQ ID NO: 202189 - DNA, 601 bp, Human; identical to SEQ ID NO: 20682

SEQ ID NO: 202190 - DNA, 601 bp, Human; identical to SEQ ID NO: 20683

SEQ ID NO: 202191 - DNA, 601 bp, Human; identical to SEQ ID NO: 20684

SEQ ID NO: 202192 - DNA, 601 bp, Human; identical to SEQ ID NO: 20685

SEQ ID NO: 202193 - DNA, 601 bp, Human
ggtgatggatagagagagggtggaagagaacaggcatttctttggcgtcggttactgtcgtcttgtcactgtgctaggcattttacttacctttagaaagcagaccagaaagcaagaggtcagggaatcatggtaataatagtaataactaacggccgggcgcagtggctcatgccttaatgccagcactttgggaggcctaggtgggtggatcacctgaggtcgggagttcgagaccagggcctggccaacatggtgaaaccacatctctactaaaaatacaaatattagccgggcgtgrtggcacgtgactgtaatcccagctactcaggaggctgaggcaggagaatcgctggaacttgggaggcggagattgcactgaacagtgattgcgccactgcactccagcctgggcgacagagagagactctgtctcaaaaataataataataatagctaacatgttatactgcctgcctgtgctagggacttgcatgtatcaaatcatttagtctcacctaacaactgtgcaaggcaggtacaatgtccattttacacataaggaaactgaggcccagagacttacagtagtaattgggcc

SEQ ID NO: 202194 - DNA, 601 bp, Human
ggcctaggtgggtggatcacctgaggtcgggagttcgagaccagggcctggccaacatggtgaaaccacatctctactaaaaatacaaatattagccgggcgtggtggcacgtgactgtaatcccagctactcaggaggctgaggcaggagaatcgctggaacttgggaggcggagattgcactgaacagtgattgcgccactgcactccagcctgggcgacagagagagactctgtctcaaaaataataataataatagctaacatgttatactgcctgcctgtgctagggacttgcatrtatcaaatcatttagtctcacctaacaactgtgcaaggcaggtacaatgtccattttacacataaggaaactgaggcccagagacttacagtagtaattgggccaaggccttgcataactagtagagccaggatttgaacccagctgacagactcagaagctctgacttccccctgctggtggaaacacccagccttgagagcaaggggctggatgttggaagaaagtagagaagaattagctggagataagtttggggaatgtgtggttaccctcggttctgccctcccatcccccaca

SEQ ID NO: 202195 - DNA, 601 bp, Human
actgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagaggtgactccccacctactttcagacctgcctagattcaagttgggcagtgggttaaaatgtctgagaaatggtcgtcccgtaggtcagggagacctgggagctgaggacatctggaggacagtaatgaatgtcagcttccttttttttttttttttttctccccaaactcttaaagaagttcttgtttaccacttggttttgctcacgtgcaacacctgcctcactcacgtgtccctttgggccctgtcttgccccactgcgcatgtcccttgcagtcaaaggtcctgccctacttttcctaacacacacgcacacacacaccctttccggttccttctcctcggagcaggtaaattacttggctcaggtttttgctgagtcaaacttaggaggtcagagggcaggaaggaaaaagcatgcgttctttgcatgtttttaagacagcacaaagaggcag

SEQ ID NO: 202196 - DNA, 601 bp, Human
agatgtgcagcttcctggagtggagggacctcaaagttgtctataagaggtgactccccacctactttcagacctgcctagattcaagttgggcagtgggttaaaatgtctgagaaatggtcgtcccgtaggtcagggagacctgggagctgaggacatctggaggacagtaatgaatgtcagcttccttttttttttttttttttctccccaaactcttaaagaagttcttgtttaccacttggttttgctcacgtgcaacacctgcctcactcacgtgtccctttgggccctgtcttgycccactgcgcatgtcccttgcagtcaaaggtcctgccctacttttcctaacacacacgcacacacacaccctttccggttccttctcctcggagcaggtaaattacttggctcaggtttttgctgagtcaaacttaggaggtcagagggcaggaaggaaaaagcatgcgttctttgcatgtttttaagacagcacaaagaggcaggtgagttactctttacatgccctagggccacctcacctgtggccagccagggcacagaccacctccaggctggtgagaggtttgagaccagaatg

SEQ ID NO: 202197 - DNA, 601 bp, Human
gtcctgccctacttttcctaacacacacgcacacacacaccctttccggttccttctcctcggagcaggtaaattacttggctcaggtttttgctgagtcaaacttaggaggtcagagggcaggaaggaaaaagcatgcgttctttgcatgtttttaagacagcacaaagaggcaggtgagttactctttacatgccctagggccacctcacctgtggccagccagggcacagaccacctccaggctggtgagaggtttgagaccagaatgcctgggtcctgaagcaagcttgtagcgatrtctcatgcgctcctctccgcagatatgccagcctctacttctgctgcgccatcgagggccaagacaatgagctcatcacactggagctgatccaccgatacgtggagctcttagacaaatactttggcagtgtaagtctcctctgcccaccagtttccattcccagcaatcccctttggtaatccaccaaactttgaggcccctccagtctctgccctggaagtttcaggggagaggtgaagttggagcagtaagaacagtaattaatttccctttttaagctttaagcctattaaccat

SEQ ID NO: 202198 - DNA, 601 bp, Human
ctctaactctggggctcaagtgatcctcccacctcagcctcccaaagtctgggattataggcgtgagccactgtacccagccccatattcagatttttatcactggttgctgatcttggatttgcattggagttttctggagaatttttttgaatggcaatgtccaggttccactcccagagattctgaattaacttatctgagggacagctcagatcttagatggggcgtagtagtaactccataatttgtgttataaagtgcttttgcgtcctctcgtttgctccttatcccatcctakcagtaggtgttggtatccccatttttgaggccagaaaactgagacttagagatgtttcatgacttgtttagctagatggttagtggcagagccctgcttggaactcaagtcttccaccccatggtccagaattccctctttccctgccccacagtgtccaggaagcggggctaccacagcctttggtgggaagaacgtcacagattttggggggaaggcaaggggaaccatagacaaaggtagataaggcaactaatgtttcatgatcaggaggaaagatgcaagaggaagagggaaaaa

SEQ ID NO: 202199 - DNA, 601 bp, Human
agagatgtttcatgacttgtttagctagatggttagtggcagagccctgcttggaactcaagtcttccaccccatggtccagaattccctctttccctgccccacagtgtccaggaagcggggctaccacagcctttggtgggaagaacgtcacagattttggggggaaggcaaggggaaccatagacaaaggtagataaggcaactaatgtttcatgatcaggaggaaagatgcaagaggaagagggaaaaaaactgatccaaggcaaggcgcggtggctcacgcctgtgatcccagcawtttgggaagctgaggcaggtgggtcacttgaggccagaagttcgagaccagcctggccaacatggcaagaccctatctctacaaaatattttaaaaatgaggtgggcgtgatagcatgcacctgtagtcccagctactcaggaagctgaggcaggaggatcacttgagcccaggagtttgaggctgcagtgagctgtgatcatgccactgcactgcagcctggacgacagagcaagagaccctgtctctaacaaaataacgaaacaaaaaaactgaaaaagctgaccaatgactaaggct

SEQ ID NO: 202200 - DNA, 601 bp, Human
cagggacagtgaggaggaggaggaagcgcacagtggcggacagggtcctccctcccctggacacccggcctgccctgcccaccgtcgccaaggagccccccctccctgtggtatctgacccccaccacgcccagctctccagcttactctcaagccctgaccccatggggtgggaggtagggtggcagatagcccacctgtgcacccctcattccaagctctgtccttctcccaagcccccagatgtctcgtggccacccagtctcctttgtccaattctctgagcaaggcttaacaccaragggttaagggtttgctctggagttaagggttgcttggagaattggagaaggggcacctggtaggtcattcttttcttccctgatttcttcccccacctctcttttttttttcttttttttttttttaacacacacatactccaaagcctctgcgtctcaggaggaaaaggctatggggatttgggggctggcagagggcacctggatgttggttctccctgctccccagcgcccccgccctcaccccattactgcctgccccctctctgctgtgccatcaccgagccctggtgcaggga

SEQ ID NO: 202201 - DNA, 601 bp, Human
tcttccctgatttcttcccccacctctcttttttttttcttttttttttttttaacacacacatactccaaagcctctgcgtctcaggaggaaaaggctatggggatttgggggctggcagagggcacctggatgttggttctccctgctccccagcgcccccgccctcaccccattactgcctgccccctctctgctgtgccatcaccgagccctggtgcagggagatgagtcaccggaatctgcagtgatgagcgagcccggcctgagctggctctgaggagggggagagatggggggygagggagggctcatctttgcagtgggagagagggcagaactgaacttgccacctcactggtcgagcttcaccttcccacacacgcacacacacacaccctggcgcacacacacacacacacacacacatgccctggcacacacacccatcgtgtcaccagtgttgcgctcagaccctaatgacgcatctccctgcagcctggttcaccttccctcagggacctggcactcacctccctctgccttttccccactctgaaaaacaggacccagtcagctgtaccccccagggccccagaaa

SEQ ID NO: 202202 - DNA, 601 bp, Human
ccccacctctcttttttttttcttttttttttttttaacacacacatactccaaagcctctgcgtctcaggaggaaaaggctatggggatttgggggctggcagagggcacctggatgttggttctccctgctccccagcgcccccgccctcaccccattactgcctgccccctctctgctgtgccatcaccgagccctggtgcagggagatgagtcaccggaatctgcagtgatgagcgagcccggcctgagctggctctgaggagggggagagatggggggcgagggagggctcatctytgcagtgggagagagggcagaactgaacttgccacctcactggtcgagcttcaccttcccacacacgcacacacacacaccctggcgcacacacacacacacacacacacatgccctggcacacacacccatcgtgtcaccagtgttgcgctcagaccctaatgacgcatctccctgcagcctggttcaccttccctcagggacctggcactcacctccctctgccttttccccactctgaaaaacaggacccagtcagctgtaccccccagggccccagaaagatcccccacctccttg

SEQ ID NO: 202203 - DNA, 601 bp, Human
tctcaggaggaaaaggctatggggatttgggggctggcagagggcacctggatgttggttctccctgctccccagcgcccccgccctcaccccattactgcctgccccctctctgctgtgccatcaccgagccctggtgcagggagatgagtcaccggaatctgcagtgatgagcgagcccggcctgagctggctctgaggagggggagagatggggggcgagggagggctcatctttgcagtgggagagagggcagaactgaacttgccacctcactggtcgagcttcaccttcccacayacgcacacacacacaccctggcgcacacacacacacacacacacacatgccctggcacacacacccatcgtgtcaccagtgttgcgctcagaccctaatgacgcatctccctgcagcctggttcaccttccctcagggacctggcactcacctccctctgccttttccccactctgaaaaacaggacccagtcagctgtaccccccagggccccagaaagatcccccacctccttgtcccggcttcactccctttacccccaggtgtcaaggcggggcccctgcttaccaaggtcctggc

SEQ ID NO: 202204 - DNA, 601 bp, Human
gctatggggatttgggggctggcagagggcacctggatgttggttctccctgctccccagcgcccccgccctcaccccattactgcctgccccctctctgctgtgccatcaccgagccctggtgcagggagatgagtcaccggaatctgcagtgatgagcgagcccggcctgagctggctctgaggagggggagagatggggggcgagggagggctcatctttgcagtgggagagagggcagaactgaacttgccacctcactggtcgagcttcaccttcccacacacgcacacacacaccccctggcgcacacacacacacacacacacacatgccctggcacacacacccatcgtgtcaccagtgttgcgctcagaccctaatgacgcatctccctgcagcctggttcaccttccctcagggacctggcactcacctccctctgccttttccccactctgaaaaacaggacccagtcagctgtaccccccagggccccagaaagatcccccacctccttgtcccggcttcactccctttacccccaggtgtcaaggcggggcccctgcttaccaaggtcctggctttgggttctctggg

SEQ ID NO: 202205 - DNA, 601 bp, Human
gatttgggggctggcagagggcacctggatgttggttctccctgctccccagcgcccccgccctcaccccattactgcctgccccctctctgctgtgccatcaccgagccctggtgcagggagatgagtcaccggaatctgcagtgatgagcgagcccggcctgagctggctctgaggagggggagagatggggggcgagggagggctcatctttgcagtgggagagagggcagaactgaacttgccacctcactggtcgagcttcaccttcccacacacgcacacacacacaccctggcrcacacacacacacacacacacacatgccctggcacacacacccatcgtgtcaccagtgttgcgctcagaccctaatgacgcatctccctgcagcctggttcaccttccctcagggacctggcactcacctccctctgccttttccccactctgaaaaacaggacccagtcagctgtaccccccagggccccagaaagatcccccacctccttgtcccggcttcactccctttacccccaggtgtcaaggcggggcccctgcttaccaaggtcctggctttgggttctctgggtggtgacg

SEQ ID NO: 202206 - DNA, 601 bp, Human
atttgggggctggcagagggcacctggatgttggttctccctgctccccagcgcccccgccctcaccccattactgcctgccccctctctgctgtgccatcaccgagccctggtgcagggagatgagtcaccggaatctgcagtgatgagcgagcccggcctgagctggctctgaggagggggagagatggggggcgagggagggctcatctttgcagtgggagagagggcagaactgaacttgccacctcactggtcgagcttcaccttcccacacacgcacacacacacaccctggcggacacacacacacacacacacacatgccctggcacacacacccatcgtgtcaccagtgttgcgctcagaccctaatgacgcatctccctgcagcctggttcaccttccctcagggacctggcactcacctccctctgccttttccccactctgaaaaacaggacccagtcagctgtaccccccagggccccagaaagatcccccacctccttgtcccggcttcactccctttacccccaggtgtcaaggcggggcccctgcttaccaaggtcctggctttgggttctctgggtggtgacgg

SEQ ID NO: 202207 - DNA, 601 bp, Human
ctggatgttggttctccctgctccccagcgcccccgccctcaccccattactgcctgccccctctctgctgtgccatcaccgagccctggtgcagggagatgagtcaccggaatctgcagtgatgagcgagcccggcctgagctggctctgaggagggggagagatggggggcgagggagggctcatctttgcagtgggagagagggcagaactgaacttgccacctcactggtcgagcttcaccttcccacacacgcacacacacacaccctggcgcacacacacacacacacacacacctgccctggcacacacacccatcgtgtcaccagtgttgcgctcagaccctaatgacgcatctccctgcagcctggttcaccttccctcagggacctggcactcacctccctctgccttttccccactctgaaaaacaggacccagtcagctgtaccccccagggccccagaaagatcccccacctccttgtcccggcttcactccctttacccccaggtgtcaaggcggggcccctgcttaccaaggtcctggctttgggttctctgggtggtgacggactcaacctggaccccccctgcc

SEQ ID NO: 202208 - DNA, 601 bp, Human
agagggcagaactgaacttgccacctcactggtcgagcttcaccttcccacacacgcacacacacacaccctggcgcacacacacacacacacacacacatgccctggcacacacacccatcgtgtcaccagtgttgcgctcagaccctaatgacgcatctccctgcagcctggttcaccttccctcagggacctggcactcacctccctctgccttttccccactctgaaaaacaggacccagtcagctgtaccccccagggccccagaaagatcccccacctccttgtcccggcttcamtccctttacccccaggtgtcaaggcggggcccctgcttaccaaggtcctggctttgggttctctgggtggtgacggactcaacctggaccccccctgccactgttggctggctctggggctggccctgggaggctggtgggtgccccatgaagggctcactggtccggccttgggctcacattggcttctctccccctcccccgtgtctgtgcctcccccgtctgactcttcctcgtgactgctgtcttgcccaccctgtcggcctctcctggtgtctctgcgtcaccctctgtctgtct

SEQ ID NO: 202209 - DNA, 601 bp, Human
gtcaccagtgttgcgctcagaccctaatgacgcatctccctgcagcctggttcaccttccctcagggacctggcactcacctccctctgccttttccccactctgaaaaacaggacccagtcagctgtaccccccagggccccagaaagatcccccacctccttgtcccggcttcactccctttacccccaggtgtcaaggcggggcccctgcttaccaaggtcctggctttgggttctctgggtggtgacggactcaacctggaccccccctgccactgttggctggctctggggctggycctgggaggctggtgggtgccccatgaagggctcactggtccggccttgggctcacattggcttctctccccctcccccgtgtctgtgcctcccccgtctgactcttcctcgtgactgctgtcttgcccaccctgtcggcctctcctggtgtctctgcgtcaccctctgtctgtctctgccttaggaggatgagtcgccacggagtgtgctggaggagatgggtttggcatagcccctgctgggccggggtgtggcgatggggtcctggcagcgtggcgggaacggctgcttctcctctg

SEQ ID NO: 202210 - DNA, 601 bp, Human
tcaccagtgttgcgctcagaccctaatgacgcatctccctgcagcctggttcaccttccctcagggacctggcactcacctccctctgccttttccccactctgaaaaacaggacccagtcagctgtaccccccagggccccagaaagatcccccacctccttgtcccggcttcactccctttacccccaggtgtcaaggcggggcccctgcttaccaaggtcctggctttgggttctctgggtggtgacggactcaacctggaccccccctgccactgttggctggctctggggctggcyctgggaggctggtgggtgccccatgaagggctcactggtccggccttgggctcacattggcttctctccccctcccccgtgtctgtgcctcccccgtctgactcttcctcgtgactgctgtcttgcccaccctgtcggcctctcctggtgtctctgcgtcaccctctgtctgtctctgccttaggaggatgagtcgccacggagtgtgctggaggagatgggtttggcatagcccctgctgggccggggtgtggcgatggggtcctggcagcgtggcgggaacggctgcttctcctctgc

SEQ ID NO: 202211 - DNA, 601 bp, Human
ctcacctccctctgccttttccccactctgaaaaacaggacccagtcagctgtaccccccagggccccagaaagatcccccacctccttgtcccggcttcactccctttacccccaggtgtcaaggcggggcccctgcttaccaaggtcctggctttgggttctctgggtggtgacggactcaacctggaccccccctgccactgttggctggctctggggctggccctgggaggctggtgggtgccccatgaagggctcactggtccggccttgggctcacattggcttctctccccctyccccgtgtctgtgcctcccccgtctgactcttcctcgtgactgctgtcttgcccaccctgtcggcctctcctggtgtctctgcgtcaccctctgtctgtctctgccttaggaggatgagtcgccacggagtgtgctggaggagatgggtttggcatagcccctgctgggccggggtgtggcgatggggtcctggcagcgtggcgggaacggctgcttctcctctgcccagggccctgttcttggtgggactcggctgcccctcctctgctgcctcacctttcggagtgagctgtgggctc

SEQ ID NO: 202212 - DNA, 601 bp, Human
attcctaaaagcaggttgaaactgcatctacctcaacattattttatttgagtagtgatgttattgcttaggatgatgctggagttaaatttttaagtgtgcttatctatagaaaatatattaaaatatgtattaaaataaacaacagtgcacacaatatacaaatatggccaaaattttggatatgagatattttggcaactcttggctagatcattctgagaccccctctgtttctgaggctctaccttctccatcaattacagctgttgtttgagtgtttatgtgatgggggccatcygcagggttttatgcaaatcacctccttgaattctcacaagaagcctggaagcaggccttgctgtttccactttacaaggctcagagagggcaagggactggcccggagccacacagctggtcatctgaaccttcctggccccccagcctgtgccctgccccagggttctttgatggctctgtgagggaggtcagagggaactatggatggggccagagtaggatctttgggaaccccggcacagaggaggaggatcttccccttgtggagtcagggatggcgtctggagaaagccatgcc

SEQ ID NO: 202213 - DNA, 601 bp, Human
ttcctaaaagcaggttgaaactgcatctacctcaacattattttatttgagtagtgatgttattgcttaggatgatgctggagttaaatttttaagtgtgcttatctatagaaaatatattaaaatatgtattaaaataaacaacagtgcacacaatatacaaatatggccaaaattttggatatgagatattttggcaactcttggctagatcattctgagaccccctctgtttctgaggctctaccttctccatcaattacagctgttgtttgagtgtttatgtgatgggggccatctscagggttttatgcaaatcacctccttgaattctcacaagaagcctggaagcaggccttgctgtttccactttacaaggctcagagagggcaagggactggcccggagccacacagctggtcatctgaaccttcctggccccccagcctgtgccctgccccagggttctttgatggctctgtgagggaggtcagagggaactatggatggggccagagtaggatctttgggaaccccggcacagaggaggaggatcttccccttgtggagtcagggatggcgtctggagaaagccatgcct

SEQ ID NO: 202214 - DNA, 601 bp, Human
ctttggatttattattcagtaagaagccaatttattgatggctgggtgcagtggctcatgcctgtaattccagcactttgagaggctgaggtgggtggatcacctgtggccaggagttcgagaccagcctagtccacatggcaaaaccctgtctctactaaaaatacaaaaattagccaggcgtggtggcggccacctgtattcccagctacttgggaagctgaggcaggagaatcgcttgaacctgggaggtagaggttgcagtgagccaagatcgggccactgcactccagcctgggcratagagtgagactttgtctaaaaaataaacataaaaaagccaatttactggcttttttttacaacatggatgtttataggaaggaagatccaaaattgctcctcagcagatccccctttccaaactagttttttctccttttctctctcccttcctctctttttccctccctctttctttgttagatagataaatacacaagtttaatttcacacacaatgctacatcaataggctcagcaagggcaaaatagtcagcagtctcctccctctttaaattcaccttgtgctgggcgtggtg

SEQ ID NO: 202215 - DNA, 601 bp, Human
attgatggctgggtgcagtggctcatgcctgtaattccagcactttgagaggctgaggtgggtggatcacctgtggccaggagttcgagaccagcctagtccacatggcaaaaccctgtctctactaaaaatacaaaaattagccaggcgtggtggcggccacctgtattcccagctacttgggaagctgaggcaggagaatcgcttgaacctgggaggtagaggttgcagtgagccaagatcgggccactgcactccagcctgggcgatagagtgagactttgtctaaaaaataaacataaaaaagccaatttactggcttttttttacaacatggatgtttataggaaggaagatccaaaattgctcctcagcagatccccctttccaaactagttttttctccttttctctctcccttcctctctttttccctccctctttctttgttagatagataaatacacaagtttaatttcacacacaatgctacatcaataggctcagcaagggcaaaatagtcagcagtctcctccctctttaaattcaccttgtgctgggcgtggtgactcatgcctgtcatcccagcactttgagaggc

SEQ ID NO: 202216 - DNA, 601 bp, Human
ctcctcagcagatccccctttccaaactagttttttctccttttctctctcccttcctctctttttccctccctctttctttgttagatagataaatacacaagtttaatttcacacacaatgctacatcaataggctcagcaagggcaaaatagtcagcagtctcctccctctttaaattcaccttgtgctgggcgtggtgactcatgcctgtcatcccagcactttgagaggccgaggtaggaggatcatgtgatcccaggagtttgagaccagcctgggcaacatagcaagatgccgyctctacaaaaatgttttaaaaattagccaggcgtggtggcacgtgcctttggtcccagctactcgggaggctgatgcaggaggatcgcttgagcccaggaggttgaggctgcagtgagccgtgattgcgccattgcactccagcctgggcaacagaacatgaccccatctctaaaaatattaaaataaaataataaaacaaattcactttgcatttgtgacgtgatggggcgggggcaggaagaaggtgggagaagggattcttggggtgaatctgccatttctaagaggtgggagttct

SEQ ID NO: 202217 - DNA, 601 bp, Human
tactcgggaggctgatgcaggaggatcgcttgagcccaggaggttgaggctgcagtgagccgtgattgcgccattgcactccagcctgggcaacagaacatgaccccatctctaaaaatattaaaataaaataataaaacaaattcactttgcatttgtgacgtgatggggcgggggcaggaagaaggtgggagaagggattcttggggtgaatctgccatttctaagaggtgggagttcttggggtcatccacaggcccctcgggatcttgcatttttcttaagacagttccaagaatcrggggcaagtctgcctgggaagagacaggatgagggggaggccgggggagccctgagcccgcctggctcaccctccactgtacgtctcttgcaggcccgtgggagtcagcatgccgcgtggctgggccgcccccttgctcctgctgctgctccagggaggtaagtggctgccccgtggtctgcgggtggggagggcccccatcacagagctgagccagggccgggctggctttctgggctcaaaaacacggctagagtccacagattcagaaaagatgacatccatgcccttgaggctgac

SEQ ID NO: 202218 - DNA, 601 bp, Human
tgacatccatgcccttgaggctgacacgagtccagtagccggctctccactaatcagaatccatccaccaaagggctccatgaaacagaagcggtagacatgagtctcaggtggcccagcccacaggcttgtgtcttcgggtgtcactggggggatgaaaggcttcgtccttcatttcccctgacctctgccttggctggctcccaactctctgagtgaggaagttctgccttccatctaacctcagtttctccttatgtaatgactctccttggaaatgtttttcaacaattgctgcacygggtgcggtggctcctactggaatcccagccctttgggaggctgaggagggtaggtcgcttgagctcaggatctcaagaccagcctgggcaacatggtgaagccctgtctctacaaaagaaaaaaaattagccaggcataggagcgcatgcttgtagtctcagctttttgtggggctgaggcgggaggattgcttgagcctgggaggtggaggttacagtgagtcaaggtgacaactgtactccagcctgggcaacagagcgagaccctgtctcaaaacaacagcaacaacaacaacaat

SEQ ID NO: 202219 - DNA, 601 bp, Human
taagagatcctggagggcttcctggaggagggggccatgaggaggcgggatccagcacagacttgtgtggaggccggcctaggggcaggggaggaactcaacagctgctctgctgactcatgggcatttttctctggtttttaccagaagacccaggacctcaaatagctccttcaggaaacagatgtcaagctttgattttccctttctgagtggcaagcatcctcatcttggttctaaaaagcctttgggtcacccaccatggctccacatctggcgggtgcagataacaagccctggytgcatgcaaagctcggagcgtcatcccattccactgtcccaacagccccacaaggcgcatgttgtaatgacgcccagttttttggctgaggaggctcagagaggctaagagacaggtgcatggccacactacccggaagaggcagagctgggatcagtttgctcttggggtctgtcttagtctgtctgtgctgctgtgactgaatacgtgagactgggtaatttataaataatagacatttactgctcgcagttctggaggctgggaagtccaagatcaaggcaccagcagtagctttga

SEQ ID NO: 202220 - DNA, 601 bp, Human
gatccacccgcctcggcctcccaaaagtgctgggattaccgcacccagcccccatctttgcctttaagatgccacattgaacgctgcaccccccccagaggggacacacgctgcatcctcacatggcagaagggcaaaaagggtctgaatgttgggttcgtccagccctcttatagcatcaataattcattcaggggggctctgcccccatgacttaatcatctcctagagtccccaccttttaatatgatcacattggcaactgagtttctggggagacacagacgtcaaaccgtagcayggccttcaccatgctgtgctgctatctgtggagtgatagccatgtgcgggcagcatgcaggcacaggcatgatctcatctcaacacctcaacagcctctagggcaagcagtgtctccggcttacacatggggaggagaagcagttttgagtcacatgtttgcagtcacagagctactttgtgcacctctcactgcctcctgcacgctttcataaccccagacatgggatggccctggggctctctgccctgtggctggggtactgacagggcattttcccaccctctcatccctggtgcc

SEQ ID NO: 202221 - DNA, 601 bp, Human
gtgctgctatctgtggagtgatagccatgtgcgggcagcatgcaggcacaggcatgatctcatctcaacacctcaacagcctctagggcaagcagtgtctccggcttacacatggggaggagaagcagttttgagtcacatgtttgcagtcacagagctactttgtgcacctctcactgcctcctgcacgctttcataaccccagacatgggatggccctggggctctctgccctgtggctggggtactgacagggcattttcccaccctctcatccctggtgccacctccctgccactcrggggctgccgttgcctccccaagtttggagacaaaccctgtcccttggtagctttgagcctggctaggaatggtagctcctctccaaattcccagagctctgagaaagaaccacgaggatacgaactcagagatgacacagctacttagaggctctgtgttgaggttttgccaaaatcagtcctgttttctccaccaagtgctggaactagctccttttcactccaccgacaagttctgtgtgtctccctgaggaaagccccctcctagagcaagatttacttccatgactcagatccct

SEQ ID NO: 202222 - DNA, 601 bp, Human
attagcaatatctgtcatgtgtgcggctatgaaaaactagcacagactaggtatttccttccctgggtgagtgtctcagcagcccagaccaagagagacaagaggcatggtctagtcttggagcctcagtgttctcatctctacaatgaactaaaggatatttccagacacagtattcttggctccgcatataggttctgtcctagagtgagacccaggaagggaatctaccaccaccacctcaggggtcttcattagtccagggaaaataggaaaaagccaccaaaaatgaacctacttraaaaggggaacaaggtcaggcacgatggctcattcttacaatcccagcactttgggaggctgaggcaggtggatcgcttgagctcaggagattgagaccagcctgggcaacatggtgaaaccctgtctctacaaaaacacaaaaattatccaggcatggtggtgcacaactgtagtctcagctactcaggaagttgaagtgggaggactgcttgagcctaggaggtggaggctgcagtgagctgagatcgcaccactgcattccagcctgggcaacagagcaagagatcctatctcaaaa

SEQ ID NO: 202223 - DNA, 601 bp, Human
aagggaatctaccaccaccacctcaggggtcttcattagtccagggaaaataggaaaaagccaccaaaaatgaacctacttaaaaaggggaacaaggtcaggcacgatggctcattcttacaatcccagcactttgggaggctgaggcaggtggatcgcttgagctcaggagattgagaccagcctgggcaacatggtgaaaccctgtctctacaaaaacacaaaaattatccaggcatggtggtgcacaactgtagtctcagctactcaggaagttgaagtgggaggactgcttgagccyaggaggtggaggctgcagtgagctgagatcgcaccactgcattccagcctgggcaacagagcaagagatcctatctcaaaaagaggtgagcggtacaagtttctagtaaatagcagcaaaaaatagtggaattggcactcgaatatacaaaacaaagctacaaattattccattgattttgtccacatttaacaaaatgtagatgatgattgcacccctgttttagaacacagcgaaacaattaatgtttggggagcaggatggaaaggtgttaaatcttccaacaaaattgcctcatag

SEQ ID NO: 202224 - DNA, 601 bp, Human
agcaagagatcctatctcaaaaagaggtgagcggtacaagtttctagtaaatagcagcaaaaaatagtggaattggcactcgaatatacaaaacaaagctacaaattattccattgattttgtccacatttaacaaaatgtagatgatgattgcacccctgttttagaacacagcgaaacaattaatgtttggggagcaggatggaaaggtgttaaatcttccaacaaaattgcctcatagggcaatacctagaagacttcttggtggcggtggcatttttggccgcaggatcacgcagamctttatgcaaaagtgtccgagggctttttaattctctcacggtttcctactccttgaagcacttcctgaatctccgagagtgggtgtcctgtggatccaacttctgtagagccgagacctcttccttgtcagggttttgggacattttcagcatagctgtccttgactctatgaggtcctgaccctcttggggtgtgtgcgtgtgctctggctgggttcctaccacatctggggcatttaggatattgccattctgagtgggagcttggccaggagggacacagacctggtggccgggcg

SEQ ID NO: 202225 - DNA, 601 bp, Human
gatcacgcagacctttatgcaaaagtgtccgagggctttttaattctctcacggtttcctactccttgaagcacttcctgaatctccgagagtgggtgtcctgtggatccaacttctgtagagccgagacctcttccttgtcagggttttgggacattttcagcatagctgtccttgactctatgaggtcctgaccctcttggggtgtgtgcgtgtgctctggctgggttcctaccacatctggggcatttaggatattgccattctgagtgggagcttggccaggagggacacagacctsgtggccgggcgcagggctctggaggagggtgctgagctggggaccagctagttttatattatttgccatcacatgcatcctgtcttcatagccagccttgaaacattggtgctcaaacaaggaatttccaggtggtgaggccccctgggtgccaggcctacatctaagcagctcctgagtcctcatatttgtcccggcctggggacccctgcacccattcttcctccagccctcgaggggatggagaggaagctctgcagtcccaagccaccccccaccaaggcctctctccccactgac

SEQ ID NO: 202226 - DNA, 601 bp, Human
ttcctgggtttttccaccaagtcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtggtgaggaatgtggggatcagtgcagctttgtgggaggggaggggagatgacggagtgcaaaggcatctgggtgggagagacgggtgaacaacatcattcatggccaagaacagagaccaagggcrcgagcactcccttacagcgggccctcctcctcccctcacttctccccaaggtaggagacccctgaataatctgtcctccccaaactggtctcctcggcggtcagcatgccaaagagactgtcccttccccagactccaccccaggtctagcatagtcacaatagaagaagtttcagaaatggggcaacctggaagcttcccaattgcttagaatggccatagttggagagttccagaaatatcaattattaagaaggtccagccaggtgcggtggctcatgcctgtaatcccagcacttt

SEQ ID NO: 202227 - DNA, 601 bp, Human
gggcaagcttcagtatgagctgcagtacaggaaccggggagacccctgggctgtggtgaggaatgtggggatcagtgcagctttgtgggaggggaggggagatgacggagtgcaaaggcatctgggtgggagagacgggtgaacaacatcattcatggccaagaacagagaccaagggcacgagcactcccttacagcgggccctcctcctcccctcacttctccccaaggtaggagacccctgaataatctgtcctccccaaactggtctcctcggcggtcagcatgccaaagagactgycccttccccagactccaccccaggtctagcatagtcacaatagaagaagtttcagaaatggggcaacctggaagcttcccaattgcttagaatggccatagttggagagttccagaaatatcaattattaagaaggtccagccaggtgcggtggctcatgcctgtaatcccagcactttggaggccaaggcaggtggatctcttgaggtcaggagtttgagaccagccagggcaacatggtgaaactctgtttctactaaaaatacaaaaaattagccaggcgtggtgacatgcacctgt

SEQ ID NO: 202228 - DNA, 601 bp, Human
tacttgcctggggtgaggaatgagaacaagatttgaacccagatccatctcacttcaagacactagcagtaacagcctctcctaccctcttccactctaccccagacccatttcccaccatgcccaccccatatggcctctggtagagttggtgccatttaaccctttctttgcttccttcccagagttaaaggaaggctggaaccctcacctgctgcttctcctcctgcttgtcatagtcttcattcctgccttctggagcctgaagacccatccattgtggaggtgaggccaggggatsaggaaggcagggaggtggtcagcctgggccactgcccctgtatgatacatgcagggttggaaaacatgactgtcatcatggtaacaatgatgatgatgggataataaccaactcacagccaccatgtgctggacactgtggagggcactcccttcacccccatggctgccctatgagcttgagacactgcagttgcccttattttacaaatggagaaactgaggcaaggagatgtcaaggacaaagtcacacagctccaaggtggagaaattgggattgaaaatctgtgcccttaaacag

SEQ ID NO: 202229 - DNA, 601 bp, Human
agtcacacagctccaaggtggagaaattgggattgaaaatctgtgcccttaaacagggacctcagctgtgatcttgtccagtggattttaagctttgaggcttaatgggcttaaggggccactaggtggtggtgaagaggtggctgtaatagtccacacctctgaaatggcctctctgcgcacccctggttgcagataaagaagttgaggctcagaaggggcaacatttgcccagcacgcaacaggcagccaagaacataaccacgatatcccttcaggagcctgtgagggagacttactkctcccattttacagaaggggaaaccaagccccagggaaggagggaggcgcctgggctgagtcttgggatgctcggaagctcctgtaggatgaagctggggagcgtccgaatgggaggccaggctgccctctggtgatgtcagggtcctcacccctctctgccccctcaggctatggaagaagatatgggccgtccccagccctgagcggttcttcatgcccctgtacaagggctgcagcggagacttcaaggtgagctcccgaccctgtgatgagctcctcggagcccctcctcctcttc

SEQ ID NO: 202230 - DNA, 601 bp, Human
taccaaaaacttaaaaatcattcaagtgaggtggtgcacgcctgtagtcccagcaactcgggaggctgaggcaggacgatcgttcagaggctgccgtgagctatgatcacaccactgccctccagcctggccaacagacagagactatatcttaaaaaaaaaaaaatcaaaaagaaaaagtaaacaaaataatgcagcattggcccagcccaaggaaccagactgggatagggggtgaggctggtggtctcctgagtcacagattgccccactggtcctttcttaggtgtccttaatctgrgttggagagggaatagattctggaaagagcctggcccacggggcaaaacacactaacgtttgccaagcctccaactcaccaccacccgccagcacccacaggttgtctgtgcccatttacagccgtgtcacccaccctgcagcagtgggagtggctgccacagagaggatgtggtgacagaggtgggagggccagccccacctgctgcagcccagcctgaaagtcagacagtgtagacctagaccattgattgagctcctgctgtctgcctggtgctgcgctggacacccttcctgcctc

SEQ ID NO: 202231 - DNA, 601 bp, Human
tcattcaagtgaggtggtgcacgcctgtagtcccagcaactcgggaggctgaggcaggacgatcgttcagaggctgccgtgagctatgatcacaccactgccctccagcctggccaacagacagagactatatcttaaaaaaaaaaaaatcaaaaagaaaaagtaaacaaaataatgcagcattggcccagcccaaggaaccagactgggatagggggtgaggctggtggtctcctgagtcacagattgccccactggtcctttcttaggtgtccttaatctgagttggagagggaatagrttctggaaagagcctggcccacggggcaaaacacactaacgtttgccaagcctccaactcaccaccacccgccagcacccacaggttgtctgtgcccatttacagccgtgtcacccaccctgcagcagtgggagtggctgccacagagaggatgtggtgacagaggtgggagggccagccccacctgctgcagcccagcctgaaagtcagacagtgtagacctagaccattgattgagctcctgctgtctgcctggtgctgcgctggacacccttcctgcctcactcattctcatattca

SEQ ID NO: 202232 - DNA, 601 bp, Human
cgggaggctgaggcaggacgatcgttcagaggctgccgtgagctatgatcacaccactgccctccagcctggccaacagacagagactatatcttaaaaaaaaaaaaatcaaaaagaaaaagtaaacaaaataatgcagcattggcccagcccaaggaaccagactgggatagggggtgaggctggtggtctcctgagtcacagattgccccactggtcctttcttaggtgtccttaatctgagttggagagggaatagattctggaaagagcctggcccacggggcaaaacacactaacrtttgccaagcctccaactcaccaccacccgccagcacccacaggttgtctgtgcccatttacagccgtgtcacccaccctgcagcagtgggagtggctgccacagagaggatgtggtgacagaggtgggagggccagccccacctgctgcagcccagcctgaaagtcagacagtgtagacctagaccattgattgagctcctgctgtctgcctggtgctgcgctggacacccttcctgcctcactcattctcatattcacagcagcccctgcagagtggatgttccactgcccccagggc

SEQ ID NO: 202233 - DNA, 601 bp, Human
caaaacatttcctgttgtgaggtggttgtattcatgtgtttattccaatttttttatttctagatctctgagttactttacctacatgtgtttcaagttttcgtaaacaattttaagaactcttaaacgtcttctcagaccaaatcagaagtgtgcattttgcttagactccaactatcactaatgggaaccagaaaaataacactttaagatttacatttaaaaccagttattggtttaaagtttcattctaaaattttagtttcctttcagaatttcagttatcatagttcttcagaastatacttatgaattggcattaacagaggataataatctataaatagactgatgaaaatttggaagttttatggtacagtgtgtcttaagggaatattgtcaaaccagcagttttctaccttggcagtttgagacatcggttattaatacttttaattttgtagaatggtttcttatattaaagtatgtttgtcttatttgacattgtcattgatggttaaagttgggaggcatcccaaatgtctgttctatgtgtttattaatataataatacacttagcatcatatataataggggtgt

SEQ ID NO: 202234 - DNA, 601 bp, Human
aagaagaaaatatcaaagataactttcattatagaatctactataactttgcttagactgttgccccatacttagtgaccctactcagaaaaagagaacaaatcctgtgtttattttattctctttggaaatgaaagtgtttatttattttgtctcatgaagatagtcaaaaaggccattatataattaaatagaatgtttttccctagtgataattttgtatatatttttgtatttttaaggttttaatcataaagaaaaagttgtaatggatttcagcttacctgtacatagaaagttrgcactgaatgttggcaaataataggtgttgagaaaaggggatctacactttaaaatgataccagctgtagtggtgattaagccattatgaagtgtcagaactggaagtcacttctgagccttagctgatctttctttaaaatgcatactgataaaaacttttacttttattaacatattaataatataaaagcattgtcttgctattctttttaaatgtcatgaatttcatatatgtaatactgaattgtattacttacataatactcattaaatgttttctataaatttatggtgccat

SEQ ID NO: 202235 - DNA, 601 bp, Human
atttgtacttgctcatccccatacttgtgtttttacgtcctttcctcttagagtcttttctcctgtcttattgatttgctacccacctcccttcctctttaaaacattgtttttaaaggctgcataatactctgttgtactaatattctataatttttttaactgtttttcttttgggaggaaattttattcccaaccatttaatactttaatatttcagagaatacccttgggacgtgtaaattttaatgcaaatttatttttttaggaaaaaattcctgtaagggaattttgggatagraaagtatgtgttgttttaaggttgaaccaaatcgtacactccaagagatagtatcaaattaagaaaaatttactaattacattccatcatcaatctggggatgtgactatatctttgcatttttgcttaaaaaatattattgtcaatttcataggcaaaagtgtggttggtaattaaagttatatgttgggatcatggttatgtataggagaagcacttgtatttgcagattttctacttagggtgtcctttacgtattcatttgttttgtcttacatttttcagtcatcttttagtttg

SEQ ID NO: 202236 - DNA, 601 bp, Human
tgatctcataggattactgaaaccatatctttgcatgtcattttgaggttttataatgaatattatataaaacagttatatttatgagtaaacttggttaattttttcagctttgcttcaaacactggctacaaatgatgaacctcatagacttttttgatggagatgttaaaaaggctttcaagatagcattcagactggcattgggcatactgttgggcctgttaccaccagcagttaaagcttgcagggcttctaaacagaagcatggcatgcagtcagctggagtcttgatttcatracaattttacagattgggacaagatttttgaggtaaaggtttcaaaaaataataagttactcctttgcctgaccaacatcatacggtctatttcaggagatgtttgaactccagagctcccaaatccaatcttacagggatgtttatttatatttcaaacaggcttttccttaaataatggttagcagtgtcctttcttaaagattcgaagacaatacaaaagtaaaaatattagcgtaatccaagtcaagtgcagttaatgtaagattactctatttttaattgttctgtatatcttca

SEQ ID NO: 202237 - DNA, 601 bp, Human
gtggccccaaccatccttcttcttttctctctttcaccctgtgcctctcccttcatgtgggggaattcttacagttcactaatccttagttatgcctcttcatgaaatcctgtccctcactcaagatccatctcagataccaccttttctgtaaaatcttttttcaagcagttgctgcttctgcttagctcccataacactttttgaatagttaggagaaaagtgtttacctgggctgtacaggatgtgatggatataaataaatacttgtcagcaagttattaattaaccagtagagaaytacacaatgaggtagacaagcattataggtaaagtttgaaattcagttggttaagtggagaagtgaagtaattaggtgtgacttgaaatttgtttataaatgcaatatgattaggggaaaatagctaggggaaccatcaccaatttctattatatacacagttgtacagacaacctggagaaggtatctgttgatacatacataaacacacacacacacacacacacacacacacatcattttaccgatgtattaccttttttgtagaagtatttacttttcatcttctttctgcctaaa

SEQ ID NO: 202238 - DNA, 601 bp, Human
tatagaggtataaggtataaattactttagtttcccagttcagcgtgggtatctgatgatttttaaattcactttaagtgattaatgtctgctgtgaaatcctggctggggtctttgtgtgaagttattcaacttttcttttctgaactcatgttcctctttgacccataagtgtctttattctcaggtgaaaatcatgctaaattgtttagggttccgttgaactttctaattgagacacaagctacgaaagctaataattaagtataattattgtctacatgtaaaagcaaaagttgcyggtaatcaccattaacctctaatatttgccaacaagaaatgtaaatagcaaaagtcaaatttattcttcttttaatatttgaggaccacattagatggctggaggaccatctgcaggtgtcagaggggctttgggacattatctctaatgagttgaaagtaaataaatacagaaagctggtgatatgaagataaatactttatttagggttgtccttgtttattgacaacgtcaatgatgctgagatgcttcctgtggaagatagcaaaggaagtatgattttcatataatttatcacaa

SEQ ID NO: 202239 - DNA, 601 bp, Human
agccaggacaacgtagtgagacctcgtctccatacaaaataaaaaattagctgggcttggtggtgtacttctgtatcccagttattcgtgacactgaggtgggaagatatcttgagcccaggatgtcaaggctgcattgagccatgatcgtgccactgaacttcaggagtgagactgtttcacacacacacaaaagacggagacaagtagtctgatgggattggttgacataaagaaccttaatgaattgtacctactgaattcttcatgtattttctagcctgaaattttctcatacaaytgtcatatttacagagcattctgttgtcagctggatttttttttatcgtgtctaatttctgtgttatggagacatttcatctctttatctcagcatggtagagggaggttgtgttttgtgattaaagcactgacagcaggagctgtggatgctagttcagttaacgaatcttgtgttttttgatagactttaacctcactgttccacagggtcttcatcttctcagcatgtttgataaagatgcttgcttgccctgatatattaggtttgtagtaaattctaaaaatgagagatctgtga

SEQ ID NO: 202240 - DNA, 601 bp, Human
tagttatctcttaatatttatgtttttctactgccagtgactctaggtggaactaatatcaattgtgttgattaaatattaattttaagagattccaaacaataatttagatatataaagtctgacactgttattgtccgtttttaggcttatttcataatgtaagggtttggctttgttgttttctttttaaaagcaagtgttactgatgcttcataccagagcttttagaaaagtaacagaatatagttgactctgacgttgtatggttttagtgcattcaagcaaatgtggccattaktaagcaagcaacaacataacttaccgaatagaaagggagaaaaggccattctctcttctgccattctctctgtgtacagattaaacatttcctttggtcttgatgaactgttaggtcagtttacctcaaactgttttttggcctaaggaaatctgttctctggccttttgaagttacattcagagaccgtgcttttggctgtttcttgcaaagagatatgttttaacttctgcaaaggccagaatggcatgagattctggtgtgacacattcactgatgatttaccagaaaatacactgc

SEQ ID NO: 202241 - DNA, 601 bp, Human
aacatttgaatgcttgctattctcatatatctggttctcaaattgtactgtgcacaagaatcacctgaagaccttgataaaacttggtcatccctgtgagccccattgtcagatattctgaatcagtagttcacagtggggcccatgaatttgcatttctattaagctcacaaggctgctggtcttaataacagttatatagactagagcttcaactatattatatacccagtggaaaccactgaagggttttgttacagggggtgtgtatatttcaacttgtgtttcagatgcaactttyggaaattgtgtaatggttggcatcaagatgatttaatactagaagattaggttcctaggaagatttaagtgtagatgactaaagtagtggtatctagctactactgctaccacaaagtctaaactcctgatttcttgcattctaaagaaaatacattaatgtccatagaaaagcctgtttgaagcctaatgtattatataactgtcttaatcaggatttgatattgtgatttatattagtaagaaaatcagagagattagccattttccaatccatttttttctcgcatatacacatgga

SEQ ID NO: 202242 - DNA, 601 bp, Human
aactagcgtaaaaccaatgaatttatcttggttatttcatttatgttaaatcttaatccattcttattttacctttttttattttaaacagaggaagaattgttttaggatatactgaagcagagctgtgcacgagaggctcaggttatcagtttattcatgcagctgatatgctttattgtgccgagtcccatatccgaagtaagttgtagttccttatgaacatgtcagaagaaaacggcatatactgttgtacatgtttcaaattcttacgtaatgtaaagtgtttaagtaaagtatrtggataaacttctacttagtaacatatcattatgattaaccagggttacactctttgttcattaacttgtctacacctgccatgtagaaatattgttgtttagttattaaaaaatgaccattttggcccatgaagttttgcttgggaattttttaattacatcgttatcaattcataaatctatgttaatattgtaacaataatagtgttaataattctagtttaaaattataaagtattaggctgtaggaaaatattccctatttaaaatgaaaataattttttccccaacttatgttc

SEQ ID NO: 202243 - DNA, 601 bp, Human; identical to SEQ ID NO: 121946

SEQ ID NO: 202244 - DNA, 601 bp, Human
ccggaggctgaccagtctacacacggctgaagcttgaagaaacaacaagcccggctctagtcacgcactggcagctgaatagtctacgcatggccgaagcttgaggacttgtcaagcaagtaaacgtagttaaaaatcttaagactaatagttttcctgtaatactgttttcctattgttctgtcactgtattcaatctttttcccaggtaaggacctcttttgtccttgctggatacaaatatgctgtatattgttttgttattgttaccccccataaccatgctagaagaaacacctayataaggtgtccccattgtacacatactacttagtcaggaaacccagacccgtccagcccagcaacaattccgagtctttaagtcattctttaaacacataaaccagaagttacaagagcctcctcctttagcaaaacaaacaaacaacctatttgctcagctggctgaaaacattgccagcagcctagacgtttcttcatgttatgtttataaaaaggctaacatgagagaccaatggccttgagaagcaaaagatttaatgcctcaagattactttaactctttccccaagcagatgcc

SEQ ID NO: 202245 - DNA, 601 bp, Human
aaaagacccagagaatgcaactcagcttcagcatttgcagcagtactaagaggcacttctgcagaggctaagaggtagtagaaaaaaagcaattaatataaaaaagatttcagaagtgcttcaaggagctgacaagagcctaagtcagttttataagagactctgtaaagcattctggctttacatcctatttaaccctgaggctggtggctcacgcctataatcccagccctttggaaggccgaggtgggcagatcaagaggtcaggagatcgagaccatcctggctaacatggtgaaamcctgtctctactaaaaaaaaaaaaacacaaaaaaattagctgggcgtggtggcgggtagctgtagtcccagctactcgggaggctgaggcaggagaattgtgtgaacctgggaggtggagtttgcagtgagccgagatcacaccactgcactccagccttggcaacagagcgagactccatctcaaaaaaaaaaaaaaaatcagcatatatatatattcgaaaaaatatatataaatatatatatacaaatatatgtaaatatatagaaatatatacacgtaaatatatatatttacata

SEQ ID NO: 202246 - DNA, 601 bp, Human
tcaaacacaaagtaagcccactccgctagaaactgtgttaaaaaaaaatttcaagaagaaaaataaaaggaaagtcatctaatcatcaaaacttactctattaaaatgcatgttacagaaccttaagaaaggttttgcaggggattacagaggttaagcccccagaggttaagaactctatgtgaattagaattgccctcttttgctgggcgcggtggctcacgcctataatcccagcactttgggaggccgaggcgggcagatcacgaggtcaggagattgagaccatcctgactaatakggtgaaaccccatctctactaaaaatacaaaaacaaaaaattagccaggcgtgctggcgggcacctgtagtcccagctactcaagaggctgaggcaggagaattgcatgaacctggcaggcggagcttgcagtgagtggagattgtgccactgcactccagcctgggcaacagagcgagactccgtctcaaaaaaaagaaaaaaaaaaaagaattgccctcttttggtgttggatggcccaccgaaggaactacagacagggaacaattggccatgtatttaaggtggtgacaggggttg

SEQ ID NO: 202247 - DNA, 601 bp, Human
ctccgctcttaagccacaagtctgccagtgcttccggccgaataaacctctttcttctttaatccggtgtctgaggagttttgtctgcagctcgtcctgctacatttcttggttccctgactgagaagcgaggtgattaagggacgttcaagccagccccttaggcagcttatgcctgccctgtagagcatccctgtggggggctccagccagcttgcgcgatgcagatcctgagagtgctcccgggtaggcatttgcccccgtggaatgcctcgtcagagcggtgcatggcaagcccccrtggaggatcaacgcagtggctgaacactgggaaggaactagcactttaagtctggacatttgaaacttggtaagactggtctttggaacttgcacactccatttgagtggaagcgtggcctgatcacccatggcgtgcctgtaccggcactttggtttttgtttttgacttgacttgaaatgcttgatactttggtttttgtttttgacttgacttgaattacttgataaacaggcgtgcctttattggcactttggctttggttctgattttgacttggcttaaattccttgacaaaca

SEQ ID NO: 202248 - DNA, 601 bp, Human
tggaccccttaaagttgtaagcctttaaacaggccaagaatttctttttcggggggctccgctcttaagccacaagtctgccagtgcttccggccgaataaacctctttcttctttaatccggtgtctgaggagttttgtctgcagctcgtcctgctacatttcttggttccctgactgagaagcgaggtgattaagggacgttcaagccagccccttaggcagcttatgcctgccctgtagagcatccctgtggggggctccagccagcttgcgcgatgcagatcctgagagtgctcccsggtaggcatttgcccccgtggaatgcctcgtcagagcggtgcatggcaagcccccgtggaggatcaacgcagtggctgaacactgggaaggaactagcactttaagtctggacatttgaaacttggtaagactggtctttggaacttgcacactccatttgagtggaagcgtggcctgatcacccatggcgtgcctgtaccggcactttggtttttgtttttgacttgacttgaaatgcttgatactttggtttttgtttttgacttgacttgaattacttgataaacaggcgtgccttt

SEQ ID NO: 202249 - DNA, 601 bp, Human
ttgctcgatttatcacgaccctttcacatggaccccttaaagttgtaagcctttaaacaggccaagaatttctttttcggggggctccgctcttaagccacaagtctgccagtgcttccggccgaataaacctctttcttctttaatccggtgtctgaggagttttgtctgcagctcgtcctgctacatttcttggttccctgactgagaagcgaggtgattaagggacgttcaagccagccccttaggcagcttatgcctgccctgtagagcatccctgtggggggctccagccagcttkcgcgatgcagatcctgagagtgctcccgggtaggcatttgcccccgtggaatgcctcgtcagagcggtgcatggcaagcccccgtggaggatcaacgcagtggctgaacactgggaaggaactagcactttaagtctggacatttgaaacttggtaagactggtctttggaacttgcacactccatttgagtggaagcgtggcctgatcacccatggcgtgcctgtaccggcactttggtttttgtttttgacttgacttgaaatgcttgatactttggtttttgtttttgacttgactt

SEQ ID NO: 202250 - DNA, 601 bp, Human
cccgagaggagggaaaggaattccaccctggtaacatggtattagtcaagtcccttccctctaagtccccacccctagatacatactgggaaggaccctacccagtcattttatctaccctgagtgcagttaaagtgtctggagtggagtcttagacacatcaaaccctggataccgccaaaggaacccaaaaattcaggagacaacgctagctattcctgtgaacctctagaggatctgcacctgctcttcaagcgacaactgcgaggaaagtaactggaatcgtagagctccatggccmcccccgtcatatttttctctttactgttgtcttacccccctttcactatcacctcaccccctccatgccgctatactaccagtagctccccttaccaagagcttctatggagaatgcggcttcccagaaatattgatgccccattgtataggagtttttctaaaggaaaccccactttcaccatccacacccatatgcccctgcacttcgggccacacatttcaatccctgtatctttaacctccttgttaagtttgtctcttccagaatcaaagctgtgaaactacaaatgttcttcaa

SEQ ID NO: 202251 - DNA, 601 bp, Human
tacccgagaggagggaaaggaattccaccctggtaacatggtattagtcaagtcccttccctctaagtccccacccctagatacatactgggaaggaccctacccagtcattttatctaccctgagtgcagttaaagtgtctggagtggagtcttagacacatcaaaccctggataccgccaaaggaacccaaaaattcaggagacaacgctagctattcctgtgaacctctagaggatctgcacctgctcttcaagcgacaactgcgaggaaagtaactggaatcgtagagctccatggccccccccgtcatatttttctctttactgttgtcttacccccctttcactatcacctcaccccctccatgccgctatactaccagtagctccccttaccaagagcttctatggagaatgcggcttcccagaaatattgatgccccattgtataggagtttttctaaaggaaaccccactttcaccatccacacccatatgcccctgcacttcgggccacacatttcaatccctgtatctttaacctccttgttaagtttgtctcttccagaatcaaagctgtgaaactacaaatgttcttc

SEQ ID NO: 202252 - DNA, 601 bp, Human
atggccttctcagtcttagtctctggtcctggacaaccgtcctccagatctgtcactacccgaggggtcctaggataggcagtcactagatacttctcccagccactaagttgtgactggggaacttcattcttttcacttgcctttctaattatgcctgaaacccccacacccttgttagggagatacattctagcaaaagcaggggccattatacacctgaacatgggagaaggaacaccgtttgctgtcccctacttgaggaaggaattaatcctgaagtctgggcaacagaaggacratatggatgagggaagaatgcccgtcccgttcaagttaaactaaaggattccgcctcctttccccaccaaaggcagtaccctcttagacccgaggcccaacaaggactccaaaagattgttaaggacctaaaagcccaaggcctagtaaaaccatgcaatagcccctgcaatactccaattttaggagtacagaaacccaatggacagtggaggttagtgcaagatctcaggattatcaatgaggctgttgttcctctatacccagctgtacctaatcttatactcactctgctttccca

SEQ ID NO: 202253 - DNA, 601 bp, Human
aaagattgtctgaatagaaataagctgcccctcatccatgcccctcatgtcaagggaatcactggaaggcccactgccccaggggatgaaggtcctttcagtcagaagccactaaccagataagccagcagcaggactgagggtgcccggggcaagcgccagcccatgccccaggtatgcttgaccattgggggccagaaggttaactgtctcctgaacactggcatggccttctcagtcttagtctctggtcctggacaaccgtcctccagatctgtcactacccgaggggtcctaggayaggcagtcactagatacttctcccagccactaagttgtgactggggaacttcattcttttcacttgcctttctaattatgcctgaaacccccacacccttgttagggagatacattctagcaaaagcaggggccattatacacctgaacatgggagaaggaacaccgtttgctgtcccctacttgaggaaggaattaatcctgaagtctgggcaacagaaggacaatatggatgagggaagaatgcccgtcccgttcaagttaaactaaaggattccgcctcctttccccaccaaaggca

SEQ ID NO: 202254 - DNA, 601 bp, Human
gcatattcctatagaggcaaatgggggcaacgagcgaacattcttccgctgtgttcccaaaatccatctatcaagagagagaatgagagggaaagagaaacagagagagaaaggaaagagagagagaagagagagaaagaaagagagaggggggaagaaaggcagaaagtcaaagagaaagagagagacagtcaaagagagaaagaaagagagagatatataagtagttaagaaaaaaacagtgtaccctattcctttaaaagccagggtaaatttaaaacctataattgataattgaagrtcttctctatgaccctataacactccaataccactttgttgtcagttaaacagtgtaatgcaaacattaggaaaaaaacttcaaaagtccaccttaggcccagagcaaaacatagaaactctaatgaacttggcaacctcggtttttttcacaatagagatcaggaggagcaggcagaacaggacaaacgggccctcaggcaagcagaagttcacttcttgcccccatttgccactataggaatatgcacctccctttaatttactcaattcgctttcatcctgatctattgtgttgttg

SEQ ID NO: 202255 - DNA, 601 bp, Human
aagcggtgagtaatattgaaccactttcacttgctattctgtcctacccttccttagaattggaggaaaatactgggcacctgttggctggttaaaaatgattaatgtggccaccggacttaagactcaggtgtgaggctttctgggaaaaggctttctaacaatccccaacccttttgggttgggagcattggtctgcctggaaccagcttccacttttacagttttcttggggaagctgagggctgactagaggcagaaagctgtcgtcccaaattcccggcattggccggtcaagatyatggcgcagccagaagtctctactcaacagttgcccatgcgtgcacccctatctctccttctggcccatacctcctgggtcctaaccatgactttcttgaaagtgtagccccaaaattctccttacctctgaatctacttcctctgatccctgcctcctaggtactaatgcttcagactcacttcctctcccaagtattagagcaagttgtatctccaaagggatctaaggaagctctacgctgtgtccttaagcacctagggtatgaacccagggagtcttgtccctggtgtccctccc

SEQ ID NO: 202256 - DNA, 601 bp, Human
gattctccaaagcggtgagtaatattgaaccactttcacttgctattctgtcctacccttccttagaattggaggaaaatactgggcacctgttggctggttaaaaatgattaatgtggccaccggacttaagactcaggtgtgaggctttctgggaaaaggctttctaacaatccccaacccttttgggttgggagcattggtctgcctggaaccagcttccacttttacagttttcttggggaagctgagggctgactagaggcagaaagctgtcgtcccaaattcccggcattggccrgtcaagattatggcgcagccagaagtctctactcaacagttgcccatgcgtgcacccctatctctccttctggcccatacctcctgggtcctaaccatgactttcttgaaagtgtagccccaaaattctccttacctctgaatctacttcctctgatccctgcctcctaggtactaatgcttcagactcacttcctctcccaagtattagagcaagttgtatctccaaagggatctaaggaagctctacgctgtgtccttaagcacctagggtatgaacccagggagtcttgtccctggt

SEQ ID NO: 202257 - DNA, 601 bp, Human
ggtacccccccgttgaatgggagctctgttttcactctattaaatcttgcaactgcacactcttctggtccatgtttgttccagctcgagctgagctatcacttgctgtccaccactgctgatcatcgccatcgcagacccaccactgacttccacccctccggatccagcagggtgtccactgagcttctgatccagtgaggcacccattgctgctcccaatcgggctagaggctcaccattgttcctgcatggctaagtgcctgggttcgtcctaattgagctgaacactagtccctgrgttccacagttctcttccatgacccacggcttctaatagagctataacactcaccgcatggcccaaggttccattccttggaatccgtgaggccaagaaccccaggtcagagagcaagaggtttgctgccattttggaagcggcccaccaccatcttgggagctctgggagcaaacactcatcggtaacatttgctgggctcgtatggggattctccaaagcggtgagtaatattgaaccactttcacttgctattctgtcctacccttccttagaattggaggaaaatactgggcacct

SEQ ID NO: 202258 - DNA, 601 bp, Human
ttccaagtggcttggctgatgaaggcattgaagggaatggctggtgaacccaagtctgtctgagtcctgggcgtgggccgcccaccttcactgtttaaggcctagaggaaagaggaacttttgagtcctttgagctgaaacagcctgcggtgctggagcctgagtctggccgctcaggatgctgactcccctctgtgcagggaggtgggagccgcaggtctgagcacctgttggtgggcggcggcaggaatcctgccttctatagtcttatcttatttcaccctccaacagctgtgagccmagtactactgccccccatgaaagatggagaaacggaagctcagagaggctgtgtttcccaaaccccctccgctgagaagtggggagaagggctccaagcccagcaatgtctaacctcagagtcatgcctttcaagtaccaccttaagacactggaaaagaaacacaaagtaaacttaaattatttccttccttcttaaagcagaaggaagaaaataataaaagatagagcaactgtgaatgaaacagagaacagaaaaatagagaaaaatcaataaacgatcaagttggttccttgcaaa

SEQ ID NO: 202259 - DNA, 601 bp, Human
agacagagatatgactatcattcccaatggactagaggactggaggcttaagaaacatcaacaatccgtgttcatttccagactcctcatcaattccctgaggcctgtcctggggtgcagagaggagagaggccgcgctgcctgggatgagcctcgcccggcagaggaggagctgtgagagccagaaatcccattctgctaacgaactaagaccccactgggaaaaaagacaagctgcgcacaaccgcacgcctcaccttaaagcggagcatgccctccccttccgtgaacagcgccagckccttccagctgaaggacgctcttgctcggtaggcatcgaggggccccctggggaattctgggagcagagctgtgtcgcctccttccacagtggatgccatcgcgtgataagagcctgcacaaaacatgcaacctgaatccatgctctcccatctatgggttcaaactacccccaccaacaggagagcccgcaacaccttacaaatcagagaaaagtaaacttgaaatccaaaaggatggcaaaagagaatcactctgtgaatggctagcatcattttcccagaagaaaaggcgagaagaa

SEQ ID NO: 202260 - DNA, 601 bp, Human
ggccagggtctcctgacacacagctgccccgggtccctgagttcatgtgagtggtaagacctacatctctgtgccgagcaccttgtataaggcacacagaaatcacctgggaattaagatgcctgcaaggagtcctgggggtctgaggacagcagggagagctgtaaggagagcagagcccaccagcccatcaaacaatgcaggcaaggctaagggcaaagccattttgcccaagctcagctctgctggtatgttacaaaggaaggaaaaacacaggtttctccctttggcctactttttwaatttttttattttttttttaatcatttgtctctttttttgtatgaggtaaaaaaaaaaaaagtcccaacagctcctcttctgatgggacttgaagcttcaccacattgtattttattcaaggacttatgggtgcaaatttacaaatacatgatggtggatgggcttgaaaataaaaaaatgaaaagggggactgaaatttttttaaaaacattaaaaaaaagataatttttaaaatttgcaaatatagctggacaaactggtgtttctctgcctcttggttggccctgggacaggcatc

SEQ ID NO: 202261 - DNA, 601 bp, Human
tatcaacagggggcaggtaagaagagtactgctcttccggaacatcacaacagacaacggcactcaacaccatgcccacgctggttccctgccacactgcactttccccaaggtggagaacaagtgctgagaggttagccagcagcctggatgcccaaggccagggtctcctgacacacagctgccccgggtccctgagttcatgtgagtggtaagacctacatctctgtgccgagcaccttgtataaggcacacagaaatcacctgggaattaagatgcctgcaaggagtcctgggggtytgaggacagcagggagagctgtaaggagagcagagcccaccagcccatcaaacaatgcaggcaaggctaagggcaaagccattttgcccaagctcagctctgctggtatgttacaaaggaaggaaaaacacaggtttctccctttggcctacttttttaatttttttattttttttttaatcatttgtctctttttttgtatgaggtaaaaaaaaaaaaagtcccaacagctcctcttctgatgggacttgaagcttcaccacattgtattttattcaaggacttatgggtgcaaattta

SEQ ID NO: 202262 - DNA, 601 bp, Human
tcctatcaacagggggcaggtaagaagagtactgctcttccggaacatcacaacagacaacggcactcaacaccatgcccacgctggttccctgccacactgcactttccccaaggtggagaacaagtgctgagaggttagccagcagcctggatgcccaaggccagggtctcctgacacacagctgccccgggtccctgagttcatgtgagtggtaagacctacatctctgtgccgagcaccttgtataaggcacacagaaatcacctgggaattaagatgcctgcaaggagtcctgggsgtctgaggacagcagggagagctgtaaggagagcagagcccaccagcccatcaaacaatgcaggcaaggctaagggcaaagccattttgcccaagctcagctctgctggtatgttacaaaggaaggaaaaacacaggtttctccctttggcctacttttttaatttttttattttttttttaatcatttgtctctttttttgtatgaggtaaaaaaaaaaaaagtcccaacagctcctcttctgatgggacttgaagcttcaccacattgtattttattcaaggacttatgggtgcaaat

SEQ ID NO: 202263 - DNA, 601 bp, Human
caccccgcacccctccacagcactgacagccccagggcatccgtgtcccgtctcactgcacccctgcgcccctccacagcaccgacagccccagggcatccatctgtggcccatctccctccacccctgtgcccctccacagcactgacagccccagggcatccatctgtggcccgtctcactgaacccctgcgcccctccacagcactgacagccccagggcatccatctgtggcccatctccctccaccccgcaaccctccatgcacccctccatgcactgacagccccagggcatccttgtcccgtctcactgcacctctgcgcccctccacagcactgacagccccaaggcatccatctgtggcccatctccctccacccctccacccctccacagcactgacagccccagggcatccatctgtggcccgtctcactgcaccccgtgcccctccacagcactgacagccccagggcatccatctgtggcccgtctcactgcaccacaccagaactcccaggcagcagccacaatgcaggtaccagagaggtcaagaggatggcaaggacccgaggagtcagactgcggtggcggaaa

SEQ ID NO: 202264 - DNA, 601 bp, Human
cagcactgacagccccagggcatccatctgtggcccatctcactgcacccctgcgcccctccacagcactgacagccccacggcatccatctgtggcccatctccctccacccctgcacccctccatagtactgacagccccagggcatccatctgtggcccatctccctccaccccgcacccctccacagcactgacagccccagggcatccgtgtcccgtctcactgcacccctgcgcccctccacagcaccgacagccccagggcatccatctgtggcccatctccctccacccctgygcccctccacagcactgacagccccagggcatccatctgtggcccgtctcactgaacccctgcgcccctccacagcactgacagccccagggcatccatctgtggcccatctccctccaccccgcaaccctccatgcacccctccatgcactgacagccccagggcatccgtgtcccgtctcactgcacctctgcgcccctccacagcactgacagccccaaggcatccatctgtggcccatctccctccacccctccacccctccacagcactgacagccccagggcatccatctgtgg

SEQ ID NO: 202265 - DNA, 601 bp, Human
gacttcatcgaaattgaaaaactttgtgcatcaaatcaaccagatggtctcagaggcctgcagctcctgtggccaggagccttggccaggccctctcagctgtgtcactgggggacattgggctggatgtttctttctaaggcaagggtggggctgtctgtgcactgtgggcagggctgtctgcaccgtgggaggggctgcgggatacactgtgggtggggctgcctatgcaccctggaaggggctgtgggatataccataggcggggctgtctgcactgtgggcaggactgtctgcactrtgggtggagctgtctgtgcactgcgggtgggcctgtaggatacactgtggggagggctgtgggatacactttgggcgggcctgtctgtgcactgtgggcagggctatctgtactgtgggtggggctgtctgtgcactgtgggcagggctgtctgtgcactgtgggcagggctgtctgtgcactgtgggcaggactgtctgcactgtgggcagagctgtctgtgtgctgcgggtagggctgtaggatacaccgtgggcggggctgtgggatacactttgggcaggcctgtctgtgcaccgt

SEQ ID NO: 202266 - DNA, 601 bp, Human; identical to SEQ ID NO: 27809

SEQ ID NO: 202267 - DNA, 601 bp, Human; identical to SEQ ID NO: 27808

SEQ ID NO: 202268 - DNA, 601 bp, Human; identical to SEQ ID NO: 27807

SEQ ID NO: 202269 - DNA, 601 bp, Human; identical to SEQ ID NO: 27806

SEQ ID NO: 202270 - DNA, 601 bp, Human; identical to SEQ ID NO: 27805

SEQ ID NO: 202271 - DNA, 601 bp, Human; identical to SEQ ID NO: 27804

SEQ ID NO: 202272 - DNA, 601 bp, Human; identical to SEQ ID NO: 27803

SEQ ID NO: 202273 - DNA, 601 bp, Human; identical to SEQ ID NO: 27802

SEQ ID NO: 202274 - DNA, 601 bp, Human; identical to SEQ ID NO: 27801

SEQ ID NO: 202275 - DNA, 601 bp, Human; identical to SEQ ID NO: 27800

SEQ ID NO: 202276 - DNA, 601 bp, Human; identical to SEQ ID NO: 27799

SEQ ID NO: 202277 - DNA, 601 bp, Human; identical to SEQ ID NO: 27798

SEQ ID NO: 202278 - DNA, 601 bp, Human; identical to SEQ ID NO: 27797

SEQ ID NO: 202279 - DNA, 601 bp, Human; identical to SEQ ID NO: 27796

SEQ ID NO: 202280 - DNA, 601 bp, Human; identical to SEQ ID NO: 27795

SEQ ID NO: 202281 - DNA, 601 bp, Human; identical to SEQ ID NO: 27794

SEQ ID NO: 202282 - DNA, 601 bp, Human; identical to SEQ ID NO: 27793

SEQ ID NO: 202283 - DNA, 601 bp, Human; identical to SEQ ID NO: 27792

SEQ ID NO: 202284 - DNA, 601 bp, Human; identical to SEQ ID NO: 27791

SEQ ID NO: 202285 - DNA, 601 bp, Human; identical to SEQ ID NO: 27790

SEQ ID NO: 202286 - DNA, 601 bp, Human; identical to SEQ ID NO: 27789

SEQ ID NO: 202287 - DNA, 601 bp, Human; identical to SEQ ID NO: 27788

SEQ ID NO: 202288 - DNA, 601 bp, Human; identical to SEQ ID NO: 27787

SEQ ID NO: 202289 - DNA, 601 bp, Human; identical to SEQ ID NO: 27786

SEQ ID NO: 202290 - DNA, 601 bp, Human; identical to SEQ ID NO: 27785

SEQ ID NO: 202291 - DNA, 601 bp, Human; identical to SEQ ID NO: 27784

SEQ ID NO: 202292 - DNA, 601 bp, Human; identical to SEQ ID NO: 27783

SEQ ID NO: 202293 - DNA, 601 bp, Human; identical to SEQ ID NO: 27782

SEQ ID NO: 202294 - DNA, 601 bp, Human; identical to SEQ ID NO: 27781

SEQ ID NO: 202295 - DNA, 601 bp, Human; identical to SEQ ID NO: 27780

SEQ ID NO: 202296 - DNA, 601 bp, Human; identical to SEQ ID NO: 27779

SEQ ID NO: 202297 - DNA, 601 bp, Human; identical to SEQ ID NO: 27778

SEQ ID NO: 202298 - DNA, 601 bp, Human; identical to SEQ ID NO: 27777

SEQ ID NO: 202299 - DNA, 601 bp, Human; identical to SEQ ID NO: 27776

SEQ ID NO: 202300 - DNA, 601 bp, Human; identical to SEQ ID NO: 27775

SEQ ID NO: 202301 - DNA, 601 bp, Human; identical to SEQ ID NO: 27774

SEQ ID NO: 202302 - DNA, 601 bp, Human; identical to SEQ ID NO: 27773

SEQ ID NO: 202303 - DNA, 601 bp, Human; identical to SEQ ID NO: 27772

SEQ ID NO: 202304 - DNA, 601 bp, Human; identical to SEQ ID NO: 27771

SEQ ID NO: 202305 - DNA, 601 bp, Human; identical to SEQ ID NO: 27770

SEQ ID NO: 202306 - DNA, 601 bp, Human; identical to SEQ ID NO: 27769

SEQ ID NO: 202307 - DNA, 601 bp, Human; identical to SEQ ID NO: 27768

SEQ ID NO: 202308 - DNA, 601 bp, Human; identical to SEQ ID NO: 27767

SEQ ID NO: 202309 - DNA, 601 bp, Human; identical to SEQ ID NO: 27766

SEQ ID NO: 202310 - DNA, 601 bp, Human; identical to SEQ ID NO: 27765

SEQ ID NO: 202311 - DNA, 601 bp, Human; identical to SEQ ID NO: 27764

SEQ ID NO: 202312 - DNA, 601 bp, Human; identical to SEQ ID NO: 27763

SEQ ID NO: 202313 - DNA, 601 bp, Human; identical to SEQ ID NO: 27762

SEQ ID NO: 202314 - DNA, 601 bp, Human; identical to SEQ ID NO: 27761

SEQ ID NO: 202315 - DNA, 601 bp, Human; identical to SEQ ID NO: 27760

SEQ ID NO: 202316 - DNA, 601 bp, Human; identical to SEQ ID NO: 27759

SEQ ID NO: 202317 - DNA, 601 bp, Human; identical to SEQ ID NO: 27758

SEQ ID NO: 202318 - DNA, 601 bp, Human; identical to SEQ ID NO: 27757

SEQ ID NO: 202319 - DNA, 601 bp, Human; identical to SEQ ID NO: 27756

SEQ ID NO: 202320 - DNA, 601 bp, Human; identical to SEQ ID NO: 27755

SEQ ID NO: 202321 - DNA, 601 bp, Human; identical to SEQ ID NO: 27754

SEQ ID NO: 202322 - DNA, 601 bp, Human; identical to SEQ ID NO: 27753

SEQ ID NO: 202323 - DNA, 601 bp, Human; identical to SEQ ID NO: 27752

SEQ ID NO: 202324 - DNA, 601 bp, Human; identical to SEQ ID NO: 27751

SEQ ID NO: 202325 - DNA, 601 bp, Human; identical to SEQ ID NO: 27750

SEQ ID NO: 202326 - DNA, 601 bp, Human; identical to SEQ ID NO: 27749

SEQ ID NO: 202327 - DNA, 601 bp, Human; identical to SEQ ID NO: 27748

SEQ ID NO: 202328 - DNA, 601 bp, Human; identical to SEQ ID NO: 27747

SEQ ID NO: 202329 - DNA, 601 bp, Human; identical to SEQ ID NO: 27746

SEQ ID NO: 202330 - DNA, 601 bp, Human; identical to SEQ ID NO: 27745

SEQ ID NO: 202331 - DNA, 601 bp, Human; identical to SEQ ID NO: 27744

SEQ ID NO: 202332 - DNA, 601 bp, Human; identical to SEQ ID NO: 27743

SEQ ID NO: 202333 - DNA, 601 bp, Human; identical to SEQ ID NO: 27742

SEQ ID NO: 202334 - DNA, 601 bp, Human; identical to SEQ ID NO: 27741

SEQ ID NO: 202335 - DNA, 601 bp, Human; identical to SEQ ID NO: 27740

SEQ ID NO: 202336 - DNA, 601 bp, Human; identical to SEQ ID NO: 27739

SEQ ID NO: 202337 - DNA, 601 bp, Human; identical to SEQ ID NO: 27738

SEQ ID NO: 202338 - DNA, 601 bp, Human; identical to SEQ ID NO: 27737

SEQ ID NO: 202339 - DNA, 601 bp, Human; identical to SEQ ID NO: 27736

SEQ ID NO: 202340 - DNA, 601 bp, Human; identical to SEQ ID NO: 27735

SEQ ID NO: 202341 - DNA, 601 bp, Human; identical to SEQ ID NO: 27734

SEQ ID NO: 202342 - DNA, 601 bp, Human; identical to SEQ ID NO: 27733

SEQ ID NO: 202343 - DNA, 601 bp, Human; identical to SEQ ID NO: 27732

SEQ ID NO: 202344 - DNA, 601 bp, Human; identical to SEQ ID NO: 27731

SEQ ID NO: 202345 - DNA, 601 bp, Human; identical to SEQ ID NO: 27730

SEQ ID NO: 202346 - DNA, 601 bp, Human; identical to SEQ ID NO: 27729

SEQ ID NO: 202347 - DNA, 601 bp, Human; identical to SEQ ID NO: 27728

SEQ ID NO: 202348 - DNA, 601 bp, Human; identical to SEQ ID NO: 27727

SEQ ID NO: 202349 - DNA, 601 bp, Human; identical to SEQ ID NO: 27726

SEQ ID NO: 202350 - DNA, 601 bp, Human; identical to SEQ ID NO: 27725

SEQ ID NO: 202351 - DNA, 601 bp, Human; identical to SEQ ID NO: 27724

SEQ ID NO: 202352 - DNA, 601 bp, Human; identical to SEQ ID NO: 25663

SEQ ID NO: 202353 - DNA, 601 bp, Human; identical to SEQ ID NO: 25664

SEQ ID NO: 202354 - DNA, 601 bp, Human; identical to SEQ ID NO: 25665

SEQ ID NO: 202355 - DNA, 601 bp, Human; identical to SEQ ID NO: 25666

SEQ ID NO: 202356 - DNA, 601 bp, Human; identical to SEQ ID NO: 25667

SEQ ID NO: 202357 - DNA, 601 bp, Human; identical to SEQ ID NO: 25668

SEQ ID NO: 202358 - DNA, 601 bp, Human; identical to SEQ ID NO: 25669

SEQ ID NO: 202359 - DNA, 601 bp, Human; identical to SEQ ID NO: 25670

SEQ ID NO: 202360 - DNA, 601 bp, Human; identical to SEQ ID NO: 25671

SEQ ID NO: 202361 - DNA, 601 bp, Human; identical to SEQ ID NO: 25672

SEQ ID NO: 202362 - DNA, 601 bp, Human; identical to SEQ ID NO: 25673

SEQ ID NO: 202363 - DNA, 601 bp, Human; identical to SEQ ID NO: 25674

SEQ ID NO: 202364 - DNA, 601 bp, Human; identical to SEQ ID NO: 25675

SEQ ID NO: 202365 - DNA, 601 bp, Human
ttaggggaagggtgttccaggtaccaggaacagccagtgtaaaggccccgaggtgggactctactgggtgtggttgcagaacagcaactaggaatgatggcgggggggtgtgggggtgggggggggccgtgggcaagaggcaataggggcaaatgaggtaaagaaacacctgtgggccacattgaggactggggcgtgtatttggggtgatgaaaaatgtacattcttgagtagaggagaaatgtgacttggcttgtaaaagtctagattggaccctaggggtcctaacctgatcaaacckttctggcagccctgagaagagctggtgtacactgagacccccccgccctccacacaatcccacccagtggttgggtctgggcaggacaccctgacacacgctcccctccccccccccacctgggtagatgaatgggatgatgcagtggttgtcatgacgatgagtgctagagaagtcaggaagagggtccctgtggccacagggaatagtctgccttggcctttgagggtggtgctaggggaactatgccactctatggccgtgctcgagaccatgtcacccatccttcaattctgggca

SEQ ID NO: 202366 - DNA, 601 bp, Human
cggccccctgacatcctgcttgggtccacggactactccactcagattgacatgtggtaaggacaggtggaagtgtggcaggggccatgtggtaaagggggtggcttggtcacaacagccacccagccagctgcctttctattcactgtgccctccctgcccaggggtgtgggctgcatcttctatgagatggccacaggccgtcccctctttccgggctccacggtggaggaacagctacacttcatcttccgtatcttaggtgaggaggcatgggccctaggcgctgtggagacacacrgggaggacctgtgaaatgtttgggataactcctcttccctactaggaaccccaactgaggagacgtggccaggcatcctgtccaacgaggagttcaagacatacaactaccccaagtaccgagccgaggcccttttgagccacgcaccccggtgaggctggtgggtgggtgggcgttaggggccagagtgtccaaactcattttaaatcaggtctctttgtccttgtggcagacttgatagcgacggggccgacctcctcaccaagctgttgcaggtgagaccaccttgggtcagccttg

SEQ ID NO: 202367 - DNA, 601 bp, Human
gtcagaagagtaattttcctagaatcaaagaatgggctagttggagatttttttaatgctcttcttttagttaaacaaacaacatgattttgcgggggaataaatatcccccaactttatgtcattaaagacagtgtgtggtactataacggtattccccaaagtcatctagaaattatcaatgaaggaaaatacatattataaatttctgctaggcaacatttaaactggaaaagcagtggtcttaaatgagtttaaatattttttttctgaattttttctctttattttcagaattggaagcaagaactacaacaaaatgcctcttacctaaagtagaccttaatatgcaactgaaattcaataaagatacattttttaaagtctgttttgttttttaatgtccaattaccaaatgggttaagagcacatacttgaagcccagctttcttggttagcatcttggttccacacttactggttatgtgtgcataggccagttactcaatctttgtgtgcctccatttcctcagctgtaaagtgggggtagtagtatctaccttacaggattttcatgaagatttataaagcaaatatttac

SEQ ID NO: 202368 - DNA, 601 bp, Human
agtcagaagagtaattttcctagaatcaaagaatgggctagttggagatttttttaatgctcttcttttagttaaacaaacaacatgattttgcgggggaataaatatcccccaactttatgtcattaaagacagtgtgtggtactataacggtattccccaaagtcatctagaaattatcaatgaaggaaaatacatattataaatttctgctaggcaacatttaaactggaaaagcagtggtcttaaatgagtttaaatattttttttctgaattttttctctttattttcagaattgraagcaagaactacaacaaaatgcctcttacctaaagtagaccttaatatgcaactgaaattcaataaagatacattttttaaagtctgttttgttttttaatgtccaattaccaaatgggttaagagcacatacttgaagcccagctttcttggttagcatcttggttccacacttactggttatgtgtgcataggccagttactcaatctttgtgtgcctccatttcctcagctgtaaagtgggggtagtagtatctaccttacaggattttcatgaagatttataaagcaaatattta

SEQ ID NO: 202369 - DNA, 601 bp, Human
gagctctccttactatctgattggtcgggtgtgagctaagttgcaagtcccatgtttaaaggtggaagcggtcactttcccagctaggcttggggattccttagtcggcctaggaaatccagctagtcgtgtctctcagttgcaatagatattaatgaagaacacagaattcagtcaactaagaagaaaaaaaaattactaaaaaaaaaaaagacaaggtcctgggagagaaaaaaaacaaaacaaaacatgaaggtcttttaaatacacacatgcacacatgcacacacatgcacacatacacacacacacacacatcttggatgttagcttttaattaagctgacttttaaccattgagttccttttttaaaaaaatcttttaaaatctcattactattgtcagtgaaaagagttgaactctaaaatatttgaagagctttattctgagccaaatatgactgatcatggcgcatgacacagccctcaggaggtcctgagaacgtgtgcccaaggtggtcagggtgaggcttggttttacacgttttagagaggcacaagacatcaattaaatacatttaagaaatatattggtttggtc

SEQ ID NO: 202370 - DNA, 601 bp, Human
gccacttccaagatggtggtgggtcgcttccaagatggtggcaagcctcgtgttctctgacctggggttcttggcctcacggtattccaaggaatggaatcttaggccatgtggtgagtgttatagctctattagaagccgtgggtcatggaagagaaccgtagaacccagtgactagtgttcagctcgattaggatgaacccaggcacttagccgtgcaggaacaatggcaagcctttagcccaatcgggactggcaatgggcaccttgctggatcaggagcacagcacacaccttgccrgatccagagggatggaagtcagcagcaggtctgcgatggcagcaaacgacagtggtgggcagtggtggacggcaagcgaaagctcagctcgagctgtaacaaacatggaccagaagagtgcagttgcaagatttaatagagtgaaacacagtgaaaacagagctcccgtacaaagggaggggacccaaagggggttgccattgctggctcgaatgcctgggtttatatcctgatcattgtccctcctgctgtgctctcaggcagcagatggctatttctttacctcctgtttttgcctaa

SEQ ID NO: 202371 - DNA, 601 bp, Human
ttatttagtaaagattttacagctgggcacggtggctcacacctgtaatcccagcactttgggaggcctaggtgggtggatcatgaggtcaggagatcgagaccagcctggctaacatggtgaaaccccatctctaccagaaatacgaaaaattagctgagggtggtgctgtgcacctgtaatcccagctactccgaagctgaggcaggagaatcacttgaacccgggaagcagaggttgcagtgagctgatatcatgccactgcactccagcctgggcaacagagccagagtctgtctcaaaaaaaaaaaaaaaaaggactttacttaaatcatgtaaacttgaaaaagcattggacagccacgcacagtggctcatgctatagtctcagcactttgggaggccaaggtgggcagatcacctgaggtcaggaattcaagaccaccctgaccaacatggcaaaaccccatctctactaaaaatacaaaaattagccatgtgtggtggtgcttgcctgtaatgccaactacatgggaggctgaggcaggagaattgcttaaacccaagagacagaggttgtattcagccaagatcatgccat

SEQ ID NO: 202372 - DNA, 601 bp, Human
aaagctagcttatttagtaaagattttacagctgggcacggtggctcacacctgtaatcccagcactttgggaggcctaggtgggtggatcatgaggtcaggagatcgagaccagcctggctaacatggtgaaaccccatctctaccagaaatacgaaaaattagctgagggtggtgctgtgcacctgtaatcccagctactccgaagctgaggcaggagaatcacttgaacccgggaagcagaggttgcagtgagctgatatcatgccactgcactccagcctgggcaacagagccagastctgtctcaaaaaaaaaaaaaaaaaggactttacttaaatcatgtaaacttgaaaaagcattggacagccacgcacagtggctcatgctatagtctcagcactttgggaggccaaggtgggcagatcacctgaggtcaggaattcaagaccaccctgaccaacatggcaaaaccccatctctactaaaaatacaaaaattagccatgtgtggtggtgcttgcctgtaatgccaactacatgggaggctgaggcaggagaattgcttaaacccaagagacagaggttgtattcagccaaga

SEQ ID NO: 202373 - DNA, 601 bp, Human
acccctatgccaaattttgacaccttatagtatttggcagggataagtatgaaattgcttgattaataaatgcaaacaaaaatgtatgctggcaatgcttaagacatttctaatattactttatcagtaattttaaagctagcttatttagtaaagattttacagctgggcacggtggctcacacctgtaatcccagcactttgggaggcctaggtgggtggatcatgaggtcaggagatcgagaccagcctggctaacatggtgaaaccccatctctaccagaaatacgaaaaattagcygagggtggtgctgtgcacctgtaatcccagctactccgaagctgaggcaggagaatcacttgaacccgggaagcagaggttgcagtgagctgatatcatgccactgcactccagcctgggcaacagagccagagtctgtctcaaaaaaaaaaaaaaaaaggactttacttaaatcatgtaaacttgaaaaagcattggacagccacgcacagtggctcatgctatagtctcagcactttgggaggccaaggtgggcagatcacctgaggtcaggaattcaagaccaccctgaccaacatg

SEQ ID NO: 202374 - DNA, 601 bp, Human
ggattaattagttcaaaaaaagacataatttttttttgagacagagtctcgctctgtcacccaggctggagtgcagtggcatgatctcagctcactgcaacctccatctcctgggttcaagtgattctcctgcctcagcctccccagtagttgtgattacaggtgtgtgccaccatgcccagctaatttttgtattttttggtagagacagagtttcaccatgttggccaggctggtctcaaactcttgacctcaaacgatcctccctccttggcctcccaaaatgcttgaattacaggtrtgtgcccagccaaaaaaaagacataatttataattttgattttggaaagtttgtcaaatatcaaaggtttacacttgatatcacaaaataggattacaggttattgtaaaataagtcattcatttaaccagagtgataactcaagggtttgaaaaaaaaaaagtgaaaaccttaattctttaagagaggacacttaattttctaaacaattagctctaataaaaacagcatgaagccaaataaatttgtttttcaaaattttataaataatctataaaatcttaatattggtcataaaat

SEQ ID NO: 202375 - DNA, 601 bp, Human
ttcttattgcatttatgcaaataactgtattgtcgtaagttaagaatactcacaaatagtttccaaattctgtagaaatcaggtacagagaaagaaatatgctccaaattttattcataggagtatacttactcaattgttagaatctgtaaatagcttaaacattttcttgactttgaaaaacaaaagaatcagcaccattttaggcaaaaagttaaacagattacttcagacttctattagtttaatccatgaagttaattcctattctgcttgatattcatgaatattttatctctcyatgagtcctgaaagtttttcatctattctgatgtcacaatctccaatgttatcagaaacctgtgttcaagagcacctgttagagttttataaaactaccttctaaagagaaccaaaaaaagacaataattgtccgtggatgacaaaaagttttagggcagccatagtcaaagacacaattgatgaggaaatttgttacctctgttgcacacaataatttaacataacaattataattattactgataatgtacactaagtcgtatcagaattatagaagtttcccataattttagaatac

SEQ ID NO: 202376 - DNA, 601 bp, Human
ctgtagtagagaaagtttaatagatacaagactagtcatgccacatgggaaatggagtttgtactcaaatgatctcctccaaaggtcttaggtcaggggtttttcaaaggcagtttgggggaagggagggggtggccaggtaataggtgcttgctgttgattgactggggtggagatgaaatagtaaggcgtcaaagctgcccttctgtgggctgaattgcttctgggtgggaccataggagctgggttggctggtccaggtggagccgtgggtgtcagacatgcaaaaaaaaaaaaaaamaaaaacaaaaaaccctgaaaagatatctcaaaaggccagtgttaggttctacaatattgatgttatttgcaggagtaattggggaagctcatatcttataacctccggaataatggctggcaatggtttatgtctgcaccttagcaggactcaggctcccctcctccccacagcctgatggcctcccattagctttataaaagtgaatgagttttaggataagacttattatcatttaaaccatagcctaaatatctttcaaagttagcttggtcctgtgaaccctgaaaatctgagaca

SEQ ID NO: 202377 - DNA, 601 bp, Human
agacagaccacaacactgtagtagagaaagtttaatagatacaagactagtcatgccacatgggaaatggagtttgtactcaaatgatctcctccaaaggtcttaggtcaggggtttttcaaaggcagtttgggggaagggagggggtggccaggtaataggtgcttgctgttgattgactggggtggagatgaaatagtaaggcgtcaaagctgcccttctgtgggctgaattgcttctgggtgggaccataggagctgggttggctggtccaggtggagccgtgggtgtcagacatgcaaaaaaaaaaaaaaaaaaaaacaaaaaaccctgaaaagatatctcaaaaggccagtgttaggttctacaatattgatgttatttgcaggagtaattggggaagctcatatcttataacctccggaataatggctggcaatggtttatgtctgcaccttagcaggactcaggctcccctcctccccacagcctgatggcctcccattagctttataaaagtgaatgagttttaggataagacttattatcatttaaaccatagcctaaatatctttcaaagttagcttggtcctgtgaaccc

SEQ ID NO: 202378 - DNA, 601 bp, Human
ctacacccagcaactgcagaatacacattcttttctatttaacttggaacatccaccaagacagatcatatgctgggccataaaccaaatctcaacacatttcaaagaactattattgttcagaatatgctctgtgtccaaaagaggattaaactgataaccaataacagaaggatatctggaaaagctgcagttatctggaaatcaaggaacacattccttcataacccatgggtcaaagaagaaattgcaaagaaaactttaaaatattttgaactaaatgataataaacattattaataaacacaatatatcaaaatttgtgggatggagctaaagcagtatttggaggcaaatgttagctttaaacatttgtagtgaaagagaataaaggtttaaaatcaaagtctaaactttcaccttagaaactggaaaaaggatagcaaattaaactccaagtagaaggaaggaggtaataaaaataagagtagatatcaattaaaatttaaaaataggtaaggaaaatcaataaaggtaagagctagttcttataaagattcataaaattgaaaacctcctaactagactgattgagaaaaag

SEQ ID NO: 202379 - DNA, 601 bp, Human
tattccctgcagaaaaaagagagctatgatactttcaatctgccatataagtcttaaaagaagctcataaaggatcaaactaatttgcaaataattcaaattccttcccctcttttaaggaggcaataaaatccaaacacttcacaatatggactaataatgtctggcattcaatcagaaattactagacacataaagaagcaggaaaatgtgacccataatcaggaaaaaaatcagtcaatagctgcatacccagaagtgacagaaatcatggcatatgtctgggaacagtagctcacayctgtaatcacagcactttgggaggccgaggcaggtggatcacctgaggtcaggagtttgaaaccagcctggccaaaatggtgaaatcccgtctctactaaaacttcaaaaattagccaggtgtggtggcactcgcctgtagtcccggctacccaggaggctgaggtaggagaatcacttgaacccaggaggcagaggttgtagtgagccaagatcatgctcctgcactctccagcctggtgacagagagagatttcatttcaaaactaataataataataatggattagcaaacaaggac

SEQ ID NO: 202380 - DNA, 601 bp, Human
gccaagtcattcacctccttcgtctcatcacataggcattgtatcatctcatatcatcacaaaaaaggtgaatatagtataagatattttgagagaaagagagagagaccacattcacataacttttcttaaagtatattgttataattgttcaattttattatcaggtgttaatctctttccatgcctaatttataaattgaattttatcataggcaaaaatacatagtgtatataaaatttggtactgtccatggtttcaggcaccccctgggggtcttggaacatattccctgcagawaaaagagagctatgatactttcaatctgccatataagtcttaaaagaagctcataaaggatcaaactaatttgcaaataattcaaattccttcccctcttttaaggaggcaataaaatccaaacacttcacaatatggactaataatgtctggcattcaatcagaaattactagacacataaagaagcaggaaaatgtgacccataatcaggaaaaaaatcagtcaatagctgcatacccagaagtgacagaaatcatggcatatgtctgggaacagtagctcacacctgtaatcacagc

SEQ ID NO: 202381 - DNA, 601 bp, Human
gctaatctggacatgcataaatgaaaattccacagactggacaaagaataacttccaaggtattaacagttaaataatcccaaaactcacacagaccttggagatattcaagttactacctgtagactggagagattcagtgaagacctcaggcattaataatgcttacatggacttggcacagtggctcatgcctttaatcccagcactttggtaggctgagatgggcagatcatttgaggtcaagagttcgagaccagcctgaccaacatggtgaaaacccgtctctactaaaaatacaaaaaaattagctgggcaaggtggcacatgcctgcagtcccagctactcaggaggctgaggcaagagaatcgcttgaacctcagaggtggaagttgcagtgagcagagatcacactgctgcactccagttgggcaacagagcgagactctatctcaaaaataaataaataaataaaaaatttaaatgcttacatgaaaagccacacttcaatagcagggctaacctaactctaggttaaaggatacagtacccccttatttgtggttttactttcaacaactttatttacttgtggttgag

SEQ ID NO: 202382 - DNA, 601 bp, Human
cttctaatcaaggtatggtaaatagaaatgattgacataaaactcttcacaccaggcctggcacaaattgagtccttaattacagtaaatattaagattattattattttcctgtgagatagttcctggagcttattattaaataattcattgtaattgtattaagtttctggttaaataacataatcaaatacaaagggctcaaagaaatccagagtaaggaaaaaaaattattggggaagagagtatggttgtacctgaaaattttaagattttaagtcttttaggggctgggcacagwgactcatgcctgtaatcctagcactttgggaggccgaggtgagtggatcacctgaggtcaggagtttgagatcagcctggccaacatggtgaaacctgcatccctacgaaaatttaaaaaattagctgggcttggcacacatctgtagtcccccagctactcaggaggctgaggcaggagaatcacttgaacccaggaggtggaggttgcagtgagccaagattgtgccacttgactccagcctgggcaacagagtgagattctgtctgaaaaaaaacaaaaacttaggtaaatatgaaa

SEQ ID NO: 202383 - DNA, 601 bp, Human
ctaggtctctagcaaggccatggaaattttcctagattcttctcccaaatatgttttccaaacttttagaattcttagatttggttggttaacataatgccagacttgttggaggctttgttcatattttcttattcttttttgtctttgttggattggattaatgcaaagaccctgtcttcaagctctaaatttctttcttctacttgtttgattatgttgctgagattttccagagcattttgcattgctctaagtgtgtccattgtttcctgaagttttgattgctttttattcttgttatttcattatttctcccttcacttcttgtatcattttttttttatttccttaaattgggcttcatctttctgtggtgtctccctgattagcttaataactaaccccctgaattcattttcaggtaaatcaggggttcttctcagcttggatccattgctggtgagctagtgtgatttttggggggtgttaaagaacattgtttttttatattaccagagttggttttctggttccttctcatttgggttggctctatcaaaggaaaggtctagggctgaaggctgttgttcagattctt

SEQ ID NO: 202384 - DNA, 601 bp, Human
ttagataacctgatgacaatgtgcctaggtgatgatctttttgtgatgaatttcctaggtgttctttgtgcttcttgtatttggatgtctaggtctctagcaaggccatggaaattttcctagattcttctcccaaatatgttttccaaacttttagaattcttagatttggttggttaacataatgccagacttgttggaggctttgttcatattttcttattcttttttgtctttgttggattggattaatgcaaagaccctgtcttcaagctctaaatttctttcttctacttgtttrattatgttgctgagattttccagagcattttgcattgctctaagtgtgtccattgtttcctgaagttttgattgctttttattcttgctatttcattatttctcccttcacttcttgtatcattttttttttatttccttaaattgggcttcatctttctgtggtgtctccctgattagcttaataactaaccccctgaattcattttcaggtaaatcaggggttcttctcagcttggatccattgctggtgagctagtgtgatttttggggggtgttaaagaacattgtttttttatat

SEQ ID NO: 202385 - DNA, 601 bp, Human
aagcttggcttcactggatacacaattgttggctgataattgttttgtttgaggaggctgaagatagatagaatcccttctagcttgtacagtttctgctgagaaatctgctattaatctgataggctttcctttataggctacctggtgcttttgtctcacagctcttaagattctttcctttgtcttaattttagataacctgatgacaatgtgcctaggtgatgatctttttgtgatgaatttcctaggtgttctttgtgcttcttgtatttggatgtctaggtctctagcaaggccrtggaaattttcctagattcttctcccaaatatgttttccaaacttttagaattcttagatttggttggttaacataatgccagacttgttggaggctttgttcatattttcttattcttttttgtctttgttggattggattaatgcaaagaccctgtcttcaagctctaaatttctttcttctacttgtttgattatgttgctgagattttccagagcattttgcattgctctaagtgtgtccattgtttcctgaagttttgattgctttttattcttgctatttcattatttctccct

SEQ ID NO: 202386 - DNA, 601 bp, Human
gcttttgtttatctgaaaaagactgtatctttccttcatatatgaagcttggcttcactggatacacaattgttggctgataattgttttgtttgaggaggctgaagatagatagaatcccttctagcttgtacagtttctgctgagaaatctgctattaatctgataggctttcctttataggctacctggtgcttttgtctcacagctcttaagattctttcctttgtcttaattttagataacctgatgacaatgtgcctaggtgatgatctttttgtgatgaatttcctaggtgttctttgtgcttcttgtatttggatgtctaggtctctagcaaggccatggaaattttcctagattcttctcccaaatatgttttccaaacttttagaattcttagatttggttggttaacataatgccagacttgttggaggctttgttcatattttcttattcttttttgtctttgttggattggattaatgcaaagaccctgtcttcaagctctaaatttctttcttctacttgtttgattatgttgctgagattttccagagcattttgcattgctctaagtgtgtccattgtttcctga

SEQ ID NO: 202387 - DNA, 601 bp, Human
tgaaacgtctttttccacccctttatcttaagtttatgtgagtccttatgtgttaggtgagtctcctgaaggcaacagacagttggttggtgaattcttatccattctgtaattctttatcttttaagtggagcattttggccatttacattcaatgttagtattgagatgtgaggtgccattccattcattgtactacttgttgcccatatactttggttttttgttttttaaattgtatttttgttttataggttctgtgagatatatgctttaaagaggttctgtttgatgtgttccsaggatttgtttcaatatttagagctctttttagcagttcttgtagtggtgacttggtagtggtgaattctttcagcttttgtttatctgaaaaagactgtatctttccttcatatatgaagcttggcttcactggatacacaattgttggctgataattgttttgtttgaggaggctgaagatagatagaatcccttctagcttgtacagtttctgctgagaaatctgctattaatctgataggctttcctttataggctacctggtgcttttgtctcacagctcttaagattctttcct

SEQ ID NO: 202388 - DNA, 601 bp, Human
catccctggtatgaaaccaacttgatcagggtggattatctttttcatatgttgttggattcggttagctagtattttgttaattttagcatctacgttcatcagggatattggtctgtagttttcttttttggttatatcctttcctggttttggtattaggttgatgctggctacatagaatgatttagggagggttccctcattctctatcttgtggaatagtgtcagtagaattggtaccaattctttgaatgtttggtaggaatcttctgtgaatctgtctggttctggacttttytgttgttggtaatttttaagttaccatttcaatctcactgcttgttattggtctgttcaggttatctaattcttcctgatttaagctagcagggttctgtctttccaggaatttatccatctcttctaggtatcctggtttatgtgtgtaaaggcgttcatagtagcctcgaataatcttttgtatttctgtgatgtcagttgtaatatctctcatttcatttcttattgagcttttttggattttctctcttcttttcttggttaatcttgctcatggtctatcaattttatttatttt

SEQ ID NO: 202389 - DNA, 601 bp, Human
tatttatttagtctgattgctctggctaggagttccagtgctatgttgaagaggagtggtgagagtgggcatccttgtcttgttccagttctcagagggaatactttcaacttttccccattcagtattatgttggctgtgggtttgtcatagatggcttttattacattgaggtatttcccttgtatgctgattttgctgagagttttaatcataaaaggatgttggattttgttgaatgctttttctgcatctattaagatgatcatgtgatttttgttcttaattctctttatgtggygtatcacatttattgacttgcatatgttaaaccatccctacatccctggtatgaaaccaacttgatcagggtggattatctttttcatatgttgttggattcggttagctagtattttgttaattttagcatctacgttcatcagggatattggtctgtagttttcttttttggttatatcctttcctggttttggtattaggttgatgctggctacatagaatgatttagggagggttccctcattctctatcttgtggaatagtgtcagtagaattggtaccaattctttgaatgttt

SEQ ID NO: 202390 - DNA, 601 bp, Human
cagagctactgatttgtgtacattaattttgtatccggcaattttgctgaattcttttatcagttctatgagttttctggaggagtctttaggattttctaggtaaacaatcataccatcagcaaacagtgacagtttgacttcatctttactgatttggatgccatttattatttatttatttatttatttatttagtctgattgctctggctaggagttccagtgctatgttgaagaggagtggtgagagtgggcatccttgtcttgttccagttctcagagggaatactttcaacttytccccattcagtattatgttggctgtgggtttgtcatagatggcttttattacattgaggtatttcccttgtatgctgattttgctgagagttttaatcataaaaggatgttggattttgttgaatgctttttctgcatctattaagatgatcatgtgatttttgttcttaattctctttatgtggtgtatcacatttattgacttgcatatgttaaaccatccctacatccctggtatgaaaccaacttgatcagggtggattatctttttcatatgttgttggattcggttagctagt

SEQ ID NO: 202391 - DNA, 601 bp, Human
ggctataagggctcttttttggttccatatgaattttagaatttttttatagttctatgaagaatgatggtggtattttgatgggaattgcattaaatttgtagcttgcttttgatagtgtggtcattttcacaatattgattctacccatccatgagcatgggatgtgtttccatttgtttgtgtcatctatgatttctttcaacagtgttttgtagttttccttgtagagttctttcaactctttggttaggtatattcctaagtattttggtttttttgcagctattgtaaaaaaaasgttgagttcttgatttgattctcagcttggttgctgttggtgcatagcagagctactgatttgtgtacattaattttgtatccggcaattttgctgaattcttttatcagttctatgagttttctggaggagtctttaggattttctaggtaaacaatcataccatcagcaaacagtgacagtttgacttcatctttactgatttggatgccatttattatttatttatttatttatttatttagtctgattgctctggctaggagttccagtgctatgttgaagaggagtggtgagagt

SEQ ID NO: 202392 - DNA, 601 bp, Human
tcagcaaggaataaacctggggaaggaatgcattcttggggggaggtctatagatggccactctgggagtgtctgtcttatgcggttgagataagggctgaaatacgccctggtctcctgcagtaccctcaggcttactgggattggaaaattccagcctggtaaattctagtcagaccagttctctgctttcgaaccctgtttcctgttaagatgtttatcaagacaatgcatgcacagtgggacatagacctccatcagtatttctaattttgccttgccttgtgatctttattgcccrttgaagcatgtaatccttgtgacctactccctgtttgtacaccccctccctttctaaaatccctaataaaaacttgctgattttgcggctcggcgtcaccatcacggtcctaccaatatgtgatggcactcccggaggcccagctgtaaaatttctctctttgtactctttttctttatttctcagaccagccaacacttagggaaaatagaaagaacctacgttgaaatatgggggctggttcccccaaaactttcttatgcttttgcatcctcatagcttagctcccacttacgagtg

SEQ ID NO: 202393 - DNA, 601 bp, Human
aatcagtgcaccctgaaaaagaacagaataacagtgattttcagggaacgagggaggataaaggtctgactgcctgtggggtcaggcagaatacagccatatttttctttctgcagaaagcgagtaggagaaatatcgctgaattcttttctcagcaaggaataaacctggggaaggaatgcattcttggggggaggtctatagatggccactctgggagtgtctgtcttatgcggttgagataagggctgaaatacgccctggtctcctgcagtaccctcaggcttactgggattggaamattccagcctggtaaattctagtcagaccagttctctgctttcgaaccctgtttcctgttaagatgtttatcaagacaatgcatgcacagtgggacatagacctccatcagtatttctaattttgccttgccttgtgatctttattgcccgttgaagcatgtaatccttgtgacctactccctgtttgtacaccccctccctttctaaaatccctaataaaaacttgctgattttgcggctcggcgtcaccatcacggtcctaccaatatgtgatggcactcccggaggcccagctgtaa

SEQ ID NO: 202394 - DNA, 601 bp, Human
gattgtaaaacatgggtgtttgaacaatatgaaatcagtgcaccctgaaaaagaacagaataacagtgattttcagggaacgagggaggataaaggtctgactgcctgtggggtcaggcagaatacagccatatttttctttctgcagaaagcgagtaggagaaatatcgctgaattcttttctcagcaaggaataaacctggggaaggaatgcattcttggggggaggtctatagatggccactctgggagtgtctgtcttatgcggttgagataagggctgaaatacgccctggtctcytgcagtaccctcaggcttactgggattggaaaattccagcctggtaaattctagtcagaccagttctctgctttcgaaccctgtttcctgttaagatgtttatcaagacaatgcatgcacagtgggacatagacctccatcagtatttctaattttgccttgccttgtgatctttattgcccgttgaagcatgtaatccttgtgacctactccctgtttgtacaccccctccctttctaaaatccctaataaaaacttgctgattttgcggctcggcgtcaccatcacggtcctaccaat

SEQ ID NO: 202395 - DNA, 601 bp, Human
aacggagggaccagctgaagctgcagcagaagaacataaattgtgaagatttcatggacatttattagttcccagaattaatacttttataatttcttatgcctgtcttactttaatctcttaatcccatcatcttcataagctgaggatgtgtgttgcctcaggaccctgtgatgattgcattaacggtacaaattgtgtgtaaaacatatgtgtttgaacaatatgaaactgattgtaaaacatgggtgtttgaacaatatgaaatcagtgcaccctgaaaaagaacagaataacagtrattttcagggaacgagggaggataaaggtctgactgcctgtggggtcaggcagaatacagccatatttttctttctgcagaaagcgagtaggagaaatatcgctgaattcttttctcagcaaggaataaacctggggaaggaatgcattcttggggggaggtctatagatggccactctgggagtgtctgtcttatgcggttgagataagggctgaaatacgccctggtctcctgcagtaccctcaggcttactgggattggaaaattccagcctggtaaattctagtcagaccagttct

SEQ ID NO: 202396 - DNA, 601 bp, Human
gaacggagggaccagctgaagctgcagcagaagaacataaattgtgaagatttcatggacatttattagttcccagaattaatacttttataatttcttatgcctgtcttactttaatctcttaatcccatcatcttcataagctgaggatgtgtgttgcctcaggaccctgtgatgattgcattaacggtacaaattgtgtgtaaaacatatgtgtttgaacaatatgaaactgattgtaaaacatgggtgtttgaacaatatgaaatcagtgcaccctgaaaaagaacagaataacagygattttcagggaacgagggaggataaaggtctgactgcctgtggggtcaggcagaatacagccatatttttctttctgcagaaagcgagtaggagaaatatcgctgaattcttttctcagcaaggaataaacctggggaaggaatgcattcttggggggaggtctatagatggccactctgggagtgtctgtcttatgcggttgagataagggctgaaatacgccctggtctcctgcagtaccctcaggcttactgggattggaaaattccagcctggtaaattctagtcagaccagttc

SEQ ID NO: 202397 - DNA, 601 bp, Human
ttcttttctgagacaattcatcaaattgcctcctcaaaatagctaatgtgagtcaatatattcattcattcagtgtacatttatttagtacctattaactcttcctcattaaaagacctcaatttgagtccacagtacagtcatccctaggtatacgtggtgatcggtttggttgaaaaaaatccacatataagcggacccatgtagttcaagcccaagttgttcaagggtcaactttaaatagaatgtacaggattaagaaaatgctattgttcttagtttaaaaaaaaaaaaggatatwacatgctagacactgggcaagggagtgttcattagatcccctactgtgaaaagcaatttgcctagtcaagagtatcaccttgggacattagacaaactttggttaaaatttcaaattttctacttgcttagctgtgttacttaggtcaagttacgtccttcatgatttcttaattaaatgatcaatctaatgtgtaaactgccaaaaacgaggtgctccatctatggttagattcctgctaatgagcaaactatctttggttataatttaacttctcaggtagatttgtttacagggaaa

SEQ ID NO: 202398 - DNA, 601 bp, Human
aatatatacaagtgtgttcttttctgagacaattcatcaaattgcctcctcaaaatagctaatgtgagtcaatatattcattcattcagtgtacatttatttagtacctattaactcttcctcattaaaagacctcaatttgagtccacagtacagtcatccctaggtatacgtggtgatcggtttggttgaaaaaaatccacatataagcggacccatgtagttcaagcccaagttgttcaagggtcaactttaaatagaatgtacaggattaagaaaatgctattgttcttagtttaawaaaaaaaaaggatataacatgctagacactgggcaagggagtgttcattagatcccctactgtgaaaagcaatttgcctagtcaagagtatcaccttgggacattagacaaactttggttaaaatttcaaattttctacttgcttagctgtgttacttaggtcaagttacgtccttcatgatttcttaattaaatgatcaatctaatgtgtaaactgccaaaaacgaggtgctccatctatggttagattcctgctaatgagcaaactatctttggttataatttaacttctcaggtaga

SEQ ID NO: 202399 - DNA, 601 bp, Human
aaatatatacaagtgtgttcttttctgagacaattcatcaaattgcctcctcaaaatagctaatgtgagtcaatatattcattcattcagtgtacatttatttagtacctattaactcttcctcattaaaagacctcaatttgagtccacagtacagtcatccctaggtatacgtggtgatcggtttggttgaaaaaaatccacatataagcggacccatgtagttcaagcccaagttgttcaagggtcaactttaaatagaatgtacaggattaagaaaatgctattgttcttagtttawaaaaaaaaaaggatataacatgctagacactgggcaagggagtgttcattagatcccctactgtgaaaagcaatttgcctagtcaagagtatcaccttgggacattagacaaactttggttaaaatttcaaattttctacttgcttagctgtgttacttaggtcaagttacgtccttcatgatttcttaattaaatgatcaatctaatgtgtaaactgccaaaaacgaggtgctccatctatggttagattcctgctaatgagcaaactatctttggttataatttaacttctcaggtag

SEQ ID NO: 202400 - DNA, 601 bp, Human
taaatatatacaagtgtgttcttttctgagacaattcatcaaattgcctcctcaaaatagctaatgtgagtcaatatattcattcattcagtgtacatttatttagtacctattaactcttcctcattaaaagacctcaatttgagtccacagtacagtcatccctaggtatacgtggtgatcggtttggttgaaaaaaatccacatataagcggacccatgtagttcaagcccaagttgttcaagggtcaactttaaatagaatgtacaggattaagaaaatgctattgttcttagtttwaaaaaaaaaaaggatataacatgctagacactgggcaagggagtgttcattagatcccctactgtgaaaagcaatttgcctagtcaagagtatcaccttgggacattagacaaactttggttaaaatttcaaattttctacttgcttagctgtgttacttaggtcaagttacgtccttcatgatttcttaattaaatgatcaatctaatgtgtaaactgccaaaaacgaggtgctccatctatggttagattcctgctaatgagcaaactatctttggttataatttaacttctcaggta

SEQ ID NO: 202401 - DNA, 601 bp, Human
ctttgtcagctccctctaaatcttcataatcctatttaacctacctctaactatagatgctcatttgcatgacactgattctctgtatttttattcaaaaattatatgatttgagggattctggctcttgatcctaagttattaaatatttgatagtctgtcttcctacacaccaagaccttcagccagagtggtcaatgatgccttcatgtttataaccataataattaaacgttatgtaattaattgtttatatctatttcccctgtaggaactgtaaatgtcatgagatcaggaaccrtgtctatgttgcccattacttgtccattaccgtatctctagcattcagtttgatactatgcatagtcattcattcaacaaatatgtaaatattaaatgacaggctctcttctaagcattgcagagtcaataggtaacaaaactaatttctgcccttgtggagcatacactctaattaaagatgggaaagacaataaataaagtaataaatatataagcactcagatgttgattattgatatgataaagaagaaaacaagggaaagaaatagaaaatgatatggggtggggcaggactatc

SEQ ID NO: 202402 - DNA, 601 bp, Human
ctacgaggcacaaagaaaagttccttcctcagagactccacagaggcaggacacaggcaaacaaaaaaataaaaaaaagagagagagaaagagagatgattacaaaacagtgtgataaagggctgagagattacatacaaggagcccaaaaatttggggaggaaaggaactgaactggaaggctttgggaagattatctttttgctgaaattgaaggtaagttggaatttcatgtgcatatataaaacttacatactacaatatttttctgatttatccaagtttaaaaggataagagtaytgtgttgtgttgtgttgtgttgagttgtgttgtgttgtgttttcccctccaaagcatgattagcttgaccctgtatacctatcactggatttcttttccgggtacctgcagtaaccttgactgatagaaagaacatagctgcattggattatctatttagtaggctacttttaatcttgttccctgtcttgctttgtcagctccctctaaatcttcataatcctatttaacctacctctaactatagatgctcatttgcatgacactgattctctgtatttttattcaaaaattatatga

SEQ ID NO: 202403 - DNA, 601 bp, Human
gctcacacctgtaatcacggcactttgggaggtggaggcaggtggatcacacaaggtcagaattttgagaccagcctggccaacatggtgaaaccccgtctttactaaaaatacaaaaattaggcaggcatggtggtgcacacctgtaatcccagctactcaggaggctgaggcaggagaattgcttgaacccaggaggcagaggttgcagtgagccaagatagtgctactgcagtactccagcctgggcaaggcattgagactccatctcaaaaaaacaaacaaacaaataaaaaaaaatatatatatatatatacacacacacacacacacacacacacacaatatatatataatatatataattgtccctcacatctaagaaatgttttttaattacccaatttggatctagcattcatgaaagtactcagaccagacctctgtgggtctccttaatattttcaacttaatattgcttcttggggagttaagatcttcagaaaatgactgcctgttgttgaatgtggaagacctttttgtttttacattcagtgttcactttactttagcctctctaatgccaactgttgttatccac

SEQ ID NO: 202404 - DNA, 601 bp, Human
ggtgtggtggctcacacctgtaatcacggcactttgggaggtggaggcaggtggatcacacaaggtcagaattttgagaccagcctggccaacatggtgaaaccccgtctttactaaaaatacaaaaattaggcaggcatggtggtgcacacctgtaatcccagctactcaggaggctgaggcaggagaattgcttgaacccaggaggcagaggttgcagtgagccaagatagtgctactgcagtactccagcctgggcaaggcattgagactccatctcaaaaaaacaaacaaacaaataaaaaaaaatatatatatatatatacacacacacacacacacacacacacacaatatatatataatatatataattgtccctcacatctaagaaatgttttttaattacccaatttggatctagcattcatgaaagtactcagaccagacctctgtgggtctccttaatattttcaacttaatattgcttcttggggagttaagatcttcagaaaatgactgcctgttgttgaatgtggaagacctttttgtttttacattcagtgttcactttactttagcctctctaatgccaactgtt

SEQ ID NO: 202405 - DNA, 601 bp, Human
cagaaaaacgtttttcatcaactgttattcaatttcctcatctttacattgaatgcacctgtaaaccccttagcactttacctgcatacaaatgcaaaatttgataatgcccactattactttttataatattcttgtcccttgaggcccggtgtggtggctcacacctgtaatcacggcactttgggaggtggaggcaggtggatcacacaaggtcagaattttgagaccagcctggccaacatggtgaaaccccgtctttactaaaaatacaaaaattaggcaggcatggtggtgcacrcctgtaatcccagctactcaggaggctgaggcaggagaattgcttgaacccaggaggcagaggttgcagtgagccaagatagtgctactgcagtactccagcctgggcaaggcattgagactccatctcaaaaaaacaaacaaacaaataaaaaaaaatatatatatatatatacacacacacacacacacacacacacacaatatatatataatatatataattgtccctcacatctaagaaatgttttttaattacccaatttggatctagcattcatgaaagtactcagaccagacc

SEQ ID NO: 202406 - DNA, 601 bp, Human
tttcttcaaatcctaaaacaattctgtgaagtagaaaaggtatctacttcatcttttgaagaagaaaatgaaggctgggagatgaggtcatttgtccagagtcacaatggctgctaccatatcagagttagctgtgattcacacccagagagggttactagatttggcaactaaaagtacagtataagtatatatcaaatattgcatgagacaaacttattttaaaaattgggttttttaaatctgaaattcaaatttaactgggtagtctgtgttttatctgatacctctatgtctaggyctatctgacttcagagcaccacactacttttgacatctggaaggtaaaaacatggaaaattagtcaagtcgcctatttcagcaaattgcctctaacagtgatagcaaagaattcttctacagaaaaacgtttttcatcaactgttattcaatttcctcatctttacattgaatgcacctgtaaaccccttagcactttacctgcatacaaatgcaaaatttgataatgcccactattactttttataatattcttgtcccttgaggcccggtgtggtggctcacacctgtaatcacggca

SEQ ID NO: 202407 - DNA, 541 bp, Human
ctgtaatcccagcactttgggaggctgaggcgggtagatcacaaagtcaggagtttgagaccagcctgaccaacatgaggaaaccctgtctctactaaaaatacaaaaactagctgggcgtggtggtacagtgcctgtaatcccagctactcaggaggctgaggtcggagaatcacttgaacccaggaggcagaggttgcagtgagccgagatcacaccactgaactccagcctgggcgamagagcgagactttgtctcaaaaacaacaacaacaaaaaaaaagtaaaagaaaaagaaaaagaaaaagagaataagccccttgccttgaataccatggcagtgtcttaagtctatctctatgaaattaatggtaaatatttggaaacccatgaagtaatcaacagacacacaaagaaattatcaagagaatgaacttaactttcttcaaatcctaaaacaattctgtgaagtagaaaaggtatctacttcatcttttgaagaagaaaatgaaggctgggagatgaggtcatttgtccagag

SEQ ID NO: 202408 - DNA, 601 bp, Human
agcaacatcattatcctttgcttgagtctgagcctattaatatgaatgagagttagaaataaaagaggggttctcaaagctacatctctcaacaaatttgaaagtaaaccacatgtactattgcctgatgaattttattaaaattatacctccaacttcacccagggttatcatcttgaaaatagcgtctaggttttttacaaagtataattacattttcaaatacagtgccatgatattaaaagttatttaaaatattagtaggatgcacttcattagtcattgatcttttaattgtctrttttatggaggaattgcatatttgacagatacctagtcaagaaataaaataggataaagctgagcttgcctgaaagaaaaattcatgctttagatgtataaaaatcatcacaatatttcagttagtgtctcagtgttactctaataacctaaaagtaaatttccctaagaactcttttatgcaatatatgacaggctacatactcacaaaacttttgcttatggctgaaaatcagaatgacatgaaataaatactgtttccatttagcaaaactgcctttatttccatctattagctcca

SEQ ID NO: 202409 - DNA, 601 bp, Human
atatacggtaaatcttgacattgtcaaaatccaggccctaattttttaaaaataataaacatgctgattttttccctttcctcaaagatacacaaatggctagttttcaaaattattcccagggaaataaacagttcgtcgcattgtcaaagtaggattttcatgactcggcattggatttgcggatttacacatggatgaaaataacagcaacatcattatcctttgcttgagtctgagcctattaatatgaatgagagttagaaataaaagaggggttctcaaagctacatctctcaayaaatttgaaagtaaaccacatgtactattgcctgatgaattttattaaaattatacctccaacttcacccagggttatcatcttgaaaatagcgtctaggttttttacaaagtataattacattttcaaatacagtgccatgatattaaaagttatttaaaatattagtaggatgcacttcattagtcattgatcttttaattgtctattttatggaggaattgcatatttgacagatacctagtcaagaaataaaataggataaagctgagcttgcctgaaagaaaaattcatgcttta

SEQ ID NO: 202410 - DNA, 601 bp, Human
aactttgtcttctagaagtggacgtcactggtgtatccaaacaaacagggatatacggtaaatcttgacattgtcaaaatccaggccctaattttttaaaaataataaacatgctgattttttccctttcctcaaagatacacaaatggctagttttcaaaattattcccagggaaataaacagttcgtcgcattgtcaaagtaggattttcatgactcggcattggatttgcggatttacacatggatgaaaataacagcaacatcattatcctttgcttgagtctgagcctattaataygaatgagagttagaaataaaagaggggttctcaaagctacatctctcaacaaatttgaaagtaaaccacatgtactattgcctgatgaattttattaaaattatacctccaacttcacccagggttatcatcttgaaaatagcgtctaggttttttacaaagtataattacattttcaaatacagtgccatgatattaaaagttatttaaaatattagtaggatgcacttcattagtcattgatcttttaattgtctattttatggaggaattgcatatttgacagatacctagtcaaga

SEQ ID NO: 202411 - DNA, 601 bp, Human
catgagtttgatagtgtcctatctccaaattttagaaagaaaaatcagtatatgacacttcctttggggaaaaacatacctgtcaaaggtattgtttttgacttctaaaaataaaactaaaatttgtgaaaagcaggtagcatttactattttgtgatattcagattagcagaatcatattgccaggtagagtattcacttatctgtcaaaaagacagagaagttaataaaaatacaatcatagctgtatctagagagcacatcacatgaaaagcaaagcaaaagctgaaactttaaagartcaaaacagaagtataagcatttgtgaaaaatataactctaattatcgttatcactgggttcttacctttggttgtttaagtaatataactttgtcttctagaagtggacgtcactggtgtatccaaacaaacagggatatacggtaaatcttgacattgtcaaaatccaggccctaattttttaaaaataataaacatgctgattttttccctttcctcaaagatacacaaatggctagttttcaaaattattcccagggaaataaacagttcgtcgcattgtcaaagtaggattttca

SEQ ID NO: 202412 - DNA, 601 bp, Human
atgagtgattggtgtttatgggtgttagccaagtgaaagaatgagtgtaattgaacaaactgattaaaggatatataaacaaaaagtcaaaatgtaaaaagcccgttttaagaggtatctttattgatagaaacattttaaaatcttgttttaagactgttcaactttccaatatagaatgaaatcactgatattttgaaacatgtaatcttattacatgatgaatgcagtacgcattttttaattaaagaaaaacatgacagtaattgataacagttttttatttttctttctttctttytttttttttttttttgatacagcgtctctctctttcactcaggctggagtgcagtggtgtgatctcggctcactgcaacctcaacctcctgggctcaagtgatcctcccacctcagcctcctgagtagctgggactacaaacacatgccaccacacctgggctaatttttgcatttttttagagacaaggttttgccatattgcccaggctggtctccaactgttgggctcaaggatctacctactccagcctcccagagtgctgggattacaggtgtgagctaccaggcccagccaata

SEQ ID NO: 202413 - DNA, 601 bp, Human
gaaatgagtgattggtgtttatgggtgttagccaagtgaaagaatgagtgtaattgaacaaactgattaaaggatatataaacaaaaagtcaaaatgtaaaaagcccgttttaagaggtatctttattgatagaaacattttaaaatcttgttttaagactgttcaactttccaatatagaatgaaatcactgatattttgaaacatgtaatcttattacatgatgaatgcagtacgcattttttaattaaagaaaaacatgacagtaattgataacagttttttatttttctttctttctttctttttttttttttttgatacagcgtctctctctttcactcaggctggagtgcagtggtgtgatctcggctcactgcaacctcaacctcctgggctcaagtgatcctcccacctcagcctcctgagtagctgggactacaaacacatgccaccacacctgggctaatttttgcatttttttagagacaaggttttgccatattgcccaggctggtctccaactgttgggctcaaggatctacctactccagcctcccagagtgctgggattacaggtgtgagctaccaggcccagcca

SEQ ID NO: 202414 - DNA, 601 bp, Human
gttttaaattgatccatttgggttttctggataaacaatcatattaaccacaggtaatgataattttctctcttcaaagtatatatcttattcttttttcttgttttattgtgttgggtagaatttatagaacaatgttaaataatagatattctatcaggcactccttgacttcttgtttcagtctctagaatttctcctattttgcccattaatttcagataaatttttcttattttgtcaaagaaatttctttataaaaaattttctgttttatcaagactatatcattgcatttaaycaattacctttttatcaactaaagctataaaaattgttaaagctcaagttgatttgtactttggaaaggtaacatttgagaaccattacctataactgtaagcacttgtcccagactatcaagtagctatattagcattgttcaaaatcttggcacaggctgggcatggtggctcacacctgtaatcccagcactttgggaggcagacatgggaggatagcttgagctcaggagtttgagaccagcctgggcaacatggcaaaaccccgtctccacaaaaaatacaaaaattcgctgagt

SEQ ID NO: 202415 - DNA, 601 bp, Human
agaaccttatacagtgccttatacaggttcataaaaagcaacaaaatttttttaattattgcattttattgcacaaaacactacttgcatgtctaataaaaaagtatacatctacactcatcactttaatgactgcatttaagtgattttttttttttcttgagacagagtttcattcttgttgcccaggctggagtgcaatggcacgatctcggctcactgcaacctctgcctccctggttcaagcaattctcctgcctcagcctcccaagtagctgggattacaggcatgtgtcactaygcctggctaattttgtatttttagtagagatggggtttctccatgttggtcaggctggtctcgaactcctgacctcaggtgatccacccacctcagcctcccaaagtgctgtgattacaggcgtgagccaccgcgcccagccctaagtgatttttatcctatttaatgattatttattcctatgacagtacagtgtatacatttattattgccagttgcctttagaataattttatcaagtcccctaaaaataaactctcacaacgtactttaaagagatttttttaatttttggattaa

SEQ ID NO: 202416 - DNA, 601 bp, Human
aacactcacataatatagagagcttatcatcagtgcactgacccattattttatcatgatccatttatgtcagtgtctctcccccagacttgaggacaggtcacagtgagctctgatttttattagagttcatttaatgaactctaatgtctccagaaccttatacagtgccttatacaggttcataaaaagcaacaaaatttttttaattattgcattttattgcacaaaacactacttgcatgtctaataaaaaagtatacatctacactcatcactttaatgactgcatttaagtgattttttttttttcttgagacagagtttcattcttgttgcccaggctggagtgcaatggcacgatctcggctcactgcaacctctgcctccctggttcaagcaattctcctgcctcagcctcccaagtagctgggattacaggcatgtgtcactacgcctggctaattttgtatttttagtagagatggggtttctccatgttggtcaggctggtctcgaactcctgacctcaggtgatccacccacctcagcctcccaaagtgctgtgattacaggcgtgagccaccgcgcccagccctaa

SEQ ID NO: 202417 - DNA, 601 bp, Human
tcaacatttgttgagcgctccctttgacagcagcatcgtgtaggttgctgaggtatggaagtgagaaagaaaagaaaatagaatgttgattaagacaggcttccagccctagagaaattagtaagagaaacctgtaagtgataaaaatctcatatgacaatatcacgtgtgcataggccaactctgttagaggtgggagaatcacagagcttcccaaagcaggggatatgtaattggatcttgaaagatgaataggagtttgcgacagtagaggaaatgagctttcttggcagaggaaacmgcatgtgtaaaaggtaaagaatgaagaaaagagtaaatatttctaatggctggtgttacaggctgaattgtgtgcccccaaaatccatatattgaagctctaaccccagaatgtgacggtttttggagacaaggcctttaaagagatgattaagtcaaagtgaggccattaggctggacccaacccaatctgactggtgtccttataagaagaggaaacgtggacatacaaagagacaggaaggatgatatgcacaaaggaatgactatgggaggacagagcgaaaagatgaccatctgc

SEQ ID NO: 202418 - DNA, 601 bp, Human
ttcctgtatgctagtggtttccagagtagtattctgtgtgaatgcccctaaagattattacaaatgatgcatttgttatttacatattatttgctatattgaaatttaaagtaaaatatatacctttgtaaaataaatgatgctctcttcttcattagttcaaactttttgtgaagaaggtattctaatccaccaaccagttaacttcgggatgtgtaaaaaaaaaaagtgcagaagagtaggcactaaattacatagctacctctggacagtagtattatatacttctgttttatatcarttttacagaatgaacacattaattttataataaaatgatatatttcaatattttttctcatattcttctgaacaacttgaagaaatgttcatgatatattgctaagtagaaaaagcaaattgtggccgggtgtggtggctcacacctgtaatcccagcactttgggtggttgaggcgggcggatcttttgagcccaagagttcgagatcagcctgggcaacatggcgaaaccccatcaatacaaaaaatacaaaaattagtcagtctcataacctggtctctagatagatagatagatag

SEQ ID NO: 202419 - DNA, 601 bp, Human
atgaggccaagtgtggtggctcacacctgtaataccagcactttgggaggctgaggtgggcagatcacttgagatcaggagttcaagtccagcttggccaacatggtgaaatcccatctctactaaaaatacaaaaattagctggaaatcgcttgaatctgggaggtgaagactgcagtgagccgagatcgcgccactgcactccagcctgggcgaagagcgagactccatctaaaaaaaaaaaatacagtatgctaccatttgtaggaaatatacatatatatgtaaatatctatatttttgtgtgtgtgtgtgtgtgtgtgtgtgctgtgcgtaaaggagtggtgagaatctctctggaaaaatgcaacaagaaagtggtaacagtgattgcctctgaggaaggggaagtatgggactgggcaattggagtggaagggaaaatatctttcactgtatatattttatacattttgaatgttgtatcatgtaaattaattacttagtgaatatatatactgaccccccatttcaaaatgcaaaacagcatatcattatatatgaattatgaaatattcatatattcattttatatgaacta

SEQ ID NO: 202420 - DNA, 601 bp, Human
cagtgaataagacaaaaaggatatgtaatagataagtaatacttttgaaggaggttctcagtcagggtcccaaccaaaaagaaaggcacactcaaaataattctggaagaggttatttccaaagagactatttacaaagatgttagtatagggaaaccacaaaggatggttgcagcaacctcgggttagaagtagccaaactgttaataccactgggatccaaggacaagaagaggaatttagtgtggccctggatagagggggagttatgcagaataactatgaggaacagtgacttaaygttgaagaacacagccagcacaaggcaagcccacgggaacagcatagctagggtactcaataccctgatctcaccaccacctcccccaactccacaactgacaaaattatctcctgctaggattactgctcacacctgtaatcccagcactttgggagactgaggcaggtggatcacctgaggtcgggatttcgaggccagcctgaccaacatggtgaaaccccatctctactaaaaaaataaaaaattagttgggcatggtggcgcatgcctgtaatcccagctactcgggaggctgag

SEQ ID NO: 202421 - DNA, 601 bp, Human
caggtgtgcaccaccaggcccagctaagttttgtatttttagtagagacagggtttcaccgtgttggccaggctggtcttgaactcctgacctcgggtgatctccccgctttggcctcccaaagtgttgagattacaggaataagccaccacgccccgccaaaactaagattttaaaaaaactgcttggcgactataatcctaccatcttccatcattccttccattcttgcttcttgagacaaaaatatttatcaatacctactagccacaggaagtgtactcaatgttatgaatacagmtattaacaaaatatatgatatatgccttcaagaaattaatactacagtgaataagacaaaaaggatatgtaatagataagtaatacttttgaaggaggttctcagtcagggtcccaaccaaaaagaaaggcacactcaaaataattctggaagaggttatttccaaagagactatttacaaagatgttagtatagggaaaccacaaaggatggttgcagcaacctcgggttagaagtagccaaactgttaataccactgggatccaaggacaagaagaggaatttagtgtggccctggat

SEQ ID NO: 202422 - DNA, 601 bp, Human
ccacactggtcccttcaccgagacaaatttctggaggcatgagccatgcccgaatcactagccagaaccccactcctagtaaagtgatttccatagagcagaaacacagagaactgtgtttcggaaactgattcggagactgggagaaatgagaaaattttaggaaaccaaactcagttttttgtttgttttttgttttttcgtttttttgttttttttagatggagtcttgctctgtcgcccaggctggagttcagtggcacaatctcggctcactgcaacctccacctcccgggttcawgcaattctcctgcctcagcctccctagtagctgggattacaggtgtgcaccaccaggcccagctaagttttgtatttttagtagagacagggtttcaccgtgttggccaggctggtcttgaactcctgacctcgggtgatctccccgctttggcctcccaaagtgttgagattacaggaataagccaccacgccccgccaaaactaagattttaaaaaaactgcttggcgactataatcctaccatcttccatcattccttccattcttgcttcttgagacaaaaatatttatcaatacc

SEQ ID NO: 202423 - DNA, 601 bp, Human
accatgttggccaggctggtctcaaactcctgacctcaggtgatccacccacctcagccttccaaactactgggattacaggtgtgagccaccatgcctggccctgataagttattctttttatatgctactgggtcccagctgctagtattttattttgaatttttccatctgtttttaaaggtaaaattactctgtagtttgagaaaaaaattttaatagtaattgcttattcttttcatacacttttcaactcttgaggtatcataggatcataggcaaaacatctgaaaagaacagaaaaaaaatattcttttagggacttcgttgctttactggttttcccatgcatgagtctttgaattgaaatttgtgaatcaaagagaaacaattgctttggaaagcaagattcagctctcatatttagctgactcacaaaaattcctcacttaagcgaggatataacaaagtacacaaaaatataccaaagcaatggttgagaaaatcttatgggtaattcaggcaaaacaaatatggaacatgaactgtgaatacatggaacagtatattctactgattgaagtcatgctctagcttgggt

SEQ ID NO: 202424 - DNA, 601 bp, Human
acttctatgataaacacttcttggttatgataagttattctttttttttttttttgagacagagtctcactctgtcacccagactggagtacggtggtgtgttctcagctcactgcaacctccaccatcttggttcaagtgattctcctgcctcagcctcccgagtagctgggattacaggtgcccaccaccaggcccggctaatttttgtatttttagtagagatgaggtttcaccatgttggccaggctggtctcaaactcctgacctcaggtgatccacccacctcagccttccaaastactgggattacaggtgtgagccaccatgcctggccctgataagttattctttttatatgctactgggtcccagctgctagtattttattttgaatttttccatctgtttttaaaggtaaaattactctgtagtttgagaaaaaaattttaatagtaattgcttattcttttcatacacttttcaactcttgaggtatcataggatcataggcaaaacatctgaaaagaacagaaaaaaaatattcttttagggacttcgttgctttactggttttcccatgcatgagtctttgaattga

SEQ ID NO: 202425 - DNA, 601 bp, Human
aatattagaaatgggaattaatgttgagttttattaaagtctcctttgctctcatagaaataatcatattttcctgtgaatattaatatggtgaactatataaataattttaacacttctatgataaacacttcttggttatgataagttattctttttttttttttttgagacagagtctcactctgtcacccagactggagtacggtggtgtgttctcagctcactgcaacctccaccatcttggttcaagtgattctcctgcctcagcctcccgagtagctgggattacaggtgcccrccaccaggcccggctaatttttgtatttttagtagagatgaggtttcaccatgttggccaggctggtctcaaactcctgacctcaggtgatccacccacctcagccttccaaactactgggattacaggtgtgagccaccatgcctggccctgataagttattctttttatatgctactgggtcccagctgctagtattttattttgaatttttccatctgtttttaaaggtaaaattactctgtagtttgagaaaaaaattttaatagtaattgcttattcttttcatacacttttcaa

SEQ ID NO: 202426 - DNA, 601 bp, Human
ttctgattgtcagaacaaaccgagcctgggctttgcttaaccctaaagaaaaatgagtccttctcttgtcctataatttcttgttggcctaagtgttctacttggaatttttttttattaatcacttttaaacatacataatcacttttaaaaatagaaattataaacagaaaaagacatttgaaatttataattatttataaatattttccccacttgttttatggttttctttttaatctacctcaaattaattttggtgcaaggtatacagtagagatttagctttatattttctgartggatagtcgatattctaattagcatttaatcaataatcaatagaccatcttttccctactgatctgaaatgttattctaaaactgcctttccaactatagagattttgatggaatttgcattaaaatcatagaataaattaggaaattattttcctttacattttcaaaaatgtttcaatgtatagattctaaatttttattaattcctacatgttttatatttgtgttccttttgtcattagcttggttttcccttgatgtatattaactctttacttttgctacgtcaggaaattat

SEQ ID NO: 202427 - DNA, 601 bp, Human
cctagaagcagttataatttcaaatgtcacttgagccaaccttccattcaaacaggaatgccgctatcatattcctgataaatgatcacctggtctcttttggaacacttctggttgtgggaacttcctgccttatgagtagcctgttccattgttggacaactttgttctttaggaaattcatcttattttcctgaataacatttgcttcacaaactgtggtgaggataaaatgagttaagtgcttagcattatgcctggcacatagtaagagcccaataaatgacaatttattctatcrgtttaataaacataatcctcacggtagcatatacttttgagttacaatgaactgtcaatcatgtccacccatttatactctgccctgaaagagtccaaggcaggactgtccccatctgttcttagaacttttcttgccaattcataggactcttaagtaaattaaaatgaaagaaaaatcatttgatatagaaaaatgtataaaatatacctcattattgaaagtaaaatcaataatgacttaaattttataaaatgttaaatattcaagtgaagacaacaataaataatgctttctatc

SEQ ID NO: 202428 - DNA, 601 bp, Human
catagaaacctagaagcagttataatttcaaatgtcacttgagccaaccttccattcaaacaggaatgccgctatcatattcctgataaatgatcacctggtctcttttggaacacttctggttgtgggaacttcctgccttatgagtagcctgttccattgttggacaactttgttctttaggaaattcatcttattttcctgaataacatttgcttcacaaactgtggtgaggataaaatgagttaagtgcttagcattatgcctggcacatagtaagagcccaataaatgacaatttmttctatcagtttaataaacataatcctcacggtagcatatacttttgagttacaatgaactgtcaatcatgtccacccatttatactctgccctgaaagagtccaaggcaggactgtccccatctgttcttagaacttttcttgccaattcataggactcttaagtaaattaaaatgaaagaaaaatcatttgatatagaaaaatgtataaaatatacctcattattgaaagtaaaatcaataatgacttaaattttataaaatgttaaatattcaagtgaagacaacaataaataatgc

SEQ ID NO: 202429 - DNA, 601 bp, Human
cgtgggccatcacgccaagccaataactggattttaaattgagtgagtttgctggtattatttggtttatattacaaggtgtgatggcctttgcaaagcagaatcatagaaacctagaagcagttataatttcaaatgtcacttgagccaaccttccattcaaacaggaatgccgctatcatattcctgataaatgatcacctggtctcttttggaacacttctggttgtgggaacttcctgccttatgagtagcctgttccattgttggacaactttgttctttaggaaattcatcttaytttcctgaataacatttgcttcacaaactgtggtgaggataaaatgagttaagtgcttagcattatgcctggcacatagtaagagcccaataaatgacaatttattctatcagtttaataaacataatcctcacggtagcatatacttttgagttacaatgaactgtcaatcatgtccacccatttatactctgccctgaaagagtccaaggcaggactgtccccatctgttcttagaacttttcttgccaattcataggactcttaagtaaattaaaatgaaagaaaaatcatttgata

SEQ ID NO: 202430 - DNA, 601 bp, Human
accagagtacatatgatgccaaaactctatgcttttaacttctcgttacactgatttctaatttcccccaaatttttgcactacagatgagaaatccaaaacatatttaaattttaatattaaagttgtcataattctagtataccatttcaataatccacttttaaatttgaggaccactgaacctcaaagagaaaaaataaaccaaagactacgtatattatctgtttaagcaaacaacactaatttagtgtcttgactgacagaaagaattgatatgtttaaaacataatagctgaatttttttttttttgacacagggtcttaccctgtcacccaggctggaatgcggtggtgtgatcatggctcactacagcctcaaactcctgggctcaagcagtcctcccgcctcaaccttctgggtaggtgggaatacaggcacgtaccaccacatttggctaatttttttgtagaaatgggatctcactttattgctcaggctggtcttgaactccagacgtcaaatgatcctcccaccttagcctcccaaagtgttggaattacaggcgtgggccatcacgccaagccaataactggattt

SEQ ID NO: 202431 - DNA, 601 bp, Human
tatattgttgaaaatgaaaaaaaaaagtatacgtttttagtgatgccattctttaatgtaataatttacttgacaatttactgggttcttactatatgccagacataaagcactctattcaggtaattctcactacaaactgtgaagtaagtatttcctcaggttcttacagataaggaatctggaactcagaaaatgtacttaatttgccaagaacatatagccagaatatatactcaatatagtagttatgtgaaccagagtacatatgatgccaaaactctatgcttttaacttctcrttacactgatttctaatttcccccaaatttttgcactacagatgagaaatccaaaacatatttaaattttaatattaaagttgtcataattctagtataccatttcaataatccacttttaaatttgaggaccactgaacctcaaagagaaaaaataaaccaaagactacgtatattatctgtttaagcaaacaacactaatttagtgtcttgactgacagaaagaattgatatgtttaaaacataatagctgaatttttttttttttgacacagggtcttaccctgtcacccaggctgg

SEQ ID NO: 202432 - DNA, 601 bp, Human
ggctcatgccagtaatctcagcactttgggaggccaaggagggcagatcacttgaggtcaagagttccagaccagcctgggcaacatagtgagatccccatctctactaaaaatacaaaaattagtcaggcatggtagtgcatgcctgtggtctcagctattcaggaggctgaggtgacaggatcgcttgagcctggggcggagtgaagtttacagtgcactccagcctgggtgacagagcaagattgtgtttcaaaaataaaaataaaaatactgtccaatgtggtggccaccagctgtygtagctactgagcactggaaatgtggctagtgagactgaagactggattttaaactttatttaattttaactatttgaagtgataataaagttattaggagacttttaagtgtgtttggaacaacttgactatgcgaaccttcaatttcaattgtgaattttataaatctaaatatatagattgagcatttacctggaaatttaacatgtgaattgaaatgtgctggaagtgtctgagtaaaaaaagaatgcaagatatctgattacagatttttaaaatattaattatggccgggcgcg

SEQ ID NO: 202433 - DNA, 601 bp, Human
gagctgagaaccaatgatcagacactaaatatgctgtccaggccaagtgccatggctcatgccagtaatctcagcactttgggaggccaaggagggcagatcacttgaggtcaagagttccagaccagcctgggcaacatagtgagatccccatctctactaaaaatacaaaaattagtcaggcatggtagtgcatgcctgtggtctcagctattcaggaggctgaggtgacaggatcgcttgagcctggggcggagtgaagtttacagtgcactccagcctgggtgacagagcaagattstgtttcaaaaataaaaataaaaatactgtccaatgtggtggccaccagctgttgtagctactgagcactggaaatgtggctagtgagactgaagactggattttaaactttatttaattttaactatttgaagtgataataaagttattaggagacttttaagtgtgtttggaacaacttgactatgcgaaccttcaatttcaattgtgaattttataaatctaaatatatagattgagcatttacctggaaatttaacatgtgaattgaaatgtgctggaagtgtctgagtaaaaaaag

SEQ ID NO: 202434 - DNA, 601 bp, Human
gggttgggggctgtggaactgtgcttttaaaaccctcttctgtggattctggattctgccaagtagtcagagctgagaaccaatgatcagacactaaatatgctgtccaggccaagtgccatggctcatgccagtaatctcagcactttgggaggccaaggagggcagatcacttgaggtcaagagttccagaccagcctgggcaacatagtgagatccccatctctactaaaaatacaaaaattagtcaggcatggtagtgcatgcctgtggtctcagctattcaggaggctgaggtgasaggatcgcttgagcctggggcggagtgaagtttacagtgcactccagcctgggtgacagagcaagattgtgtttcaaaaataaaaataaaaatactgtccaatgtggtggccaccagctgttgtagctactgagcactggaaatgtggctagtgagactgaagactggattttaaactttatttaattttaactatttgaagtgataataaagttattaggagacttttaagtgtgtttggaacaacttgactatgcgaaccttcaatttcaattgtgaattttataaatctaaatatat

SEQ ID NO: 202435 - DNA, 601 bp, Human
tactctgtttctcactaatttcagtatatgtatttactcaatttaagatggatcactgacctaaacatagaagctaaaattataaagcttctagatgaaaacataggaaaatatcctcatgaccttgggataggcaacacttcttagagaaggcacaaaaaagacactaaatctaaaataaatttttgatgcattggatatcattagaattccaatcttttgcttatcaaaacacatatgatgaaatgaaataatatgtatataaaaacacttgtacaagaatgttttcattagctatatwtatagaagtcccaaacaggaagcaacccatattttcatcaatagaggaatggataagcaatctggtttaaaaaaacaatgaaatacttttcagcaataaatagaaatgaactcctgatacttccaacaacatggatgaatcccaaaaacatgaaagaagccagatataagagtatatgctgcatgactatatttatataaaatttaaggacaggcaaaacattggtgatagaagtaaaaatagtagttgtctaaggggggtgaaatttactgaaaaggacaaaagggaactttctggaat

SEQ ID NO: 202436 - DNA, 601 bp, Human
aattaaaaccacaagatactttttcacacctagtacaatggctaaaatttaaaagaccaacaccccaaatgtcacgcatgtcactggtgggacaaaagattgtacaacctctttggcaaactgtctggcagttacctacaaacacacaactactctgtttctcactaatttcagtatatgtatttactcaatttaagatggatcactgacctaaacatagaagctaaaattataaagcttctagatgaaaacataggaaaatatcctcatgaccttgggataggcaacacttcttagagarggcacaaaaaagacactaaatctaaaataaatttttgatgcattggatatcattagaattccaatcttttgcttatcaaaacacatatgatgaaatgaaataatatgtatataaaaacacttgtacaagaatgttttcattagctatatatatagaagtcccaaacaggaagcaacccatattttcatcaatagaggaatggataagcaatctggtttaaaaaaacaatgaaatacttttcagcaataaatagaaatgaactcctgatacttccaacaacatggatgaatcccaaaaaca

SEQ ID NO: 202437 - DNA, 601 bp, Human
gatatttactaaagctttttagcattaaagtggaatcaattctgcactaagttttaactgagtaccttaaacataattcattataattatttcatttttcatttaagtaatgcagaaacataagtaataaagttaaagctacaaataaatttatttttattacagaaataaaatcacttgccataacagaattactttgattgtttatagagaaattaacaacataaagaagaaaatgtttgcgaagaagattttatgtgatcaatcaacaaagacatgaagcatggagattttgagaaargtcaggaaactatagagaaagacaggtataagtcactggggagagagttggtggcaaatgtgggtgctggtgcccaacagcctcgcaaaaactatcatgtttaattagaggcaaagggaatattatagaaactcaaaagaaatgagaaatcaataacaacaaccaatggtacacactcatctaagagcctttggaccaccaaaaatatatcagatttaattagtcccactaattccatgttcactttggaaacttgaaaaccttgtggcctgagtgtgcaaataaagtaaattatcattt

SEQ ID NO: 202438 - DNA, 601 bp, Human
aaactgaaagagctaaaaatctacattactgagtctgctttgcagctcagattctggatggcatttgcggcacttaggtttagtcaattaaatgcatttgtatgagatttggaaggtagaagtgaggtgaagacaatggatcttccatttctgctatggctgccagcaagaatgggcagggacacgttggatattctgaggcggctatccccgtctggttactagctttcctggtgccaaaggaagggcatccagtttatgctggaatgcatctagcaggagtagggtgactgttgtgccrggtgcagtggaagtggctcccatctaaggaagtgcgttcttgaataaacagttccagtgggagcttcctcactgcccactttcaggttacaagagaggaagaaacttccctgctggctaattctggcatattgttctggggttatgcctatggttcagcctagagccccagcccttctaatgactctttgcatctatttccaagaattaaagctctttctattgaaaaaggccagtgtacaattcggtttctgcaaatgaacaaattcttttcctgattttagatacatgaagtgctgta

SEQ ID NO: 202439 - DNA, 601 bp, Human
ttgaaatggttcttagggcgacagatatggtgaattggcccacataacccattcttctctccttctagtgtgctttcatgatctgcaaaaactgaaagagctaaaaatctacattactgagtctgctttgcagctcagattctggatggcatttgcggcacttaggtttagtcaattaaatgcatttgtatgagatttggaaggtagaagtgaggtgaagacaatggatcttccatttctgctatggctgccagcaagaatgggcagggacacgttggatattctgaggcggctatccccrtctggttactagctttcctggtgccaaaggaagggcatccagtttatgctggaatgcatctagcaggagtagggtgactgttgtgccaggtgcagtggaagtggctcccatctaaggaagtgcgttcttgaataaacagttccagtgggagcttcctcactgcccactttcaggttacaagagaggaagaaacttccctgctggctaattctggcatattgttctggggttatgcctatggttcagcctagagccccagcccttctaatgactctttgcatctatttccaagaattaaag

SEQ ID NO: 202440 - DNA, 601 bp, Human
gctccccatcccgctgaaagtcacctccactgttcaacaaagtctcagcattcattacctttcaaacagttcatatgacctgatttgtccagtactctggaaaagaatggaggtggggaggttaacactcagctgtccccggacagcaaggctaaaggagctcactataacacatgcccacttgggctctggcacctttccgtctgcgtgctcccccttccctcaggggtttgagcagcggcgggggaggggaccaaacaggtgagccacacccctgccgcacgtcctgcaaggggaatcrgaaaaccttcccattttataaccacatgaaagatgacatcgcctgcatcttccatggcttccaatactcggtgccagaatggttctgactgcagagtggtgaatgttcctcctcctaattccctactggccttgatcacctaggcgtggagtttgatacctgcccttaaaagagccagccacttaaagaacatacttctgttcaaaacgtgcacatgtgaggcaccccttcagggattccctggaaaaccttacgagcctttttgaagggggggtaaagctgaaggccctctgggtgtag

SEQ ID NO: 202441 - DNA, 601 bp, Human
tgataacgggaagggggacagggaagtgctgggtagagaagagtggggtccccggcgagggctccacactcgggccttatgccctcggaccttatgccctcggacctaagtgaaaacaggcactcctgttttcgcctcaatgttgcattttctgagaccactctagctgtcacgtcccccccatcctgtgcccatataaacctgagaccttagcgggcacacacacaagcggctgaatgtcgagaggaacagagtggcagagaatagcagagagcggcagagagtggtggagagcagcagrgcagcacggcagagaaggagggaagaggcgtctgaacatcaagaggagttgcgtccagaacggcggaactccaggggaagattatccccacacccctccaccttcccggaattccagctccccatcccgctgaaagtcacctccactgttcaacaaagtctcagcattcattacctttcaaacagttcatatgacctgatttgtccagtactctggaaaagaatggaggtggggaggttaacactcagctgtccccggacagcaaggctaaaggagctcactataacacatgcccacttg

SEQ ID NO: 202442 - DNA, 601 bp, Human
ctatgttcaggctgggcatggtggctcatgcctgtaatcccaacactttgggaggccgaggcaggcagatcacttgaggtcaggagttcgtgaccagcctggccaatatggcaaaaccctgtctctactaaaaatacaaaaaaaaaattagcctggtgtggtggtgcacacatgtagtcccagctacctgggaggctgaggcaagagaatcacttgaacccagaaggcagaggttgcagtgagctgagattgtgccactgcgttccagcctgtgcaacagagtgagactccatctcaaaataaataaataaataaataaataaataaataaataaataaaatctatgttcatttgttagacaagttatgcagttccaaagtgtaaataaatttgctaaatacattacaaagttcaaggttacaaattataaagctaaattgaaattaaatctagttaaattaaagaactgtagctaataataaaaatgcatgggaaaatgtttggatttacctgcatgctccattttccatccttcgtatttccttttcaatatctggtacaatcacattgggcatggttacaaaagactgctgtgtattg

SEQ ID NO: 202443 - DNA, 601 bp, Human
tagtgtttgattattggaacgctaagcatgtgggagttatttctatcctactgctcaaggtcatcaccatgatctgattgcaaaaattcaaaacactgcaaccttaagcataaatggttaaaaacaagcaccaagggatggatcatactgctcacctctgtgatggtcctccctttctgagtgacttataactaaaggaaccccttgcatgagggttttcattctctgattcttcagatgtagaggcactgtcatcatcctcagaaaaggagctacagtccaataggaggcagagagagawgagttaatgttttcaaccactgcagagaggcaacattcctcactagggggacaattgcctcacctcttttccttccctctcaaactaacacacataacaatttttagttagcataaagttagaactatacaaaatacatagaattatataaaatatgtgcataattcagtaaaatgcatttaactaagaaactagtttctaggttttccacattcctattgtttgatgcattggttgatgttaatatttatcaaatagcaagtgtgatatctgggacttagatcatattatacctttgtg

SEQ ID NO: 202444 - DNA, 601 bp, Human
tggaggtagtcaatgggaagaaaaataagaaaaaggaaaaaaaagtaaagaaagagtaattatgtaaaacaggtggaaaccccagctccaacaccaataccacaccacaccccttctgcaatctcaagtccggtatctgaagttttcacaacttctttatttcctactaaggatatttttgcttttctcttctagcacctctctccagtgctctatttcctaaaagtaggaccaaaagggatggagcattttagagaataacagccaaccctctcacatgtacttgcttcaggaccctgamagaaggatcagagagaaacaagaaatcagaaaggactgggtttcttaagggacagaccccagtgggtctcagggaaaatgaagcaagagtgtttacaacttggaacgccatggccataaataatcatcgggcagtggcaatatttcccaagagacggcatgggtaaggaacagaagtaattcctcctgagatcccacattgtgtgtagatagcagaggcatttgccgagcttgctccgaaacaacagtttacaaacccatttatgcctagtgtttgattattggaacgctaagcatgtgg

SEQ ID NO: 202445 - DNA, 601 bp, Human
ctgggaaatgaaaaacatgcagtgaaatcacagtagtcaccatctgtataatgtccatggtaggcaaatggtctgaaaaaacaaattcttctccatttctactcattactaaagactatgtagatgatagatatttcaaaaacatattatgaagcataaagcataaaagtatatcctgagcctccatgaagcatgacttgccaaatgccagtgtcttgaacaaacatagtgatatggtttggctgtgtccccacccaaatctcatcttgaattatagctcccataatccccacatgccacrggagggacccagtgggaagtaattgaatcataggggtgggtgttgcccatgccattctcgtgctagtaaataagtctcacaagatctgatggttttataaagggcagttcccctgcacatgctctcttgcctgccaccatgtaagacatgactttgctcctcctttgccttctgccatgattgtgaggcctccccagccatgtggaactgtgagtccagtaagcctctttttctttataaattaaccagtctcgggtatttcttcataacattatgaaaatggacatggttagtaaatgc

SEQ ID NO: 202446 - DNA, 601 bp, Human
acactatagacatgattttttctacatgtattcaaataaatgaatgaacactacttttcaacaaaatgataagactatcattgccattgtattagatcatttgattaataaatgtttcctctataacagattcagatatattcctacatttttactggttttctttaaaaccaaaactttggttttctattgtaaatatacttactggtccttattgctgctgttgttcacattaaaaagtgcaatggcaccaggcaggtactgctccctgggaaatgaaaaacatgcagtgaaatcacartagtcaccatctgtataatgtccatggtaggcaaatggtctgaaaaaacaaattcttctccatttctactcattactaaagactatgtagatgatagatatttcaaaaacatattatgaagcataaagcataaaagtatatcctgagcctccatgaagcatgacttgccaaatgccagtgtcttgaacaaacatagtgatatggtttggctgtgtccccacccaaatctcatcttgaattatagctcccataatccccacatgccacgggagggacccagtgggaagtaattgaatcata

SEQ ID NO: 202447 - DNA, 601 bp, Human
tactccccagccactttggtcccctcatgcccaacaggcaaggaagagagtcaccacactggcaaaagttattgaccgtgatcatcagaagtaggcagtgctgtatacaatgcagggaggggagatgtatttgcacctaggtggtcttttggtattttccagcccagttttggtggtaaatgggcaagtactgtagccatgactcaagaagggcatggtgacccagggctcaagttcttcagggatgagtgtctgtactgttccaccagctaagtcatctagaccagcagatgtgctggcyaagggtgagaggaccctagaatgagtagaagcggagagggtgaagaatttcatttgaggcctcaaaaccacctgcaactgccagagaccttagtttaatcccattaactttactcttataagctttctcaggaaaaaataaccaggatcctggagtaggtattcccacatggggtgaattttctatataaacaaaatggatctgggcagcacacggttgggccatacagtggctatgcaggtggtgcacaaaattcaggcactcattccccacttgccaagagtgttggttgctgtcagc

SEQ ID NO: 202448 - DNA, 601 bp, Human
ttgcttttttgccacagggctttgaccagtgccattatttaggggcatatgaagcatgatcactatatatgaaatattgcttaacatcactttggaccaaggacccactttaaggcaaaaaaaaaaaaatgtggcattggaacctgagtttgggatccagtggtcctatcataagctgcacacctttgtcagctactgacatgatagttaaggagggactttttgaaaccacagctgaagtgctatcatagagtttatactctaggaagaaaaggtgccatcctctaggatactgtatatrtgctaaaacaatgatcattgtatggttctctatgcctgtatagaatgcattggtctgggaactatggggtctaagtaggggtgacaaatgtaggaaaggtatgtttcccattcttgcaacttaaggatctatggatctagaggtcctggcttccagaggggtgatgcatctgccagggaatgccagagttccattaaacattaagctacggctactccccagccactttggtcccctcatgcccaacaggcaaggaagagagtcaccacactggcaaaagttattgaccgtgatcatcag

SEQ ID NO: 202449 - DNA, 601 bp, Human
ctgttagtcaggccctgaaataggattacctaaccatgggacataaaaagaatgcccattatgagatggattctgtcagaaacaacaattcataatgtatcaatccgtcatatgatgaagtaagatatctgggattgagcatgaatcagagcaaataagtaagctgcccaggcaggtggctcagtacccttcgtctttttctttctttctttctttctttctttttttgaggagtcttgctctgtcacccaggcaggagtgcggtggcacaatctcggctcactgcaacctctgcctcccrgttcaagtgattcccctgcctcagcctcccaagtagctgggactaaaggcgtgcaccaccacacctggttaatttttgtatttttagtagaaatgaggtttcaccatgtaggttggccaggctggtctcgattcctgaccttaggtggtctgcctgcctcggcctcccaaagtgctgggattacaggtgtgagccaccatgcccggccttcagtacccttctttatgtcatttccacgttggaaatttccatttattttccactatgtcattttccactcagcacctatttatcagcccc

SEQ ID NO: 202450 - DNA, 601 bp, Human
ctacactcttttccaaggctatattaactttctttcctactgtcatgacagccttgagggacctggatcacgtggacatttctcagagcaccacattagtccactatatctgcatcaatggcattctgttagtcaggccctgaaataggattacctaaccatgggacataaaaagaatgcccattatgagatggattctgtcagaaacaacaattcataatgtatcaatccgtcatatgatgaagtaagatatctgggattgagcatgaatcagagcaaataagtaagctgcccaggcagstggctcagtacccttcgtctttttctttctttctttctttctttctttttttgaggagtcttgctctgtcacccaggcaggagtgcggtggcacaatctcggctcactgcaacctctgcctcccagttcaagtgattcccctgcctcagcctcccaagtagctgggactaaaggcgtgcaccaccacacctggttaatttttgtatttttagtagaaatgaggtttcaccatgtaggttggccaggctggtctcgattcctgaccttaggtggtctgcctgcctcggcctcccaaagtgc

SEQ ID NO: 202451 - DNA, 601 bp, Human
tgcaaaaaccaaatggatcctaatggatagcaatagacaattgcaaaatcaaccaagtagtagccccaattgcagctgctgtgtcatatgtggaaaacaatgcattcacttgatatacactgcatacctaaggttctgggtcagtcattgtgaatgtcatttttcattactatcaggaaagaggatcagacatagctcatactcacaggggataacaaactgtacacacctacactcttttccaaggctatattaactttctttcctactgtcatgacagccttgagggacctggatcacrtggacatttctcagagcaccacattagtccactatatctgcatcaatggcattctgttagtcaggccctgaaataggattacctaaccatgggacataaaaagaatgcccattatgagatggattctgtcagaaacaacaattcataatgtatcaatccgtcatatgatgaagtaagatatctgggattgagcatgaatcagagcaaataagtaagctgcccaggcaggtggctcagtacccttcgtctttttctttctttctttctttctttctttttttgaggagtcttgctctgtca

SEQ ID NO: 202452 - DNA, 601 bp, Human
aattataatgagcattaaggtggggatggtaaccaagggtcttaacccatagacagctatggaggaggttaatagaatatagtattcctagacagatgggaagcctgttagctagttagggtattatttaatgtatacaaccaaaatgaatcaggaatgaataattaggaggttgagggcaacttactccatcaaaaaaatcagaatcctagtagggcatggtggcttatggctataatctcagcactttgggaggttgaggcgggaggatcacttgagcccaggagttcaagaccagccygggcaacatagcaagaccccatctcaaaaaataaattgattcattacaatttaaattttaaaaaaatcagaatcctttgaacagttccagacctaagccagtacttagacctaagccagtacttagacctaaaaccaatgactagaggagaagccaagacccatgaagaaagactctgcaacagtatgacaaacatattccagtaacgatttccctggtctttctcctaaagaacctatgaccattacttagatcactatactctgggggaaaaaagaatacttagatacattgaagact

SEQ ID NO: 202453 - DNA, 601 bp, Human
gggtggggcagacaattatccagataataaacaagaacttctaagctaatagatttgggaaatagaaacaaatggagatgaataaaggcataaaaccaaggagaaaaatttaagaaacaacagccccccaagagtgttcttcgaaagtgttaatgtattaaaaataatatttaaaatttaagcttcttgacatcatttacatttatccttgaataaaatcattcagaattttaagaaaatgccatcaattttctttagaggggataaccctgactgaagtcatttttcatgagtaatcaayaagctgtctggtaatatggtggaatctcagttattagaataatttaccagatttaaggccacctttttccacatacaatttcttcttgagtggagactgtgtaactagtgcctctttctatgattagctttctctatcagcaggggaatagattctgaagtcagacagacctagggttatagcaggctgccattgtcagctcagaagtcttaggaaatttcattagccagacatgaatgaacaggcatcttgttaccactaggatagtcagagaaggcttttaaagggaagtagttctaa

SEQ ID NO: 202454 - DNA, 601 bp, Human
ctttgcattcaaagacctgctccagtgctcaaaacccatctggtctcttactggaggtttctaccccaaaaagtggggggtggggcagacaattatccagataataaacaagaacttctaagctaatagatttgggaaatagaaacaaatggagatgaataaaggcataaaaccaaggagaaaaatttaagaaacaacagccccccaagagtgttcttcgaaagtgttaatgtattaaaaataatatttaaaatttaagcttcttgacatcatttacatttatccttgaataaaatcattsagaattttaagaaaatgccatcaattttctttagaggggataaccctgactgaagtcatttttcatgagtaatcaacaagctgtctggtaatatggtggaatctcagttattagaataatttaccagatttaaggccacctttttccacatacaatttcttcttgagtggagactgtgtaactagtgcctctttctatgattagctttctctatcagcaggggaatagattctgaagtcagacagacctagggttatagcaggctgccattgtcagctcagaagtcttaggaaatttcat

SEQ ID NO: 202455 - DNA, 601 bp, Human
ttcttgccaaagtcttacctcttcttttcttttttctttttctttttttcttctggttccctaaagaaaaaaataatatatctgtcacataatcacagtcttccactcttatttactttctttttcattgagcaaaaatctcagctttgcattcaaagacctgctccagtgctcaaaacccatctggtctcttactggaggtttctaccccaaaaagtggggggtggggcagacaattatccagataataaacaagaacttctaagctaatagatttgggaaatagaaacaaatggagatkaataaaggcataaaaccaaggagaaaaatttaagaaacaacagccccccaagagtgttcttcgaaagtgttaatgtattaaaaataatatttaaaatttaagcttcttgacatcatttacatttatccttgaataaaatcattcagaattttaagaaaatgccatcaattttctttagaggggataaccctgactgaagtcatttttcatgagtaatcaacaagctgtctggtaatatggtggaatctcagttattagaataatttaccagatttaaggccacctttttccacatacaat

SEQ ID NO: 202456 - DNA, 601 bp, Human
catcacaatttccttctatttcaatgccactaaaagtgcttactcttctttcttatctttgcttttctcctctttctttttcttctctttgtcctttttcttctttttcttctctgggtcgtttttattttcgtttttatcatctgacttgctgaaaaaattaagcaagtagtattaaaatacagaaatgttatgggcagaaaaatgtggggtaattcttgccaaagtcttacctcttcttttcttttttctttttctttttttcttctggttccctaaagaaaaaaataatatatctgtsacataatcacagtcttccactcttatttactttctttttcattgagcaaaaatctcagctttgcattcaaagacctgctccagtgctcaaaacccatctggtctcttactggaggtttctaccccaaaaagtggggggtggggcagacaattatccagataataaacaagaacttctaagctaatagatttgggaaatagaaacaaatggagatgaataaaggcataaaaccaaggagaaaaatttaagaaacaacagccccccaagagtgttcttcgaaagtgttaatgtattaaaaat

SEQ ID NO: 202457 - DNA, 601 bp, Human
ggaatagtggcatagatctggggtccccaacccccgggctgtgggccggtactggtctgtggtctgttaggaacccagcgggccacacagcaggaggtgagctgcagggtgagggaggtttactgcctgagctcggcctcctgtcagatcagcagtggcattagattctcataggagcacaaaccttattgtgatctgcgcgtgcaagggatctaggttgcacactctttataagaatgtaattaaaataaaaattaaatttttatttcagtttttaaaatgattgtaggatcctagaaasctaatcctccttggaacctaaatatttctcagcgataagttatcttcaccaatgcttagggaagagaattaaccctagcagtgaaaattcttgagagaattaagaataatgctaccattgctaattttagggaaattggaaaaagttttaattcacttctgataatttatgttaaatgtttatttttcaatatttaaagacatttagtctttacacagggctctttactataaagtttctttctactttgtattatggaaaatcatccctgcatctaaaacccatcacaatttccttcta

SEQ ID NO: 202458 - DNA, 601 bp, Human
atacctcagccactgagagggaatagtggcatagatctggggtccccaacccccgggctgtgggccggtactggtctgtggtctgttaggaacccagcgggccacacagcaggaggtgagctgcagggtgagggaggtttactgcctgagctcggcctcctgtcagatcagcagtggcattagattctcataggagcacaaaccttattgtgatctgcgcgtgcaagggatctaggttgcacactctttataagaatgtaattaaaataaaaattaaatttttatttcagtttttaaaatkattgtaggatcctagaaacctaatcctccttggaacctaaatatttctcagcgataagttatcttcaccaatgcttagggaagagaattaaccctagcagtgaaaattcttgagagaattaagaataatgctaccattgctaattttagggaaattggaaaaagttttaattcacttctgataatttatgttaaatgtttatttttcaatatttaaagacatttagtctttacacagggctctttactataaagtttctttctactttgtattatggaaaatcatccctgcatctaaaac

SEQ ID NO: 202459 - DNA, 601 bp, Human
gagcattatcaggttagtgaacacatctatgaactaggagggtgccacaccccaattccatggggacaaaagcccctgttctcatgactcttcccgactttgccctatgtatctcttcatctggctcttcatctgtattcattatcataccctttattaatataatagcgcagtaaacataagtgttttcctatggtctgtaagttgtgctagcaaattactagacccacaagggagctgtgggaactccaatttatagctggtcagtcagaagcacaagccacaacctgagacttacgaytggcatctgaagtgggggatcatcttgggagactgagcccttaacctgttgggcctgttctaactcccgttagtgtccaaattcagttaaattttaacccagctggtgttacagaattgcttggtgtgtagaggaaacgccatatacatattggtcaccagaattgtgttgtattgagagcatagtaacatacaatgggttgttgttttttttccccaccgtacacagttcatggaaggtttcctgaacacgctagcaatgtgcctaatagcccacgccagtgtcttgtcagaatcccag

SEQ ID NO: 202460 - DNA, 601 bp, Human
cctgggagtttgaggctgcagtgagccatgatagcactactgcattccagcctgggcaacagcgagaccctgtctcaaaaaaaaaaaaagaaaaaaaaagaaaaaaagaaaaattttgtaagtgcaaaagtgagagtgtacaaatctctcaaggtctatcatcaccatccaggtaaagccattcctttcatgagtagcattcttgtgatattgtgagatatatatatatatatatttggtccctggcacagaactcttaaaactcttgtaatttcctaagcaatatggttactaagtgcattttttttttttttgagtcagagtcttgctctgtcacctaggctggagtgcagtggtgcaatctcgtcttgctgcaacctccgcctctggcttcaagcaattcttctgcctcagcctcctgagtagctaggactacaggcacgtgccaccacgcccagctaatttttgtatttttagtagagacagggtttcaccatattggccaggctggtcttgatctcctgacctcgtgatccacctgccttggcctcccaaagtgctgggattacaggcatgagccactgagcgcggccctaagtcc

SEQ ID NO: 202461 - DNA, 601 bp, Human
caaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttytttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgctatattttgtgagtgcaagctggcttggggagccctctcttgtgtaaatgtcccccatgtttctgaaaagtgctgtagtttagtcccctcacccccagcactgcccaaacaggggccaagtgcgccccaattccaa

SEQ ID NO: 202462 - DNA, 601 bp, Human
gaaaaaacaaatatttcccctttcaactctttttaatttatttggactttaaaaatgttaaagcagattcagttatagggaacacatttttactttgagactaaaaaaaggccttttatttttgtgtgcttagagattgcctgtattttactttttttctgaaatttacacctaatttaataattaaatacacttatttaaataattcataaaattacatatactcttatacataaaaatattttgtaaactgctaatccctgtactcaaatgtttatttttgtatctaataatgatgctrgttacaatttagtgagcacctaatatatgcaagatgctttttgtatacagttttgtttaattcttggtacatacctgtaagataggtattttatatatgttttgtggaggatgaaactgaggtccatacagggtaagtagcttgcccagggtcatatagttttccagaggcttgccaggttttctgacttaaaaactattgcattgtgactttaataacagtcaccacttattgagtactttctattcttcaggcactgtactgagcatttagcatgtgttctttgatataatagtcttc

SEQ ID NO: 202463 - DNA, 601 bp, Human
atttcccctttcaactctttttaatttatttggactttaaaaatgttaaagcagattcagttatagggaacacatttttactttgagactaaaaaaaggccttttatttttgtgtgcttagagattgcctgtattttactttttttctgaaatttacacctaatttaataattaaatacacttatttaaataattcataaaattacatatactcttatacataaaaatattttgtaaactgctaatccctgtactcaaatgtttatttttgtatctaataatgatgctagttacaatttaktgagcacctaatatatgcaagatgctttttgtatacagttttgtttaattcttggtacatacctgtaagataggtattttatatatgttttgtggaggatgaaactgaggtccatacagggtaagtagcttgcccagggtcatatagttttccagaggcttgccaggttttctgacttaaaaactattgcattgtgactttaataacagtcaccacttattgagtactttctattcttcaggcactgtactgagcatttagcatgtgttctttgatataatagtcttcacaaaaacccta

SEQ ID NO: 202464 - DNA, 601 bp, Human
ttaagttttatgggagtcaaaagtcatacatggctttttcaactgcatgggagttggcgcccctaggccccacattgttcaagggtcaactgactgtaacatgatttgttagcagttgttttattcttgttcttagccaaaaaactgagaagttattgttaagcagttgttttaaatgcttattaagagttaaaatgagattttatttttggtttcattggtgatttgcacatttcttttgagacttacttgtttataaggttaagaaattgagagttggtcgggtgcactggctcgtgcmtgtaatcccagcactttgggaggccgaggtgggtggatcacttgaggtcaggaattcagcctggccaacatagtgaaaccccgtctctactaaaaatacaaaaattagcaggatgtgttggtgcatgcctgtgctcccagctgtttgggaggctgaggcacgagaattgcttgaatccaggaggtggaggttgcagcgagctgagatcgtgccactgtactccagactgggtgacagagggagactcagtctcaaaaaaaaaaaaattgagagtttaatctttctataagtatagtattt

SEQ ID NO: 202465 - DNA, 601 bp, Human
gatttttttttttttctgttattatgtagtgtcaagaaaccgtttaatgcatatgaattgaagccctgtaaggaaagtgatcatttgggattagatcgcaaattgcttgacttcaaatgtattactttgagaattttctgtgacagtttagctagtcctttatcttccttatttttcttgagaatacatgaattagctccctgccttcatatttgaagatacatacctatcagtgtacagacatgtacacacataggtacacatataatactttgctaagcagtttgtgctggggacaatrgttgaaactcggtgttttttcctaaaatttatatcgtttgtttatatatgaaatatcaaatgggagatatttttggaagcagtgaaacttgtttatgaattctttccttacacaaaagaagacaggttttttaaaaacaaattaatctttttctctttgtttctttcagcattgatgactgggaagtgagagacatagatttttgaaaagctgaaaataacttctagtttaacaaaatagtttcttccagagcttagaatttcagatgattggaaaattcatacatctaggtctgaaagt

SEQ ID NO: 202466 - DNA, 601 bp, Human
gattacaggcacgcaccactgcgcctggctaatttttttttgtatttttagtaaagacggggtttcaccatgttggccaggctggtctcgaactcctgacctcaggcgatccacccgccttggcctcccaaagtgctgggattacaggcatgagccaccgcacctggactgatagatcataaatatttttaatgatagctcgttatgcgatttttggcatgtaatttggaaggtggtaaaaaaaattagtagtacaggaacagtccaggttgagtatcccttacttgaaatgcttaagacyggaagtgttttggattttggaatttttacgattttggaatatttgcattatgttaatatatacttagcagttgagcatccctaatctgaaatttgaagtctgaaatgctcccatgagcatttccttgcagtgtcatgtcagaactcaaaaagttttcagattttggaacatttctgattttgggttttcagattctcaaactgtagtaacagaaattccttcagctcccttgtatttatttatgtgagcaagggaggatcatagagtccagaagttggagaatagcttgggtaacatagc

SEQ ID NO: 202467 - DNA, 601 bp, Human
cactttcgaattacttgtgaatcttttaaaaatgctgatgctcctaggttataaaataatctattattttgggcctaggcccaaagtactagactatgatgaagatcccacaaaagtgattgtttttctataattacatatacacatatatttattctgtagttacatgcatagatagaaaaaagacttggaatctaaaacaaaagcaaaaagataaggaaaatattaatgaaaaattgaaatggaggctagccttgatccagaaggtccaccttctcaccttcaggacacatggcttaaygagcagatgatgctctttgactgggatacaggacttgatgggtgggacacaggctgaatttcagctttcactcttcagtgggatcttctagtgcatggtgcaacctgcataattatatatagcagccctgcaccttctacataataataggcctagaaagagattagaaacaaaatagaaacgaaaggaaaaaatagaggaaaatttatctgagctaaagaaaggctcagttgaagtcattagtttgaacagccttgctgattgtcaagagagtaagtgcaaaagtatccataattagtc

SEQ ID NO: 202468 - DNA, 601 bp, Human
tgatgcaaaatagcaaacagttgatattacagagtaattttttaaagacatgcaccctcccccacatccacatgttatagttcatattaagctacattgttgcccaacaaagatattttaagaacttgatataattagatgataatgattattttagtaaaattaattacatataaatgaagcctttgagagtgcttagaagcagtttgatctcttaaatctatctttttttttttttgagacagagtcttgctctgttgcccaggctggagtacagtggcacgatctcggctcactgcarcctctacctcccaggttcaagcagtcctcttgcctcagcctcctgagtagctgggactacaggtgcgtgccaccacgcccagctaattttttgtatttttagtagagacggggtttcaccatgttgaccaggatggtctctatctgttgaccttgtgatccacctgcctcagcctcccaaagtgctgggatttaggcatgagccgccgcacccggccttaaatctttctaatccctctgtgaatatattgttatattgtctgaggtttgaagaatgtgtgtactaagcagtaaatcattg

SEQ ID NO: 202469 - DNA, 601 bp, Human
gtggtggctcatgcctgtaatcccagcactttgggaggctgaggcggcaagatcacttgaggtcaggagttcgagactagcctggccaacatggtgaaatccccgtctctactaaaaatacaaaaactagccgggcatggtggcaggcacctgtaatcccagctactctggaggctgaggcaggagaattgcatgaacctgggaggtggatgttgcagtgagctaagattgcaccactgcactccagcctgggcgacagagtgaaactccatctcaaaacaaaacaagagtagtaatttgraaggtatattgctaagcaagcttagggtttaagcatatgtaatcaagaaaggtttttaatttgctgacttgaattaaaacctaaaatgtcaaataaattatcttctcatggtgaattgtaatcgtttgttactgacatttaattggtagtatatacagatatagtagattttaaaatatgcaaaaataaagacatataacttgggaaaaattaaaactgtatcccatttttcagttacccatttgtgtttcattataaatttttaaagttctcatagaagaatttaattactcatagtct

SEQ ID NO: 202470 - DNA, 601 bp, Human
ttttctgatggtgtgttagtacgttctcacactgttataaagaactacctgaggctgggtgatttatgaagaaaagaagtttaactgactcacaggtctgtaggcttgataggaagcatgactgggaggcctcaggaaacttacagtcatggcagaaggcaaaggggaagcaaacaccttcttctcatggcagcaggagagaaagagaatgagtggggaagtgccacacacttttaaaacatcagatcttgtgagaagtcactcactttgacaagaacagcatgggggaaattcgcccccycatgatccaatcacctcctaacaagtacctcctccaacatttggaattaaaattcaacatgagatttgggcggggacacagagtcaaaccatatcagattgcaagtcagtttgctataaatgcagaaagtttgctgtcatgtcaactattattttcaacaataactttttactgttttgataaataatatatgcttatatattattttatgtatgaataatatgacaaataacaagaaaataagtaaaatctcttaatggtatttatgcctcatttttggctaccatttgtacttacttt

SEQ ID NO: 202471 - DNA, 601 bp, Human
atagggacaatatatatgtttatcttaatctccaatttttgaatattgattttggattttttttgtccgttttcatatggggtatttatatttaagtgctctttaaatattcaaattttaattagcccaatgtattttatttgcctttattttttctagttggctgtttgcctgttaatttgatttttagttgttttatgtgtttatgttttgcctttgtggaacatgtgtgtaaaggcagttcttttccatacactgtgctttttaaaaaaattcattaatctatttttgataataagtmtctttatttgtgttggtataaataagtctataattattaagtaccttctgtttgccagtatagatctaacttttaaaaatagaatttttattgcagaataattttaggtttatggaaaagttgcaaagatggcatagttactatatatgttctttacgcagttttcccttgttgctgacatcctgcattattaccatggtacgtttgtcacaactaagatgtcaacattggtacactactattaactaaatgccacattttatttggatttcactagttttcccacaagtattctttctc

SEQ ID NO: 202472 - DNA, 601 bp, Human
cctgctggttaggctggggttatttgtatcaatatagactcatgggtattttaccacttaaatttttttagcattggcctgtcattctctgtgaccctttgacatgatccatactgctcccttcttctgccttttttaaaaaacactttttttcttgtgtaagatgctctaggttaatcttctgtattcccttacctggctctggaatcagccatttctccagctactcctgttttcttttattggagagtggtatgtggaaacataccattgtggaaataccagggtgcggtgctgggtrtgtttttgggtactggtgtgtcactgcttctagtccccctcagtggacagaattagaaaatactgtttgtgcacacacacccctataattatttatattatattacggtaaacacaagtttgcactgatgtcactgattctaatccagtatcacagggttccttctgccctccgtccccttgcctaactgtaacatccccctacaaaagtgagaaacctggctcccacatttaccagccatttacttatttgttcaaccccagtatgtatgtaacataggaattaacccatattccttgt

SEQ ID NO: 202473 - DNA, 601 bp, Human
ctgttgttgaaaataccacctttgtcatattttaaaatcttatatctactagaagctttctgtgcttttcttactctgttttgttttctattcttattcaagttccaaacattacataactttatgataatttcagcatctggtagattattcctgtttttgcctattcatgttctcttaattttttaatactttctttattccaggaacattttagtggacaaaccaaatgaccaatcttcaagatggtcttcagagagcaactatcctccccaggtaagattacatgtatcccttaatrctgtttagaagtcaccatttaaataaacactcaattgatactagttatctggaatctactaatagtttattctctttttgagattgtgaggtaaatttttattctctctatttttgcttgtttattaaattttggaagaatttttatctcataggcaaatgcagtgtgagatttgatgaaacatggacttttacttctgtctaccagaacagttacgctcaagttattctgtaaatgtttaaggaaatgttagtaaattgaactctgactcaatgactatcttatggggaaaataaactt

SEQ ID NO: 202474 - DNA, 601 bp, Human
ctgaatggatattgaattttgttgctattgttccacaccttaaaacctttttatgtttctctacttgtcctagaacagagtccaaatttcttaatatggtcacaaattacacctccttccagcagaaggtgcagtctcttctacctcatgagtcttggttggtcttgtgattttctttgaccaacagaaaagtctaagaaagtgatattgcaacttctaagcaaggcctgtagaagcttagagataaatgtgcttgaggaaagcctatttagcttctttgaggttgaaagcccaatcccarttaaccccagccttcccattccccactccagttaagcccagtcccctagccaatccatcagcttaatacaactacatgaatgaatccagcagctaccaatggaaaagctgtctagcaaacccacagaatcatgagaaatcatgaaccactgttgttttaagacactggagtgatttattacataacctcagatatacatagatataaaatctggacttttctagtctcatttttgtacttcctgtttctttgccagttctttccatcacagtaaatgatatcaccacttaccctgttatt

SEQ ID NO: 202475 - DNA, 601 bp, Human
aaccactgttgttttaagacactggagtgatttattacataacctcagatatacatagatataaaatctggacttttctagtctcatttttgtacttcctgtttctttgccagttctttccatcacagtaaatgatatcaccacttaccctgttattgaagtcagaaactatgtcatcatccttaatgcctccctctttttcccctgcatccaatctgtcaccaaatcccatcaattgtttctccaaaatgtgtgtcaaaactgtctactgttgtccatctccacgctattttagtccaartctccttcatctcacctctttcctgagtttattgtgacagcatcctaactggtgtgccagttcttttaatccgctctctgtaatgcacattgtgtgcatatgtgtgtgtaatgttaatcagatcatagctttttgttgtgcttaatagatcccattgaatttataattcaaacttcatgtaattgcacaaactgcatgatctggtgactgcctcctcttcattttcaacacataccattttctgccctgcctattaggctgcaaccacactggcattttaacagcagtacctagaactaa

SEQ ID NO: 202476 - DNA, 601 bp, Human
ggaaatcaggggtaggtgagggcaaaaagaggtacagggtcttggaaggattcagggggagtcttggtttttggtaaatggagagatgtggatttttgtaaaggagtcagctgcagcctggatgattgtggagacttcagagagcggctttaactctggctggatgcagcatgaaatctgagcatgaagtctgggtattagttccaggaagccctttaggagagcatgtggaaaagtgacattttagaagtatactattaagaggaaaattaatataataataatagataataacagctarcatttattgaacacttagtatgtgccagttactgtgctaagtatacttatgtcattaaatctgtagtagaatagtagatgcactctttcagaatagttaatcttgaatttttaggatctctcagaacctctttttttttttttttttgggaggtggagtttcactcttgttgcctaggctggagtgcaatggcacaatctcggctcaccacaacttcctgcctcctgggttcaagcgattctcctgcctcagcctcctaagtagccgtgattacaggcatgcgccaccatgcccggctaa

SEQ ID NO: 202477 - DNA, 601 bp, Human
atagagtttgcagtcctttgagaatctaatgccaacgctgatctgacaggaggcagagcccaggcagtaatgctcccttaacacactgcgcacctcctgccatgcgtctgggttcctaacaggccagggacctgtacaggtttgggcctgggggtttgggacccctgttttagatgacaaaaatatataaaagtatcataccccatacattttccttattcagtcggatattggaaatcattacgcctggtatcagctattctggatattctattttgatgcttcatcaaaactctacaartgttagtttcttaaagatagttgcattattgattctgaaactgcatcagtgaatctgttgttacattaaaattcactggtctatcttggactttttacccagtggtctgtcttggactttttacccaggtgtgattttgtaacattcattggttatttagaaaatatggttcactgaattacacagatctcccaaatgttgaaacacttcattatgtaatattttaaaaatcacatttattaatatcacatctaatctcatttaaaaaaatctaagtgttgggaatcagttaagctcaca

SEQ ID NO: 202478 - DNA, 601 bp, Human
tgttcttttggcagggtctctctttgtcacccagactggagtacagtggcatgatcagttaactttagccttgaactcctgggctcaggctatcctcctgcctcctgagtagcctggactattggtgcatggtatcatgcctggctaatttttaaaaatgtggagatggggtctcgccatgttacccagactggtctttaactccttgctcaaatgatcccaaagcactggaatttcgggtgtgagctatttgtttgttttctctttttcttttcttttctttttttttgagacagggtckctctctgttgcccaggctggagtgcagtggcacagtcacggctcactacagccttgacctccctgggctcaagtgatcctcttaccaagcctcccaggtagcagggactacaggtgtgcgccactacacccggttaattttttgtagagatggggttttgctgtattgcccaggctggtctcaaactcctgggctcaagtgatccacctgccttggcctcccaaagtgctagaattacagttgtgagccgccaccctcagccgaattacttctttattttatacttggttaaaacaaaca

SEQ ID NO: 202479 - DNA, 601 bp, Human
gcaggctacatttttctgttgaatcagattcatttgctactttaaaaaattcatttcttttcctttttatattgtggcataattcctgggttgattcttttttaacattattaatattttaatgtggtgaatttttcctatttttagaagcttcttgtgagttaggaggtagggctgtgttccaggatagcaagatttttccttataacaccttttttctctttaagattttgtttcttagcaatgctcataatgcaaaaatctcacttttttcccctttcccaactgccagacccttttyctgaaacatggtttttttttttttcataatttttgctcatttatgcctttgtgcctttgtgtatgctgtattctctttcctattactttcctttttatataattcagttccagtgcattcttcaaagccaactctttcaaggtatcttctttcattatattctcactgaatcactccttcctcctcttaactcctatttgccttggtgctgtatttctcattttgttcataaaagattgttaattttctgtcaagtacatttccaaacactgcatcattgtcatcatcatcatcatcatc

SEQ ID NO: 202480 - DNA, 601 bp, Human
gtgaatttatttaattttcatacttaccttctaggttaagtattgttgttatttccgtctaatatatgagaatgattaatttgcttaagatggtgtatctagtaagtgacagagctaagatttgaattcaggtagtctggtgccaaaaatccatactctctatctctaagctttaccgtcttagtaaatatttactagttcagtgtcataatattgactattatattcttactggtataatattgccctttttttcagaatttggacaaactgatgaaatcagcttcttaaaaattctttytgatctaatcattcttgaatggtcaaaaaggattttatgctctataagttatttacctatacatgcattttaaattatttcttttgtatgtaatctctattttggtgcaaaatcaaatttgataaaagtttgagtttaccaaatataaatacatacaactaggcagcagtactataatctatgtggatttttttggttttgttttctttttaattctgggcaagagatttgaaattttttccccttttggtgaaagcttcctaaatcatgttttttaaatcatgttgtatgtgtatgtgg

SEQ ID NO: 202481 - DNA, 601 bp, Human
tcctttcctcttcttaattatatttatgataatgatagaaatgattttttaaagatatataagatcttttttcaatgaagtagaacatttattcagattatttatttttattttctcctgcttctattttgcagccttaaattgtcttatgactttttttcccctcccagttcactcccttttccttctttcaaggtctctaaccctctgataatgtcacatacgtgtccgttgaatgcaacagtgactttgtatctaatacatacagtgatgatgagaaacatagtacgtttaatatgarcttcccctaaagcaatttgtttgcatggttgtgtcaattaatattttactatttatatttgaggtagcatgaagtgaaattgaagtgatgcatattttatgaaaatgtgcttttgtattagtgacatattagtaatttcttttaatgtagccttttaaattttaatttttttctataataaataatgtaagtagttaaggtgtaattctttctcattcttcaatatttgcagatggcttgttcaatcagtatatcagtcaacaggaatataagccacgatggagtcaaatcattcccaaa

SEQ ID NO: 202482 - DNA, 601 bp, Human
tttgcagatggcttgttcaatcagtatatcagtcaacaggaatataagccacgatggagtcaaatcattcccaaaagtaccaaaggtaagccataccttctagattgtagttctttttcattaatgtctcagtcttcagttttcccaaggtagttcaagtatcatagtactaagttaataaaaaagaagatgttggccagttgcagtggctcatgtctaatcccaatacttttggaggccgaggcaggaggattgcttgagcccagaggttcaagatcagcctgggcaacatggtgagacctgtctctacaaaaaattagctatacagccgagtgtggtggctcacacctataatcccaacactgtgggaggccaaggtgggcagatcacctgaggttagtagttgaagaccagcctgcccaacatggcaaaaccctgtctctactaaaaatacaaaaattagctgggcgtgatggtgtgtgcctgtaatcccagctactcgggaggctggggtaggagaatcacttgaacctgtgaggcagaggttgcagtgagctgagatcatgctattgtactccggcctgggagacagatggagatt

SEQ ID NO: 202483 - DNA, 601 bp, Human
tatcctgttagtagatattttagttagagccattttgtacctatttggagtgctttctttttttcttttattcgttatgaattctgggtcaaactttatttaggcccatggttgatgacaaaactagatttttcagcctttaaaagaaatcatgggtggtcatttaatatacagttgtctgttgctcaagttctcatgcttttcagtatgttaccattgccacatatagtgtggaaacagtactaactatacgtggacattgaggtcgaaaggatttcaccagattcaggtggtccttgayatcagtaatagagatggcatataaaacatttggaggtggaattcctcttctgtttttttgtttttattttttacgttcaaaaaatatgtttccaagaagagctatctgaaaccttttgtcgacattttgatatcttagtacagaaatagggatagaagtgatgattcgttttaaatttatcattcactatagaggggaagactagaaggacacataccaaaatattgacgttagttacgtctggtggtacaattaccagtgatttaaaatttttttatttaaaatgtatttttaaaattt

SEQ ID NO: 202484 - DNA, 601 bp, Human
tggcctcccaaagtgccaggattacatacatgagccatcgtgcctggcctcattacagatattcttaaaggacttaatccctatcttaattgacattttatggtaagtactgctgaaccaggtattcaaataaagtgtcttcatacaggtgatattcattattgaactgatattattacaaagtaaaacattgccacctttctactactcttggttttttttccagaatttttgttgctagatcagaggtatgtgagaaagagagtgggaagaggtgaagtcagagaaagagagtgggaaraggtgaaatcagagaaatagctgggggcacaaactgtgttgagttttttaggactttgtttaggactttaacctacatgcagagtgaagtgggaagccattgttgggtttaagaaatgctatgaactgaccttgcattttaacaaaacaaattgagtgaagggcagcgagtcctttaaggatcctattgctcacctgagaagtgattatagcattggcttatactagaatggtagtagtaatgttgaaaattggtcacattttggatgtattttaaaaggtatcatataaatgctaaatg

SEQ ID NO: 202485 - DNA, 601 bp, Human
agtaattaaaaagtttgtgaaaaagtttaaaacaacttgaaaagcagtgttgaggggaaaaagtaactcactcataattccacattctaaaaaaccaatgttattttggtatatttgtttaatcttttatataattggtgccttaggaagggacaccataaatatatttataatatttttgagacaaaatactaaagtgcatataagaattttcttgatgaagatcaggtaggtttagtagtgaagaataactttctctaagtagagtttgaacaaccaggaaattccatgttaacaaaawtggtgcataagtagtaaaatatagtttaaagaagcccagttattactttaagtatgcattttaaagttttctagcacaaggattctttatctgttgaagttaggtgcaacatgttgtctgtttgcaaattttttctaggaagaaaatctgtggcttcagataatcaaagagactcttactaactcacaaaattaagaacactggccagacatggtagctcatacctataatcccagagttttgggatgctgaggtggaaggatcacttgaggctgggagttcgagatcagcctgggcaac

SEQ ID NO: 202486 - DNA, 601 bp, Human
cactgagatgtctttatataccttacatttctacattatttttagtgcatataagatgtgtagattggtactactggtagtcggtagctccagggtttgttttatactggtaccaaattggtacatgtactataccaaagaatgtggttgaattttagtttttgtggcctaagtaatgaaaaatagattgattggtgattgactcagtgttttagaatgaaatttgtttgccgtttcgaacataggccactttacctccaatccctgtcattctcaactccttcagtcagtcctgtatgcygcaagttcagatgttaccttgctacccctctgcctaagatcttctgtggcttctccactgtctgtgtggagtcaagttcaaagtctttatcctgttatttaatcccttccatgatctggacacacctgtcttttaacctcctctccacctcctacctatgtgttcttttaaatcaaacagtgtatttattcatcacacagtttaaccatttaacatgcattatttaatttaatttaattctcacagcagctttatgggatagatactgtatcacatcttagagattaagaaaccaatagt

SEQ ID NO: 202487 - DNA, 601 bp, Human
ctggaatattgtgtttttgacactcactatctccctattttggctcctgttattttactatatgtcagttttcataaatgatatatattatcttttttttggagtcttgctctatcgcccaggctggagtgcagtggcaccatctcgactcactgcaagctccgcctcccaggttcatgccattctcctgcctcagcctcccaagtagctgggactacaggcgtccgccaccacgcccagcgaatttttttttgtattttagtagagacggggtttcaccatgttaaccaggatggtctckatctcctgacctcgtgatccacccgcctcggcctcccaaagtactgggattataggcgtgagccactgcgcctggctgatacatattatctttaataaaaattgtatatatgtatgcatgtacagatctgtgtatgcacatatacataaagcatttccatagtgaataagatggcttaggtttatggctttgaattaagtgcatgattatatcctggaataaagtaaatgttaattcatttattattttttcaaatctttatagaacattttaattgcactctccatttaaactgtttca

SEQ ID NO: 202488 - DNA, 601 bp, Human
gtggcatatagtaataagcatttatttgctcatgagtctacaagttggctcggtcattcttttggtttggccgggctcattcatttgtctaggagtcagctatctgtcagctggtctagtgtggtttcagctgggactgcctggctctgttttatataggctagccagagcttgttctcatggcaggtgctgggctgcaaaggggatgaagtagacatgagcaatccatcaatttttttcttgccctgatagcaaaaagcaatcatgtaaccaagtccagagtcagttggtgcaggatacyattaaagggcatagatacaggaaattgtaaataacaacaacaataataaaacaatttatttatctcacttccttttgcttagagtaaaaactcgaaatttctcatcaagatttgctactcaattacttttccagcctcatctcccatgtgccagttaaagttgctggaattattcaactttctcgcctgtgtcctttggcaatgttgttttccttgtttggaattaacagagggaggctctccccctaactttacctaataaatacccacttattctttaaaactcagttcagacttcac

SEQ ID NO: 202489 - DNA, 601 bp, Human
ataacttggtcatcattttaatattatttgtgctaatttagttgaagcaagaagttctattattctcttattaaaatttcaagttttacactctatgcattatggcatagatttattatatgttactccgtctttgtttttgagattatttatggaggcaatcctttcttaaatcaaattttcaccttatttgctgaagatattctttgacaaaaaatattttaaaataagtttgaaaataattagtgtgaatattaaagtgtacattcacatcaacttcattgtcaaaatactgttcttyctgcctaatattccttcatttcacttaattaatactgctagattactcttcttagaatactgcctttttatgttatatcttgctttagaaaccaccagtagttctttattgcctacaagatcataaattgtctcctctgtcagtcattcatcaggctttctgtgtccactttatacatcaattctgttatttctgcaggaagaactcttcatctcagtcataactgcatagactgtattaacaagtatatttttgcctttgtttttcttctagaaaaaataatctgaaattgtgaaagag

SEQ ID NO: 202490 - DNA, 601 bp, Human
agaaatcctctgtgaagttatctggtccagggaaattcaactcaattacatatgaaaaactaaaaagcaataaataacaaagctttagagagacattctaaagaaaaacaataaaaagaaaaataacaataaatgaaagttatatcccagtacattacccctttcagaaatgaagacttatctacaaagagcgtaaagaagaataggtaatgatcatatagcataggaataagataaaacaaagaggtaaaaatgattaaccagggaaggtaggcagaggagagccaacatatatatatataactggagactttaaagaagaaagccaaaacaatggaaaaaacaaatatttatcaattgaattcaggaacattttcctgaagaaagattttactccgcatgtcaaatgggcatactatattcagaaaaagttgacccaaatacttaactctaagacatatattaataacactgactataaaagataagagatcattttatagcaagtagacaaaatgatcaagtcacctataagagaactaaaatgagactggtatcagatttctctacatctactttcagtgccaggagataatagagc

SEQ ID NO: 202491 - DNA, 601 bp, Human
aacatgaagtgtatagcttaattcaaagaaaattaaatagtgctatgttaaaagtaggcagagttcttcacattgtagaagtcagtctggagacttgattgttgtaaatgtccttttgtttgtttgttttactgttttgtaacataatctgaagggttttataaaaataaatgcagagaggtgaatttagcttcaccactcttatttgcatatctgatcgcttagtaaatggtagtaatattaataggatgcttgcctagaatgaaagaagggaatttttataaggagggtatgatcactrttcacccagaatataagtattcactcttacatataaatcaacgcctcatgtatcattggttgattttgataaaaattatgcaatttcaagaaagcagaaagctctttattccaacatgtttttaccctcactgacaaaaatgacaacttgaaaaattatttagaaacttgcatatgataatcaggggtggtatttagtgtcattagggacaaagtttagggtttttttgagaatgtaaaactgtacatgttggttttgttttagcacatatgacaggaacaaactaaaactattcaatct

SEQ ID NO: 202492 - DNA, 601 bp, Human
attgtgggattttttccattattgtggttttattaatgtgaactggagatgttattagaaaagacaaatggattcattgtttgattactgctataatcaatttttctaaaatcaaaatcaccattttttactgtgtgtgttcagtgtgtaattggtttacacaattgaattttcccacaatgcaaataaattcattaataatatttgttgaccatctactagcatctaagtttgtccctctcccttcctccttccctccccacttagttcattgtcttctgtaggcccaagattattttasgcacttgggattcatctatggacctggaggataagatcctttcccttagaggactcacattctagtggagagagacctgcagttgtgttctaagtactgtgaataaaatacactggatgccgtgataatgaataacaagggaagtctcatttaaacagagtaggttgggaaaccatctttgaggaggtaatctttaagatttaagatgaaaagtagagaattaggaagaaccatgtgaagaactgagagaagaacaagtacagagttcccaaagcaggaaggaacctgggatgttcagaa

SEQ ID NO: 202493 - DNA, 601 bp, Human
aataatgacaaactagcaattaagacaaagcttatttcctacaatgaacaaaaggctcttataaaccaataaaagtggataatcctgtagtagaacaatgacaaattatatgaatagatacttcgaagaaaaaataattcatattgccagtaaatttacacatgtacagatgctcagctttattcataacttttaagtgtaaattaaaaaatcactcagtgaatgttggtatggccatgaggaagcaggtgtcttacattctggttgaaatgtatttggtacagcctttttttttttttttaacagtactttatcattatctgttaaaatacaaaaaatatatttttttgactaagcattttactccacgaacttttcctactcatatacttttatagatccacaaaaaataagctatacagagatatttattgtagtattgtatgcaaggagaaaaaatctgaagacggattgaccatcaacttatttgatttttatttatttgattgtccaccagtaaataaattggttgatccattcaaagagttcagttttttatagcttaatacagctgagataaatcagtaaatattgttgagtg

SEQ ID NO: 202494 - DNA, 601 bp, Human
tggaccgtgaagcaaaaatagagttgagattaattcataagttaatgcaataacatatcttcctcaggaattcaaaggacttcgaaaatatttgttaactttttttttatcccccctcccacagggtttctttatgttaaatattctgacaatctctcccatttgcttagaggataaaccaaggaaggaagagaaaagatgtgattcagacatatagataaaatttttttacttcccctttagctgttctattttgagttttaaagatgttaaagaagaaatagagttgaaggattatcaytgtaacttcctaaaacaattataaaaataacgagttggcagtgataattgttgtatcattcttattttctgtttttttcagataaatgttctttcaaaatatgttaatgattaacgtttactgatctgcttgattaatttttctttgtgagtcagtttctaaactggttaaggttaaagactggttaaggtcctggcatttagttgagctttttagcagttgaatcttaaagtttttaaaatcgtttatgttgcaggtcttttgtccttccctcctcccccgcaaatatacccattagaa

SEQ ID NO: 202495 - DNA, 601 bp, Human
gaaggctcactctcccccagattacccttcagttaatttttaccctttcactatagaaactagcagcggtagcctagcccactagtgtcagaattcggtgggcaaacattatgtcagtgcagaaaccctgctggagttcagagttgatgaaaacatgtggactgaccatctgttctcaatagttcatttcttcttctcttctccctttgtccagggagactgccttctccttcctctttaaacccttgcctgaagggtttaaaggtacaaaactgttgcataggggcgtgatcatatatgracatgattcttggttctttgtgcttatgcttcagaaccctatgacttttcctctctattttccttaatctctaccagttaaggcctggcctttgagtcctctccaatatatcttaccagaaagaagagctgattccctgaaaaacattaccttgcatactgatataactagacagttgaggactacaactgtctcaaaaaaaaaaaatgagtaaacttatacatgatgtaaagcagaattattaaaacagatgaacggccaggggtgatggctagtgcctgtaatcccagcacttttgga

SEQ ID NO: 202496 - DNA, 601 bp, Human
ggcactattctagacactgggaacaaaatagtgaacaaaacagcctctttccttgtggagctcatagagtaaggagaaggcaatatataattgtttattgtttagttaaaaagttatgtagtgtgttagaagttaagtatgtggacacataaagcagaataaaggtgtattgatcttttcaagagaaactagtaggggctggatgtggtggctcacctgtaacaccagcactttgggaagatgaggcaggaatattgcttaaggccaggagtttgagaccagcctgggcaacatagcaagwccccatctctacaaaaaataaaaaaattagctgagtgtggtggtgcatgcttgtagtcccagctacttgggaggctggggcaggaggatcctttgagcccaggagttctaggctgcagtgagtcatggttgtgcctcactgcacttcagcttgggcaacagagtgaaatgctgttctttaaaaaaagaaagaaaagaaaggaaggaaggaaggaaatactaatctatctaatgtgaatattttcatcttatttttttctttaatttgtagttccaatgacaggatttacacagagagcaa

SEQ ID NO: 202497 - DNA, 601 bp, Human
tcttgtgtctataagaatgatcaagctgcaaaggataatccaactaaaagtcttcaggaagaagaaccatgtccaaggtttgcccatcagcttgtatacgatgagctacacaaggtatcctaactacattgacctgtaaactttccatggcctactatctgaaacaatccccaaatatatctttgattgttttaaattggatttgagtaaaaagttaaaatacatagtagacattcaatagaataacaaacacccaatatcacttctccctaaaattccttaagagaataagcatttttaygtagtctgtaattcttggtacttttccttttttgaaaatagtcagtggcagcttcttagctgtatagatctagatacatgacatagcctattgtttctacaatgtgactatccaagtaaaatatgtacagttgtcagcatttaggtaccttgttccgtgatataacatggtttttggttttagattttcctattgtgtgcgaagtctttttaatcttaattttcctgatatactagtgatacctcttttaaatcagccttgtgaaatggtcctctgttgtgaatttttagtgtcatagtg

SEQ ID NO: 202498 - DNA, 601 bp, Human
tcaagaaggcatcttaacattccggataaactttgaagattgtgccaacagaatttcttgatggatttgatatgggtatgagagaaagaaagcagtcgaggatgactcttagggcatcttgaaaatcttgtcaactactaattcagacaataaaaggcttattttagacctttttctctaccaagctgttagataaattcaagaatttgagggacatcgctacattatagacagaatagaagaagtttgtgtctatgaattgggtagaacacagaaattgcctttttaattcaaatgttawgcagatttatttttttataatacgggagcttgtactacactgttagactggcttatttttgttttgttcgtaatggaaaataaatattctgtttagttagaatataaatttagaaggagggaaagaagtatattgtgtgccaagtaggtacctccttgtttcttactgatgtcacttgatataataaataaaataccactattattttttcatacgacattcaggtttccaaacttgatgatttgagggtagaaatgggcaaaaaaaattgttataggattaatttctgttaatttagga

SEQ ID NO: 202499 - DNA, 601 bp, Human
ggataaactttgaagattgtgccaacagaatttcttgatggatttgatatgggtatgagagaaagaaagcagtcgaggatgactcttagggcatcttgaaaatcttgtcaactactaattcagacaataaaaggcttattttagacctttttctctaccaagctgttagataaattcaagaatttgagggacatcgctacattatagacagaatagaagaagtttgtgtctatgaattgggtagaacacagaaattgcctttttaattcaaatgttaagcagatttatttttttataataygggagcttgtactacactgttagactggcttatttttgttttgttcgtaatggaaaataaatattctgtttagttagaatataaatttagaaggagggaaagaagtatattgtgtgccaagtaggtacctccttgtttcttactgatgtcacttgatataataaataaaataccactattattttttcatacgacattcaggtttccaaacttgatgatttgagggtagaaatgggcaaaaaaaattgttataggattaatttctgttaatttaggaacagggcagaactgttgattaaa

SEQ ID NO: 202500 - DNA, 601 bp, Human
tatattcactttgtttggtagttggtttagtgctaccttgtagttttaagagaagataggaaatgctcctacccagtctctagcaccacagctgcctgtgaccacctggcattaccattacatttccaagaactccacaactacactatctacctggcagtattgttaattctggattcctaaactgacattttctaaatatccagaacaactcctcatactcagtataacagtgtattttattccaggtctgaaagacatttctgatattttctcataactccagataattatccttgtktacattttctaggtttgaagaaaaggcccaagtggatccccttagtgctctgaaatatttacaaaatgatctttatataactgtggatcattcagacccagaagagacaaaagaggtaaagaaaggtggtaataaatttcagaaattaagtatttttaaatgtcttcctaacttatatttaatgattttgctcttgagtgtgtaaaggaaaacgaagaaaatatgatgacatcagtaatctttaaaatgtcacagagcaggtgaaataaaaattgaataggcatgttttcgtgtgataag

SEQ ID NO: 202501 - DNA, 601 bp, Human
ttcctaaactgacattttctaaatatccagaacaactcctcatactcagtataacagtgtattttattccaggtctgaaagacatttctgatattttctcataactccagataattatccttgtttacattttctaggtttgaagaaaaggcccaagtggatccccttagtgctctgaaatatttacaaaatgatctttatataactgtggatcattcagacccagaagagacaaaagaggtaaagaaaggtggtaataaatttcagaaattaagtatttttaaatgtcttcctaacttayatttaatgattttgctcttgagtgtgtaaaggaaaacgaagaaaatatgatgacatcagtaatctttaaaatgtcacagagcaggtgaaataaaaattgaataggcatgttttcgtgtgataagattcaagtcaccaaaaacccttggtccattcagaaaaggattatcaggtataaagttttaacttagttttgtgttttggaaagcaaatagaaatttttactttgtccatagtcccatgattattttacttaaggattacataatggttcaatataaacttttctgtggatagttaa

SEQ ID NO: 202502 - DNA, 601 bp, Human
tagcaaaaacctgtctctacaaaaacatgcaaaaaattagctgggtggtgccatgcctgtagtcccagctcctctggaggctgaggtgggaggatcacctgagttcagagaggttgaggctgcagtgagctgtgatcataccactgcacgctgaaccttggtgacagagtgggatcctatctcagaataaattagaataaaataaaatcccaagagagacgttacaagcaaagaaaatcatggaccaatatttttcatgaacataaatgtaaaattcttaggaaaattttagttaattagkaatatattaaaaggttagtgtactatgactaagtggtggtttattctaggaatatatggctagtttaacatttgaaaaaaaattcagtgtaattcaccatgttaacagaatgaaggaggaaaaccatagatcatcttagtaagtgaagaaaagcatctaagaaaattcagactcattcataataaaaattcttagcaaactaggaataaaaagaaacttcttgaatctaaattcctaaaggacacctgtgaaaaacatacagctagggctattcttaaacatttaacccttttccctaag

SEQ ID NO: 202503 - DNA, 601 bp, Human
aggctttgggaagaaaacataggagattatcttcacaacattgggataggtaaagatttcttggacatgaactaaaggcagtaatcatcgaagaaaaatatggataaattggacttcaaaaaagttaaaatttctgctcattaaaggacttttaaaaacatagacattgccaggttcagtggctcacaccagtaatcccagcattttaggaggcctaggaggaaggattgcttgataccaggagtttgagaccagcctgggcaacatgtgagacctcgtctctaccaaaaaaaaaaaaaaagtcaaaaaatgaggcaggaggattgcttgagtccaagaggttgaggctgcagtgagccatgatcacgccactgcactcccaccttggtgacagagcgagaccctgcctcaaaaaataaataaatagacaagccacatactaaacaatctttgcagtagatatatctgacagaggactgatacccagaatgtataaagaacttctatacatttttaaatttttctttttatccccccttttcataactcttgcttagataaatacctatggaatatttgtacaatttctgatcttcaaagg

SEQ ID NO: 202504 - DNA, 601 bp, Human
aatggcggtaacccaggaggcagagctcgcagtgagccgagattgcgccactgcactccagcctgggcgacagagtgagactccgtctcaaaaaataataataataataaatttaaataaataaataaataaatcagccgggcacggtggctcacgcctgtaatcccaactactcgggaggctgaggcagaattgcttgaacccaggagggggaggttgcagtgagccaagatcgtgccattgcactccagcctgggcgacagaggaagactccatctcaaaaaaaaaaaaaaaaaaaaawaccaagactgtaataaagtgggtggtctctagaacccagacctttacttgggtgaattttcaagggcattttcatcaggataacttatgatagcttcattttttaccaagataatcgtcttgaagtatggaaattcccagctttcctctggtcagtgaatgcatattaatcccattgatgctggtgcagttattatttgccttagagttgagcaatagtattgaaattttccattgtatgtaatataaatactattttttatgtttggaataaaataacactttgggatatcaatttagt

SEQ ID NO: 202505 - DNA, 601 bp, Human
agtaacatagcaggatcttgtctctatttttttaaaaaagtcacctttgtaacactggtgaatttggataaggagcaaattcagattgtatgctaattttaataatgagaaatttgatttagtatttataaacaagaagtacttttcataaggtttcatgcctatttagagttcctggttcttgttcttattaattttctgtcagactgttctatctttgtgccaattagaatagaaataaaatgggttatttactgtacctttcattgtataaatgaatatttcattttctaaggtctgmaaaaaaaaaaaaaaaaaacctcagccgaactttctgaatgacttcctccagaaataatccaatttatgttcatcccttagtgagaattaaataaaagtattaatattgtatgtaaaattttaaagaatcagaaagatggaaggtgacattatcttagttttggaaaaatgagtgatctcggagaaaatctccaaggatcttgattttagagcttctggtggctataggcacttttaaggttgaactcagtcactttgctaagtttaagagctatatcttatttctagaaagtatgaattg

SEQ ID NO: 202506 - DNA, 601 bp, Human
ttaaagaatcagaaagatggaaggtgacattatcttagttttggaaaaatgagtgatctcggagaaaatctccaaggatcttgattttagagcttctggtggctataggcacttttaaggttgaactcagtcactttgctaagtttaagagctatatcttatttctagaaagtatgaattggagcaattaaacttattttcagcagggtatgtgacaagtaggaaaaatctggtctgtaaagcatgttgcctatttatttatttattcattcattcattcagacaggatcttgctctgatrcttaggctggagtgcagtggtgcagtcatggctcactgcagcctggacttcctgggctcaagcaatccttctgcctcagcctcccgagtagctgggactgctggcatgcacaaccatgctgagctaatttttttttccttttttacattttttgtagagatgagatctcactgtattgcccaggtttgtccttttttggtcctcacaactctttttagaagtttacagtccaaatataaagtttagtgttagaaataagaagtgtacatttaataatgtgtatgctaggaaaaaaatgag

SEQ ID NO: 202507 - DNA, 601 bp, Human
tgtgtatgctaggaaaaaaatgagaattcatgttatttctcctttaccacaagtaggaaaatccagctacgtgtaggatgttaagttaaaagtatattcctagccaggcatggtggtgtgagatggaagaatctcttgagcccaggagtttgaatccagcctgggcaatgtagcaagactccatctctaaaaacaaaaaattactcctaataggtcactttctttttagagcagtcattgtcatcagtcatactactagtgatatgctgatagctaattaatatttattgagcacttactrtggggccaagtgctcttctaagcactttgcatgtcttaacgcatgattatccccacagtagccctatgaagtagctactgtatgatccccttttgtatatgaagaaactaggttacagagaggctaaactaacttgcccaggcatagtgctagtgaatggcaaaccaggattaaaaccctgtcagtatggcttcagagcgccttttctaaaccactaaatatgctacctctcactgagctttaccagtttccactgctcaaatggttacttcctctttccattttactttatttatgaaa

SEQ ID NO: 202508 - DNA, 601 bp, Human; identical to SEQ ID NO: 36970

SEQ ID NO: 202509 - DNA, 601 bp, Human; identical to SEQ ID NO: 36971

SEQ ID NO: 202510 - DNA, 601 bp, Human; identical to SEQ ID NO: 36972

SEQ ID NO: 202511 - DNA, 601 bp, Human; identical to SEQ ID NO: 36973

SEQ ID NO: 202512 - DNA, 601 bp, Human; identical to SEQ ID NO: 36974

SEQ ID NO: 202513 - DNA, 601 bp, Human; identical to SEQ ID NO: 36975

SEQ ID NO: 202514 - DNA, 601 bp, Human
gcttcttccctgtggcccctgcctgtctgggctggagtggtgtgagcctcccagggctggccagaggacaaggctgatgcccactgcacctgtggagcctcaggaggctgctgatagactcctgacgagtcgctggtcccgtgttgaaagggacaggccctgggccaacccacccctggttcctgggcagagggcgggccagccatctaaccacctcagactataggctccctggagacctggcatgctgatataggtggcatggtgggggtcagggggatgctgggggcgggtacctggktccagcttaaggcatacagttctgggcctagggccacaccccatacccagaatcccttgaatctgtcatctctggggtctttactcatttgtagcttgtgccaatggatgggtagagcatggcagggatagtggctcctggaggctagaagtacagcaaaggcccttctcattttacaaaagattttttttttttgaggcagagtctcactctgtcgccaggctggagtgcagtggcacaatctcagctcactgcaacctccacctcccaggttcaagcgattttactgcctcagcctcc

SEQ ID NO: 202515 - DNA, 601 bp, Human
ggtgagcatggctaaggctactagcttgggaccttcaggatctggccctaaattggccctcaaaggggacatggattagatgtggctcccactccaggaccttcctgttcttagtatcactagtgaccaagcctagaagtccttacccagctaagcaggcatttactatctcccaatattgggctaagcacaacctctggtacagttattttacctgtcttgtgagtggtagctgtggccacgaggaggaaggtgacatctccccacttatagcttctgcccattgcccaggaagaccagracctggggacctcagtacatgggcaggcctgggcccagggagcttagccagctcatgatggatcacagtcctctccttgcatctgcctagccctctccccccagttgccccagctcagcctaggcaacagtcgtgggctctgtgtctttctgcctccctggtgatgtactccaggttaaccagggtggcctgtcctcatcttataacttgaccttgttcaggccatctctgcccatttgtctcatgctcatcctcttggctctgttgcccaagatggaagatagtgcttaacaggaagcc

SEQ ID NO: 202516 - DNA, 601 bp, Human
tatctcccaatattgggctaagcacaacctctggtacagttattttacctgtcttgtgagtggtagctgtggccacgaggaggaaggtgacatctccccacttatagcttctgcccattgcccaggaagaccaggacctggggacctcagtacatgggcaggcctgggcccagggagcttagccagctcatgatggatcacagtcctctccttgcatctgcctagccctctccccccagttgccccagctcagcctaggcaacagtcgtgggctctgtgtctttctgcctccctggtgatrtactccaggttaaccagggtggcctgtcctcatcttataacttgaccttgttcaggccatctctgcccatttgtctcatgctcatcctcttggctctgttgcccaagatggaagatagtgcttaacaggaagcctgaaactcagcaaacactcataaaacaggaagagctgtggccactgtccttgtaactgttgctattctgtggaggccctagaggagcaggtccctccctcccagggagctgggcctcttccgctttcccttagcccctgaccacctgcttggttcatcttggcctc

SEQ ID NO: 202517 - DNA, 601 bp, Human
tgtcctcttggcaggaactggaggactgcctttcttggagagggtgtatgggccaggcggtcctccagtgtctgcttctcctgctgacctcttgcttgtgccctctcccaggcttaactagttaattagtaccttcagctttccctctaactgggcacagccctgcagatttgtcacacatcagttaccccaccacatccaagatccagtccttcaaactttatcacatacatgaaaattgggacccaaagtgagtcacacggtttgaagtggggggtgtagcagaggcccgaattttctyccctcctgacatcctgcccagccctcttgtggtttttggcctcttggcaggcagaagtgaccatggcacttagtatctctaaataaaagcaataggctgggtgcggtggcttgtgcctgtaatcccagcactttgggaggctgaggcaggaggatcatttgagtccaggagtttaagaccagtcttggcaacatggtaagacccttatctctacacaaaatttaaaaattagggctgggtatgatgacttatgcctgtaattccagcactttggctgaggcgggaggatcacttgaagtc

SEQ ID NO: 202518 - DNA, 601 bp, Human
aggtccctctttctagaagcatttccctccactcttcccatcccccagacttagcatttcagcctttgtttccaggttgtctggggctggtgggaagcagaccaactgaggccatcaaaatttagtaaattggaggaatcttgtcttcctaagacttgatgatttcaaaatttgtgttggctatcctgtcccagagcttcctgggaagacactaggcttggaacctcagctactccctcccctcccaagaactctggtgagaagtggtcaggtggaggttcccagcctgtcaagctgccaycctgccccccatcaggtgtcctggccttggcctagaaggggagtggttgtttaggggtcctcctttcttgtgagttccctcagaaggggctggccttctccatcttgcctgttctgccaggttctggttctggaaagaaaggagaagggaagggaaggagccaggaccagtttcccaggtgtagatgtcatcatcaagcatcccagttggcagtgactcatccatagacccctaaatccttgaggacagagtgcccatggcagcattcccagtcccagtccaggtctagcccccagacag

SEQ ID NO: 202519 - DNA, 601 bp, Human
gggcaagtcacttaacctcccagaaggacatttccccacaggtagaagggcgctgctgatccttgttgggttatggtgaccactgtgtgaggtggcctctgcacagtactggcccagcaccagggacagactgttgtcctgtagggagcgctaatcccacctgactccatcattccctcagcacctacctggggcctggacgtttggggtcagtggtatcatgtgagccgccctccttggaaccgagcctctgaggaggagaggtaaatggacagggtgagacagaggacaggatgtggtyggaacttaatgaagcgaggtctcatctggcaggaggccaactcatccatagctgcaaaattggttccattagctcctttaatgagctacgaaagctcggagaatgagtttgtgagagaataatggcacatgtctgcagctctgatttgaaactgtggctaaaaagttagatattacactaccttccagctctccaaatagcaccagtgcccttgtcgggagggagagggaggacatggggggcaggagcggggttctggcattataaggaagatgctgaagctttaagaaggaaaagtct

SEQ ID NO: 202520 - DNA, 601 bp, Human
ccccacaggtagaagggcgctgctgatccttgttgggttatggtgaccactgtgtgaggtggcctctgcacagtactggcccagcaccagggacagactgttgtcctgtagggagcgctaatcccacctgactccatcattccctcagcacctacctggggcctggacgtttggggtcagtggtatcatgtgagccgccctccttggaaccgagcctctgaggaggagaggtaaatggacagggtgagacagaggacaggatgtggtcggaacttaatgaagcgaggtctcatctggcaggaggccaactcatccatagctgcaaaattggttccattagctcctttaatgagctacgaaagctcggagaatgagtttgtgagagaataatggcacatgtctgcagctctgatttgaaactgtggctaaaaagttagatattacactaccttccagctctccaaatagcaccagtgcccttgtcgggagggagagggaggacatggggggcaggagcggggttctggcattataaggaagatgctgaagctttaagaaggaaaagtctgcttctgaactctgaattcagggtcaatcccat

SEQ ID NO: 202521 - DNA, 601 bp, Human
tttatagttatgaacttacatgggtttctggtgcattttgtctttttcttcattctaaagagaatctgctgtttttgtttggtttggcttctgtcttgttttagaattataaaatgtctgaaatactgttgttaataagcagggcttgcagaaataatggtgcttggagggcctcaaggggtggtgagaggaactagatccttggcctccaggaggaagttccctttgctgtagggctgatgtctctcatactgtgagttgtcacaaaatccagagcttcagcttcttaatttattactgyctcgttgatgggagagataagtcagctctcttaccccggaaacagtgggtgttctggcagaggccatacaacagcctggccggggctgcaggttaattggccaggggtatggaggttggggtttggctgcaagaggtgttggggaaactgcttgtccaagctggtagcctcggcgcttcctgtatgtgagagatggagatactgtgggcactttaacttgagaagagcccagcactggggtgagctggatggggacacccatgtgtgggtgggtggacctggatagggggcccttcctgg

SEQ ID NO: 202522 - DNA, 601 bp, Human
gttctccttcctcctccagccttgccatcctgcagccaggtggccacagggcaatgacttcatcctcccaagcccgtgtttcctcaatctgtaaattggggctaatggttcccaccctgcttgcctcacagggtggcaccaagcattcccatgagataagggacagcagagtgttttgtaaactgcaaattgttttccaaacaggcaaatggtgctgttgttttcccagctatggaactcaagaattcctccacccacaagtaaaccctgtccttgggtggaaagggatatagtggtgatrgtgaggggcctggcctgttttgaggcccccacattccacctggtgatgctagaggggcacgggcccttctgctctcaaattttgctggggctcactagctggtgaagtcagtaggggtcttggccttctggctgctggctctgggggcaagagagagaatttggcaaaggaggatgaggggagaagggaaagtgaaaaccagtatatcagagcctgaggcctgtggtcactcgctaaaggaaacatcatctcaaattcaatgcttgttgagcttcagtggggacccacacctcaggtgca

SEQ ID NO: 202523 - DNA, 601 bp, Human
gactggccctgccctgtgggcccacagtctgatgagggaggctgctggtgttggcctggctgggggatcagccatgtgatttggggccagttacttcccctctctgtgcctcaatttctcatccaaaaagtggtgataatgaagtcctttcctcctaatgtttataaagtactccaaacagagccaggcacattgaaagtacaatatctgtatgtgtgtttttgcttaaagagttatcaaaggaacaagctaattgtatgttgtgagcaagtgctgcacaggaagtgaaaagggcgatgaygtgagagctttctggggagctaggaatgttttctgtcttgatggaagtttgggtcccaagggtgtgtgcaatcatcaaaactcattgaattggacccttgagacctgggcattttactatatgtcaattatacctcaataaacaaagcatatattgaaagaaagaaaaacaaaggatgaagagggagggcttctgagaggagatgacattgaggtggaccacattgaggggaggcctggaggagaaggctctggctatggggaaggaagatgagaaaactgaggctctaggaggttttgg

SEQ ID NO: 202524 - DNA, 601 bp, Human
aggagaaggctctggctatggggaaggaagatgagaaaactgaggctctaggaggttttgggctcagggtcaactcaaggggtcaggagagacagctcaggggatttcttggcagctggacctgggcccaggctgagggctctggctcctgtgatgtactctgcagagaggccagtggggcgtttattatattttccggggacggccctctcccctgtccctatgcctattttcagggctttggcgtttgtagagggactattttaatccatgtgggaaatgggttcctaaatatggactyagtggggcagaagccttgagaggctccagctcagggcagctccacctgctcctctacctcagcaaagcacaggatgcaggcccaggctggaaggctctccagcccctccttggccatctaccgccctccttctttccctctggctcctcctatctccctccagtcctgggcccatcctcccatcctttgtttgctcggaagcccagtgtttcctgccaggccccagccagggacccccaagtgaacttgacctgcctctgccctcaagctgctcccaggctggtaggaggaacagaagca

SEQ ID NO: 202525 - DNA, 601 bp, Human
ggtcctcccttcccccagtctctacctctgggtccttaccggtgatctgtaagcatggaatgagggtggaggctgggcagctaggtcaccttgagatggccccacctctctcacagtgcgatgacattgtcgccctggtactgcatagcagctcccaggaaggctataaagttaccttgggagctgggtactgactgggtggtcatgaccaagcaactcattttagaagcacttttcttggtagtgagagttttgttctcatgcccactcctggagaatctgaagtcttaattacttttamccctacaggagtgtggccttgtctccctccactctgggccagtttctttgtgggagatagattgacagacacaggcctcaacctctcctgcaggaagtcttccttctcactccagcactctcctgatcatgctgagtcctgtagggcagatttgcgtgttagtgcaccctctcccctccccagcctttccccagcaccttctgcttctacacttacatttctcatagatgcccagggtgagaatcacaagggaggcaccaagggcctactatgtaccaggtgctatcctgtacaatttac

SEQ ID NO: 202526 - DNA, 601 bp, Human; identical to SEQ ID NO: 30828

SEQ ID NO: 202527 - DNA, 601 bp, Human; identical to SEQ ID NO: 30829

SEQ ID NO: 202528 - DNA, 601 bp, Human; identical to SEQ ID NO: 30830

SEQ ID NO: 202529 - DNA, 601 bp, Human; identical to SEQ ID NO: 30831

SEQ ID NO: 202530 - DNA, 601 bp, Human; identical to SEQ ID NO: 30832

SEQ ID NO: 202531 - DNA, 601 bp, Human; identical to SEQ ID NO: 30833

SEQ ID NO: 202532 - DNA, 601 bp, Human; identical to SEQ ID NO: 30834

SEQ ID NO: 202533 - DNA, 601 bp, Human; identical to SEQ ID NO: 30835

SEQ ID NO: 202534 - DNA, 601 bp, Human; identical to SEQ ID NO: 30836

SEQ ID NO: 202535 - DNA, 601 bp, Human; identical to SEQ ID NO: 30837

SEQ ID NO: 202536 - DNA, 601 bp, Human; identical to SEQ ID NO: 30838

SEQ ID NO: 202537 - DNA, 601 bp, Human; identical to SEQ ID NO: 30839

SEQ ID NO: 202538 - DNA, 601 bp, Human; identical to SEQ ID NO: 30840

SEQ ID NO: 202539 - DNA, 601 bp, Human; identical to SEQ ID NO: 30841

SEQ ID NO: 202540 - DNA, 601 bp, Human
gcagcccaaggggtcccgcccgggccctggctgggcaagaggatgtctgccttaggcccccacctgctctgagccctggcctggacaatcccaagggccttcagaaacctaagctggtccaggcctgtggcctgggaggtgtcccttcccttcccaggctggagccaagctggccagctgggggtatggcaggacacccatatccccaagcccctcgctccacgaaggacttctgtccctgacagccatgtgtcctgcaccctcaggtccactggctgcccaggcagtgctgggaaagccrgggttcacagctccaaacagtagacccagcccccagagcaggtggggggaccaggaggcaacagagtggatcaggctcggggagaactgaccccaaaggacaaatgggtgcagagattcaggctggccaaggctggcacaaggacattcccagtggcgagagcatgagcaagggtcacggatgtgccaggaggggaggcggagagatgcctgggaccaacctctatggcaggccgcggcccaagggcaggggaggggtggacggagggaagggacagggtctcctccgggaccccaggga

SEQ ID NO: 202541 - DNA, 601 bp, Human
cgtctcgctggccgtccgggcacagcgattgcatgacaggcaggatgccggcagacgtcaggggcgccgctgtgtagaaggctggcagacccacgggagagggcagggtcgggggtgaaaggggagagagagagagaggaatccagaaggggagggagacagaggccgagaagagaaatttagagaaagtcaggaaggagaagcagcgttagggagaaggcggcacagagccctggccccagctgggctacaggccaagcgttctggggcgaatgactccagcaggtcagaggtcaaagarccactcaccaccccttctgccataactcccagagcattcctttcctttcagccagtgcaggcccacatgccctggcactctccccccgaaaacgtttcaggtgtggcactgcctacagagcccaggggaggacaaaggaccccctctgggcagtgacctctgacctctggccagctggttagcagagtgagtgcaagagcctgaaggagtatgaagggagagtagccaggccgctccagccccagcccaggccagcccagcctcagcccagactcagcccagaagccgaggcaccccagc

SEQ ID NO: 202542 - DNA, 601 bp, Human
ggcgctcaagcagctgcgtgaccctgcaccatggcggatgtcactcactggatgggctggggaggggtgggtgctccgaggggcgggtgggcactcacgtggagttggcgtactgcaggaagccgaactcgtctcgctggccgtccgggcacagcgattgcatgacaggcaggatgccggcagacgtcaggggcgccgctgtgtagaaggctggcagacccacgggagagggcagggtcgggggtgaaaggggagagagagagagaggaatccagaaggggagggagacagaggccgagargagaaatttagagaaagtcaggaaggagaagcagcgttagggagaaggcggcacagagccctggccccagctgggctacaggccaagcgttctggggcgaatgactccagcaggtcagaggtcaaagaaccactcaccaccccttctgccataactcccagagcattcctttcctttcagccagtgcaggcccacatgccctggcactctccccccgaaaacgtttcaggtgtggcactgcctacagagcccaggggaggacaaaggaccccctctgggcagtgacctctgacctctggc

SEQ ID NO: 202543 - DNA, 601 bp, Human
gcgtggctcagatggtgggggcgtggctccgatgtacgtgtgggggcgtggctcagatggtgggggcatggctcagagagtgggggcgtggctcagatggtgggggcaaggttcagacggtctgggcgtgactcaggctgagcatcctgaggatggctcagcaaccagggggcgtggctggggcagaagggagtggccagggctgggagctgtccctgccttacctcgggcgggtccacacgggcggccaagagtgcttgggccgtgctattgggcagcgacaagttttgcgtcaggaaaygccagagctcctgcgggtttctggccaccgagtccagagagaaggaagacactggacaggcaggaaggcgaggctgagaggccgctgcaccttggcaaggtgcccccacatgcgctcggagccgagcccaacaccacagctctgccactgcagcctgtgcgtggctgggaactcagtgcaggtggaggggcccagagtggatgtgggcttcagcccagtgacagcagagctttgcccgcagccctgccccccaacttccctgcacagggcacacctgtggatctgtccaggtggctcccc

SEQ ID NO: 202544 - DNA, 601 bp, Human
gtgggggcgtggctcagatggtgggggcgtggctcagagagtgggggcgtggctcagatggtgggggcgtggctccgatgtacgtgtgggggcgtggctcagatggtgggggcatggctcagagagtgggggcgtggctcagatggtgggggcaaggttcagacggtctgggcgtgactcaggctgagcatcctgaggatggctcagcaaccagggggcgtggctggggcagaagggagtggccagggctgggagctgtccctgccttacctcgggcgggtccacacgggcggccaagagkgcttgggccgtgctattgggcagcgacaagttttgcgtcaggaaacgccagagctcctgcgggtttctggccaccgagtccagagagaaggaagacactggacaggcaggaaggcgaggctgagaggccgctgcaccttggcaaggtgcccccacatgcgctcggagccgagcccaacaccacagctctgccactgcagcctgtgcgtggctgggaactcagtgcaggtggaggggcccagagtggatgtgggcttcagcccagtgacagcagagctttgcccgcagccctgccccccaa

SEQ ID NO: 202545 - DNA, 601 bp, Human
gatgccctcacctccatccggaacaggggattgccccctaggcggctccagggctcctgacccttgtggaggccagactgtgaatccagggcagatgagggaccaaagagcaggtggtagacctaggaggtgtgggggaatggctcagatgggggtgtggctcagatggggtgtggggggcgtggctcagatggtgggggcgtggctccgatggacgtgtgggggcgtggctcagatggtgggggcgtggctcagagagtgggggcgtggctcagatggtgggggcgtggctccgatgtasgtgtgggggcgtggctcagatggtgggggcatggctcagagagtgggggcgtggctcagatggtgggggcaaggttcagacggtctgggcgtgactcaggctgagcatcctgaggatggctcagcaaccagggggcgtggctggggcagaagggagtggccagggctgggagctgtccctgccttacctcgggcgggtccacacgggcggccaagagtgcttgggccgtgctattgggcagcgacaagttttgcgtcaggaaacgccagagctcctgcgggtttctggccaccgagtcca

SEQ ID NO: 202546 - DNA, 601 bp, Human
gctccaccctcatctgtcccaccctcatcctagggaccccctctacacccaggattggcctcgtccacaggccctcccctcccaggccaatgtccagccctggcctctgcttgttccagacaggacccctcacccagaacccaaactgcccagctgcccgcccacgagacactctggaaggtctctggacacacccctcctccaccagcactgccctggaccggccacccccagccggaggaccctgccagagcaggctctccagtgccttcccacagcagcccctggagctcccctggarcccaggggaaaagcgaccccctggtcccccacctgcagagcctgtgtcccatccgaagctgcaccccgtacccctcccgtgtcaattctgccgacaccctctgcccaggggtcccaggcctgcagagaccccctcccactctgcctgtcaaacatggagcgtcccagacccgtgcaccttgaggatgacgcggtcgacctcagagcccgcaggcgcgtacaggattttggggttgctggtcatgaggtgcacgaggaggcccaggttccgctgctccttgctcgtgaagcccagggagct

SEQ ID NO: 202547 - DNA, 601 bp, Human
cacccaatgctccaccctcatctgtcccaccctcatcctagggaccccctctacacccaggattggcctcgtccacaggccctcccctcccaggccaatgtccagccctggcctctgcttgttccagacaggacccctcacccagaacccaaactgcccagctgcccgcccacgagacactctggaaggtctctggacacacccctcctccaccagcactgccctggaccggccacccccagccggaggaccctgccagagcaggctctccagtgccttcccacagcagcccctggagctcccctggagcccaggggaaaagcgaccccctggtcccccacctgcagagcctgtgtcccatccgaagctgcaccccgtacccctcccgtgtcaattctgccgacaccctctgcccaggggtcccaggcctgcagagaccccctcccactctgcctgtcaaacatggagcgtcccagacccgtgcaccttgaggatgacgcggtcgacctcagagcccgcaggcgcgtacaggattttggggttgctggtcatgaggtgcacgaggaggcccaggttccgctgctccttgctcgtgaagccc

SEQ ID NO: 202548 - DNA, 601 bp, Human
ctcctttgctggacctgtctccatgtgtcccttaagcacccaatgctccaccctcatctgtcccaccctcatcctagggaccccctctacacccaggattggcctcgtccacaggccctcccctcccaggccaatgtccagccctggcctctgcttgttccagacaggacccctcacccagaacccaaactgcccagctgcccgcccacgagacactctggaaggtctctggacacacccctcctccaccagcactgccctggaccggccacccccagccggaggaccctgccagagcagrctctccagtgccttcccacagcagcccctggagctcccctggagcccaggggaaaagcgaccccctggtcccccacctgcagagcctgtgtcccatccgaagctgcaccccgtacccctcccgtgtcaattctgccgacaccctctgcccaggggtcccaggcctgcagagaccccctcccactctgcctgtcaaacatggagcgtcccagacccgtgcaccttgaggatgacgcggtcgacctcagagcccgcaggcgcgtacaggattttggggttgctggtcatgaggtgcacgagg

SEQ ID NO: 202549 - DNA, 601 bp, Human
tgcagccagcgcaggtgttgctgcagcctgccctgctccaggaagctgcggatctccgccgagatgttgagccagacctgggcatagtgagtcacgttgcccacaaaagcaaaagtctcgttggcctgcagggggtgaggcaggggcatggagtttctggacggacccccaccgacttgggggctctcaccccactcacctccccagtggctggtccattgccaacaactaaccctccccacctttttttttttttttttcctgagacagggtctcagtcacccacgctggagtgcagtgrtgcagtcccagctcactgcagcctccacctcccaggctcaagggatcctcccgcctcagccctccaagtagctgggattacaggtgcccaccaccacgcctggctaattttgtatttttggtagagacgggcttccgctatgttgctcgggcttgtctcaaactcctgagctcaagcgatcctcccaccatggcttcccaaagtgctgggatttcaagcgtgagtcccacgcccgggctctccactcctttctgcggcgctcaggtgaaacctgctttgccctccactcccagggcagca

SEQ ID NO: 202550 - DNA, 601 bp, Human
gaggggctccccacaccacccacagccgcctccctcgcgggcacccttggcacctgctgcagccagcgcaggtgttgctgcagcctgccctgctccaggaagctgcggatctccgccgagatgttgagccagacctgggcatagtgagtcacgttgcccacaaaagcaaaagtctcgttggcctgcagggggtgaggcaggggcatggagtttctggacggacccccaccgacttgggggctctcaccccactcacctccccagtggctggtccattgccaacaactaaccctccccacctttttttttttttttttcctgagacagggtctcagtcacccacgctggagtgcagtggtgcagtcccagctcactgcagcctccacctcccaggctcaagggatcctcccgcctcagccctccaagtagctgggattacaggtgcccaccaccacgcctggctaattttgtatttttggtagagacgggcttccgctatgttgctcgggcttgtctcaaactcctgagctcaagcgatcctcccaccatggcttcccaaagtgctgggatttcaagcgtgagtcccacgcccgggctctcc

SEQ ID NO: 202551 - DNA, 601 bp, Human
ggagtagacccaggagatcaccatgcacagcggcatcatgtgctcaatgacaaacaggaagctgcggggaggccgcgctcaggcgccactcagccccagccccagccccagccccgggcgcccagcactcactcatcgcgtgtgtagcaggggtaggggaacatctgcacgtagctgcctggctccaccacgtcgtgccccacaaaagtgtcgatgatggcgcgctccatcatgtctgtgggtgggggcagccatcaggtgccgggcaggccctctcgtcctcacacctgtcctcccccaygaatcctccagccggtcttccgggcctgctcctcaccctggatccagacgaagccgtagaggaagtagaagcggccgccagtattgggcccaggccgccagtaggcgcggcggatctcgttggttttctcggtgaagctggagttctggcggatcttgtagtgcacgtgaggcgggagcgagccgtccttccgggtctggaagatcacacctggggccgggaggttggggcggggccaagatgcaggggcgggaccaaggcgtggtgggggggaaagcaaggcacgggggcggggccaag

SEQ ID NO: 202552 - DNA, 601 bp, Human
ggctctgagaggatgtggggtgagcttgctgggcaagtgcctgccccaggtccctcctaccatggcccgcgctcaccagaacatgatggtggccaccgcgtagactgccaggaagagccagatgatgaccacgtggctgtgcataagcacctggccgtacttcaggatggcggtgagtgctgtcacggagatggacagctgcacaaagccggtgatgaaccaggccacccagtgcaccgcgttgttcaggcccatggtcttcatcacctgcgggtgggccaggggcttggggcaggccccrgggaggacgccgcccctccctgccagcccgcgcctccagggagagtcccggcccgcgcacctccttgagccggtgctccttctccgccacgatgtgctggatggtcatggccacggagtagacccaggagatcaccatgcacagcggcatcatgtgctcaatgacaaacaggaagctgcggggaggccgcgctcaggcgccactcagccccagccccagccccagccccgggcgcccagcactcactcatcgcgtgtgtagcaggggtaggggaacatctgcacgtagctgcctggctcc

SEQ ID NO: 202553 - DNA, 601 bp, Human
gcgccacctcctctcggatcgccacgtacatgtagggcacgtagctcaggaagtagatgatgccaccgcaggccgaggccagcttggccttggagtacagcacagacaccaggaagctgggtgggcaggggccacgcgcaccgtcatccacccgcacgcccggcctcctgggcaggcccgtgccagggtccagggggctctgagaggatgtggggtgagcttgctgggcaagtgcctgccccaggtccctcctaccatggcccgcgctcaccagaacatgatggtggccaccgcgtagackgccaggaagagccagatgatgaccacgtggctgtgcataagcacctggccgtacttcaggatggcggtgagtgctgtcacggagatggacagctgcacaaagccggtgatgaaccaggccacccagtgcaccgcgttgttcaggcccatggtcttcatcacctgcgggtgggccaggggcttggggcaggccccggggaggacgccgcccctccctgccagcccgcgcctccagggagagtcccggcccgcgcacctccttgagccggtgctccttctccgccacgatgtgctggatggt

SEQ ID NO: 202554 - DNA, 601 bp, Human
tgcggggcccccaccgccttccccgccccacgggccccctcaccaatcttggcgtagtactcgttgatgtactcgttgtaggccatctccatgagcccgtggcccaggttgtagttggggaaaatgaggaagcagcttttcaggtaactgttgacaaccttcaggtcctgcggggtggccggggtcaggggcacaggggtggccggggtgaggggcacagcctccgcagggtccgccacccccaccatgtcgtcaccgccccaccttgtcgtgctcgaagagctgtagcaggaaggtggcmacggtggcggtgatgccgatgaagagattgatgacaatgaggaacacgtaggcggagctggggacctcgaaccagaaggaggccgggtacatgatgggcgtgatggaccacctgcgggcaggtggcgggcagtggtcaccaggcagccccggtcccacctgaggccgctcccccctccgcttccgcttacccatagagcaggaagagggagaggacggcagggaagttggtgggcgacgtgtaggccggcaggtcgaacacaaacaggatgatgacacagcaggtagcggggaccaggta

SEQ ID NO: 202555 - DNA, 601 bp, Human
ccgcagacattttgtttatttatttaaaacaaacatctgtgcgctatgtacaggcccggctcccagggaggtgggcgggcagggggccaagctgggtgggagagcgatggcagctgggggttggggggggtctggccccttgcctggccagcagggtcagcttctccattcctgccacctgccagctggcccaagctgatggcttcccgcgggacagccacctccctgcaggagagcagggccagaggagcctcttctcaaagcaaaataaatacgggactgacccagctccgcccacagmccgctctcggcatcagccttcatcgtaagagagaaaagctggttccgaggccgggcaggagaaaggccagcagtgcctggtccagccggcgtcgccttgggcggtgagcagtgccaggcaggggcgaggggccgggcagaccccgaggctttaaggcaaagcagggcaagggtgtacgcagcccgggccgggtcagcctttggcacaattaggggcggcaaccgcagtgaccgcagggcatggccgagtacaggggctggaggaccagaagccccttggtcctgaacctccactccaggc

SEQ ID NO: 202556 - DNA, 601 bp, Human
gctggcacacccccctccacccgccaacgtctgggctgcctgagggccctcccttccaagcactgggcactgggaatgggaggagttgcctagggagggccctgccaggtctcccggtgaggcagacacgaagctgcagaggccggtgaactgaggactggcacccgccacccacccgggctcagcacagcagctgcagccccgtttcctgaataggtggcctccgcctttcctggctgagcacactctgattctcggaagcctctcctgttcatgcccacctcccatccaggggcactgtgcccaggaggaagccggcctcactctggccccttgaggccacacacacagaaccaggctgcccaggacagcgcctcagctgtgccacaatccacttaacttctccatgcctcggattccttgcctgtaaaacgggctcacagcacctcttctgcagggctgccaggagtactgtacgaatgcagtcgcaaagtctcccagttcagtccccccagaaaaacgtcagctttgcatcctgggttcctgcagggagctctgctctctggaccctcaggacccatctgtgcaggtgagagggtgt

SEQ ID NO: 202557 - DNA, 601 bp, Human
gggcctgaggtacaaagctggctctagggtctgggttccaggcccctcctagcccttttccccagcccaggagcctccatcccccacttcctcctcctgaaaagaggtcgcaggaacaagagcagctggacggtggctggcacacccccctccacccgccaacgtctgggctgcctgagggccctcccttccaagcactgggcactgggaatgggaggagttgcctagggagggccctgccaggtctcccggtgaggcagacacgaagctgcagaggccggtgaactgaggactggcaccygccacccacccgggctcagcacagcagctgcagccccgtttcctgaataggtggcctccgcctttcctggctgagcacactctgattctcggaagcctctcctgttcatgcccacctcccatccaggggcactgagcccaggaggaagccggcctcactctggccccttgaggccacacacacagaaccaggctgcccaggacagcgcctcagctgtgccacaatccacttaacttctccatgcctcggattccttgcctgtaaaacgggctcacagcacctcttctgcagggctgccag

SEQ ID NO: 202558 - DNA, 601 bp, Human
cacctctggctaaccaggactcttcctctctgcccagccccacactgcacactgcaggcagggccacgggggccacacggggcatcatccttctccagaccttggttggctggcttggtttccttggtaacctgacactcagggccctcaggctgtccgccttccttcaaggcagttccagcagccgcagtggcaggtgggcacaggagccaacgccaggcaccgcacaccctccacaacctggggcagcagcctccagtatcagtgggccgggacttgggcacgttaaacattaaacctstgccagcaggtccacctgggcccacccgccaacttggcacctggggagtgaggcagtccccgctcctgtgctgataccccaccgtccaccacgccaaaggcaggggcctgaggtacaaagctggctctagggtctgggttccaggcccctcctagcccttttccccagcccaggagcctccatcccccacttcctcctcctgaaaagaggtcgcaggaacaagagcagctggacggtggctggcacacccccctccacccgccaacgtctgggctgcctgagggccctcccttccaagca

SEQ ID NO: 202559 - DNA, 601 bp, Human
gggatatagctgagttgcctcaaagctaaggaatgtccccagtcacagcaagccagtggagccaggggaaccccagcagggccatcaaccctgcctggggagtctgcggtggcacctctggctaaccaggactcttcctctctgcccagccccacactgcacactgcaggcagggccacgggggccacacggggcatcatccttctccagaccttggttggctggcttggtttccttggtaacctgacactcagggccctcaggctgtccgccttccttcaaggcagttccagcagccgcrgtggcaggtgggcacaggagccaacgccaggcaccgcacaccctccacaacctggggcagcagcctccagtatcagtgggccgggacttgggcacgttaaacattaaacctgtgccagcaggtccacctgggcccacccgccaacttggcacctggggagtgaggcagtccccgctcctgtgctgataccccaccgtccaccacgccaaaggcaggggcctgaggtacaaagctggctctagggtctgggttccaggcccctcctagcccttttccccagcccaggagcctccatccccc

SEQ ID NO: 202560 - DNA, 601 bp, Human
ttttttttttttgaggcggagtctcgctctgccgcccaggctggagtgcagtggcgcgatctcggctcactgcaagctctgcctcccgggttcacgccattctcctgccttagcttcccgagtagctgggactacaggcgcccgccgccacgcccggctaattttgtttttgtatttttagtacagatggggtttcaccgtgttagccaggatggtctcgatctcctgaccttatgatgtgcccgcctcggcctcccaaagtgctgggattacaggcgtgagccactgctcccggccttctttttttttttttttttttgagacagagtctcgcactgtcgcccaggctggagtgcagtggtgaatcggctcactgcaagctccgcctcccgggttaaagcaattctcctgcctcagcctcctgagtagctgggactacaggtgtgtgccaccacacccggctactttgtatttttagtagagacggggtttcaccatgttggccaggctggtcttgaactcctgacctcatgagatccaacagcctgggcctcccacagtgctgggattacaggcatgagccaccgcgcccagccggccg

SEQ ID NO: 202561 - DNA, 601 bp, Human
caagggaggaggtgctagggaaacgtccaaagaccgggcacggggaggaaggagtggggtctctcgccccaacccatgtccataaagggctggccagcacagccccttctgcttccccacctccaagcaccttctcgggtagaggggcagggactccccaaggagtggggggaagccgaaggaagccaagcacccgggacccctccccaggtcattgggagaacgggggcagctgtcaggggtggggctggtggcagggctccaccggtacccactgtgggctgcacagtctgggtggacrctcccaggttggcaggaggtgcatccacacagacccttacagccacttctcggtgctcctctcaacacctcctccaggaagccgctgctgctcccacccccagcacctctgagcaaagccctcaccacacctgaagtcactcagtgactggccatcccgacagatgcggctcaggctggcgagcggggcatccccagcacccagccagtgctggcacccttcaacatttgccaacaggcggacaggacagtgagtggtggaaaagagcaagctgcctggggacggggaagtgggggcctg

SEQ ID NO: 202562 - DNA, 601 bp, Human
gagttgagtgtccagactccttccgggcaagctcctgggccaggaagtcaatctcatcttccagtctgggctggggccggcccccgcctggggagggtgaggggccatcaggtggaggggtccgtccaggaggtagccccaggcccggcctccccgcttctggcaggttcctcccaggagcctgaggactgggtacacgcctggaggccctctccctcccagattgccatggtgacagcgcgggcgcttcctgtgaggggcagtgcttcccggaaagtggaggcagggcaagggaggaggygctagggaaacgtccaaagaccgggcacggggaggaaggagtggggtctctcgccccaacccatgtccataaagggctggccagcacagccccttctgcttccccacctccaagcaccttctcgggtagaggggcagggactccccaaggagtggggggaagccgaaggaagccaagcacccgggacccctccccaggtcattgggagaacgggggcagctgtcaggggtggggctggtggcagggctccaccggtacccactgtgggctgcacagtctgggtggacgctcccaggttgg

SEQ ID NO: 202563 - DNA, 601 bp, Human
aacggagtccctctggcagctctgctctcccacctaggggctccctaacgctcaggccgcccctttgctcccggcctgccccggcccccgccattcccccgaccagcccctcctcccgcgggccgccagggattggcgggcggggggcgggccgggggcggggccgggcgcccttcatcccgcgtcgctgttgtcgctgttgcagccgagttcagccgggagcagagcgaaccgcaccggcccgagcggagcgccgcacgttcccaaccgcgaggccaggtaccgcttcgggagttcatccacccgcacaggggaatcgggtgggccgagccctactgtccaccctcctgtccgtagccgggctctgggcagctctcctctaccgtcctgacccgggcaggcgccccagcctccggcgagccaaagccccgcgcgctccaggcgctggtcttggggacctgccagtcgggactcagcgccgagcttaagcagggccctgggggtaccgggagggacacgtcgtcgccttagggcctctcggcggggctgcgaggtacagcaggaggtcggcggcacccggggctgggaccacaggacgcct

SEQ ID NO: 202564 - DNA, 601 bp, Human
tggagcgctgccccgacgggcgcctgacaggcagagcagcccggctggcacgatgggaatccgggtatatttatctcggctgctccggacaagggcttgagggcagatcgggccgggccgcctgaggggccgcggggtacatgctggtcccagagccggtgccatttgcagaggagccagcgggcacagcgggcgcagggcgcgagtggctccctgacctgaggccggggcgccgtgcgagctcctccccacctggcgctgggtagggtgtaagttagagcccgcgcagcgcacggcggakagaaggaaccaagacttggtttgcaagagcccgcccccgcccggttggccccttcgattggccacagcaaatgcgtgcgtttgtttacacccaggcagggggaggccaggggagggacctgcggggacccgcccttttccccccacggggacctgagtcctgagtccaggtatgggctctcaaacaggtctgagaaaggctaagtcaaaggctcttgagccctgaggaacaccatggaggacttccccactcatgcccatccttccttcagcctgccaaccctgtcctttcttccatgac

SEQ ID NO: 202565 - DNA, 601 bp, Human
cacggcggagagaaggaaccaagacttggtttgcaagagcccgcccccgcccggttggccccttcgattggccacagcaaatgcgtgcgtttgtttacacccaggcagggggaggccaggggagggacctgcggggacccgcccttttccccccacggggacctgagtcctgagtccaggtatgggctctcaaacaggtctgagaaaggctaagtcaaaggctcttgagccctgaggaacaccatggaggacttccccactcatgcccatccttccttcagcctgccaaccctgtcctttyttccatgaccgactctggccacagagctgcccctggaaaaggcccttggacctttcaccccttcctgttctgttctgtaaaaggtctgggatggggctcatttccttctggaaaggaagcacatccctcggggctctcagtctgggggatagaaagctaaagagacccaaagatggttccattttgaatgggggaaattcggcacagccacggtacccttcctgcaagaagcatcactgacgggagggatcaggactggaagaggccaagcctggcacgtctctgagagggctggaatga

SEQ ID NO: 202566 - DNA, 601 bp, Human
tccccccacggggacctgagtcctgagtccaggtatgggctctcaaacaggtctgagaaaggctaagtcaaaggctcttgagccctgaggaacaccatggaggacttccccactcatgcccatccttccttcagcctgccaaccctgtcctttcttccatgaccgactctggccacagagctgcccctggaaaaggcccttggacctttcaccccttcctgttctgttctgtaaaaggtctgggatggggctcatttccttctggaaaggaagcacatccctcggggctctcagtctgggrgatagaaagctaaagagacccaaagatggttccattttgaatgggggaaattcggcacagccacggtacccttcctgcaagaagcatcactgacgggagggatcaggactggaagaggccaagcctggcacgtctctgagagggctggaatgactgaaaccagaaatgggaatctgatttcttgacattgggagcagggggctgaatctctggggagggtaggagtctgtatctcagaattttgttctgcctgggcccatgggacccatgtcttcgctggcttctcaagccactccttgt

SEQ ID NO: 202567 - DNA, 601 bp, Human
agcctgccaaccctgtcctttcttccatgaccgactctggccacagagctgcccctggaaaaggcccttggacctttcaccccttcctgttctgttctgtaaaaggtctgggatggggctcatttccttctggaaaggaagcacatccctcggggctctcagtctgggggatagaaagctaaagagacccaaagatggttccattttgaatgggggaaattcggcacagccacggtacccttcctgcaagaagcatcactgacgggagggatcaggactggaagaggccaagcctggcacrtctctgagagggctggaatgactgaaaccagaaatgggaatctgatttcttgacattgggagcagggggctgaatctctggggagggtaggagtctgtatctcagaattttgttctgcctgggcccatgggacccatgtcttcgctggcttctcaagccactccttgttgtgtgctggtttttttggcccatgtcacaaatggtccccacaccagtccagggctccaggttgccagatcatgacaactggttgctcctgtccttgtgccactgccctagcaagtagccttgaagccctgg

SEQ ID NO: 202568 - DNA, 601 bp, Human
ctctcttttttttttttttttttgagatagggtctcgctgtgttacccaggctggagtgcagcggcgtgatcttggttcactgtagcctctgcctcccaggttcaagcagttctcctgcctcagcctcccgagtagctgggattacaggcacctgccaccatgcctggataatttttgtatttttagtagagatggggtttcaccatgttggccaggctggtctcaaactcctgggctcaggtgatctgcccgcctcggcctcccaaagtgctgggattacaggcgtgagccaccatgccsggccttacagctgtctcttgctgtcttgttgtctgtctcttcctccatttggctgtctctgactgggtgctcactctgtttctcacctccctggttgtttctgtcgctgtctgtctcctgtctaaatgtctgtccgctatctgcatgtggtttttgtctgtgtgtttttctgtctgtgtccctctgtgtgcatctgcatttccctgtcaccctgggccgctgcatctctgtctgtctgtctctgtgtgtggatcagtatgcatggacgcatggagctaatgactgtgttttctctccctg

SEQ ID NO: 202569 - DNA, 601 bp, Human
agtccaaatgtctccattggatctggtttccccccttactaacaccttctcctagtagggggcatcttccctctgaagcctggaggagcaggtggacagaggggtagctgtccagatgggtaccagacttaggaggggggcaccctgtctcagccaaggaggggagtggtaaaaatgagctgagctggaactgggggcagccctcacccctgagcccccagggataatcacgatggaccctcaagccaggccagctgtctctctcctgagatcttggcggaggtcaggtagcctgggcctyagcaataagctccagagggtctgtgcctccactggtgcaagtcgtcaccaaggtaaaaagagtgcgaaggcctccctgtcaccagctcactactgccgacccagacccacttatgttcctgagcatggggaaggaaagcaaggctcagagtcctggggactccaaggaccttgatccctgggcagagagctgtgcttcctgtagctgcttgcatcagccgccctgaagtggcctgggttcctggggctcaaaatctttaattagccaaactcaacacctgccgaggtgtgcctgatgaat

SEQ ID NO: 202570 - DNA, 601 bp, Human
cagcgggcaggggtggtggaggaaggagagctggttcctttgaggcccagcagggccaagccctgagagcagagaagggagactgatctggtgacccaggctcctctacagccggccaagggcctgagctcctggcctggggccctaggaaatgggggtctgttcaaagggtccactcctggacagcgggcccctgagggttgggggttccctgcctggcagtggaggagaggcttggaaaaaaacatggccctgaggccaggactgtgtggagggtgaggtgtgtgtggcacagagaacyggccctggagcacccgtttcctggaaggccccctgagggccctttgctgcagccaggcgggaagggcccaggtgtccagccacccagcaccgcctcaggcatcctggctctggggaggggggacagcctctgcgcctgccgttcccagcgccagctctcagcccacagagggctctttgttctggctgccagcagtgcccgccgggcggctgggaacagggcccacagccctcaccctctcccgaggcctccagccgtcgggcagtgccattctaggttgggcaggaggcccctggacac

SEQ ID NO: 202571 - DNA, 601 bp, Human
gattccctcgcgcctgcaggaactagaggagggggaagacaagaggggagggggtccgttttctgaggccaggcatactacagctgcaggtagtggacagatggggccgtttcggggcactgttccaaagctcccagtccccctaaattcttcgcttcaccacccgtacctcctctccatttcctcctgcccagggattcgaggctcaagggagctttgggactctgaggggtggtgatggggcgtttctgagagcatttccagcccgaacaagccgctctggaaatcccacactaaagcmccgcagcacgttagcaaatctccgggccgagggacaccccagtcccttacaaagttcctctttttataaggcgtagatggaggtggggagacagtgacagggaaaagatgatagtaaagaaatctcagtacctgtgttgttgttggagtccagggtcgtcatgtcttcaccagctgagagcggtcattcaaactggaccttgactcaaactagaggttgcgatcgccgctgttgccccctgggcactggctaagggcggggagtggaccccgcgactcacgatcaggatccgaagcaccc

SEQ ID NO: 202572 - DNA, 601 bp, Human
gatggaatcattagttggcagtaaatgaagttgacctagttcacccatcccccaaaaaggagtgagaccttcatgcagaggcttccaacgtggaagtgaggagcatactcaagagtctaggtctaggtctagacccatcactaccaacttattttgtgacctagaggacatcaactcccctctttgggtctcagttttcctttctgtgagaaaaaaaggacagtatcatttcagctatgattgtggggtgcagttgctttggggagcccttagtaggcaaactgcagcttgtctggtggasatgggggtaagacaatgctcgcagaactaaggagagagaagcttggggaacaggaatttgtaatgtggggaagctgagtctaaatgcagtacggtgaagtaggtgcaaataagagtgaagtggaaaggagtgagaagggtggttaggggtgaggtctctttagggagtgtaaaacagaaggccatgaaaggtcaggaatggctccatgttactttgttttggtgatggggggagggggccgggcaggcggaccggaaaaggaggcaggcgggggcggtgagtcagcccagcttcacccag

SEQ ID NO: 202573 - DNA, 601 bp, Human
tctggccattcagggactttgaccctctggttacattgccaatgaggtggctgtgctcccgtggtattagcaggagaaaaaggtgacctgcctgccacacctctggcaagcacctagattggtctgccatgggcggggtgggagaagggaggatcccaggacacatgtgacctaacacatgccatgccactgtgtctgcagaggcacatgtcttgctcacccactgacacacactgaactgggcagggcggccctaaaatagctcaaggttggtcagggtgaacccagctccttggaaaayagttgcacaacagatcagctcccccggtttcagggctgaggtgggggatggaatcattagttggcagtaaatgaagttgacctagttcacccatcccccaaaaaggagtgagaccttcatgcagaggcttccaacgtggaagtgaggagcatactcaagagtctaggtctaggtctagacccatcactaccaacttattttgtgacctagaggacatcaactcccctctttgggtctcagttttcctttctgtgagaaaaaaaggacagtatcatttcagctatgattgtggggtgcagt

SEQ ID NO: 202574 - DNA, 601 bp, Human
tgaaggaaatgaagggaaggaatctgcccagcctggttcccctggcctcttaagagagtgagccacagtggagtctatccctgtgtccaaaaaggacttcgaggtgcgagttgcaggaggtggaagtacaaactgtccagcctggggctctaaaattcccccttcagatctcagcctggtaacaatgaccttggctctctggccattcagggactttgaccctctggttacattgccaatgaggtggctgtgctcccgtggtattagcaggagaaaaaggtgacctgcctgccacacctcyggcaagcacctagattggtctgccatgggcggggtgggagaagggaggatcccaggacacatgtgacctaacacatgccatgccactgtgtctgcagaggcacatgtcttgctcacccactgacacacactgaactgggcagggcggccctaaaatagctcaaggttggtcagggtgaacccagctccttggaaaatagttgcacaacagatcagctcccccggtttcagggctgaggtgggggatggaatcattagttggcagtaaatgaagttgacctagttcacccatcccccaaaa

SEQ ID NO: 202575 - DNA, 601 bp, Human; identical to SEQ ID NO: 36503

SEQ ID NO: 202576 - DNA, 601 bp, Human; identical to SEQ ID NO: 36504

SEQ ID NO: 202577 - DNA, 601 bp, Human; identical to SEQ ID NO: 36505

SEQ ID NO: 202578 - DNA, 601 bp, Human; identical to SEQ ID NO: 36506

SEQ ID NO: 202579 - DNA, 601 bp, Human; identical to SEQ ID NO: 36507

SEQ ID NO: 202580 - DNA, 601 bp, Human; identical to SEQ ID NO: 36508

SEQ ID NO: 202581 - DNA, 601 bp, Human; identical to SEQ ID NO: 36509

SEQ ID NO: 202582 - DNA, 601 bp, Human; identical to SEQ ID NO: 36510

SEQ ID NO: 202583 - DNA, 601 bp, Human; identical to SEQ ID NO: 36511

SEQ ID NO: 202584 - DNA, 601 bp, Human; identical to SEQ ID NO: 36512

SEQ ID NO: 202585 - DNA, 601 bp, Human; identical to SEQ ID NO: 36513

SEQ ID NO: 202586 - DNA, 601 bp, Human; identical to SEQ ID NO: 36514

SEQ ID NO: 202587 - DNA, 601 bp, Human; identical to SEQ ID NO: 36515

SEQ ID NO: 202588 - DNA, 601 bp, Human; identical to SEQ ID NO: 36516

SEQ ID NO: 202589 - DNA, 601 bp, Human; identical to SEQ ID NO: 36517

SEQ ID NO: 202590 - DNA, 601 bp, Human; identical to SEQ ID NO: 36518

SEQ ID NO: 202591 - DNA, 601 bp, Human; identical to SEQ ID NO: 36519

SEQ ID NO: 202592 - DNA, 601 bp, Human; identical to SEQ ID NO: 36520

SEQ ID NO: 202593 - DNA, 601 bp, Human; identical to SEQ ID NO: 36521

SEQ ID NO: 202594 - DNA, 601 bp, Human; identical to SEQ ID NO: 36522

SEQ ID NO: 202595 - DNA, 601 bp, Human; identical to SEQ ID NO: 36523

SEQ ID NO: 202596 - DNA, 601 bp, Human; identical to SEQ ID NO: 36524

SEQ ID NO: 202597 - DNA, 601 bp, Human; identical to SEQ ID NO: 36525

SEQ ID NO: 202598 - DNA, 601 bp, Human; identical to SEQ ID NO: 36526

SEQ ID NO: 202599 - DNA, 601 bp, Human; identical to SEQ ID NO: 36527

SEQ ID NO: 202600 - DNA, 601 bp, Human; identical to SEQ ID NO: 36528

SEQ ID NO: 202601 - DNA, 601 bp, Human; identical to SEQ ID NO: 36529

SEQ ID NO: 202602 - DNA, 601 bp, Human; identical to SEQ ID NO: 36530

SEQ ID NO: 202603 - DNA, 601 bp, Human; identical to SEQ ID NO: 36531

SEQ ID NO: 202604 - DNA, 601 bp, Human; identical to SEQ ID NO: 36532

SEQ ID NO: 202605 - DNA, 601 bp, Human; identical to SEQ ID NO: 36533

SEQ ID NO: 202606 - DNA, 601 bp, Human; identical to SEQ ID NO: 36534

SEQ ID NO: 202607 - DNA, 601 bp, Human; identical to SEQ ID NO: 36535

SEQ ID NO: 202608 - DNA, 601 bp, Human; identical to SEQ ID NO: 36536

SEQ ID NO: 202609 - DNA, 601 bp, Human
cacccccggcagggcacgcttccatccctccccagccagcgcccatgcctggaaggccagtgaggagggacagcaggcatggccaccagggagcaggaggcagcaacaccttggtgtgtggccaggggaacaggacgagctccaggcctgagtctgcccgctggctcgccgcctgtccccacctccctcaccccagtctgtctgagactaggccctgggaggacaaaatggggcctcgctcaccaccccggtcctgggacgactcgtacgtttctcttggagtctccggtgggcacactcscggtgcccagacccacttccatcttcccttgtgtggtaccatggagggaaccagtggcagaagccagaaacctgggcaccggcctccccctgccctccagatctgggatgagggtcgggcctggcgaagcttctccaacccgcccgacttgttcacagcctaccggccacagccacgccacctctggagtcagcctaatgcctgccatcgcccccactgcagcgggtgctccgagaggcctgtccatgcagggctggggaggcatgcggaggcggaggctgagcccttccgcacagccct

SEQ ID NO: 202610 - DNA, 601 bp, Human
ctgcactccagcctgggggacagagcaagactctgtctcaaaaaaaaaaaaaaaaagaaaaaaaaagaaaatggatgagggacccactgctgagagtttggtgggaaggagtctcccatcctagaggctgcctggcctgggtttggagccctagggaaccccctcccctgccctcaggcagctgttcacagcaagtggggagcccaaggcgtgcagatagttggtgccagcaggagtgacagactgccctggggaccttaggcccaacctctgggggtctaggtttggagatgtggtaggrccctgggtgccaggtgggccagtacccacccaggctggcctccagcccctacactctaccccagccctctccttcactgctggagctcattagcacttgaatggggggcggggcggcttgggcctctgagtctcttcttcccacccctcccccaggcttgtcggggctttgtctgcaggagcaggcagggatagagctcccacactaaggagtgaacaggggtccaagctatagctgaccccctctgcctgcatcctgcccagttctgctaggctcagcccctgcctctcacgccagtgt

SEQ ID NO: 202611 - DNA, 601 bp, Human
ctcatgtctaccaggtctagctgctgctaggaaaatcagatgcaaagcaagtttgcaccctcgtccctgggcagggtcacgaagcggcccacatcacctactaagagtgggcaaaaggccagaccccctcttcactctcagtggccagatagggaaactgatgcctcaagtgggcaggagtcccgaagtcacacaagatggggaagctttcaccctagacctcaggtcccccatgccctgggtagcttccctgctgagtctgagctcgcctggctcgggactgcatggggacccatgacttcgcatccttggcctctgctcctgcagttccccccatcctggctgtgactggctcctggttcttcctcctgctctggaggagccagtggggaagacagtcaggtagccactgctgccctccctgccccagtgggtgctttgagccccagggggatgggccttaagtgttcaggcatcgctgtgaggctttcctgggacctttccccatgtcctcattggcaggtggaggagtgttggtatgcagatcctggctgcccctttgccatgcacagcccaatggggagggagtggtgctggtata

SEQ ID NO: 202612 - DNA, 601 bp, Human
gactccctgggtaatacaggctcctgggctgcactcctcaagatctggctctgttgtctgggatgggacctgggagtctgctttttttttttttttttagaccaagtttcgctcttgttgcccaggctggagcgcaatggcacaatctcggctcactgcaacctccacctcccaggttcaagcgattcttctgcctcagcctcccgagccgctgggattacaggcacctgccaccacgcctggctagtttttgttatttttagaagagatggggtttcaacatgttggccaggctggtctygaactcctgacctcaggtgatccacctgcctcagcctcccaaagtgctgggattacaggcatgagccaccactcccggcggaatctgcttttttaaacacctccccaaggcattgtcccgcagggtctcagccacattttgagaatggcagggtggaccaggcatcatgggttccctccaccctcttgcccttctgagtcctggctacatgatcttagatcaatactttatttttctgagcctcaatgtcctcatctgtagaatgggaacagaaacagtatctgctgtgactaatacagg

SEQ ID NO: 202613 - DNA, 601 bp, Human
cagtgggtcaggggcagttttcccttctctgaagcaggtcccagtagccccaggcagccgtgggaactcccagtgcccaggggacactaaccttcctggtccctggctatcaggatcatccacgaggatggctactccgaggaggaatgccggcagtaccgggcggttgtctacagcaacaccatccagtccatcatggccattgtcaaagccatgggcaacctgcagatcgactttgccgacccctccagagcggtatgtgccctccgccccaccctctcccacctcccaaaaggtttcrgggtggctggttgtggtggctcatgcctataaatcccagcactttgggacgccgaggcgggtggatcacctgaggtcaggaccagcctggccaacttggtgaaaccgcgtctctactaaaaatacaaaaattagccgagcatggtggcacgtgcctgtaatcccagctacttgggaggctgaagcaggagaattgcttgaacccgggaggcagaggatgcagtgagccaagatcgccccattgcactctagccttggtgacagagctagactccgtcacagaaaaaagtaaacaacaaca

SEQ ID NO: 202614 - DNA, 601 bp, Human
tactccgaggaggaatgccggcagtaccgggcggttgtctacagcaacaccatccagtccatcatggccattgtcaaagccatgggcaacctgcagatcgactttgccgacccctccagagcggtatgtgccctccgccccaccctctcccacctcccaaaaggtttcggggtggctggttgtggtggctcatgcctataaatcccagcactttgggacgccgaggcgggtggatcacctgaggtcaggaccagcctggccaacttggtgaaaccgcgtctctactaaaaatacaaaaatyagccgagcatggtggcacgtgcctgtaatcccagctacttgggaggctgaagcaggagaattgcttgaacccgggaggcagaggatgcagtgagccaagatcgccccattgcactctagccttggtgacagagctagactccgtcacagaaaaaagtaaacaacaacaacaaaaaggttttagggcaagtctcatcctagggaatccaagaataccctagcctgggccccattccagaggtctccctgcctctggcagagtgggggtacattccttcaactgcctgaccacccgccactg

SEQ ID NO: 202615 - DNA, 601 bp, Human
tcagagcccctggacctcagctgtgaccctcgctggccctaggctgaggaattacaaggggtcccaggaatcccagaggcatgacaagcctgcaccctttccacagttctgaactccttccctgtggtatctgtcatgtacttggactggtgcagggtgctgaggaccccacggggaacaggatagacaggctaatagccattgaggatggctgcaggggacatccacaggctttggatggtgtcaccagataggctgctgtccctgtactctagccttcccctatctctgcttaagccartcccctctgactggaacacccttttgctcctattgttcatccaatcctgagcctacccatagggtggatttcagcaagggtgggtgggaggaggaggagggtcttgcctggctgtgattcctgagccctgtccaagccacatgaacagcctcctcctacccttcttacatggcctgaatgctcttgtgaatatgtaccccctacaggagctgtggagtcacagccaaatgctgtgggggcccccaggcctcaccactgcccctccctgagatctctggcccagccaccagcgagcttggg

SEQ ID NO: 202616 - DNA, 601 bp, Human
ccagtcccctctgactggaacacccttttgctcctattgttcatccaatcctgagcctacccatagggtggatttcagcaagggtgggtgggaggaggaggagggtcttgcctggctgtgattcctgagccctgtccaagccacatgaacagcctcctcctacccttcttacatggcctgaatgctcttgtgaatatgtaccccctacaggagctgtggagtcacagccaaatgctgtgggggcccccaggcctcaccactgcccctccctgagatctctggcccagccaccagcgagcttggggtcagagcagcagggaccttggtgcccatgatactcaaaggaagcaggaatagagccacctccaggccacctcctgcttctccatcatcctctttctctattctccagacattaggcacccactgtgtgcccagcacagttttgggagtgaatacaggccctgttctcccagtcaggtttaagccttgatagctccccctgggaatgggttgcggattggaacaccacaggaagcagggctccttcagcccctcttcgcagcaaccctccaagtgtgcagcgagtcagggggtccct

SEQ ID NO: 202617 - DNA, 601 bp, Human
ctggctgtgattcctgagccctgtccaagccacatgaacagcctcctcctacccttcttacatggcctgaatgctcttgtgaatatgtaccccctacaggagctgtggagtcacagccaaatgctgtgggggcccccaggcctcaccactgcccctccctgagatctctggcccagccaccagcgagcttggggtcagagcagcagggaccttggtgcccatgatactcaaaggaagcaggaatagagccacctccaggccacctcctgcttctccatcatcctctttctctattctccakacattaggcacccactgtgtgcccagcacagttttgggagtgaatacaggccctgttctcccagtcaggtttaagccttgatagctccccctgggaatgggttgcggattggaacaccacaggaagcagggctccttcagcccctcttcgcagcaaccctccaagtgtgcagcgagtcagggggtccctggggcgaacccacctgttggggaaaagggagaggctggtgtggaatgcaccatggtacctccacattgaggactctggcagtagggggcggggcatggtatgcgggtcaca

SEQ ID NO: 202618 - DNA, 601 bp, Human
gcccccaggcctcaccactgcccctccctgagatctctggcccagccaccagcgagcttggggtcagagcagcagggaccttggtgcccatgatactcaaaggaagcaggaatagagccacctccaggccacctcctgcttctccatcatcctctttctctattctccagacattaggcacccactgtgtgcccagcacagttttgggagtgaatacaggccctgttctcccagtcaggtttaagccttgatagctccccctgggaatgggttgcggattggaacaccacaggaagcaggrctccttcagcccctcttcgcagcaaccctccaagtgtgcagcgagtcagggggtccctggggcgaacccacctgttggggaaaagggagaggctggtgtggaatgcaccatggtacctccacattgaggactctggcagtagggggcggggcatggtatgcgggtcacagcacatgcgtcatccttccccatggcccttcctgtttttctgttttgtccctgctactctgagatcatttccctctggcctggtttggcctgggtgctggtgggagccaagggccagccccagcagccttg

SEQ ID NO: 202619 - DNA, 601 bp, Human; identical to SEQ ID NO: 112569

SEQ ID NO: 202620 - DNA, 601 bp, Human; identical to SEQ ID NO: 112570

SEQ ID NO: 202621 - DNA, 601 bp, Human
ttttaatttttaaggacaatagtgatctcagcatgttttttaagccaaaagagaagtgccagtagagagggagagattgaggatacaagaagaaatagagcataattggtggattcactttaggtagaaggtggcaggagtgagacaggagaagagaagaagatgctactgctggagataaattcataggggcgggagagaaagtgaaatcaaaggaataactgaaaaaaaaggagtccctccatttatctcagtgaagtagaaggaaggtcatatgctgaaagtaagggaggagggggtrgagctgaagttagagtggagttctgaatttctggaatattgggtgtggtgattggaaaaggaagttggcaaggggtgacgaaactattgtcaagcaccattaatgacccagctatcataagcaccaaccaatctgcatggctgtgtgatttccctccagcaactcttggcagccttgacatagaagtggagagctttcatggttggattctattagggtagggtttcataggacaattataacaagaagtcaaagagtgaaattttccaggacagaagcataagagcaatttacatgctg

SEQ ID NO: 202622 - DNA, 601 bp, Human
tctagaacatagataagttttacaatttttagtaggtatattttgtagattttcaaaaaacaaaccttatatttcaagaagaaatattgatggatatatcatgtatgttctagttgttttgggcatctctctcctctctctctagatatctctctctagagatgtcatgcaatccatagtacataccaataagaattcgctggacagaccatagctatagatcaagccttttgctgaatatttgtagtgctcaaatagcacaagatctcagatctatggaattttatacttttcttttttwaaaaaaaagaactggtatcttttttattttattttattttagctcaaggagagaaaagatgtggctattgctagaaatatgtccccaggaaggtcaactaccttttcccatactattagtgaactccatcaaaatgtacattctgaaataaggagtaattttgagggcatttcaaaaaaaatctttgatagagccatcaccatcaattcttgggctgttaaaccagagagaaatttacatattaagtagttgagttttttgtttcataacatagtagtgaatagactgtgttatatgatt

SEQ ID NO: 202623 - DNA, 601 bp, Human
agaatttcatggggattctgttaaattgcagattccagggctccactcccagagtagatctggagtagaaacctaaaatctacattttaaacaatcaccaaaagtggcccccaaacagcattttatattatctaaagcctctaagttccttacttctaagttctttgacctttaaaaattaagctcagagaaaaggaaatttcctaaggtagctactctagctggtgtattctctagagcaacgttcagaacttggagttcatgggtgggcttcagatctatgaactgttgaagttatacrtaagagcatgtgtctacctgtacctttccggggagatagaccaaaccctaagagtccgggacccaactcaggttaagaacttcattcccgaccaggcgcggtggctcacatctgtaatcccggcactttgggaggctgaggcgggcggatcacctgaggtcaggagttcgagaccagcctgaccaacgtggagaaaccccatctctactaatacaaaattagctgggcgtggtggcacatgcctgtaatcccagctactcgggaggctgaggcaggagaatcgcttgaacccaggaggtg

SEQ ID NO: 202624 - DNA, 601 bp, Human
tttattaaatagggaatcctttccccattgcttgtttttgtcagtttgtcaaagatcagatggttgtagatatgtggcattatttctgagggctctgttctgttccattggtctgtatctctgttttggtaccagtaccatgctgttttggttactgtagccttgtagtatagtttgaagtcacaggctagccacattttaagtgttctgtagccttatgtggttagttactgccatgttaaacagtgcagacctaagccatagttgatggtttttaaacttgagcttgcatcaggatcayctggaaggcttgttataatacagatcgctgggctccacttccagagtttctgattcataggtctgaatggagcttgaaaatttgcatttctaacaagttccttaatgatgctaatgatgctgatctgggaaccacactttgagaaccatggccacagttctttcaaaatccaactttggaaccattttaccactgtattaacatgagtgatcaagaactgtccctaggtattgttgctattgtaccacaatactgtcgtattattgcagtttataaaatattgaaaatctccatttaact

SEQ ID NO: 202625 - DNA, 601 bp, Human
ctagccagcaggccacttgtgactgccaaccttacattggatttgtagattttggcagggtgaacctgctgagaagtggagcagtgcttctcatgaagcagattcagtgaactatactccaaagtccacaaaggcagactttcctgctcctgctccaccattaccctctctgtgccttctctctgccattacgcctttgtctaaggaaaacttcagacaagtcacttaactcctctgagcctcaatttttaacctgtgaaatggagataagaatcataactacatttttgtgagagataasgtctggctctgttacccaggctggagtacactggcacaatcatggctcactgcaaccttgacctcgtgggctcaaatgatccacctcagcctcccaagtagctacaattttaggtgtgcgccaccatgcccagctaaattttttattttttgtacagatgggaacttgctgtgttgcccaggctggtcttgaactcctgagctcaagcagtcctcctgcctcaacttcccaatgtgctgggattacaggcaggagccaccaagcctggcccattactacatttcaggactctgtctatag

SEQ ID NO: 202626 - DNA, 601 bp, Human
cctctctgtgccttctctctgccattacgcctttgtctaaggaaaacttcagacaagtcacttaactcctctgagcctcaatttttaacctgtgaaatggagataagaatcataactacatttttgtgagagataacgtctggctctgttacccaggctggagtacactggcacaatcatggctcactgcaaccttgacctcgtgggctcaaatgatccacctcagcctcccaagtagctacaattttaggtgtgcgccaccatgcccagctaaattttttattttttgtacagatgggawcttgctgtgttgcccaggctggtcttgaactcctgagctcaagcagtcctcctgcctcaacttcccaatgtgctgggattacaggcaggagccaccaagcctggcccattactacatttcaggactctgtctataggatggattttaaggagctcatcctatggttaagggagtcagaaggatctacatttaaatcatagacccattgctattagctgtgtcacctagggccagttatttaaattttctgggcctccattttctcatctaaaaagtggggataatgataatataaaaacc

SEQ ID NO: 202627 - DNA, 601 bp, Human
ccatccccacacccttagcactgtactaggtacatagtaattactcaatagatatttgtccagcagaattggatatagcatagtgcttaacttcaattcagagaagacagtgattttactaaatagtgtggataagttcttagattgttttttagcgattataccaatttatgtacccaccatcagtgtacaagggttccaattgctctacatcattgatataacgtttggtattgacaacctttttaattttagccattctgatcggtctgtagtgttaactcattctggttttattgtrtattttccagaatgtttatgagcctgagcacatttttgtattttataacttcaacttttgttatagattaaagggtacacatgcaggtttgttacatgggtaaattgtgtgatgctgaggcttgggactctaatgatgccttcacctaggcagtgagcatactacccaataggtagttcttcagcccttctccctctcctctcctgcctagtgatccccagtgtttattgttcctatctttatactcgtgtgtattcattgtttagctcccacttataagcgacaacatgcagtatttgg

SEQ ID NO: 202628 - DNA, 601 bp, Human
ctacatcattgatataacgtttggtattgacaacctttttaattttagccattctgatcggtctgtagtgttaactcattctggttttattgtatattttccagaatgtttatgagcctgagcacatttttgtattttataacttcaacttttgttatagattaaagggtacacatgcaggtttgttacatgggtaaattgtgtgatgctgaggcttgggactctaatgatgccttcacctaggcagtgagcatactacccaataggtagttcttcagcccttctccctctcctctcctgyctagtgatccccagtgtttattgttcctatctttatactcgtgtgtattcattgtttagctcccacttataagcgacaacatgcagtatttggttttcttttcttgcatttgtttgcttaggttcatgacctccagctccatccctttcttagattttttttatatcctaatatatagtattatgagaactttttatagatgttgggttgtgacaagttttttttgttttccaaatatcagtaattttgaatataagcaaaatgggttattattactactttaattactataaaactatt

SEQ ID NO: 202629 - DNA, 601 bp, Human
tcatttatttgtttagcagatatttcttgagcactaactatgttccaggcactatgctaagtgctagagagacagagatgggtaatgatggtgtgggccctcaaggaacttacagtttacactgataagtgcttgacagagggatacagggtaccagaagaacctagaggcaagcttactcaattcaaccaagtatagagcagggccagcttctagagccgttttctcccaccgggaattttccctgtctacttctggtggacttgttgttttgcttaagtaagaaacctataccttcccragtctatatacagacctcagctctccttcttcatgcctaaagggtaaataccaccagacagattgcaaaaagacagtattatgtactaaagggacttagaaaacaaaagttggcttttagatttcattttcatctggatgagtctcaggtggagctaacaataggaagggaagggatattcaatccacttagaaatagcactccaaatcattgttgtccagtatggtggccagtaaccacatttggctactgagcacttgaaatgtggctagtccaaatggaaatgtacttaagtataaa

SEQ ID NO: 202630 - DNA, 601 bp, Human
atggagtcaattgtattcctacttttgtcttctttagtgtttagcacagtgcttttgcacttagtaggccctctgaaataattttgtgcagttatgatcaacagctgggttcactttggccagattcaaagaactgcaaagctgtctgccaactccgtctctgtgggtctgtttttgcctcaataaatatttgttgagctaatgaaaatgtttgtctttccactgcatcttctcactcgtaagtgggagttgaacaatgagaacatatggacatggaggggaacaacacacactggggccrgaaggggaatggggggcgaagggagtgagagcattaggacgaatagccaatgcatgcggggcttaaaacctagatgatgagttcataggtgcagcaaaccaccatggcacacatatacctaagtaataaacctgcacgtcctgcacttgtatcccagaacttaaagtaaaattaaaaaaataaaaaagaaaatgtttgtctttctagctatctctttcctctgtcctctgtatttacatgtgtatatacatgcctatcttgctcctcctgtgtctgtctttccctgtttttcctcagtgt

SEQ ID NO: 202631 - DNA, 601 bp, Human
ctcaaaataattacattttatttcaagtaaaatatattggtaacagcttgattgcttattcttttgataattttcaccttcacagggcatcaggtactgtttatacagcactagacattgcaacaggacaagaggtaagtgctaacgttcaatcctgatttttattttcttttattcatatttaacagttatcttcttcgatggcaacttcgcctaaaaaaaaaatgggtagcactgggttgacataggtgtttacttccttggtgcccaaagcctctgaagtgagtagtttacccatgataaccaaaaaataaaaaaaaaagtggggggcatgtgtttgtggcacagggaaagagcttagtaaataaagaatgtgtatgtttcactctatgtcccccaaaatatgaatattcatgtttattataatgattgtaattcattcttgtattttaattgccattcaggtggccataaagcagatgaaccttcaacagcaacccaagaaggaattaattattaatgaaattctggtcatgagggaaaataagaaccctaatattgttaattatttagataggtaagtgttttgtcttattatgta

SEQ ID NO: 202632 - DNA, 601 bp, Human
ataacaaggagcacatttcagatgagaagaattatatgatcaaaggtgaagagttagaaatgggcacaccaagtttaagagagagagagagatcgatctgacaagagtgaaggaagataaggaaaggtaagagaggaaaaatgttcaaatcacccacatagctaaactcaagtcccaactcagtctcatcttagctttaaagttggaagtttcatgtcatttttttctgacataaaactcaactcccagctttctcagttaagtgattgagtggacagtgatgcttttaacaagaataaartgatagaagaaaaatagcaggttagggtgaggtgataggagggtagaaaagggatgatgagttatgtttgggacatgttgaagtaaaggtgccagtgtgacatccaagcacagatgttaaacaagcagttagttaaatgggtttagaactcaaaatagaagtctgagctgtagatatagattagggagtcattatcccataataacaggacaataatagcagtgatgatgacaaatacttatgaagcatatactctatcaaaggcatggttctaagagttttccaaatagtaaatcattt

SEQ ID NO: 202633 - DNA, 601 bp, Human
aacaaccttatgaaggaaatgctgtttttatcctcatctaacaaaaggactaaaaccaaggctcagagaggtctcatgcccaaggtcacacaagtggtatctattggagacaagatccaaacccaggcaagtacagatccaaagttcgtgctcctcgttaccatactaagagtgagtgttagtagtcttagaagtagagtcacttactctagcagagcagagtaaaataggtcagctactgatccttgaaaataccaatatttcagaggtaagtcggagaaaagaatctttcagaagagamtaacagcaatcatagagatagaaggaaaactaggagtgagtgatggccttaaagtcactgaggagagaatgcccaaaaaggggaatggatattagcagcattaagagctgcagccattggatttgacaattcaaggggctttgaacaatgcagtagttaggacaggggacagaaaaccacaagccatgggcaaaattgggcctaccatctgttttggtgtggcctcaagctaaaagtggtcttcacatttttaatgcctggaaaaaatcaaaagaaaatacatttcatgatgtaaaagtt

SEQ ID NO: 202634 - DNA, 601 bp, Human
gcctagtggttaaacccagaggctctcgagccagtctgtctgggttcttctaattccaactctaaggtcatctgtgaggccttgggcaatttgcttaacttttctgtacttagttccttcatctgtaagatgaagatcataagatccaccctatagtattgttgtggggcttaaatatgaagcacatagaacagtgcctattatgtaatgagtactcaaaaagattattaaaatgctttcctcttaaaagcttttaagaataagaataaagttgatgctcactgtttaaagatttgaagaratcttaagcaagtcacatcgcttttctgagtcttagtatcctctgtaaaatgggatgatgagagtatatggcaagatgtttcaagcatttttttggtagtacaaccttttattcaagattaattgatgcttctttttatttaaatcttggtataagggaataatatcctacatatgccttagatacttttagtccacaagactgagagtgacgctttcctctgctatttcttggtttcttaaccctatgacaccagaggcatggaatgcccccagcttatctgctcacaccagctgttag

SEQ ID NO: 202635 - DNA, 601 bp, Human
ccaccctatagtattgttgtggggcttaaatatgaagcacatagaacagtgcctattatgtaatgagtactcaaaaagattattaaaatgctttcctcttaaaagcttttaagaataagaataaagttgatgctcactgtttaaagatttgaagaaatcttaagcaagtcacatcgcttttctgagtcttagtatcctctgtaaaatgggatgatgagagtatatggcaagatgtttcaagcatttttttggtagtacaaccttttattcaagattaattgatgcttctttttatttaaaycttggtataagggaataatatcctacatatgccttagatacttttagtccacaagactgagagtgacgctttcctctgctatttcttggtttcttaaccctatgacaccagaggcatggaatgcccccagcttatctgctcacaccagctgttaggggacagtagagattttcctttagagtgaaagctgcaacaagcatctgagaataatttgttatttatcaagtgtttccttttgttcaccatcaaacctgacactggtcattggaatcacacaaaccagctggtgagtaaaaacac

SEQ ID NO: 202636 - DNA, 601 bp, Human
tttcttcctcccccttcctatatctccattcaagccatcccttacaccaccaggccatctattacaccaccagcaaaatctcttcaccactcacctgtacagccccaactagtcattcctcttagctctcaataatggggtaaaaaatgtgcttttgagacactaatattagtactggtgccattaacctattaagccctttcaatgtaagggaacagcatttattaacactaactacagaccaagttctgtgatagatgctaagcatacagaacttcagttagtcctcactacaacaccraaacataggcaccactgtcaccattttataaatgaaactgaaactcaaaatatcgaagtcacatagctagacagtagcaaactcttcatttctacaagaaaatgcatgccaggttccccaaaccaatttaaatatcacattctggaatttgaaccatttaaggatttgtatacccacgagtaaactcctttgaaaaatgtgtccatttaatacttccagttagactgctttctccttgagtacactaatgttgtcattaaccaacaggttttcttcataatgtcaaatatttccatctga

SEQ ID NO: 202637 - DNA, 601 bp, Human
catgcacatgtgcgcacacacagtcctttttcttctgcctcaagtcacacacacatttacacaaacctatatgtttggctttcatcaaaccaatactgctataaatgagagcaggaaccagggcattaattactactttgtctttcatgtcataccatgtgagagccctttcctgggataatcgcctaaggcagtgttgcccaacatgggttccttcagtatgttaacaagtgttacaagaggaaaaagtcaattcagtatcgaaaatgctgggataacaaagcagcacttctcacagccgttgtttgtttgtttgtttgtttgtttttgttgttgtttttgagatggagttttgctctggtcaccaaggcaatggtacaatctcggctcactgaaacctccgcctaccgggttcaagcaattcttctgcctcagcctcctgagtagctgggattacaggcacgcaccaccacgcccagctaatttttgtatttttagtagagatggggtttccccatgttggccaggctggtctcaaactcctgacctcaggtgatccgcctgcctcagcctcccaaagtgctggcattacaggcgtgag

SEQ ID NO: 202638 - DNA, 601 bp, Human
agcaattcttctgcctcagcctcctgagtagctgggattacaggcacgcaccaccacgcccagctaatttttgtatttttagtagagatggggtttccccatgttggccaggctggtctcaaactcctgacctcaggtgatccgcctgcctcagcctcccaaagtgctggcattacaggcgtgagccaccacgcccagcctagcctttaatattctaatgtacattgtgcatctctgagagggtagtaaagtaaatggtgggattttttatttgccaaacttatttgactgtagaatcctyccaccaccctacccacagcacctcaaattctttggaatgatatgaattgttggaccaaatcctatgttcagacagcctttctgtacattcatgcttaggcccaaaatacattttgttctatttatacattaagaatatatttttattttaagtctcagctactcagaaggctgaggtgggaggatcacttgagcccaggagtttgagcccagcctgggcaacatagcgagatcctgtctcttcaaaatatatatatatattaaatatataaatatatatttatgtattatctattaatta

SEQ ID NO: 202639 - DNA, 601 bp, Human
atcctatgttcagacagcctttctgtacattcatgcttaggcccaaaatacattttgttctatttatacattaagaatatatttttattttaagtctcagctactcagaaggctgaggtgggaggatcacttgagcccaggagtttgagcccagcctgggcaacatagcgagatcctgtctcttcaaaatatatatatatattaaatatataaatatatatttatgtattatctattaattactatataattaattacatattttgtatagtatatatatgtgtgtgtgtgtgtgtgtgtrtatatatatgcgtgtgtgtatatagtagcctgtaatacatgctttgtctctcagttcctgccttggtgccccatgcagttggtggtgcttccagatgaatatggagggcagggcagcataagaaggcatcattccttacccaaatcaggaataggcattccagaatgtctttaagataaggcagtctcttggtatttggcattgtttaggcaagatgaaaagttgctgtcataataacaattcacaaaggaagagcagtttacagttgcagagagctttcacataaaccatctcatttct

SEQ ID NO: 202640 - DNA, 601 bp, Human
tttataatcctttcttctaatctaaaagaaataaagcaaaaaaaaaaaaaaggtgggggtggcggtagacggggctagttatgaagttatgatgcatctagttttctttcccccctagagcagggtttctcaatctctgcactcttgacattctaggcaacataattatttgttatagggctgtgcattgtaataggtttggcagcacccctggcatccactgactaggtgccagtaactcctcctcaagttgtgacaaccaaaaatgtatccagacatcaccaatgtcccctggagtgtkgggagggaatctcctcaagttgagaaccacagcactagaaattaaagcagttagaaatcccagatattaacccctggaaagccacgtggactttattttcccagtttgataaatcgaatcagtttaaatacagaagacaccactcaacggttcacaaaaataatttggatagttatctctctcccacttataataaacccttaactgcctccattgactttaaataactcaacattatcagagcaatgaggtgaattactgagggccaacaattgagggactcaaaatcaagttataatg

SEQ ID NO: 202641 - DNA, 601 bp, Human
attctaggcaacataattatttgttatagggctgtgcattgtaataggtttggcagcacccctggcatccactgactaggtgccagtaactcctcctcaagttgtgacaaccaaaaatgtatccagacatcaccaatgtcccctggagtgtggggagggaatctcctcaagttgagaaccacagcactagaaattaaagcagttagaaatcccagatattaacccctggaaagccacgtggactttattttcccagtttgataaatcgaatcagtttaaatacagaagacaccactcaacsgttcacaaaaataatttggatagttatctctctcccacttataataaacccttaactgcctccattgactttaaataactcaacattatcagagcaatgaggtgaattactgagggccaacaattgagggactcaaaatcaagttataatgattactccttgcaaatgtataataattcatgttttacacatctgtcaatttgaattcattttaactttcattggttatttctgtgtgccaggggcctttaattttcataccacctatattagttttctgtgactgctgtaacgaattct

SEQ ID NO: 202642 - DNA, 601 bp, Human
cctgtaacatccacacagtggcttctgccacagataggctccttttttcaaggctaagagatacaaacatacagctcacaccaacacagcaaatcaaagaacccgcacatttaagtactttttatacgaaaatgttcatttgttacattaaagatacactggcatttgtagtaaacaatatccacattgtcagtcaactttaaaagtaacactaatctagggttggctctgcactagggactttgagaactcaggagaaatgtaaaccacagttcctacctcaaaagatttacagcctaaytgaggaggtggcatttctaaatgatgcatttgtattatatatcagtataacatgtacataagttcatattcaaaagaatggttacagataccatgaagtacagtggatcatggtagaaaggaaggtttcatggagaagaacttaaagggtgaatatattttgcataagcatataaaagaggcaagaatagttcaggaatagaataagtctcacgaaggcagggggttgagaatgaacctggtaggattgaaggtcagatggcacttgcctggaaggaggggaaatttggtaaaaaaaaaa

SEQ ID NO: 202643 - DNA, 601 bp, Human
aaatgtaaaccacagttcctacctcaaaagatttacagcctaattgaggaggtggcatttctaaatgatgcatttgtattatatatcagtataacatgtacataagttcatattcaaaagaatggttacagataccatgaagtacagtggatcatggtagaaaggaaggtttcatggagaagaacttaaagggtgaatatattttgcataagcatataaaagaggcaagaatagttcaggaatagaataagtctcacgaaggcagggggttgagaatgaacctggtaggattgaaggtcakatggcacttgcctggaaggaggggaaatttggtaaaaaaaaaaaatatagctaagatatattacagtcttaaaggtagagagtttgaaaaatatgatcagtttataatacttttcatctgcccctatatagaggctggatctaatagttaaaaatgaaagtttaagccagagtagtagttaggagtactggacagaagaaaagccaggtgttgggaaccgaagagggctaatccatgagatgagaagaaaagacaggggccatgaccttgaggaggtaagctacaaaggatcagaaagcc

SEQ ID NO: 202644 - DNA, 601 bp, Human
tgtcatcagtttcataggtcttagcgggtaactataattctaatgcttataattattaacttttctttatacaaaagacatcacttatgctcttgtgccaaatgtagcagatgctgtcataccaatacttttttacccttaccacttcagtgcctgccacccccaaattcctactgccagcacctgcatttctttccctggggactttttctggattccaaacttgttttgccaacttgtatagtaggttggaaatgctgagaaattaatggccccaaccaaagactgataggagtcagcrtactctcacctctcaggtggggtaactctgaaggagatgtcttacactgcctccaagactttcccctgaagacttaagccccagacactctgtctgtggcagcaaatgtgataatgttgtctttaacacgtgcttacttgtttcactgctccattcttctatcactatttccttcaactctgaaacaaactacttatacttgaatccctgtctcagagtatattcttgtgggagcccaaactaagatcttctcacaaacctgtgagataattaagggtagacatcataattttgcagttt

SEQ ID NO: 202645 - DNA, 601 bp, Human
aaaaaaagtgaggccctataggacttgattcagaatctatatacatttgcattgtatgcataattttaaccaagtttgaatgttttatttccagtctcaccaaagattagagacatcctgttaaaagctagtcagtggatgttaaaacaaagataacagaacacctacagcacagggagagaaaaactacggaaaagctggcaaaataactctgcagtcagagaacatttagtgtttgtgcaaacgttcattcttacagcctgtaataggttctgagggcattgctggatacagcacactraaaagctgaaaatcatagtgtggaccttgagtcatcaagaaaagatgagactgtattccatacagtctgcctaaggaggcaacgaagtgtacaatacatgttagaaaacgttctaacaaaagcagttaaattaaaacttgttgaaatgtaacgacgtaaatttctacaccagaaaactctactatccagaaagattcctttttcaaaagctccatctcttgctgaaatttcaattgttctgacttcatcatttacagccttggtcatctcttggtggaagactatgattttgcatctcat

SEQ ID NO: 202646 - DNA, 601 bp, Human
gaagtgtacaatacatgttagaaaacgttctaacaaaagcagttaaattaaaacttgttgaaatgtaacgacgtaaatttctacaccagaaaactctactatccagaaagattcctttttcaaaagctccatctcttgctgaaatttcaattgttctgacttcatcatttacagccttggtcatctcttggtggaagactatgattttgcatctcatactcccttttgcagtggaaaaatacatgtgcatggttttgccaagtttttaaactcttggaagaagggggaatctttatttttrattgcatattttgtatgcttctgggggtcacaaactgtccccattcttatattatcagtgaatttccaataaaaaactagtgcaaatttagacacctcccaaaatgaaggaaaattacccacaatgcatctttgcagtagaaggttggcccagttagattatgcagcaatttgtgtgatttctcatctggacactcagcacttagttcccatttcacctctaccaactgaagctttgacaatttgtctgacaagtccataacctaacttttttttaaaaaaatgcaaaagaaacagaagc

SEQ ID NO: 202647 - DNA, 601 bp, Human
tattacacaagatgatacatgtaaagtgcttagcacaatgcctagtacttagtcaatgaccaaaaaatattcatttctgctctctttttaatcacataaaattctactctgttttacagaaaggagctctttttaaagatgaggctatcagctgggtgcggtggctcacgcctgtaatcccagcactttgggaggccgaggtgggtggatcacctgaggttgggagtgccaggccagcctgaccaacatggagaaacccaatctctactaaaaatacaaatagccaggcgtggttgcacawgcctgtgatcccagctacttgggaggctgaggcaggagactcgcttgaacccgggaggcagaggttgcggtgagtcgagatcgcgccattgcactccagtctgggtaacaagagcgaaactctgtctcaaaaaaaaaaaaaaaggatgaggctttcatgaaaacgactcattattctacctttcttctaattttgagtatcatttaagggtcctctactttgggttatatagctacctattattctgtctcaatttgaaagttgagagacagttcactccagttaaaatggcttacacca

SEQ ID NO: 202648 - DNA, 601 bp, Human
tttttaaagatgaggctatcagctgggtgcggtggctcacgcctgtaatcccagcactttgggaggccgaggtgggtggatcacctgaggttgggagtgccaggccagcctgaccaacatggagaaacccaatctctactaaaaatacaaatagccaggcgtggttgcacaagcctgtgatcccagctacttgggaggctgaggcaggagactcgcttgaacccgggaggcagaggttgcggtgagtcgagatcgcgccattgcactccagtctgggtaacaagagcgaaactctgtctcaaaaaaaaaaaaaaaggatgaggctttcatgaaaacgactcattattctacctttcttctaattttgagtatcatttaagggtcctctactttgggttatatagctacctattattctgtctcaatttgaaagttgagagacagttcactccagttaaaatggcttacaccaaaaagacagtcaataacaaatgatggtgaggatgtggagaaaagggaaccctcttgcactgctggtggaaatgtaaattagtacaaccactacggagatcagcttggagattcctcaaaaaactaaaat

SEQ ID NO: 202649 - DNA, 601 bp, Human
ccaatctctactaaaaatacaaatagccaggcgtggttgcacaagcctgtgatcccagctacttgggaggctgaggcaggagactcgcttgaacccgggaggcagaggttgcggtgagtcgagatcgcgccattgcactccagtctgggtaacaagagcgaaactctgtctcaaaaaaaaaaaaaaaggatgaggctttcatgaaaacgactcattattctacctttcttctaattttgagtatcatttaagggtcctctactttgggttatatagctacctattattctgtctcaatttraaagttgagagacagttcactccagttaaaatggcttacaccaaaaagacagtcaataacaaatgatggtgaggatgtggagaaaagggaaccctcttgcactgctggtggaaatgtaaattagtacaaccactacggagatcagcttggagattcctcaaaaaactaaaataaaggtgctgtacaacccagccatcccactgctgggtatagaccccaaagaaaagaaatcagtacatcaaacagatgcctgcactcccatgattgttgcagcactattagcgatagccaagatttgga

SEQ ID NO: 202650 - DNA, 601 bp, Human
taaagcataatttagaaaaaaagaaaaaaaaaagttaaaagcactaagtttcatcccagcttttctaataactagcacagcatctttctgggcctgtgtttgtatatagtgaataaggatctttgaacttgagtattccttccagttttaaacttgcatgaaactaattattcaggccaacaataaaagacaagtcaccactttgctagcaagaagaaaagaaatatgtacatggggatatttgagggaccttgagaagtcaaccagtttgcttaatgctaggatgatttaagtctgacamctgggatagagatcccatacattctttgttgatgttctctaaggtttttctccctgaaagtaagcctctgtgatttatatgtacggaataagtaaagtatgcaaatatcataagtatataatagtcactgcactgatgcagtgaatcaacctatattctgagacatgatgggctctgcagtatgaaataactttgaggtactcggccaggcgcggtggctcacgcctgtaatctcagcactttgggaggccaaggtgggtggatcatgaggtcaggagatcgagaccatcatggctaaca

SEQ ID NO: 202651 - DNA, 601 bp, Human
gtatatagtgaataaggatctttgaacttgagtattccttccagttttaaacttgcatgaaactaattattcaggccaacaataaaagacaagtcaccactttgctagcaagaagaaaagaaatatgtacatggggatatttgagggaccttgagaagtcaaccagtttgcttaatgctaggatgatttaagtctgacacctgggatagagatcccatacattctttgttgatgttctctaaggtttttctccctgaaagtaagcctctgtgatttatatgtacggaataagtaaagtatrcaaatatcataagtatataatagtcactgcactgatgcagtgaatcaacctatattctgagacatgatgggctctgcagtatgaaataactttgaggtactcggccaggcgcggtggctcacgcctgtaatctcagcactttgggaggccaaggtgggtggatcatgaggtcaggagatcgagaccatcatggctaacacggtgaaaccccgtctctactaaaaatacaaaaaattagccaggcgtggtggcgggcgcctgtagtcccagctactcaggaggctgaggcaggagaatggc

SEQ ID NO: 202652 - DNA, 601 bp, Human
gctctgcagtatgaaataactttgaggtactcggccaggcgcggtggctcacgcctgtaatctcagcactttgggaggccaaggtgggtggatcatgaggtcaggagatcgagaccatcatggctaacacggtgaaaccccgtctctactaaaaatacaaaaaattagccaggcgtggtggcgggcgcctgtagtcccagctactcaggaggctgaggcaggagaatggcgtgaacccgggaggcggagcttgcagtgagccaagatcgcgccactgtactccagcctgggcgacagagcragactccatgtcaaaaaaaaagaaaagaaaagaaataactttgatgtactcataaaagaggatccagaaagataatttgttatttggtctgaaacttaaacataatctgctctcagggctgagggtgttttctcctattatcaagcctatgtagttaaactttggcccatgtattttgaaagatgaagcataactaaacttacagaacttcccaatcatgcacacacatgcgcatacacacacaacatacacacacacattttcctttcctcctaaaggagacaggatctatttttcaaa

SEQ ID NO: 202653 - DNA, 601 bp, Human
tagaaatatttagctagcactatgtcagatagcagggacaccatgatgggcaagacagaaaaggtttctgccctcatggagctgacagtctagtgcagtgtggtccagtagaaatataatacaagccacatttgtattaggttggtgcaaaagtaattgtggttttgccatttgcatttattaccttcaaagatgtcaataaaaaccaagtgaaattatttcaatgtaatttatttaacccactgtatccaaaatatcattcaacatgtaatcagtatacaaaattatcaatgagatattmggcattcttttttattgtactaagtcttcaaaatctggtctgtattttatacttactatgtatctcacttcatactagccacactttaagtgctcaatagccacatgtggctcatagctactgtactagtttaataagtgttaaccagatgaatggcaggtaaaacggtgttctagaagaaggaaatagcataagcaaaggaccagcagtgcaagaagatgaatgtgcccaaaggctagaggaaagaaagcagaacatttgcagaaaaacacaagtatttcagacgctgctggtgtgtgg

SEQ ID NO: 202654 - DNA, 601 bp, Human
caagacagaaaaggtttctgccctcatggagctgacagtctagtgcagtgtggtccagtagaaatataatacaagccacatttgtattaggttggtgcaaaagtaattgtggttttgccatttgcatttattaccttcaaagatgtcaataaaaaccaagtgaaattatttcaatgtaatttatttaacccactgtatccaaaatatcattcaacatgtaatcagtatacaaaattatcaatgagatattaggcattcttttttattgtactaagtcttcaaaatctggtctgtattttayacttactatgtatctcacttcatactagccacactttaagtgctcaatagccacatgtggctcatagctactgtactagtttaataagtgttaaccagatgaatggcaggtaaaacggtgttctagaagaaggaaatagcataagcaaaggaccagcagtgcaagaagatgaatgtgcccaaaggctagaggaaagaaagcagaacatttgcagaaaaacacaagtatttcagacgctgctggtgtgtggatggggaaggaagaagaaaggcccagcgccccaaggtccaaggcccaaca

SEQ ID NO: 202655 - DNA, 601 bp, Human
agaacatgcagtgtttttaagggataggtagaggcagagggaagggcagaggctctacccacagatgcagccactttcaccaggtcttgaattgagaggcactaaagacttctgctctaaaatggttttcccttgcctttatgcgtcagagttcatgctgtgctccctcttctgaggcatccaaggtcctcacttaattatgaataaaacttggcaggaacagtacagttatcattggtcattaacacccagacccaaagcatgttatcacattcaaagtcaggcagacttctgagaatckgggtccctgaagaggcaagttgtgaagatgaggaagagagtttaagaaaggtctatggctgtcaaagctgcctaggagagaaaggcctgaggatgatcatgatgaagatacccgaagcagcctaagggattttatgaaaatattgggtgcctcagcagcaagaccctacaggaggaaataagactacactgaaaacagactttactccttcccggtttggcccccgcaatctcgattcataaactacacccaactcaaacgtgacacatggcagctaggttctcttctgcagtggcagag

SEQ ID NO: 202656 - DNA, 601 bp, Human
ctaatattatttgttgtaattgttacaaagctgagtagttctaaaagtcactatgcctaatgcctatctaattggccatattgctggctggatttcaggtaactcacagtgacctgccatggccctctacttccctttcatgtacctctcaaccaccatcctctggatggagatgattataatttgcatgttgttgagctgtgttcaccacctccctctttttgctctctgctagtgtgggagcaacttgatgggccagcagaagctgcagaggcagacatggagaggaagcagcacattygccaactgggtttcagagggaagcagctctgggaactgacgttcaggctttgaccaacccctgccccccgccgccaccttccccctgccaagatctgtccattctcctgggaacccatggtcggccttgggggatacatagagattttggatgagatttgtccaggcatctgcatgaaacagctccgggacagttccctctatcatatcaggtcaatttcaaatttgcagcaaaggttcatcctgagctgctgaagtaattcacaaagtagtcacagaagtggctcaccctatataaaga

SEQ ID NO: 202657 - DNA, 601 bp, Human
taaataaatatgtccaactattatgtatcaattaaaaattaaaaataattttagatggctaattaggaacagctctggtctgcagctcccagcatgattgacacagaagatggatgatttctgcatttcaaactgaggtcatcaggatcaaagaccaaaggtagataaaaccacaaagatggggagagaccagagcagaaaagctgaaaattctaaaaatcagagtgcctcttctcctccaaaggattgcagctcctagccagcaacagaacagagctggacagagaatgacttcgatgarttgacagaagtaggattcagaaggtcagtaataacaaactactctgagctaaaggaggatgtttgaacccattgcaaggaagctaaaaactttgaaaaaagattagacaaatggctaactagaataaacagtgtagagaagaccttaaatgacctgatggagctgaaaaccatggcatgagaacttcgtgacgcatgcacaagcttcaatatccgattcgatcaagtggaagaaggggtatcagtgattgaagaccaaattaatgaaataaagcaagcagacaaggttagagacaaaaga

SEQ ID NO: 202658 - DNA, 601 bp, Human
gtagattatttattagatagcctgaaaccctagggatctttttgggctcctgtgtattaggaaaaatgggcttggtatttataagcttttgaaaaaatctctatattgcccagtagagagatttccaggctatgacaaaggtagcatatccagtcagcagctaaattcatttttttaaaaaaacctatcaaattatttatttgatgaatagacctaggtgtgatagattgctgccaggtttttagaaaatgatgtgcaggagccctaaagggcttttctttatcaaattgattcatctatytactttgctcatttgctcatggtgtcctccacccaaacgttaacctaacattttcactctaagtgggagaaaaaaatggtggtgaaggattgtatgaacatctgagccttgatggaccattgcctttggccactgtcccccattcgtctaaatctcagccctgtttatgaaataggatgatagagaaagaaggttaacattatctaaatgatgagagattaatctgtatggttcagctaataagtcataagagtacagggaaaagagcagtcactgtgtactgaggtggtcagggaaggc

SEQ ID NO: 202659 - DNA, 601 bp, Human
atgtgcaggagccctaaagggcttttctttatcaaattgattcatctatctactttgctcatttgctcatggtgtcctccacccaaacgttaacctaacattttcactctaagtgggagaaaaaaatggtggtgaaggattgtatgaacatctgagccttgatggaccattgcctttggccactgtcccccattcgtctaaatctcagccctgtttatgaaataggatgatagagaaagaaggttaacattatctaaatgatgagagattaatctgtatggttcagctaataagtcataaragtacagggaaaagagcagtcactgtgtactgaggtggtcagggaaggcttcttgaaggaggggctagatgtaggcccagaggaaaatgggaaagaattccaaatgcatctagccactggcatgaccactgtggtaccggcaggaatgagtataacaaatgcaattggtatagaggggaaagggagcatctccaggactgaaggtctctaacagccctgcattgctgacctagaagagatagagacacaaggaaggaaagaggaaagagacagacaactggtgggagtaaaagagtagtt

SEQ ID NO: 202660 - DNA, 601 bp, Human
gaggaaatattttggtgaatatgagacaacaagttttgtcttcatggaattaaaatcaaagaaaatatgtaccatgagcaagccaagataagcatggtaaaggacattggacagtaggcaaatcatatgcaccttgaggtctcatttatttagcgaatatatattgaatacttactacattcaggcaatgagcctgaccctttaggggaatataaaaatgaataagatgctccatactcctaagaatgcttagggtataacatgttcactcaatatttgaataccagcctaaaatctttaygttcaagttcaagtgacaactcatgtttccaagctatttgtcttgtcaggtacaagggtaaatttgtgtcaagcagaggaagaagaaaggaagggtgaaataggtacaaaatgactaaatatcagctaccatctccattaaactggagtgctctataaaagattgcaatcaatagagctagggacaagacagtttttttcaccaactgactgacaggcatatggcacctaattgatataaggtgtcagcaggttcttgttctctgactgtaagtaaaatgacaaaggggttgccagtgtg

SEQ ID NO: 202661 - DNA, 601 bp, Human
tgaggtgaaggaggggcttcttgcccgagcccatgactgcgtggggatgtggttaatctcacaaacaaaagcagggctctgccaacagagcattctcccatctctatccccaccattctttcatggaataattcaatacatatttattgggagcttactatgtgccaggtactgggaataaaatagtgaacatgactgatgaggttctggctattatggagtttacatttgggttgggagagccaaatgttaaaatagtgaacaaataaaaatgtagtcaattcaaataattataagttcytgaagaacttaccttgaaaaaaatgtagatggaaatgaagctaggatagtgagatgtagaatgacatgtgtggggcttgaaagcgtggtcttgaaaggcttcactgaagagaggacatttgttctgaaactatacaataggaaggaaaatgtgcagctttatggaagaggactaaagtgtaaggacccctatgtgatcacatgtttgacaggtttaaagagcagatagaaggccagtgtgttcttaaataccattgtgttttatatacccacatctgagcacatgctgtgtctacaatct

SEQ ID NO: 202662 - DNA, 601 bp, Human
gctcctctgagcctacccttgtcagcaaatcagccttgtactcaaaccaccaagtagatagtatctctcttcttcgcaatgtgcctgcacagggaaggaagggtttcaatgtccactgagagatccagagtttagaatagtctgagctttgtctacccaagcaaaatgaagatacgtcatatttacttaagcaattttctccctctaccccctaatttcttaactccaaatataagatgtgaaattattcaatcacaagggtcctaggtcaccaccacccttctccacattcatttgtttrtcttgaagttgtaaaaataatgcatgttagctataagaattataacaacataaaagcatgtaaaggaaatcatcccctatttcccactctcaaaataacgccctagaagtcattactatgaacaaattatgtgtgtcctaggtattttctctacatagtaaaacagaaacacacacaaatacacaaagacttttttttttaacaaatgttctacaaacctgttctttttaacagtacattatggatgtcttgccaaagctagacacaacactgatgaagtgacatttgcactgcatctgc

SEQ ID NO: 202663 - DNA, 601 bp, Human
ctaggtcaccaccacccttctccacattcatttgtttatcttgaagttgtaaaaataatgcatgttagctataagaattataacaacataaaagcatgtaaaggaaatcatcccctatttcccactctcaaaataacgccctagaagtcattactatgaacaaattatgtgtgtcctaggtattttctctacatagtaaaacagaaacacacacaaatacacaaagacttttttttttaacaaatgttctacaaacctgttctttttaacagtacattatggatgtcttgccaaagctagrcacaacactgatgaagtgacatttgcactgcatctgctgcttggcctggctgtcatctccccctgccttcctccctgtcctcctcctcctttttggtaaccttgagagcctgatgactttccaagcacaggccagtgaaccatggactttacctctaagcatgtgattggccacttccagggtgattggggccctatccctcatcctccattggcatgcatgcctgccgagagcaccaggtgattttccagggcaatggcttccagtggggctacatgagtcttgatctgggctaccgtc

SEQ ID NO: 202664 - DNA, 601 bp, Human
tttctgctaaagaaggaataaatattcttgaaatgtgtcacattaagatgtctgtgctagatgaacttaggcattttgatgttattcaggcccaggcgtgttttctcaatggcttcccaaccctaatcaattcttgctacagagtgaggggctcctgggtgcatggttgtttcttagagaagccattcagaaatctcaaatggggagttcaagcagaaagatcctgaatacaaaattgccccagggtgcttccagtagtaccagctaacaaaactgtttcccaccttggggataatagttaaaaaaaaaaaaaaaagtttcccatcattaatagtagtcattgtaggtttgcctcatgtttgcctagaatatccataacttacggaatttttattctgatgataatcaagggcctgtggtgttgccatgagatacatgtccactgacttctttttagtgtagctaagagtaatagcaccatgccatggagaggcagtctccataatgacctgcccagttccctgtcagagtagcccttcagtcctccacagccccggatgaagacacttcattcccatggattgactcttctatccattac

SEQ ID NO: 202665 - DNA, 601 bp, Human
ttctttttaaaaggtttcctctctggtgttaggtactcaggaagccgaatggagaataataaagttccttgttagacaatataatcgagtagtttcagaaagcatttcatattctaggcatagacaacaacaaccttttggctctatcatacaagtggggctaaacactattcacgggtactgctgtgtgtattggacaggactggcagcactgccttagaagaaaagaaaggaaaagagtaagaaaagtagaaagaataaggaagtggcggggagagagagagagagagagaaagagagygaggaaagaggaatagcatggtaggaagcagacccatacccataatcgaacccagggaatcctgtgctacaggttagcctctcttcccttctgctcaacacttttagaccctgacagagatgaggaatgcctctgcctggagaaagggcagatttctcatctgagctcgcttcttcctgggcagactgtgacaaatttctcacttccccatctctcccaactctaggctttatgctgatagtgtttatgttcatttccaggcccactcagacctacttcttccttagcctgaaagcttat

SEQ ID NO: 202666 - DNA, 601 bp, Human
tctcttgattaagcatcagagattccaacattgtttccagggtccattcctgtgtacattgaagtggactttttattgtggtaagatatacctaatataaaatttcacattttaaccacctgtaagtttacagttcagtggaattaagtacattcacatcgtgcatccatcgtcactaggatgcatttttgaagatgcacaagttttggagtgtctattttactttcaatagtgaacttatctaagcatagtttcatatttcacaaggacacacttaaaaaattaattaattaattaattwatttatttatttatttatttttgagacggaggctctctctgtcacccaggctggagtgccgtggcacaatctcagcttactgcaacctccgactcctgggttcaatcgattctcctgcctcagcctccatagtagttgggactacaggcgtgcaccaccacacccagaaaatttttgtttttttttttgtttttttttttaattaattaattaatttatttatttatttttagtagagacggggtttcgccatgctggccaggccggtcttgaactcctgacctcaagtgatctgcctac

SEQ ID NO: 202667 - DNA, 601 bp, Human
tccagagcttaggcaatccgcctgtcttggcctcccaaagtgctaggattataggcgtgagccaccgcgcccggcctgttaatgacatctttgattagaggaatctgaaacactaaagttatgtttcataactgtggcccccttgtccaccttatatgaatatttgtggtaaacttaaaattatctttgagatgccttcagtatttttctttctttctttttttttttttttttgagacagagactcgctctgtcgcccaggctggagtgcagtggcacgatcttggctcactgcaagctmcgcctcccaggttcacgccattctcctgcctcagcctcctgagtagctgggactacaggcgcccgccaccacgcccagctaatttttttgtatttttagtagagacggggtttcatcgtgttagccaggatggtctccatctcctgacctcgtgatccacttgccttggcctcccaaagtgctgggattacaggcgtgagccaccgcgtccggccgccttcagcatttttctagggtctttaagatgaaattgtgaccaggtataagacttcagtgattttccttatcttgtaaaatgca

SEQ ID NO: 202668 - DNA, 601 bp, Human
gttaatgacatctttgattagaggaatctgaaacactaaagttatgtttcataactgtggcccccttgtccaccttatatgaatatttgtggtaaacttaaaattatctttgagatgccttcagtatttttctttctttctttttttttttttttttgagacagagactcgctctgtcgcccaggctggagtgcagtggcacgatcttggctcactgcaagctacgcctcccaggttcacgccattctcctgcctcagcctcctgagtagctgggactacaggcgcccgccaccacgcccrgctaatttttttgtatttttagtagagacggggtttcatcgtgttagccaggatggtctccatctcctgacctcgtgatccacttgccttggcctcccaaagtgctgggattacaggcgtgagccaccgcgtccggccgccttcagcatttttctagggtctttaagatgaaattgtgaccaggtataagacttcagtgattttccttatcttgtaaaatgcagttccaaccttcataagtataatggcagtcacctccaaggattatttattaccctgaagagatgtgatattggaaac

SEQ ID NO: 202669 - DNA, 601 bp, Human
ccccttgtccaccttatatgaatatttgtggtaaacttaaaattatctttgagatgccttcagtatttttctttctttctttttttttttttttttgagacagagactcgctctgtcgcccaggctggagtgcagtggcacgatcttggctcactgcaagctacgcctcccaggttcacgccattctcctgcctcagcctcctgagtagctgggactacaggcgcccgccaccacgcccagctaatttttttgtatttttagtagagacggggtttcatcgtgttagccaggatggtctcsatctcctgacctcgtgatccacttgccttggcctcccaaagtgctgggattacaggcgtgagccaccgcgtccggccgccttcagcatttttctagggtctttaagatgaaattgtgaccaggtataagacttcagtgattttccttatcttgtaaaatgcagttccaaccttcataagtataatggcagtcacctccaaggattatttattaccctgaagagatgtgatattggaaactgacagttttatttatcaatacaagtaattcacaaataactaacttcaggaactagaagtc

SEQ ID NO: 202670 - DNA, 601 bp, Human
tatgctaccagatatcaaggctagttacagagctagagaaattaagacagcgtagtactggctcaaggacagacaaataaatcaatggaaccatgacccttacctcataccagataccaaaataatactaataatgatttgaaatgaatcataggcctaaaaatgaaagtcaaaacaacaaagcttctagatcacaccaccagagaaactcttcatgaccttaggtaggcaaatatttcccagaggacaaaaaacattaaccatgaaagaaaagattaattaattataccttaagaggatraaaagccaaccacagactgggataaaatattcacaatatatatctaacaaaggacttctatccactacattcatacattttttaaactacaaatcaatacgaaaaacataatcaatctaatttttaaaaaatataaaagaattgaactggcacttcatagaggagaatatccgaatggctcacaagcatataaataggtgttcatcactattgctcatcagggaagtgcaaattaaaaccacaatgagatatgcaaaacccaccagaagagctaaaatgaaaaagactgacaataccaag

SEQ ID NO: 202671 - DNA, 601 bp, Human
gaaaatggaatgaaatatgaatgtgcagggcagtgtccctttggcctgtgtggctctctacttcatggcagtgctaaggcaagagaccctgatagctaggccgagtttttaattgatacaagatgagataacctatatcttacaagtagctcataaagacccctgaggcagaggccatactatccatctggtaactgagatctttgaccccattgaatttttattaacctctcttgggactttttttgtctgcacaactaatcaaaagtcaccatttttcttttagctgaaagtcctaccyggcaattttgcaatgctcctaactggaaaactggcaataagtgtctaacagtaggatggaaaaggagcaaagaaatccaaatcctctgggtctatctttatagttgataagcttctttgtattaggtaaggtaaattagttcatatccaaggagaacagaggcagttatgtgggaaagattaaaatgcacctttggtgagggtgggtgccagattcctatttacaaacaggaaaatttttttccatagtgttcccttctccggtgctgcagtaccatttggatacatgcattcaatatag

SEQ ID NO: 202672 - DNA, 601 bp, Human
cataatgaaacagcatgcaacaattcaataaataaacctcaggctgaaaaaaaagaagtgtcaatgcaagcataatctaccaaacacttaacagattttagataatacatggatgcaaacatcactgaaacatgaagaaacatacaacaaccttggctacatgggtatgtactgaagtatctgacactgaggaagtaggccggatggaagaaaaaacattattttattttattgacagagtttcactcttgtcgcccaggctggagtgcaatggcatgatcttggctcactgcaacctccrcctccggggttcaagcaattctcctgcctcagcctcctgagtagctgggattacaggcgcccaccaccatgcccaactattttttatatttttagtagagacagggtgtcaccatgttggccaggcttttctcgaacccctgacctgaggtgatccacccgtcttggcctcccaaagtgctgggattacaggtgtgagccaccatgcctggcagaaaaaaaacattatttttaaggggaatattggctttggaggcagagaaacctaggttcaagtctaaaagttttcttgccttagttc

SEQ ID NO: 202673 - DNA, 601 bp, Human
ggtaggtgtgccaccacctccagcctgctgcctttttctctctcaccgtttcctcttaattattttattcattcatttatgtcccttctcattccacaaaggatttgcagtagttacaatctcatgctatgcatttttccttaattattataccaactcctatggttttacccatcatctctatataggcaactccccaagctgtgcctctgactctgactctgatgtccttcctacacaccacactacctgcctgatcacctgctgaacaccatccatacatacctcaaatccaacataycctaaacttgaggtttacccaggacctagttttagcactgaaagttccgtgtcctcggaattccctcaaccccaagcaaaccagaacactaagtcaccacaactaaaatgaactcaacagtgtctgttccaaacccattcttcctcatgagctcctaattcctctccatcattttgtagcagagatatcctccttctgcataaacttcaactcctctttgccttccacctactcatgcaactgattgctagatattgtcaattttatctccaaaatatcttctttaacgtcacttccttt

SEQ ID NO: 202674 - DNA, 601 bp, Human
gctcccaggcatttgagcatgatgactacacaatatgacacctaagaaatgttgttatgaatgactaaaatacacggagtattaatatgagctctaagtgaaagggaaaatcaaaacaaaacaaaaaccaccaccatacccttgagaagccaggaactgagtttgtcggttccagttttgcatcttttcatttcttcagagaagtatatgataaccacagttaaggaaagtaaatattgccagggaattctgggtggtagagactcattaaagccttgatattcatatgaaacagaatcawctggaagtcatattaaacagaaactaaacttgagagagaattcactggttccctcagggcattaggtcttaactgatctgtggccctactccctaattacctctgctgcaagagccataggctttccatctcagactggcaaggaaaaagagaatttacataaacgatgtttatatcagtgacaggaaatatgtatcccacttgaataaggggtacggcgtgcccaatatagattatgaaaaatgaaaaactgccaggagaagaaggcaagtgctttccctagaggagagagagctcatc

SEQ ID NO: 202675 - DNA, 601 bp, Human
actattaataaatggcaaagccagagtcggacctcatgtctgtcttactccaatgcctacataccagagactatgtagtattatggttacagcagggcccagaactctttctatagagggcccatagcaaatattttagacactgttgaccttatggtctctgttgtaattactcaactctgcataaaagcaaccacaggtaatacataaacaaatgaatgtggctgtattcctataaaacttcatttacaaaagcaggcaatgggctagatttagcccagaggctatagtttgatcaccycaagttagagcactagtggtgtactcagatagacctgggttcaaaacctggctctcaccacttactagacaaaacatttagtctctctgtgtctcagtttcttcagcggtagaacagcaacaataccaccctcatagagtcatcatgaggattaaggattaaaggcatgtctggcacatagtcaacttctcagacagtcattttattaaaagcccaccacatgctggtccctagaaggaaggagaaaggacatggattagaataattacaactctctttaaaatcaagctaccagggccc

SEQ ID NO: 202676 - DNA, 601 bp, Human
tggtagctgtaaaaagcagcagcctggcacccactgaaggggagcaaactgggtttggagcaccccaaatagacccatccccagagaactgtcattatctgtcagtcaacttcgttaagaagcccaattcccaggactggtcttcatgtgatctgactcagtaccaatagttcttttcctgggggcatttgtttaaaaaaatcagcaacagttgtttaatatgaaggctgcctgaggcagtagataacaattgggtcaaataataggctaaagaaaaagcaatctaaatccagcaacatakaaaacgaattagacactatgggccaggtgtggtggctcacgcctgtaatcccagcactttgggaggtggaggcctgcggatcaggaggtcaggagatcgagaccatcctggctaacatggtgaaaccccatctctactaaaaatacaaaaaaaaatagccgggtgtggtggcaggcacctgtactcccagctactcgggaggctgaggcaggagaatggcgtgaacctgggaggcggagcttgcagtgagctgagatcgcgccactgcactccagcctgggcaacagagcaagactccat

SEQ ID NO: 202677 - DNA, 601 bp, Human
cccatagctgacatcacacttaataggaaacttgaaagcttttcttctaacatcaggaaaaagacagggatgtccactgacagcacttctattcatcatcatactgaagattctagccaggtcaattaggtaagaaaaagaaataataggcttccagtttggaaaggaagaattaaaattgtctctattcactgatgacatggaccttgtacagagaaaatcctaaggtatcaacaacaaaaattattagggctgataaatgagttgggcaaggttgcaagataacatacaaaatcaatcrtgttttgttcaacaaaaattatggaaggccattgttttggactgagctcccatactaggccccaacagaccagaccaaaccaaaatggaatcacctgctaaatgccatataatcaaactaaaactttaagaaagcaggtacatccccaaacagaccagtttttcctgaaaataggagattctactccacctgagtccatgtaatatggaagatgcctctgttttaacccttgccaaaaaaagtaacctgatgttaaccgattttttttcccctatgttctctttcctttttcccacctta

SEQ ID NO: 202678 - DNA, 601 bp, Human
aggacagagaagctgtctgtcagttagtctagagacaaagccaagtatcagtcaggacaggcctcaagtaaggtaagcagagcaagtgctgatcagtctattcaaagcaccttttcccataaccaaggggcacatgaatctgctcatttctcatggctactccacacgacccagttcttgttcagggtctacatcctatttggacactgacttcacaaccaagggggaaacctgggaaattcacacatcatggtaaaagcagccctaccagtagtctccaggcataattagattgcactgkactcttcaacacatggccatcttctaagtccttgctactcaaactgtggtccccaaaccagcaatatcagtaccacctgggagattatttgacacaaagaacctcaggtgccacccgggatctgaattttaacatgatcctcaggtaattcacatgtactttaaagtctgagaaagtgcagccctagaccacagccacagcttttactattttctttattccaaggcagaagaaacatctatgtcatcaggtaaaattttacaaaacttctacatgatgagagaaaaaaggaaaaaaaaa

SEQ ID NO: 202679 - DNA, 601 bp, Human
tctatattcctctggtgcctggtaaaatatggcacatatagaagatactcaataaataccttttcactgattgatagggaaaaggttggggatatctctgatctatagtttgtcgactatgttaaaaaatacatgatgtcaatttatatccattgcaagtgtttagagatcaataaatttctatggcagtgggtaggggtattatctaatggaaagaaaatctacctagatgatggattttataattatagtcaatacagtgctttatactttccaaagcacaatagcatatcatattgtcttattcgatcctcacaagagctctatgaaagtaggcactattatctgaatgttacagatgaggaaacaggcttcccgagtttgagacttgcctggggtttcatgccaggtgtgtttgttcattcattcattctttccataagaacttgtgagtctgctatgtgcaaggaagtaggtgagagggaactcaggtctagtgacccctgaggtgatttttagaagctatctataagatggaagtatggcttgggaagttaaaagttagttcctgataagtgaggtaggaagttagaaaacacac

SEQ ID NO: 202680 - DNA, 601 bp, Human
aaggccctcaccagatgacagcaaatctgctggcaccttgatcttgaacttcccaggctccagaattgtgagaaataaatttctgttgtttacaagccactcagttaatggtattttgttatagcagcccaaataaactaagtctcattgacaatcactgcaaagaaaatgaaatacttagttataagcttaacaaaacatgcagaagagctgtacactgaaaactataaaacacaatggaaaaaatgatatactgtatttgtggactagaagacttaacagaataaatatattaacaatyttgacaaagaaaattaaagtggaaggaatggaattgcgctacctaatttcaacagttactatatagctacagccatcaagacagtgtggtatgatgcagagatggacatatagattaatgtaacagaacagagaattcagacatagactcacacaaatatccccaactgattttttcttttgcatttaaaaaaataagtcttactaagatataattcacatacaataaaatttacccttttaagttatataattcagtggtttttagtatatttgaatatatgtgcagcctttactactg

SEQ ID NO: 202681 - DNA, 601 bp, Human
cttgggtatatacctaggagtggatttgctgggtcatgtggtagctctatgtttaacaatttgagtagcaaccatactgctttccaaagtggctataccattttacacacacacgagcagtgtatgaggggaccaatttatgtatatcctcacaaacagttgttattatctgtcttttcttataatagtcatcctattgggtatgaggtggtatctcattgtggttttgatttgaattttcctaatgattaatgatgttgagaatattttcaggagcttgttgtccatttatgtatcttcytcgaagaaatgtctattcaaacgattttcccatttttacattggtttgtcttttcattgctgagctgtaattattttttttataaattacccagtctcagatatttattcatagcaatgcgagaacagcctaatacagcaagtgtcactcagatctactttctgtacaagagttctgggagaggctccttcgggacgctgatgggactctcttcctggggatgacttgtaaaaggagggttggtaggatgaactacagcccccctgcagctgcagctggtcttgcggctatagctgatat

SEQ ID NO: 202682 - DNA, 601 bp, Human
gttaagtataggtctatgatccattttgagttttgtacgtggtataaagtaggtgtttaactctactcttttgaatgtggatgtctagtagtccagcatgccccactgatgttcggcaaaggggaaaagcagttcaatggagaaatgagagttgtccaacaaattgggtcagagcaattgttcactcatattttcaaaaagaacctcaacataaacctcttcccttatagaaaaattaactcaaaatggatcatagaactaaaggcatatcttacaactataaaagttgtggaggaaaacmtaggagaacatcttcatgaccttgggctagctgaagagttcctggacatgacagaaaaagcacaatctatgaaaaaatggatagttttataaacatgataattttgactttctcaaaagtaaaagtttgctccagtaaagacatcattaagagaatgaaaagacaagatacagactggaagaaaatatttgcaagccatatatctaacaaagggattgtatctagaatatatatgtatattctatattatattacatatatataataaaaatgggcaaaggatctgaaaaacacttcatc

SEQ ID NO: 202683 - DNA, 601 bp, Human; identical to SEQ ID NO: 24110

SEQ ID NO: 202684 - DNA, 601 bp, Human; identical to SEQ ID NO: 24111

SEQ ID NO: 202685 - DNA, 601 bp, Human; identical to SEQ ID NO: 112541

SEQ ID NO: 202686 - DNA, 601 bp, Human; identical to SEQ ID NO: 112542

SEQ ID NO: 202687 - DNA, 601 bp, Human; identical to SEQ ID NO: 112543

SEQ ID NO: 202688 - DNA, 601 bp, Human; identical to SEQ ID NO: 112544

SEQ ID NO: 202689 - DNA, 601 bp, Human; identical to SEQ ID NO: 112545

SEQ ID NO: 202690 - DNA, 601 bp, Human
aggggggaagatgttgtccacgatgcagatgaggatgttgggctggcccagctccacccgagacttggggagcacggtcacccgtggaggcactaggaggaacgggccctgagtccacaggctcatccctcaccccagggccttactaggactgggattaagggacgttccccctttgtagccatctgtgggcaggggatgctctggggtatccactggggcaggagaggagggaaacagagggagaggagactggggagggagtggggacgccaggagctcctatatttgactggtcccygggcgggagtccgggtgagaggtgtcattcctcaaggagaggggtgccaaaggggtctgggaagacctggagcctcctgggaaagaaaggaacagggcatgacaggcgcgggcgctgagagcgcgccccagagtgatgggagcctaggaactgggaggaagtttctctggaccttcccgcctgactgggtgggcagagggagggccggtaccgttgatggctctgctgcggttggagcgctccaccaggatgtccagatgggctttgattgcggcgatgccggccagcccgccctgcggg

SEQ ID NO: 202691 - DNA, 601 bp, Human
agaagctggtctgggccactccctcagtgacagtttggccgttgcgtagccaggtgatattgatcacaggggggaagatgttgtccacgatgcagatgaggatgttgggctggcccagctccacccgagacttggggagcacggtcacccgtggaggcactaggaggaacgggccctgagtccacaggctcatccctcaccccagggccttactaggactgggattaagggacgttccccctttgtagccatctgtgggcaggggatgctctggggtatccactggggcaggagaggaggraaacagagggagaggagactggggagggagtggggacgccaggagctcctatatttgactggtccctgggcgggagtccgggtgagaggtgtcattcctcaaggagaggggtgccaaaggggtctgggaagacctggagcctcctgggaaagaaaggaacagggcatgacaggcgcgggcgctgagagcgcgccccagagtgatgggagcctaggaactgggaggaagtttctctggaccttcccgcctgactgggtgggcagagggagggccggtaccgttgatggctctgctgcggtt

SEQ ID NO: 202692 - DNA, 601 bp, Human
tccgtaccccaatgcctgaggagtggcgcatccaggccccagtgctccacctggcagtcatagacgtcctcggctgagggcacgaagggcaggtagtggaacttgcggaacaaatggtcaggctgggaatagaagctggtctgggccactccctcagtgacagtttggccgttgcgtagccaggtgatattgatcacaggggggaagatgttgtccacgatgcagatgaggatgttgggctggcccagctccacccgagacttggggagcacggtcacccgtggaggcactaggaggaacrggccctgagtccacaggctcatccctcaccccagggccttactaggactgggattaagggacgttccccctttgtagccatctgtgggcaggggatgctctggggtatccactggggcaggagaggagggaaacagagggagaggagactggggagggagtggggacgccaggagctcctatatttgactggtccctgggcgggagtccgggtgagaggtgtcattcctcaaggagaggggtgccaaaggggtctgggaagacctggagcctcctgggaaagaaaggaacagggcatgac

SEQ ID NO: 202693 - DNA, 601 bp, Human
ccatggcatctggtggtggaataggcacctggagctctaggagagaaaggaaggagtcggtggtatatgaaaggattctagagtaaaggaaacctggggccaggagggtgcatggggagggggctccgtaccccaatgcctgaggagtggcgcatccaggccccagtgctccacctggcagtcatagacgtcctcggctgagggcacgaagggcaggtagtggaacttgcggaacaaatggtcaggctgggaatagaagctggtctgggccactccctcagtgacagtttggccgttgcgyagccaggtgatattgatcacaggggggaagatgttgtccacgatgcagatgaggatgttgggctggcccagctccacccgagacttggggagcacggtcacccgtggaggcactaggaggaacgggccctgagtccacaggctcatccctcaccccagggccttactaggactgggattaagggacgttccccctttgtagccatctgtgggcaggggatgctctggggtatccactggggcaggagaggagggaaacagagggagaggagactggggagggagtggggacgccaggagc

SEQ ID NO: 202694 - DNA, 601 bp, Human
caccccacctctgcttcttttctccctgcccatttcttttctgacttctttccccacaacagaatctctgattctccacccacgtcctgttcagagtcatccactttcctcccccaccccccagactcccggggcctctgcacctggggacactggacacatatgtgcccatgatgatgaggacggtgcccacgaggaagcccaccaggccgatggccaggcccagggcacagaccagggtctccatggcatctggtggtggaataggcacctggagctctaggagagaaaggaaggagtyggtggtatatgaaaggattctagagtaaaggaaacctggggccaggagggtgcatggggagggggctccgtaccccaatgcctgaggagtggcgcatccaggccccagtgctccacctggcagtcatagacgtcctcggctgagggcacgaagggcaggtagtggaacttgcggaacaaatggtcaggctgggaatagaagctggtctgggccactccctcagtgacagtttggccgttgcgtagccaggtgatattgatcacaggggggaagatgttgtccacgatgcagatgaggatg

SEQ ID NO: 202695 - DNA, 601 bp, Human
acatacgatcgaggttgctcaatttcaatatgctgggatcctatctctgagtgcccacctcccccaaaacctcactctctcaccccacctctgcttcttttctccctgcccatttcttttctgacttctttccccacaacagaatctctgattctccacccacgtcctgttcagagtcatccactttcctcccccaccccccagactcccggggcctctgcacctggggacactggacacatatgtgcccatgatgatgaggacggtgcccacgaggaagcccaccaggccgatggccagrcccagggcacagaccagggtctccatggcatctggtggtggaataggcacctggagctctaggagagaaaggaaggagtcggtggtatatgaaaggattctagagtaaaggaaacctggggccaggagggtgcatggggagggggctccgtaccccaatgcctgaggagtggcgcatccaggccccagtgctccacctggcagtcatagacgtcctcggctgagggcacgaagggcaggtagtggaacttgcggaacaaatggtcaggctgggaatagaagctggtctgggccactccct

SEQ ID NO: 202696 - DNA, 601 bp, Human
acgcaggggctgtcacaaacccatgaggatctgcagggtgtctcccacaagtcatttctctcagaaggatcattacctaaaatagcagaaaacatacgatcgaggttgctcaatttcaatatgctgggatcctatctctgagtgcccacctcccccaaaacctcactctctcaccccacctctgcttcttttctccctgcccatttcttttctgacttctttccccacaacagaatctctgattctccacccacgtcctgttcagagtcatccactttcctcccccaccccccagactccyggggcctctgcacctggggacactggacacatatgtgcccatgatgatgaggacggtgcccacgaggaagcccaccaggccgatggccaggcccagggcacagaccagggtctccatggcatctggtggtggaataggcacctggagctctaggagagaaaggaaggagtcggtggtatatgaaaggattctagagtaaaggaaacctggggccaggagggtgcatggggagggggctccgtaccccaatgcctgaggagtggcgcatccaggccccagtgctccacctggcagtcatag

SEQ ID NO: 202697 - DNA, 601 bp, Human
actgttgttagctgagggggtcgtgaggaacaggataatctgcatccctttcagggtaaacctgaactcaggaggcaaatttcatgaagtccatgtgaaatggctcattcacaaagtaacacacaatgggccaaatggagcaagacacacctgtgtgggccccaggacggctgccaatccccagcaccacatgcctcacccctggaagaactggccaaggcctggaaaggacacagtgcaaacaccaccaaagcatttagtgctgccagccagagctttgggtagagcaagaatgtgtgtktgtgttgaatgggaagggaagctagtaggtgtccaacaaaccctgccatgaatactggggccaaaaaagaggggacccgtaggacagatgttgatcccactcaaagtcagcacagcgggatgcacttaaagggcactgagcacgcaggggctgtcacaaacccatgaggatctgcagggtgtctcccacaagtcatttctctcagaaggatcattacctaaaatagcagaaaacatacgatcgaggttgctcaatttcaatatgctgggatcctatctctgagtgcccacctcccccaaa

SEQ ID NO: 202698 - DNA, 601 bp, Human
tctcccctcactgccaaatgagcagtggcaagtaggaagtagaagtggaaacaagggataagagttagacctgaattttagtcccaggtctactattaactctgtgtgactttgcataagtcgtttgcattttctgtgacttggtttcctcatttgaaccgaggatctttaaggctccttccaactcaatagtagaataaatgtagctttatcttccctcacttcttcttgattcttttcttgacctggaaaagtcagcttaaacttctcagtcaaattatctcttggtacaaatttaccyccctggctgctgagatatgtatttacctcttgatcggaaattccataactgaaacttttattttcaaccatctgtatgtgttccttgctgcttctctcctgccttgcccctggccatgctaaccactgccctcctcgattttttccaatgttcagtaaattggaagagctcacttctgatgaaatggggggtgagagtggaggattgtggaccaaaaaaaaaaaaatagactgaccttgtttcccaagatcatagtcaattactctgtgttgggtctacaccacatctgcacatactatg

SEQ ID NO: 202699 - DNA, 601 bp, Human
ctgagatatgtatttacctcttgatcggaaattccataactgaaacttttattttcaaccatctgtatgtgttccttgctgcttctctcctgccttgcccctggccatgctaaccactgccctcctcgattttttccaatgttcagtaaattggaagagctcacttctgatgaaatggggggtgagagtggaggattgtggaccaaaaaaaaaaaaatagactgaccttgtttcccaagatcatagtcaattactctgtgttgggtctacaccacatctgcacatactatgagcccttccrttggagataattttcacttgcggagctgcttcacttctacctgtaggagcctcatctccacctctctacagtggagaggattccactaggcaagttggaacttagggacacagttctttctgtgttgtatcacagctgggctgtggcattcccctgcagccggatgaagcaatagagaaagtggaaagatgaagggaaaaaaagcctgtactgacagtcagctctggcctgttactgtgtaatctttgagccagtcacttcgcctctctgggaatgtttcttcttctctaacatgagggc

SEQ ID NO: 202700 - DNA, 601 bp, Human
ctctcctctgggcttccccactctcctgcagaggaagatggaagtcctatgtcattctagcaatgagttccaaggacactacctctgaaagcatagtactttggggatatgagataccagggcttcattgcagggtgcagagaccacttaatgtctcagtgggaaggaagggcttgatgattctttaacctgaggatccctttcccaggtatatggaaccctgggaggaatgctgactcgacagccttttgccattggtggctccggcagcacctttatctatggttatgtggatgcagcrtataagccaggcatgtctcccgaggagtgcaggcgcttcaccacagacggtaaccagccaagtggaagggtacctggggagggctttgaaacatgggaaggaagtagattatgaggaacaggaagagaaatacaggggtggccatttaagttaatgccgggcctggtacacttttaagagtgaaaaggggcaggacaaatgcaaagctcaatggggttcttgggcaatacggataaaccagggctgttctgagtaaatcaaatgaggatacacagtcactgtgagaaccagtggtgtgct

SEQ ID NO: 202701 - DNA, 601 bp, Human
accctgggaggaatgctgactcgacagccttttgccattggtggctccggcagcacctttatctatggttatgtggatgcagcatataagccaggcatgtctcccgaggagtgcaggcgcttcaccacagacggtaaccagccaagtggaagggtacctggggagggctttgaaacatgggaaggaagtagattatgaggaacaggaagagaaatacaggggtggccatttaagttaatgccgggcctggtacacttttaagagtgaaaaggggcaggacaaatgcaaagctcaatggggytcttgggcaatacggataaaccagggctgttctgagtaaatcaaatgaggatacacagtcactgtgagaaccagtggtgtgctaagcacagtggctcacacctgtaatgccaacaatttgggaggctgaggcaggaggattacttgagcccaggagtttgaggccagcctaggcaagatggtgaaaccctgtctccacaaaaaacaataaaaaaaagtaaaaaaaaaaatgaactgggcatagtggtgcacacctgtagtcccagctactcaggaggctgaggtggaaagatcatctgag

SEQ ID NO: 202702 - DNA, 601 bp, Human
ccgaggagtgcaggcgcttcaccacagacggtaaccagccaagtggaagggtacctggggagggctttgaaacatgggaaggaagtagattatgaggaacaggaagagaaatacaggggtggccatttaagttaatgccgggcctggtacacttttaagagtgaaaaggggcaggacaaatgcaaagctcaatggggttcttgggcaatacggataaaccagggctgttctgagtaaatcaaatgaggatacacagtcactgtgagaaccagtggtgtgctaagcacagtggctcacacckgtaatgccaacaatttgggaggctgaggcaggaggattacttgagcccaggagtttgaggccagcctaggcaagatggtgaaaccctgtctccacaaaaaacaataaaaaaaagtaaaaaaaaaaatgaactgggcatagtggtgcacacctgtagtcccagctactcaggaggctgaggtggaaagatcatctgagccggggagatcaaggctgtagtgagcggtgattgcaccactgcgctgcagcctaggtgacagagagagaccctgtctggagaaaaaaaaaaaaaaaaagaacc

SEQ ID NO: 202703 - DNA, 601 bp, Human
ttaagttaatgccgggcctggtacacttttaagagtgaaaaggggcaggacaaatgcaaagctcaatggggttcttgggcaatacggataaaccagggctgttctgagtaaatcaaatgaggatacacagtcactgtgagaaccagtggtgtgctaagcacagtggctcacacctgtaatgccaacaatttgggaggctgaggcaggaggattacttgagcccaggagtttgaggccagcctaggcaagatggtgaaaccctgtctccacaaaaaacaataaaaaaaagtaaaaaaaaaaatgaactgggcatagtggtgcacacctgtagtcccagctactcaggaggctgaggtggaaagatcatctgagccggggagatcaaggctgtagtgagcggtgattgcaccactgcgctgcagcctaggtgacagagagagaccctgtctggagaaaaaaaaaaaaaaaaagaaccagtggtgtgctgaggtgtgctgaggctggcttgggaccactcatgagagcggactgttaaatagtcaaggatttgtgaactgcttagctatttgtaacttgcaattcatcatagcgggagcattta

SEQ ID NO: 202704 - DNA, 601 bp, Human
cctgctgacgtcccacaggctggacccctggaagatgcaggaagcctggaagctggtgggtggctctgacggggaaaggactgcgcccttttgctcctggttccagggagtcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccargggcctggcccgccagcccaaaagatggtcatcgggaagagaaaaagaaaaaaatgctgcagttgttctctcaagctagggcagaagaggggtgtcaagctcctcaataaacttgtctccacttcttcgagtgcagtgtggtcttcaccaggacccccagaacaccacaaacctggagagcccagaggctgccagaccctgctgcatgggaaggacatctccagggacatgggagagaggacagcctctctgaggaggaaggcccctaaaaggcaaagctaaggccacagcagccacaag

SEQ ID NO: 202705 - DNA, 601 bp, Human
gagccgaactgccattcttggagggtctggctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtatgcttgtctttggggaaaatgggaccaagaggtcctggataaccttggacagacaaggtttgcasagagagaagttggcaagtgcaggctcctgggcgtgttcatgtctgcatccagcctggaggggactcaggcagagagccctaagctggagtgtccaggctctgaggatcactgaggattcagtgctcacgaagaatgcctcttattccccagggtggagcaggagcccacatcccttggacaattaaggagagaagggagggagggggataggttttagcccctgaaggcattctcattaaaggtacttctcccagcctccccagaacttggttagggtactagagtgggttgcgacttgt

SEQ ID NO: 202706 - DNA, 601 bp, Human
aattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtatgcttgtctttggggaaaatgggaccaagaggtcctggataaccttggacagacaaggtttgcagagagagaagttggcaagtgcaggctcctgggcgtgttcaygtctgcatccagcctggaggggactcaggcagagagccctaagctggagtgtccaggctctgaggatcactgaggattcagtgctcacgaagaatgcctcttattccccagggtggagcaggagcccacatcccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacaggga

SEQ ID NO: 202707 - DNA, 601 bp, Human
attcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtatgcttgtctttggggaaaatgggaccaagaggtcctggataaccttggacagacaaggtttgcagagagagaagttggcaagtgcaggctcctgggcgtgttcatrtctgcatccagcctggaggggactcaggcagagagccctaagctggagtgtccaggctctgaggatcactgaggattcagtgctcacgaagaatgcctcttattccccagggtggagcaggagcccacatcccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggat

SEQ ID NO: 202708 - DNA, 601 bp, Human
actggcctattctctctccaaggacatgggtacagtaaacagagagaggtgcccagtggtcagtatgcttgtctttggggaaaatgggaccaagaggtcctggataaccttggacagacaaggtttgcagagagagaagttggcaagtgcaggctcctgggcgtgttcatgtctgcatccagcctggaggggactcaggcagagagccctaagctggagtgtccaggctctgaggatcactgaggattcagtgctcacgaagaatgcctcttattccccagggtggagcaggagcccacaycccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggattgagtgtaggttatcagacagccaaggaagcagtaaccaagtgaaaaatctcttcttcctgctgcctccctgtggctggtgtaatattatggcatctatgatccattgtttttctctcaggatactctca

SEQ ID NO: 202709 - DNA, 601 bp, Human
gaggaattgccacactgtcttgagataccatctcacaccagttaaaatggcgatcattaaaaagtcaggaaacaacaggtgctggagaggatgtggagaaataggaacacttttactctgttggtgggactgtaaactagttcaaccattgtactctcaggacatttctagtccaaatttacaccaacactctgagaggaaggactgcaaagtaggtaccttagttttccactgacttccacttttcctgcttacacccttcctcctagacctctccacacccctcctaggacacacctaraaggtactgacatcatgtcacctcctcatctttcagggtagcaaggttggaatctcctgaatacagcccctcaagccctaaaacctcttatctattaccttgggttcattgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggaagtgacggatgcagcgcccccatcccataggcagag

SEQ ID NO: 202710 - DNA, 601 bp, Human
ttcaaccattgtactctcaggacatttctagtccaaatttacaccaacactctgagaggaaggactgcaaagtaggtaccttagttttccactgacttccacttttcctgcttacacccttcctcctagacctctccacacccctcctaggacacacctaaaaggtactgacatcatgtcacctcctcatctttcagggtagcaaggttggaatctcctgaatacagcccctcaagccctaaaacctcttatctattaccttgggttcattgtccaggaaggggaggagaacttgaacttrtagtcacagaagggtgctgagaactaaccagcaggacggctcagccctgggaactgcagaggggtgaggctggggagagaggaggctggagcagcactggtgacactgaacagtgtcaggaggaagtgacggatgcagcgcccccatcccataggcagagctgtcatgtgggatgagggacagtgttgggagccaccaaggaaacccagaggtgggggagcagagagcagaagggggcatgtgatgctgggcagtgaaagggaggacaggcaaaggctgggttgaggtttgtagggggaa

SEQ ID NO: 202711 - DNA, 601 bp, Human
ctagacctctccacacccctcctaggacacacctaaaaggtactgacatcatgtcacctcctcatctttcagggtagcaaggttggaatctcctgaatacagcccctcaagccctaaaacctcttatctattaccttgggttcattgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggargtgacggatgcagcgcccccatcccataggcagagctgtcatgtgggatgagggacagtgttgggagccaccaaggaaacccagaggtgggggagcagagagcagaagggggcatgtgatgctgggcagtgaaagggaggacaggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaag

SEQ ID NO: 202712 - DNA, 601 bp, Human
acacccctcctaggacacacctaaaaggtactgacatcatgtcacctcctcatctttcagggtagcaaggttggaatctcctgaatacagcccctcaagccctaaaacctcttatctattaccttgggttcattgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggaagtgacggatgcrgcgcccccatcccataggcagagctgtcatgtgggatgagggacagtgttgggagccaccaaggaaacccagaggtgggggagcagagagcagaagggggcatgtgatgctgggcagtgaaagggaggacaggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctg

SEQ ID NO: 202713 - DNA, 601 bp, Human
cccctcctaggacacacctaaaaggtactgacatcatgtcacctcctcatctttcagggtagcaaggttggaatctcctgaatacagcccctcaagccctaaaacctcttatctattaccttgggttcattgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggaagtgacggatgcagcrcccccatcccataggcagagctgtcatgtgggatgagggacagtgttgggagccaccaaggaaacccagaggtgggggagcagagagcagaagggggcatgtgatgctgggcagtgaaagggaggacaggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctgatt

SEQ ID NO: 202714 - DNA, 601 bp, Human
ccctcctaggacacacctaaaaggtactgacatcatgtcacctcctcatctttcagggtagcaaggttggaatctcctgaatacagcccctcaagccctaaaacctcttatctattaccttgggttcattgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggaagtgacggatgcagcgyccccatcccataggcagagctgtcatgtgggatgagggacagtgttgggagccaccaaggaaacccagaggtgggggagcagagagcagaagggggcatgtgatgctgggcagtgaaagggaggacaggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctgattc

SEQ ID NO: 202715 - DNA, 601 bp, Human
attgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggaagtgacggatgcagcgcccccatcccataggcagagctgtcatgtgggatgagggacagtgttgggagccaccaaggaaacccagaggtgggggagcagagagcagaagggggcatgtgatgctgggcagtgaaagggaggacrggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaa

SEQ ID NO: 202716 - DNA, 601 bp, Human
gagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgttgcaaagaaaaaattcaaaattcttattcttgaatgaaaaacgttctcttactggtgattgaggaggagaaacaaagactaacaaatgaaaatgggagaatccacactcagagtggggcaattgaacaggcaggggcggatggatggcagaggaggaggaatctggactcaa

SEQ ID NO: 202717 - DNA, 601 bp, Human
tctcctccttgaattatctccatatttcaccctccgatgagtctcctcaaactggggctttaggttgaagatattttacccaagtcccctccctttcaccccaccctaattttccccattctctcggtgacccgtaactgatcaaaagtccccccgcaccgcgctacgctctcgcgattcctcttagatcccaaccgtgggtccggccggtccgctagatgcgcttcccgccaaatccccctcccccagttcagcccccggccgctccactccctttcagggacaggaaggtaccacagcwttcccctcagactcagcgcccagctctccccaatacctctccctctatatccccgcccccgcctctgatccccgcaccgtccggcccccacctcagaaaccgtctctcgaggcgaccctcgccgcaattctcagaacctcgcatggttccctccgccttccttcccactcccaccgcaggccccactacggaccggaagtcacagagtttccgccttcatgcaactaagcgccgccatattgtcgtacggaacacaggcttcctgtggccggaggtgacagtaggcccgccccgcgaaca

SEQ ID NO: 202718 - DNA, 601 bp, Human
cacactcctgtgggcgccacctcatgtgtttgccccctctgctctcaaacaagtcaaccccacacccaccctatcctgaatgatcaccccaactcctagactctctgaggtgaaagaggttccctcccaacagtccgttctcttttctcctccttgaattatctccatatttcaccctccgatgagtctcctcaaactggggctttaggttgaagatattttacccaagtcccctccctttcaccccaccctaattttccccattctctcggtgacccgtaactgatcaaaagtccccccrcaccgcgctacgctctcgcgattcctcttagatcccaaccgtgggtccggccggtccgctagatgcgcttcccgccaaatccccctcccccagttcagcccccggccgctccactccctttcagggacaggaaggtaccacagctttcccctcagactcagcgcccagctctccccaatacctctccctctatatccccgcccccgcctctgatccccgcaccgtccggcccccacctcagaaaccgtctctcgaggcgaccctcgccgcaattctcagaacctcgcatggttccctccg

SEQ ID NO: 202719 - DNA, 601 bp, Human
cttctgctccacccctcacgtcgatttccggtctttctgttgcatttcccccctatttcttagagttggcaagttgattcttcctcccacactgcaccccaaatcgtcctgacacccccttgcacagacaacacactcctgtgggcgccacctcatgtgtttgccccctctgctctcaaacaagtcaaccccacacccaccctatcctgaatgatcaccccaactcctagactctctgaggtgaaagaggttccctcccaacagtccgttctcttttctcctccttgaattatctccatakttcaccctccgatgagtctcctcaaactggggctttaggttgaagatattttacccaagtcccctccctttcaccccaccctaattttccccattctctcggtgacccgtaactgatcaaaagtccccccgcaccgcgctacgctctcgcgattcctcttagatcccaaccgtgggtccggccggtccgctagatgcgcttcccgccaaatccccctcccccagttcagcccccggccgctccactccctttcagggacaggaaggtaccacagctttcccctcagactcagcgcccagc

SEQ ID NO: 202720 - DNA, 601 bp, Human
taggggatcaaatcccccggagggaggaagtggtggggatttcagaattcctgctggaaggggatggggcctcagaatgagcccctccagcatagccccatcccttcacctcacacattttctgaactccttgggtttcagtaacatccagccctgaccaacactgtcttcaccacctgatttcaataaccattagttctatatgctttttggggcccttcaagtggtgtggggggggggcaaaccacccccacaccttaagttgccaccttctgctccacccctcacgtcgatttccggyctttctgttgcatttcccccctatttcttagagttggcaagttgattcttcctcccacactgcaccccaaatcgtcctgacacccccttgcacagacaacacactcctgtgggcgccacctcatgtgtttgccccctctgctctcaaacaagtcaaccccacacccaccctatcctgaatgatcaccccaactcctagactctctgaggtgaaagaggttccctcccaacagtccgttctcttttctcctccttgaattatctccatatttcaccctccgatgagtctcctcaaactggg

SEQ ID NO: 202721 - DNA, 601 bp, Human
ggcacccctgggatgccattccactagggccctgggagacaaagaagtttctctaaggaatcccttgccccagagggtttggttcttgctttccttctcatgctcccccatcagtcaacctggactccctggtggccagtgcaggggaaggacaatgtctctctgaaggctgtaccccatccacacctcaccagaatccaaggaggcttcgggggtgtctgcagagtgggaagaggtgccttggagccgagctcttctcttttttctctcgccctcctcacttttgtcttgcaacattgcrtatttggagatgacctcatccagccgactcatggccaaactccggttttcccgaaggcgccgggccaacacaggatctgatagtgcagggtcaacgcctacgtgggaagacataaagtcagagcactcagcccttgaagggactagaagagtaaaaaccctagaaaggactagagagatgccccatccgcctcatacctgacatataagggtcactgagaggcatcccaccaaccccctacctggcctatagtcatctgtgaggtggcagccaaagttgtagatgagatcgaggtgacgt

SEQ ID NO: 202722 - DNA, 601 bp, Human
tcccttgacatacctgctgctgcttcttcctcttcgtcctcctcttcatcatcctcctgaccctcctgcatctgttccagatcctcctcctcttcagaatctgtggcctcctcctcttcttcttcctcctcctcctcctcttcctcatcactctcctcatcgtcttcgtcatctgtctcagctctggaggcagaagggcacccctgggatgccattccactagggccctgggagacaaagaagtttctctaaggaatcccttgccccagagggtttggttcttgctttccttctcatgctmccccatcagtcaacctggactccctggtggccagtgcaggggaaggacaatgtctctctgaaggctgtaccccatccacacctcaccagaatccaaggaggcttcgggggtgtctgcagagtgggaagaggtgccttggagccgagctcttctcttttttctctcgccctcctcacttttgtcttgcaacattgcatatttggagatgacctcatccagccgactcatggccaaactccggttttcccgaaggcgccgggccaacacaggatctgatagtgcagggtcaacgcctacgtg

SEQ ID NO: 202723 - DNA, 601 bp, Human
cgggaggctgaggcattatcgcttgagactgggaggtccaggctgcagtgagctgtgatctcaccactgcaccctggcctgggcgacacagcgagacaaaaaaaaaaaaaaaaaaaaaaaggccaggctagaaaggacagagcgggactaccccggggatactgggctaaccctgagcaaggggacagctaatgccaatctgtaacagtagaaggacaagaaaaagacagtgatacagtaagaaaagaactttattgtttattaatgtttctgtgtaaaacttaagcttttttttttttttaaagaaacaccaccaaaaggggattagcttagtccatcccttcctcagtcatctgcttcccaccttcctccaaatgttatcccagaacattctggaggcagggagaaggggaggcagctaatcagagtctgagagcacgatgatctcttctggatcgcattgtgtggccacacttgtctgcagggaagtgagagacaaagagtcaaagagatctggagtacaggagaaaagaaacaggaggatttagaggataaaatgggtgggaaaaaggaagagacaggatgtggcacgtggaatatt

SEQ ID NO: 202724 - DNA, 601 bp, Human
tgtgtctgtcgctctgagactgtggtccctgggaaccggctggtcagctgtgagaagtgtcgccatggtgagagggcaggtcacctgaatggtccagcttgctcttccctccaggatggtctctatatcacctgtcctggccttagtccccaagccactgctctggccaggctgcttagccttatcttagtcctcatccgctttcagcccagggagaagcagccatggaaaggggtggtataacctttgcaggcagaagatggtttaaatgcatccttttctaaccatatgacctcggacragtcccttaacctctaggagcctcagttccctgacttgtaaaataaggataatgcaccccctcatcaagaccatggtcagggattaaatgagatgggtaaagactattcctgtcccaataccaagcacacacaggtatgcaataagtggtctactattatcactgcagcttatcaccaggactgccatgttcccagggctccagcccctggagagggagagggcacatcctgggtatgccgccagtgtgtctttgcgatcgccaccaaggtaaaggcacttccctgttacccttcctgtg

SEQ ID NO: 202725 - DNA, 601 bp, Human
tatatgccccaacctcccacctcaggactcccctggctcttaaaatgcctctgtggtcttgaaaactttgtttttccagggtggatgtggcccatcttgtcctgtatcacctcagtgtttgctgtaagaagaaatactttgattttgatcgtgagatcctccccttcacttctgagaattgggacagtttgctcctgggggaggtaaggggtagtgcagttttgggggttgggatgggacagggagatgtagcggaaaggggaagagaagaaatcactgctcccctggccccatttttctycatttctcccagctttcagacacccccaaaggagaacgttcttccaagctcctctctgctcttaacagccacaaggaccggtgagttggagggaagaggaggcaaggatgaggctcggaaagagatggagagtggaagcctggaaggggaggggcttgcaacccacctggaagactgtgactgaaaaggattgaggaatggcgtaaggaggaaccgttttttacagcactgaccctatatcatttctcttcttgccccagtttcatttcagggagagagattaagaagaggaaatgtttg

SEQ ID NO: 202726 - DNA, 601 bp, Human
cctctgtggtcttgaaaactttgtttttccagggtggatgtggcccatcttgtcctgtatcacctcagtgtttgctgtaagaagaaatactttgattttgatcgtgagatcctccccttcacttctgagaattgggacagtttgctcctgggggaggtaaggggtagtgcagttttgggggttgggatgggacagggagatgtagcggaaaggggaagagaagaaatcactgctcccctggccccatttttcttcatttctcccagctttcagacacccccaaaggagaacgttcttccargctcctctctgctcttaacagccacaaggaccggtgagttggagggaagaggaggcaaggatgaggctcggaaagagatggagagtggaagcctggaaggggaggggcttgcaacccacctggaagactgtgactgaaaaggattgaggaatggcgtaaggaggaaccgttttttacagcactgaccctatatcatttctcttcttgccccagtttcatttcagggagagagattaagaagaggaaatgtttgtttggtctccatgctcggatgcctccccctgtggagccccctactgg

SEQ ID NO: 202727 - DNA, 601 bp, Human
gtgttagtcctggggggtatatgtatagagatggggaggtcttgggggtgtccgggagggggctggggggataaggaggcctcttacagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggtactggagcagggggaaccckatggagcaaatggtggggtgtgggaaggagtcaaggattatctctcagtcctttgccccctcttctaggcctcagtgtctccaccatcccccagccctaaccagagttaccagggcagcagcggctacaacttccggcccacagatgcccgctgcctgcccaggtcagtgctcctctgcccctcccccacaaaatatgctcccaattattcacatcttctggactttatcacccagaattcttttccctctcccccttggctacccacttcttggcctagaccgacttctagaactagtg

SEQ ID NO: 202728 - DNA, 601 bp, Human
cctctgagcctctgtcagtggccggagcccctgtagccacctctggatatcatggtcaggttggaggttatagccacgacattcattctggagccgtcgcaactcagaaaggactgcaaactcctgggaaggagccctcaaactgcaggagccaaaactcagggacccctgacttttccccctccccttcctggaacatggatagggaagtccagcatccagcccagacactccgctcaccttcctccgcttgtcaaaattgatgtatccattctgcgaggaaaatggggatggggtgaargttccaaccctaccttccggccacagagagagaatatcccctctcttaaacacacacagccacatccaactcacaaccacttccctccagcctctctgactcttcgatccctccctgccttcctcctcaatctatcatggcctaagcactccacttgaccctttaaattgaatttctcaggtagacaacgagtctgctttgcagatgagaggactggatagtatccaattcgacaggattccttatccagagaggataaggaacttgtccaaggtctcagtatttgtttatttaacaaac

SEQ ID NO: 202729 - DNA, 601 bp, Human
aaagtgaataaacaggccccccctgaaattgtgcaacacagtgaccctgaagggcaggtgtcttgggaaagcagatgggatcaaaagggcagaaaatcagatagatgaaaaggacatcaagaatatcagaattagccgggcgtggtggtaggcacctgtaatcccagctactcaggaggctgaggcaggagaattgcttgaacccaggaggcagaggttgcagtgagctgagattgtgccactgcactccagcctgggcaacagagcaagactccatctcaaaaaaaaaaaaaaaaaaaaacacacacacacacacaaaaacaaagaatattagagttcttttaggggaggaagcatgcactgaaagatcagtcacctcaggaaaggcaaggggtctcataaagaccacaggcctgacaaggttagaggattggaaggtcaatgggccatggggaagttcacacaaggatctggggttacaaggaaaacaagaaaatgaaagtggccaggcagtaagttggtcacaacctctcacctgggggctgctgacaggcccggagaatcctgggggagctggagggggcagaccaggggaccccat

SEQ ID NO: 202730 - DNA, 601 bp, Human
aggggttccacaaatatccttacggcctcatcaggatctcatggcccttgggagatatttataggaattggggaagtcactagaaagggtggactgggggcagccctgaaggaagggttataaaagggcaggtaagtcagtcgggaagggtgaggtaggtaaaagaattagggaggaatttaaatggagagcctactacatggttaaaaaaaacatgccaagattcaacctgagaaagctgattgaaaaaaaaaatttttttaaataaaatatgccaagaaacatgctaagcacattttamcattcactcaattatcataatgatgctggaagcatttattctcatttttaagatgaagaactcggggttcaaagagattagtttgcttaaattcatataatacatggcaggtcatacaactgactctaagtgtgtctgagtgcaaatcttgtgctcttctgactcaacaaataggcagtgaaaggagcactggcctaggtctttgaagatgtgggttctgatcccaaacctgcctgccactcctttgttgcatgaccttgggaaagccaagcctcaggctcatcttctctaaagtgggtg

SEQ ID NO: 202731 - DNA, 601 bp, Human
ttttgagatggagtctcgctctgtcacccaggctggagtgcaatggcgcaatcttggctcactgcaatctcctcctcccaggttcaagcaatcctcctgcctcagcctcccgagtagctgggattacaggccgcgcacacctggctaatttttgtactgttagtagagacagggtttcatcatgttggtcaggctggtctcaaactcctgaccttgtgatcctcccgcctcagcctcccaaagtgctgggattacaggcgtaagccactgcacctggctatttttttttttttttttttttgagacaggtctcactctggagtgcatggctcactgcagccttgacctcctgggctcaagcaatccttccacctcagcatctttagtagctgtgaccacaggcacacatcaacacacacccggctaatttttcattttttgtagagatgaggttgttgcccaggctggtctcaaactcctgagctcaggcaatcctactgccttggactcccaaagtgctgggattatgggtgtgcactaccacgcccagccaaggcttagacattttagaatgaggcgatcctgatttcagttctaccag

SEQ ID NO: 202732 - DNA, 601 bp, Human
gcgatccgcccacctcagcctcctaaagtgctgggattacaggtgtgagccactgcacccggtgttttcggctttagagacaggttgttttgtcacctaggctggattgtaatggtacaatcatagttcactgcagcctcaaacatctgggctcaagtgatgttcccacctcagcctgccaagcaactgggaccatgggtgtgtaccaccatgcctggttaagtttatttttaaattttttgtagagacaaggtcttgccgcattgcccaggctggtctcgaactcctggcctcaagcaaycttcctgccttggtctcccaaagtactgggattgcaggcataagccactgcacctggccacaccaggatctatgatcacaagcctatcacagcagagttcagggctgagcttgggtcaggggtttgagcaccaagatttgggggaccctcagttttcacgtgctattgcctgattgtgggtcagcagtaggggtagtctcagggaccctacgcactgaggatttcatgggggagtaacactgtgacaagtctaagtaacaagttttttttttgagatggagtctcgctctgtcacccagg

SEQ ID NO: 202733 - DNA, 601 bp, Human
gctgggaagtgtctcctgtccgaccctcacctgcagctgtcccagcaattgcatggtccgttcattaggaattgtctggttgatactgacaagagcggaggagaactctgcatagcggcgtgtgatctaggagagagtgggaaggaaaatcacacccacctcctggcccaaccaacacaacctcccaacttccttagccaacccacctccatgtgatgtgactctaccttcagtccctcctacccacagtgcaccactcaccatgagtttcaccaccctcccagaacacctgctcatagcrtggcccatgacacaactgtgaccttggccaacccccacaatgatgcttagagccctgcctttcaagaaccctttgttacccttgccctccctcacatagtggggccgagtatccaacccccctaggcgctgggggtcagtgcttcggacgctctgaacattcatctccaggatcagttcaaaccgtggccatagcaaggcaagcacctgttcccagtacctgtgggcttaatcagaatcagaggtcagccagcaaggaatgttggagggggatgggagggagtggggcatcattcagttt

SEQ ID NO: 202734 - DNA, 601 bp, Human
tggtatagatgaaacaaaactgtccgtgaactgctatacaccgaatatcactgatgatgcctgggggttcactatgcttttctaatagcatagtgaaatttcccataataaaatgttaatttttgtttaatgtaaaagggagattcaaacaaaaaaactcataaaagcaaacaacccagacagaaagatctggtaagaagaaagtgaaattattattccatttaaaaataaattattaatactaaaattagccaggtgtggtggtgcatgcctgtaaccccagctactcagggagactgargcagaagaatcacttgaaccgggaggcagaggttgtagtgagccaagatcatgtcactgcactccagcctgggcgacagagcagcaacttgtctcagtaaataaataaataaataaataaataaaaattgtatcttttctattcttccctcaaaatattcacttatatccactgagggtgtcaaataactaatatgctgcaaggaaggatctttctataatcaaggcatctttgtgatgtgattttggacagagattaaataaccaaattcaacctattacagttgcctaaatgcagtct

SEQ ID NO: 202735 - DNA, 601 bp, Human
gtcagcagatttgcccaattctggcatcatgactaatgtagatccatctgaatggcatctttcagctgctgcaaaagttaaggaaaatcctctatggagaaaaatatcctcaatcctaattttggcccatacagttcccctggttaagatcaaacaatgaactcaaagatcactagacacaaaagaagggcagctaccaagagagtcagcagacacaataagcaatagctgctgaccttaagaactatccgatacggatagcagttgtactgtgtgcaatgtctaaagttaaggataggcygggcacagtggctcacgcctgtaatcccagcactttgggaggctgaggtgggcagatcacctgaggtcaggagttcaagaccagcctggccaacatgatgaaaccccatctctactaaaaatacaaaaattagctgggcatgatggtggatgcctataatcccagctactcgggagactgaggcaagagaatcacttgaacttgggaggcggaggttgcagtgagcagagatcatgccactgcactccagcctggatgacagagcaagactccgtctcaaaaaaaaaaaaaaaaaaaaag

SEQ ID NO: 202736 - DNA, 601 bp, Human
ttctgggtccggtgctagtcaaacaggagctgggggaggctcgggccacagtagggaagaggctggactatatcacagctgaaatgtgagtttttattccaccaccgtgtgctgcaccctgtgatgcaagtgaaccattggagtagaggtgttgaaccattgcagaacagctctccatagtggcccctagtcctccagttcctccaaccctttccttcccttttaaccccccttcttctccctcccctggatctcaagttttccacctatctctttcttgcgtttagcactctccatagtragtcctactaatttctccctttctgcttgtctcccttgtctctccttagtaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctggctctgtttcctgaccaggcacttctgtcatatc

SEQ ID NO: 202737 - DNA, 601 bp, Human
tcagtgagcacagctgaagagcaccgggccctgtgctggccaccagtccagccctgtggccaacatgtcctgggtgtgaatcttggctctgcaattcaccagattcccagcctctctgagcttctgcttccgcatctgttaagggaaggcgctactaaatgtgcctacctcagggtcagttgttcaaatgaaaggagcagctggatgtacagggcttattgcagaacctgacacatagcaggtgctaaagacggccaacttccttattgtgactactttttcctttttaattttggaaagrcaggatatgcacatagtaaaacatttttaactgcatgaaagggtgtgtccctgccccaacaccaggccaccaggcctccttcccagaggcacccattatcccagttctttttggaatcttcgcatatattctaggccttggcagccattgagggggcaacatagtgatctttaacagcaaggaggtgggagaaggggaggctgacggtctcatctacttacctgctgaaatggagactctgcacaagcatgtggccacttggccatgtgcagctgtgtgttctgggtggccacaggatgc

SEQ ID NO: 202738 - DNA, 601 bp, Human
gagtattcacgcagaaaccagcccaggccatgcaccaggcctcttttccccggagaggcaatgataggtcctttactggcacatagtggctgcatgtgcttctgtgtagatgtgggtgtctctgagtacacaggtgtgagcacactctgtccctgagggtgtatacacgaggcgccgcaggctggagccagactgcctgggtttgaatcccagctctaccacttcctagctatagggccttaggcaaagttacttaacctctctgtgcctcagtttcctcatctataatttttttttttttgagactgagtctcattctgttgcccaagctagagtgcagttgtgcgatctcagctcactgtaacctccctctccaaggttcaagcgattctcttgccttagcctcctgagtagctgggattacaggcgtgcaccaccatgcccggctaatttttgtatttttagtagaataggggctttgtcatgttggccaggctggtctcaaactcctgacctcaagtgactcacccacctcagcctcccaaagtgctgggattataggcgtgagccatcgtgcctggccctcatctataaattagat

SEQ ID NO: 202739 - DNA, 601 bp, Human
ctcctgggcctgtgcctcttcaagaatgtaacgctgccatccacaagaaatgcatcgacaagatcatcggcagatgcactggcaccgcggccaacagccgggacactatagtgagcctgggtccggggcagggctggggatctggggggcttggccagatgggagggatttgcaccctctccccaccctccctggggagcttaccctccctccccatttttcttagtctttccttgcctctcccagtggagctctcttgggatgttgttgtgcccagggttgggggagagctaggggttgragaagaggctggagctggcacgtgaccctcagcctgtgatacccccacctccagttccagaaagaacgcttcaacatcgacatgccgcaccgcttcaaggttcacaactacatgagccccaccttctgtgaccactgcggcagcctgctctggggactggtgaagcagggattaaagtgtgaaggtgcgtgccaccccgcccctgggctgcaggaggggcactcccagctggtgctgctgtgaattccagccacctcacgccaccctcgcctcctcacctggagacgggcacctcattca

SEQ ID NO: 202740 - DNA, 601 bp, Human
caggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggtgcccgggcctcctgccgtcaccaccccatgccacagccatgtcccacagctcctcagcccccctcagtcagggctgtgtctccccctcaggccacttaaggcagggccatgctttccccccstcatgcctcccagggcagagtcgtccacctcagccagggcctgtccctgctgtttcctgttggggcttggccccagtggccctcagtgagggagcctcctgcctattcctcacccctgctcaccacccttcccaccccaggaccacctgttctttgtgatggagttcctcaacgggggggacctgatgtaccacatccaggacaaaggccgctttgaactctaccgtgccacgtacgtaagggccatggtggggaagggcccagtgtggaggaagggctactggctcagagcccacttcc

SEQ ID NO: 202741 - DNA, 601 bp, Human
atacaagatgtacttgatcatgctcaggtggtccatggagttatttgcagcatttcttgctcctggaagtggggttgagggcccgaggagaagcagaggctgctcggcagagatcccggaacactttatccctctctcttgcccaggttttatgccgctgagataatgtgtggactgcagtttctacacagcaagggcatcatttacaggtgcgggggtgagggcagcgggggctcttgggaggggaggctccagccccatcatatcttctgaaatgctccaagcaggatccccccaactycagttccttctctgctggaaatcaatctttagctgggtatttgcctatgcctcccaccctggtgttagcattcctgtggccaccatttgaggctggctcagcttcaggaactaggaactcactgctcatatttgacaccatcgccccacccatccttggagccgtcagtctcgctctgaagccccatcgagtcatctaagcttctgccagaagggactccttccataaagtctcatctaataagttatgattccatcctatggtgggaactgtacacccaccaaaaaggctgaggtcagg

SEQ ID NO: 202742 - DNA, 601 bp, Human
acctgtgggaaagtgtatatcgaatattagcattcagcctttaaaacgtgggagggagactgagcgcgatggctcacgcctgtaatcccagcactttgggaggccaaggtgggcagatcacccaaggtcaggagttcgagaccagcctgaccaacatggtgaaaccctgtctctactaaaaaatacaaaagttagctgggcatggtggtggatgcctgtaatctcagctactcaggaggctgaggcaggagaattgcttgaacccgggaggcggaggttgcagtgagctgagatcatgccmccgcactccagcctgtgtgacagaatgagactgtgtctcaaaaaaaaaaaaaaaaaaaaaaaaaaaaaaaaaggtgggagcgagctgcatgctgccatatgcttgtccacgcctagaattgctctaaggagagcctcatgattgagctcagtggaaggtagactttgtactgtttgccatttctagttcccatatgcattaagtatatactcaaatgactaattactaaatatagacatggtctctgcctgtgggaagtagacaaacctgaacctgggggtcacttctgctgctgactgc

SEQ ID NO: 202743 - DNA, 601 bp, Human
ctcacgcctgtaatcccagcactttgggaggccaaggtgggcagatcacccaaggtcaggagttcgagaccagcctgaccaacatggtgaaaccctgtctctactaaaaaatacaaaagttagctgggcatggtggtggatgcctgtaatctcagctactcaggaggctgaggcaggagaattgcttgaacccgggaggcggaggttgcagtgagctgagatcatgccaccgcactccagcctgtgtgacagaatgagactgtgtctcaaaaaaaaaaaaaaaaaaaaaaaaaaaaaaaarggtgggagcgagctgcatgctgccatatgcttgtccacgcctagaattgctctaaggagagcctcatgattgagctcagtggaaggtagactttgtactgtttgccatttctagttcccatatgcattaagtatatactcaaatgactaattactaaatatagacatggtctctgcctgtgggaagtagacaaacctgaacctgggggtcacttctgctgctgactgctaggggaccctgggcgagtgacatcacctgtttgagccccatttgggcttcaggaagtagggcagtgtatgc

SEQ ID NO: 202744 - DNA, 601 bp, Human
gctaggccagctgcaagaaaatcacacagcctgctttcagtctcacttttgatagatttccttctccgcactaagaaacacaaagcaggtgtgatgtaccccttgtcagtggggcaggggctgtccagggggctcttagcaccaagagtgggcaggaagtgggcccagggctgctttaatctgccagttttcaaaagaagctggaaatctggatttttaggttgcattgctcaattttaaaatataagttcaggccgggcacagtggcccacaccagcactttgggaggctgaggcaggcmgatcacctgaggtcaggagttcgagaccagcctggccaacatggtgaaaccccgtctctactacaaaaaatacaaaaaaaattagccgggtacggtggtgcacacctgtaatcccagctactcaggaggctgaggcaggagaatcgcttgaacccaggaggtggaggttgcagtgagccgagatcgtgccactgcactccagcctgggcaagagagtgagactccatctctaaatgaataaataaataaaaataaataaataaaatataggttcaaattccattaaaacccagtacaagc

SEQ ID NO: 202745 - DNA, 601 bp, Human
ctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaaaaaggagcacaagctgtttgaaccaccaggtttatttgtgtgtctaaataaacaccaaatagtaccaacctggttgtcaggacacgtttgtcccaggaagctggtggtggccactcccacttttggcagcactggcccggaagccaactgctgggccttcatgcaaatgtgtttgtatttatgggtttcctctggccccagg

SEQ ID NO: 202746 - DNA, 601 bp, Human
cctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaaaaaggagcacaagctgtttgaaccaccaggtttatttgtgtgtctaaataaacaccaaatagtaccaacctggttgtcaggacacgtttgtcccaggaagctggtggtggccactcccacttttggcagcactggcccggaagccaactgctgggccttcatgcaaatgtgtttgtatttatgggtttcctctggccccaggac

SEQ ID NO: 202747 - DNA, 601 bp, Human
ctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaaaaaggagcacaagctgtttgaaccaccaggtttatttgtgtgtctaaataaacaccaaatagtaccaacctggttgtcaggacacgtttgtcccaggaagctggtggtggccactcccacttttggcagcactggcccggaagccaactgctgggccttcatgcaaatgtgtttgtatttatgggtttcctctggccccaggaccctgggcctaaggcagacagcttttctgggtggcgacagggagccccagatgtctctgtggggtgatgggaccagctgtagctgtctctggaagggcag

SEQ ID NO: 202748 - DNA, 601 bp, Human
agtgagcatgagggtctttgtgtgagccccagtgtgagccctaggaccccagtgagattctgggtgtgagctctaggtctcaatgtagatctaagctaaagggtaagaccgtgaatctaagcatgagcctacagtcccagtgtgggtcccagtgtgagcagagttccaatgtgagtctatgtggaaactccaggactgaagtgtatccctggatatgagccccacaacgtaagtgtcagtccatatgaatgtaagcccctagaccctagaaggagttgaagtgtcccagtgtgcatctgastatggattccagagcccccagaagtcctgtgcatgaactttaaactcctagtctttgtgtaggctcagggtctcagttggagtatcagccctgacagtgtgaaccttagctctatctcaccaatgctgaccaggagcccctggcaccagctgagaggatttgtgtgggttgtgacagtggagacagagaggcatagtttgagacacctaggcccttctagcccccaagtcattgctagccctacatccctgggaatctgcaatggttcaagccccattcccacacgtgtaatgacacacc

SEQ ID NO: 202749 - DNA, 601 bp, Human
gtcccagaatataagtgtgaatcggagtgagcatgagggtctttgtgtgagccccagtgtgagccctaggaccccagtgagattctgggtgtgagctctaggtctcaatgtagatctaagctaaagggtaagaccgtgaatctaagcatgagcctacagtcccagtgtgggtcccagtgtgagcagagttccaatgtgagtctatgtggaaactccaggactgaagtgtatccctggatatgagccccacaacgtaagtgtcagtccatatgaatgtaagcccctagaccctagaaggagytgaagtgtcccagtgtgcatctgagtatggattccagagcccccagaagtcctgtgcatgaactttaaactcctagtctttgtgtaggctcagggtctcagttggagtatcagccctgacagtgtgaaccttagctctatctcaccaatgctgaccaggagcccctggcaccagctgagaggatttgtgtgggttgtgacagtggagacagagaggcatagtttgagacacctaggcccttctagcccccaagtcattgctagccctacatccctgggaatctgcaatggttcaagcccc

SEQ ID NO: 202750 - DNA, 601 bp, Human
ctgagtgtgagctctgagatcccaatatgaatctgagtgagtcacaggacttcaagtgagtcctaccaagatcctggtatgagtctatgtgtgagctccaggttacccatggaggtctaacccccaaagttcccatatgaatctaagtgtgaacccaaaggtcctagtgtgaatctgagtgagctccagggtccccgtgtgagtcaatgtgatccccagcttggaaatgtgaatctgactatgaaccccagtgtcctcagcgagtccttgagttcaaatgtgagccccatgttccccatgygagtctgactaactcggagtcccagaatataagtgtgaatcggagtgagcatgagggtctttgtgtgagccccagtgtgagccctaggaccccagtgagattctgggtgtgagctctaggtctcaatgtagatctaagctaaagggtaagaccgtgaatctaagcatgagcctacagtcccagtgtgggtcccagtgtgagcagagttccaatgtgagtctatgtggaaactccaggactgaagtgtatccctggatatgagccccacaacgtaagtgtcagtccatatgaatgtaagcc

SEQ ID NO: 202751 - DNA, 601 bp, Human
cccagagtgcctagctctggtgacccccaaccgggcacagctctgtgctttgggactctctttgccctctgcagaggtaaaagggactgatgacctcagtgctctccatccccagggaccacttgccttcccagcccctccccacaggaagctgagagcccttgtgggtttggtcacccagggccacaggagtttacaaagctgaggtctcccccactacccccacccaatggtgggtctggaggaggggtcagttctcacttctcaggctccttgctctccaggacgccccaaaccaagyacacatggtcccccctaacccatctgcatttcaaagaaaatccactccatatgtttccgattcatttacacttcaactcgccatgggggggcagagagcaggggtgtcttgcctccaagcctcccaccccggctggagagcgtgtgtccccttcaggacggggagcagttacagcccagccatctcagcattgggagggaccgcagggccatgtccctactgtgtgggctcccatgggggaagacagcatatctcaggcagccccacccactgatgttcatagcagcagagcacgcaaag

SEQ ID NO: 202752 - DNA, 601 bp, Human
cacatggtcgtgcccacagggagcattcggtccaatgagacagaaaaagatgtattactgttcacacaagaatgccttcctctggtgtacgaggtctgtgccaagggcaggcaggtacagggtgagcaagggagacccagtccttgagtcacgtagagctcagaggcaactactgtgcaaccttcctgggtgtcacgtggggaaagtacaggtaggatatatggtggggcacactgactaccctggggtctggagaaacctgtcctcctacaggctaaggactcttcagtttgctcctaarcccaagacgggccctcgagctgaacacaagtcactaccatagtttaatttcagttcctgctactgtagctctagtcttagcttttgggagctggctgcccacagccacagggtctaactcttcctcaacgcctgctccagctcctccttccaccccttggcccccagagtgcctagctctggtgacccccaaccgggcacagctctgtgctttgggactctctttgccctctgcagaggtaaaagggactgatgacctcagtgctctccatccccagggaccacttgccttcccagcccc

SEQ ID NO: 202753 - DNA, 601 bp, Human
gctctggctggacagagtatttttaggatccgaaccccgtgttctcagacaggcattaataaccaatacagacagtctgtggtgcccacaacagctacacagcctcagagcccagccttggaaggtcagagatggggtccattccttcagctagagggtcagagatggggtccattcccccgagggaatttcttcttgtccaagaaactcacacctagagggtaagggacgtgttcaccaccacatagggaaaaaaggaccttactttctacaaaatcctgaggctgggaaggggcaggacgacctctgacctctgccacagaatcggtgtgattgctctgccccagcctcctctggtccagacctttccaaggaaggagcctatcctctgcactccttccctgagtgaaggaaagtccttcctctactctagcctgcaaaccagtcttcctttgagccaaacaggggtgtaggacaggggatgctgggtctcaaaccacaaatcccagcagcttccctctcctcatgatctgtcccactcagtgattcatgcctcaacatttattgagcacctattccctgccaggcactgtacagggag

SEQ ID NO: 202754 - DNA, 601 bp, Human
gggctctggctggacagagtatttttaggatccgaaccccgtgttctcagacaggcattaataaccaatacagacagtctgtggtgcccacaacagctacacagcctcagagcccagccttggaaggtcagagatggggtccattccttcagctagagggtcagagatggggtccattcccccgagggaatttcttcttgtccaagaaactcacacctagagggtaagggacgtgttcaccaccacatagggaaaaaaggaccttactttctacaaaatcctgaggctgggaaggggcagtatgacctctgacctctgccacagaatcggtgtgattgctctgccccagcctcctctggtccagacctttccaaggaaggagcctatcctctgcactccttccctgagtgaaggaaagtccttcctctactctagcctgcaaaccagtcttcctttgagccaaacaggggtgtaggacaggggatgctgggtctcaaaccacaaatcccagcagcttccctctcctcatgatctgtcccactcagtgattcatgcctcaacatttattgagcacctattccctgccaggcactgtacaggg

SEQ ID NO: 202755 - DNA, 601 bp, Human
tgggctctggctggacagagtatttttaggatccgaaccccgtgttctcagacaggcattaataaccaatacagacagtctgtggtgcccacaacagctacacagcctcagagcccagccttggaaggtcagagatggggtccattccttcagctagagggtcagagatggggtccattcccccgagggaatttcttcttgtccaagaaactcacacctagagggtaagggacgtgttcaccaccacatagggaaaaaaggaccttactttctacaaaatcctgaggctgggaaggggcaggatgacctctgacctctgccacagaatcggtgtgattgctctgccccagcctcctctggtccagacctttccaaggaaggagcctatcctctgcactccttccctgagtgaaggaaagtccttcctctactctagcctgcaaaccagtcttcctttgagccaaacaggggtgtaggacaggggatgctgggtctcaaaccacaaatcccagcagcttccctctcctcatgatctgtcccactcagtgattcatgcctcaacatttattgagcacctattccctgccaggcactgtacagg

SEQ ID NO: 202756 - DNA, 601 bp, Human
agaaagggattccatgtcttccaatcctgcccagagatgcagagacaccaccacccagggagagatagccagaaactaaaataagatgttagagacagggtggttgatagtgacagatacagccacaccaagacaggctcaaagggaggaagactgaggggaagccagagacagagagggacacattaggccaaagaatgagagagatagctggaaaaggagacaataggagtagaggagggtacaggctgacatgaaaaaacaccgacagatacactccagtatgcagacagacacatayagacccatctgaccttcacaagaaacagactgtgaaagcaagcaaggctcaggctgtgtgtggcgtgcgtatgtgtgtgtgcgtattgtggggggagcatgcagagtctgtatagctacgcacattacaccagctgcttccagcaatttcatctgattaataataaatgccccataattacagccgctcccccagcccttcttcctgttttttgtcagctgctgccagaccagccccccataaaccctatggtcccctccatcctcacctgctgtcctctaggaggctgagagaatgtga

SEQ ID NO: 202757 - DNA, 601 bp, Human
acaactggtagttggtaaaggagctggccttgaactcagggatatcttgaaagccactgttgcttctatggactctagccattcaaaagacccctcaccttctataagaccccaggagatcctcagggtccaactgctcccttgaaaacaggtcccagatatatctgccaaagatatgattaggtgcctaaacacataccatgagaaagggattccatgtcttccaatcctgcccagagatgcagagacaccaccacccagggagagatagccagaaactaaaataagatgttagagacagggtggttgatagtgacagatacagccacaccaagacaggctcaaagggaggaagactgaggggaagccagagacagagagggacacattaggccaaagaatgagagagatagctggaaaaggagacaataggagtagaggagggtacaggctgacatgaaaaaacaccgacagatacactccagtatgcagacagacacatatagacccatctgaccttcacaagaaacagactgtgaaagcaagcaaggctcaggctgtgtgtggcgtgcgtatgtgtgtgtgcgtattgtggggggag

SEQ ID NO: 202758 - DNA, 601 bp, Human
tgggtgaccaagtgaaaccctatggcaaaaaaaaaaaaaaaacacaagctttggaggtaatcctgtttctgttttacagatcctgaaactgaggctcagagagcagaagcagcttggccaaagtcatacaactggtagttggtaaaggagctggccttgaactcagggatatcttgaaagccactgttgcttctatggactctagccattcaaaagacccctcaccttctataagaccccaggagatcctcagggtccaactgctcccttgaaaacaggtcccagatatatctgccaaagrtatgattaggtgcctaaacacataccatgagaaagggattccatgtcttccaatcctgcccagagatgcagagacaccaccacccagggagagatagccagaaactaaaataagatgttagagacagggtggttgatagtgacagatacagccacaccaagacaggctcaaagggaggaagactgaggggaagccagagacagagagggacacattaggccaaagaatgagagagatagctggaaaaggagacaataggagtagaggagggtacaggctgacatgaaaaaacaccgacag

SEQ ID NO: 202759 - DNA, 601 bp, Human
ggatcacctgagcttaggagttccagactagcctgggcaacatagtgaaaccccatctctaccaaaaatacaaaaaattagccaggcgtggtggcatgtgcctgtggttccagctactcctgaggctgaggtgggagggtcacttgagcgtgggaggcgaaggttgcactgagccaagattgagccactgcactctccagcctgggtgaccaagtgaaaccctatggcaaaaaaaaaaaaaaaacacaagctttggaggtaatcctgtttctgttttacagatcctgaaactgaggctcaragagcagaagcagcttggccaaagtcatacaactggtagttggtaaaggagctggccttgaactcagggatatcttgaaagccactgttgcttctatggactctagccattcaaaagacccctcaccttctataagaccccaggagatcctcagggtccaactgctcccttgaaaacaggtcccagatatatctgccaaagatatgattaggtgcctaaacacataccatgagaaagggattccatgtcttccaatcctgcccagagatgcagagacaccaccacccagggagagatagc

SEQ ID NO: 202760 - DNA, 601 bp, Human
atgcattctcacatgcacaatcctagaggcacagggtcacaggcacggtgtaaataaccaccatcgtaacacccccttccttatcaccactatgatttattgagcatctattatatgccaggaactgtgtttggcactttatatgcattatcttacttaatcttcatgatttctccatgaggtaggttttattgttcttcacatttgataaccaaggagattgagcttcaaggaggccttgcccaataccacagagctgatcagttccagagtctagatttgagtccgtatctagttccawaaccttgctgctataccaatttgcctgtgcaggtctctcacccacctgcacaatgtctttcccaagaataataacagcaggtatcacttgttcagggtccttggttacccagacactgtgataagtacttaatttacattttggtactgaatcatcaaaacaagcttcaaggccaggcatggtggctcacacctgtaatcccagcactttgggaggctgaagcaggtggatcacctgagcttaggagttccagactagcctgggcaacatagtgaaaccccatctctaccaaaaatacaa

SEQ ID NO: 202761 - DNA, 601 bp, Human
atcagaggtcacagaggagccacaggccttagtccaactcagaggccattccatactcacagccccactgtgagaaggggagactgaggcaggcagcagctaaacgtctggaagaagaaaagttgagagtaatacagacccctcccagcaccccttgctgacttcaggttctgaaccacagggacaaaggttgccagaaggcagtggcctgatacaatacacagatacacacccacagacaatccacaattcttatacaatcagtttgcagacacacaggcacctccatatcacatgcatyctcacatgcacaatcctagaggcacagggtcacaggcacggtgtaaataaccaccatcgtaacacccccttccttatcaccactatgatttattgagcatctattatatgccaggaactgtgtttggcactttatatgcattatcttacttaatcttcatgatttctccatgaggtaggttttattgttcttcacatttgataaccaaggagattgagcttcaaggaggccttgcccaataccacagagctgatcagttccagagtctagatttgagtccgtatctagttccataacctt

SEQ ID NO: 202762 - DNA, 601 bp, Human
cttggatgcccccacccccaagctgccaatccaggggccttgcctggcctgaatgagagacagggagagtcaggctcggccccacagctggcctcagaagattctggactttctgacctgccatcccatctttttaaagcctagctgctcctccaatcaaataagagagatgtctggggggcagagaggaaatctgaggatactgaaacagaaacatactcccatatctgggactcagcacccccttagtatagaacccagtttcctaacctggtgttgcccttgcctgtgtgaccacagrtaagtctcttccctttctatttgagagcatgaaaagcctcagccaggctgagcccaaaacctctggaaaaagaaaggacaggggaagagaggaaggaatctcaggtcctcctccactcatgtcccctagacgtacagccccactacacctgcctgattccctgagattgatctgccccacgtgggccccagcacctacctcttcaccactggccacacaccaagcacatcaatgtcctcctcctcctccagaccaactcttcaggacttccaaaaccaagggggcaagatgaggtgacaa

SEQ ID NO: 202763 - DNA, 601 bp, Human
cctctcgcagacactggcattcagagcctaccatcgtggccacacatcagggcctcccacatggacacccactcccacagccccgtacacgctggtgtgcgtgcacacattacagtcacactcacacacacagactccctcacacagccatggtctcacatatggataccatcacacactccgaacagtcaaccttccacacagacaccattgtacacttccagaagctcagggcccccagtcgcccttggcctctcacgccccgacaccggcaatgggaaacacccacatacacaccctsaacagccacactgtgccagcacctcaggttgcctagccgtgcctgaggggagggacagaaagcctagggatgcctagggcaggaaagaaaaggaaaggaaatacttcgttggtccctaaaaagtgagaaaataaatgattattccccaggcagctccttcttccccaaaccctgctttcaacagcattagggaatgaagggagatccattccagacaggagaggtgaaggaagtacctgggggagacagatggtggcactggaatcagcaagagccagaaaggcccagaaatcagccgac

SEQ ID NO: 202764 - DNA, 601 bp, Human
caaagaaggtcaccggatggactccccccattgccaggcgtcagggtgggttcagaacatccatctgatgaagggcatccggcccagcacagagcggaggggactccccacagcttccagtccccgctctgactcccacagcccagactccagaatcccacagtgaggggaaaaggcaccttttatcctggagcctcatctccttcacctctccccacagcagcctagagggcccatctcaggaatgaggcaagaatgcaggacacagcatggactcactgattcaaacgcctggggactytagaagcctcagacctgcagaggaattaggttggagcagagaaacagagatacatagacttggagatggagaaggaaatgagagacagagcgggggcaaagacagggacaaggacatggtgggcagggaggaacagtactggctgaggggggagcctggaagagatagtcagggcaggcgggaagctccaggacagggaggaggggctgaggctgggaggcccccagatcccaccaggcctaggcagcctggacagcgtgggcggtgggggcgggggcagaggcctgagcggtccagagg

SEQ ID NO: 202765 - DNA, 601 bp, Human
agaggtcagccccagaatgaggagggaacagagggggtaccccataagcaaggaaggagcctagcgcccaaaagcccctgagccccttgtcagcacaagggtccctgcacctctcccagcacagaaccctagtgtcatcattactcccacacaggtaacacattaagagtcaaattctggggccccaacttactgccattgtcccactgtggcataaagataccattacacaatgataacaacacccattgaaaatgacacagttgtaccgttgacaatgacacacagggatgttgacagkcaccacgatgacaataatgcagtgagtgacagtcacatacattgacaccaacaaacgcggcaatgataccagttgacactgacacagtcacagtgatggtaacctcagaatcaaagatgcaatgagactcagtcacatcgagtcacactgacggtgacatcaacacagtgacacagcaatgttgatagactcagtaacagtctcacagaatgatactagtccacagcaatactggcagccctgaagtctgacagccgccgtcggtaacaaacagacacagcgacaggctccaggtcagga

SEQ ID NO: 202766 - DNA, 601 bp, Human
aaacaggcgtacacccagaaaaacagcttgagagaagagccagagccacagccagatgctcagtcaggaagtatccacaccactccaaacactgccagagacactgtcagacacacagtcagacacactgccagagacaccgttataaagactgccagagaaacagccagacacacagccagaaaaactgacagagacgcagtgccagatacaccccgagaaagtgccagagactcagctccagacagtgcagacatagcataacagagacaaatgtgggtatcagcctgaagcagctgcsgagaggctggagagcaatggacttcctggggcttcctgtgggagagggctcctgcctgccttttgctacccttgaccctctccaggaaagtcccctcctctgagcctgcttttcctttcctccctgtcacagccacaggtgccctgactgcccctccctggcacagtaaatctctctgtgtcctaagtggccccagctaccctttgcgcatcagtgactcctggagccttagctaccacttggcctggctccttctgaccctcagcccctcaccactcttcagctactcctcaggcctag

SEQ ID NO: 202767 - DNA, 601 bp, Human
atttttctaaaaaaaaaaataactttactggtgaggttagctaattagctataaacatcataaactgaaagggtaatgttttaactcaattggaggtctgtacttctccagattgctttgaatggcaggccccctgctgtgctcctggggagagagcctgaaacctggatgctcgggagcccctcagatccgtcatctgtccccgacacccctgtggtgagccttgccactgggccctgagaagctcagagcagtcgagtcagggcagtgggacatgacccaggtcagatgtggcttttcygtaattgtacaccaatgatcaagagaaaatgaaggattttaatatgtaagtccttgtcaggaaccccggcccacccttgaccccagccatgtgcccctaggagcctgggacccccagcccagtaggcgtgcatcagtgtccacatgcacccatgcaagtacacaggatgcactcaggacatggccccagaagccaggatggatccagtgccccccaacctggtgtcctgcttcctgagatgagtccaactattctctccccctcccccagcacacacctacacttgatggcagggaaata

SEQ ID NO: 202768 - DNA, 601 bp, Human
ttaggaagcctggtttaaggtgagagcatcttgaccccaaaatgcccttcttaatggggctcaagatcttctttcaggcaacagaaagcaacattattggcatctgtaggcaaaggtttgctaagatggtagaaggcaacctatggtggtttgctgttcgataagactagtggctacacaatgttgtcaactgcaaatgagttacagaatattggtaatgccagggccatttttctaaaaaaaaaaataactttactggtgaggttagctaattagctataaacatcataaactgaaaggrtaatgttttaactcaattggaggtctgtacttctccagattgctttgaatggcaggccccctgctgtgctcctggggagagagcctgaaacctggatgctcgggagcccctcagatccgtcatctgtccccgacacccctgtggtgagccttgccactgggccctgagaagctcagagcagtcgagtcagggcagtgggacatgacccaggtcagatgtggcttttccgtaattgtacaccaatgatcaagagaaaatgaaggattttaatatgtaagtccttgtcaggaaccccggccc

SEQ ID NO: 202769 - DNA, 601 bp, Human
tgcagctatgccagtgagggttcatgcccagctctgagaggggggtcagcaggcggctcccgtgagcactcaccctgtggactgtgtctctgggcgtagacaactgcggcggcggcggcaagcacagcacagcaggcccacgggacaggagcagccatctgttgggagaaaccggggtgggggaggggacagcatcagcccaggcaggactgtcctggggagcccctcctgttctcaggcaagactgggaaatcccagccctagggccctggagaggccctcacccgctctgctttcaccyaacccgactgacacggagtaggaggtgggaatcatgcaggcagggagcttaggaagcctggtttaaggtgagagcatcttgaccccaaaatgcccttcttaatggggctcaagatcttctttcaggcaacagaaagcaacattattggcatctgtaggcaaaggtttgctaagatggtagaaggcaacctatggtggtttgctgttcgataagactagtggctacacaatgttgtcaactgcaaatgagttacagaatattggtaatgccagggccatttttctaaaaaaaaaaataact

SEQ ID NO: 202770 - DNA, 601 bp, Human
ggctggaccagacactaaacaggggcctccccctgaccagaggcccagtgtccaagactccggccactgagcgcccccaacagtccaccagctccagccactgagcccccctccagcctcccttccaaaaacctggagcttccaggaaacatgccaagcccctctctctgcaccccctagcagagactttgcatccagctgcctgaggaggaggctgaaaactgacctttggggagggggcgtggccatcatggtcccagcagcaacacatcaacactgaccaggcagctcaacgctaacrtggacccagtgtggcccttaatcctggggagcaggtacggccaccacacgaggacacagcaaccgaacaacacattacatacaatggctatgggataacacctccccaccacaccttgtctgctgcacaaaaaaagtagaaacgcaacctgacaataatgacagaccgatgatgtaaaggcagggcagaacgaaaaaatgacaacacaatggcagaagacaacgacaggccacaatggagaggtggaggggtaagaggacatgacaagcacacagtgtcacaactgctacaataacacaa

SEQ ID NO: 202771 - DNA, 601 bp, Human
gagcctgtgaggatggatgagtgaggacgagaggctcggtgtctgtgtgagtgtttggggagatgaagagtgttcaaagctcctctatgcctgtgcaagtgtgtgggtatatgaatgtctccaaatgtgaatgtgagtgagcatgtacaggggctaggtatgtgaatgggcgatcttctgtgtgtgtgtgtttgcatgtgacagagagtttgcatagtgctgagaggggtcagttctcagagaaaacccagttcctctccagtccctgggttttttaaagtttcctgacccccatgacccrgatctcttgccacccacaggcccagcccagttactgacgtccattattacccaggcaagctggcattgaggggccccactcctggactcctttttcggtctccttatctctttctcttccccaccccatccttgtctctttctgtcctgtctctaccccccacctcccccatctctcttcctgtctctctccctttcctctgccttcccagcctgccaccccacaacaacccgcccctcagccatccagggctcaggcagcagcaggagaagggagaatgggcagcagggaaccctaggg

SEQ ID NO: 202772 - DNA, 601 bp, Human
ttcttttgctttgcctgctgggacatcagggcaaaagtgctggggaatcaaagagcctccctcccaccccaggtgaatctctcaaccactgatgggcaggagctagtgtatacacatcccagctccctcaccctcaggcagggcaactcaggtgcacgttctgcatctgcaccttcggtggttaacctcagtcgccaagaggcaatgtctggataactcactctttactgactaacctaacttcctttttgtgtgtcactttcccattccttcacggtatttccttcacctgccaaacaarctacttgcataagaattctcatcttgggatctgattctagggaaacccaaactaagacactgttcaaacagcacacattatcttttccttccgttttcttcctgttgcagtcatggattcctccagctgtcttgactcctcccaccttctactctcctgtccttcccacctccaatccatcaccaattcttcgacgtccaactgcgccttctcagcttccccagctccatgccctggtcccaggtcctcatcctctctcctgcatccagtaacagtctccttcctaccttggtttttctc

SEQ ID NO: 202773 - DNA, 601 bp, Human
ggagtccttagggctctgctcgtgaggatccacttgagagcaagaaggtggatcaggagaaagcagttcagggattagcctggttaaggagacttccaacagaatactgttaagaccaagttcccttgtaaatagagacaaattgcatgtgtttgggataaatattaaataatttttggtttgaatgacccacaaatcaggggtaactctgtcctgttctctgagagctggcaggaaggataatttgatactgagtgttgccaaagccagtctcttgttactaatataaagtgactgagaygataatgattaatatcccctgttcctctgaccaggtctttagaaggaaataatgcaatgagagataagtacctgaaactaatgctacagccaactcatggccagccttcatctggcagcagggcctggagggcagtgagcactctatataaaaggtctgggccctggtcacaacagggcagctgtgggcatgtcccgtgggtatagactatggacattacttcaagacccaattcccctccaacgacctctcaaagaagatcacatcatcaagaatgggggtccagggtcatcaaggccc

SEQ ID NO: 202774 - DNA, 601 bp, Human
acacaggggaacagtgggcttccatccacagtgtgcacgtgactgtgagtgactctgtgtgattgcgtgtgcgtgtccagtatgtgtgatgctgggaggggcctggggcagaacccccaggatccagatctagctttgcagcagaagagatgagggggcagagaggcatcagaactccagggcaccaggtggagggtgcaatgctgtgggcggaggcagctccattccccaggcctgtcagggaaagcggggtccagctgagaccccacagggccaacctgcattctgccttccactgtgygcctcccttgggaagccttccgggccctgcgtccatctcatgtcgttccatgttcatcctgtgtgcctttagtgtctcttccctgtctgcccacgggtgcagaactctgcctgggggtggggtggggggcggccaaggacacaggaagtgccttctgggggcctgttggccaagccagagttggcagccaccccaggaggaaaggacattccgaggtcggccgagaagcctccactccccgctcctgccaccgctgggggtggggtggggatcggagtgtgcagagtccgctccctgctg

SEQ ID NO: 202775 - DNA, 601 bp, Human
ctggccaggcgggagggactccggactctgtcagggaacatgtgagtgcatgagcaggctttgtgggggacaggcacccaggaatcgaattacacactttaaaggccggactggataggggcatgaggagctggagttagagcctggtagatgaggtgggggtacaagttgacccccaggaaccagcctgggttgtcccatggagcaccctctcaaccccactcctagcccacaggcctcatgggtcacacagagtgcccacgaccctatgggcccagggccctcaaagcaagagaacccsaagtctgccccagacctctggctgttccccagagctctctattgtagcttgatccagaccatagtctgaccccatactgacccttgtccactgcttggttcccagccaggctaccttccgactcacagcctcaagctgacccctaagctgggtctgactttggagtcctgatgccagtcagggcctaaactcacatgctggaccaggcttgaccccactgcctgatcctgaccccttgggcccatctgtgagcccttgaggacaggcacgttcctgtcccttggggccagcacaagccca

SEQ ID NO: 202776 - DNA, 601 bp, Human
atgcattaggcgcgggcagctggccaggcgggagggactccggactctgtcagggaacatgtgagtgcatgagcaggctttgtgggggacaggcacccaggaatcgaattacacactttaaaggccggactggataggggcatgaggagctggagttagagcctggtagatgaggtgggggtacaagttgacccccaggaaccagcctgggttgtcccatggagcaccctctcaaccccactcctagcccacaggcctcatgggtcacacagagtgcccacgaccctatgggcccagggcyctcaaagcaagagaacccgaagtctgccccagacctctggctgttccccagagctctctattgtagcttgatccagaccatagtctgaccccatactgacccttgtccactgcttggttcccagccaggctaccttccgactcacagcctcaagctgacccctaagctgggtctgactttggagtcctgatgccagtcagggcctaaactcacatgctggaccaggcttgaccccactgcctgatcctgaccccttgggcccatctgtgagcccttgaggacaggcacgttcctgtccct

SEQ ID NO: 202777 - DNA, 601 bp, Human
aggggggcttgtgaaactagaccctggttattagcaatgcattaggcgcgggcagctggccaggcgggagggactccggactctgtcagggaacatgtgagtgcatgagcaggctttgtgggggacaggcacccaggaatcgaattacacactttaaaggccggactggataggggcatgaggagctggagttagagcctggtagatgaggtgggggtacaagttgacccccaggaaccagcctgggttgtcccatggagcaccctctcaaccccactcctagcccacaggcctcatgggycacacagagtgcccacgaccctatgggcccagggccctcaaagcaagagaacccgaagtctgccccagacctctggctgttccccagagctctctattgtagcttgatccagaccatagtctgaccccatactgacccttgtccactgcttggttcccagccaggctaccttccgactcacagcctcaagctgacccctaagctgggtctgactttggagtcctgatgccagtcagggcctaaactcacatgctggaccaggcttgaccccactgcctgatcctgaccccttgggcccat

SEQ ID NO: 202778 - DNA, 601 bp, Human
cctcctggaggcatcgccaccccactctcgccccgctggccccatcctgctggtctcccccaaccctccaggccagcctgcctgtccggcgccccttccaggcccaggctgggctctggttcatctcagtggcacccgctgcctcattaagccgcctcgtaaacaggggcagccggcaggggcggaggagggggccgctctgggccacgtctggcttcagggcttttttggtccctgttccaaccttcccccgagaaaactggggtctggcctatctgacctgacaggctgtgagtgcatscacacgtgtgtgtatgtgtctgggcatgtgcggtgggtccaagcggggcaggaagcccctccagttcctcctcagcctgtggccctgatacggtggtaaaggtcagggtcatggtgagacaccttttgggcccagaccctgggctcagtaaatcctaatctcagccctggaagatcggagggtcccaaagaccctcttctcctggagccagggtcccagttccacctctggcaccccagtccctttctgctcggcaaagataccctctggctgagtagccacggctccttcggctctgtc

SEQ ID NO: 202779 - DNA, 601 bp, Human
cacccagcctcactcaacctaccagatcaagagactgctggcagtggcggcagcggcagccagggccagagtgatggggacgctgaccaagaagggtgccgagggtcccccgccgctgcccagctccccagggtcacagatcttcgtggtaggtgggggtgccagggagctggtggtgctggtcgtggtctctggggaacatgggggaaactcagggcaaggccagggctgggtcccatccagatctgggggctcatgagacataccattctgcttcctgcatcagactggtactgcctcycccatcaggcagatcctgtttcccaaggctcacagataacccctccacccaatgacccctaccaaggatgtccagatagcaaggaccaggaatggcaggagttggacagacaggcagaagtgtggctacccccgggagcagaggctggaggcagcagggtagaaccaggccacaggttctaccacaggcctccaggacagcaaagccaggaggtaggggcgggagcaagctcacccgcagcctgggcctccgtggtgaggtgtcgcggttcctcagtccagggcgtagcgtgggcggcta

SEQ ID NO: 202780 - DNA, 601 bp, Human
tgagagaattttaacacttggggctgacactgtccaggagaaccatggatgtatcgtgtgggagggaggaggagaaactgacgtttttgaagttggaaaggtgtggaagtggcatcttaatttagttgtgcaaagaggaagtaaaaagattgacgataaagacgtgtatagatcagaatagaacgttcttaagagggaaagatgaaacataagctgttaatattttaattcccagtctgttcttaaagatgagaaagctttgatggcaaggcgaacattctagaaagaactattacgtgtrtgtgggggggtggggaatgtgtgtatgtatgcatctgtcagaccttgagtcattacaagtgttctgggcgtaagaactccgattcatattgcattctcttccatcactttatttggggtgaagcacatcgtcctgtcagtatccacatttgaaaaataaagagatcctggctagattgggatctaagttcacttagtttttagtaaggggaacttggtgaaaaatcgacttgtgaggtctccagaaacacttaattgataatgagtcaaaaggcattactcttggcatgtgaatattgga

SEQ ID NO: 202781 - DNA, 601 bp, Human
cccagcactttgggaggctgaggtgggcagatcacctgaggacgggagtttgagatcagcctggccaacatgatgaaaccctatctctactaaaaatacaaaaatcagccgggtgttggtggcctgtgtctgtagtcccagctactctggaggctgaggcaagagaatggcttgaacgagggaggtggaggttacgctgagcccagattgtgccactgcactccagcctgggcgacagagagactgtgtgtcaaaaaagcaaaacccgcacacaaaaacagtggtgagtgagctgctgtarcctcttcttgccatgttggagtggaaggtctctaacaggccagccagctctgaaaaggtctagcaatcctatgtccatttttttcccctgggctgggcgtatcttttgaaggcagacctccaccagggtctgtatcctggagacagctctggtacatggtagatatttggtacacgctgattaaatagaccaagtttatgttatggtaaaggtggaatgctggttcatgtccattaggggaaagtgagatgctcatttaccttgtagaattatgaggatggtccagaattcagaaacgtg

SEQ ID NO: 202782 - DNA, 601 bp, Human
tgacagcccaaaatgtccatagtgcccaggcagagaaaccctggtttaaattcatactagaccatttcagtaatttggatgacagatcatcagcaaaatttccctggtccttcttggaagtgtcagttatgcccacaaattgttaggcagggaaggaggatgggccctgtctttctctaaggttggcactgggctctgttaggagcttggtcattgcttcctactgaactgagcctgtggtttgaggtgaccttccctccctgatttcctgaaccatcgctctttttaaccagctcccacrctcccctgtatttgagctgccttctggtggaagcatgtcttctttgtgtgttttaaatagctataactgtctaaataataaaacctaaacaatgtagttcagattgcatctagctttctcaagagtagagaaagcttccttcctcccgctccttcagcattattatcctgtcccactacactttaatcccccattgtgataacaccgcaggcacagacgctgttgctttaacaatgcagcctttcggggctgatgactgggagtggggaatgcatgcttgggccctactctacacggact

SEQ ID NO: 202783 - DNA, 601 bp, Human
agggcttcctccctaagtgattaaagcagaattttaaaaggacactttgatttaagatatcaattacttgtgttgcatgactccattttttttcataaatgaaaatttctccagtgagaatcctgagcaattcctagaacactgctgtatttaattctgaattctcccttctagaaggactgtagatcacagtgttcaaacaagacttatgtgcctgtgggcattccaaattcctttgctggccttacagtgcagaggtgaatatagaactgttcctcaatcctttttcttagagtacagsttgagcatccctaatccgaaatgctccaaaatctgaaactttgagcaccgacataacacaaaaaaatgctgattcgggatttccagattagggactttgagtcagtgagtgtgatgcagatattccaaagtggaaaaaaaaaaaatccaaaacactttcggtcccaagcattttggataaaggatattcaacgtgtattttcagggccagtgccttggatcatgctttggaaaacagtagtggcatagttttttgtttttgtttttcaaagatggggtcttgctgtgttgctcagactga

SEQ ID NO: 202784 - DNA, 601 bp, Human
cccttagtgcatgtttgcatgaaaagagcttgggtgtcatttctgtgttggtgttgtgtttttcttctgtagttaatttttcttgtctggttgctcttctctgtgaacatcagaaaccattctatgaaaaagtcctgtaaatttttcacgccactgtctctgttctgtcacccaggcaggagtgcaatggcaagatctcagctcactgcagcctctgcctcctgggctcaagcaattctcctgcctcagcctcccgagtagctgggactacaggcacgcaccactgcacctggctaatttwtttttatttttatttttatttttttattttttgagatggagtcttgctcttgtcacccagactggagtgcagtggcgcgatctcggctcactgcaacctccgcctcctgtgttcaagtgattctcctgcctcagcctcctgagtagctgggattacaggcatgcgccaccacgcccggctaatttttgtgtttttagtagagacggggtttcatcatgttgctcaggctggtctcgaactcctgaccttgtgatctgcccgccttggcctcctaaagtgctgggattacaggtgtgagcc

SEQ ID NO: 202785 - DNA, 601 bp, Human
ataagaatgtatgtattagttttctattgctgtacagtaagttaccacaaatttagtcacctgacacataatcacagtttatgtggattaataatctgagaatggctcagctgggtccatttttattttatttatttattttgagacagaatctctttatgtcacccaggctggagtgcagtggcaccgtctcggctcactgcaacctccacctcctgagttcaagcaattctcctgcctcaccctcccaagtagccagggctacaggcgcctgccaccacacccggctagtttttttgtrtttagtagggacggggtttcaccgtgttgggcaggctggtctcgaactcctgacctcaaaccttggcttcccaaagtgctgggattacaggtgtgagccaccgtgcccggccttctttttcaaataatggctttttttcctctgggtatatacccagtaatgggactgctggatgcaatggtaattctacttctagttctttaaggaatctccatgctgttttccatagtggttgtactagttgatattcccaccagcagtgcagaagtgtttcctttcaccacatccacgccaacatct

SEQ ID NO: 202786 - DNA, 601 bp, Human
tgggattctgaaggctcagcgtgttagtttgggatttttggggaacagctttattgagatatgattcatatgctatataactcctttatcgaacatgtacaattcagtggctttcaggatatttgcagttgcgtgaccatcatgacaatcaactttagaacattttcatcacctcaaaaacaaaccctgtgccccttagccatcacccttattcctccccgcattcttcccagcctctggcaaccactaatctgctttacatctctatgagtttgccttttctgttttgttttttgaggtraagttttgctcttgttgcccaggctggagtgcaattgcgccatctcggctcaccgcaacctccgcctctcgggttcaagcgattttcctgcctcagcctcccaagtagctgggattacaagcatgtgccatcacacacggctaaggatttgccttttctggacataacaaatagaatcacttatttcacttagcatagtgtttttaaggtcctaccgtgttgtatggagcgtgtatcagtacttcgttccttttatgcctgaatagtgcgtggataaccacagtttgcttctccatctat

SEQ ID NO: 202787 - DNA, 601 bp, Human
ttaatgtatagatcatgtatacaataaggtagattatcaaacatgtacagcagaaggctcatttcagatcagaagttctacattcagtgagggtggtagaaatgaaaacattttattcattttgcatgttgcctatattttctaattttaaaaatacacatattgcttctttctgtattaataaaagcttattttaaatgaccgtactaatacagtttgtactgtggttaaaatatacatgaccttgaccatgagagagctaaatcttctgttccaaccgcctcattttgcagaggacaaygtcaaggctctggcctgtggaatctgatggctctgcctgaggggaggggtgttgacaacacacaagacagttggagttgtgtagccttcagaaagccctgtgtgctcatggcctgagttttcttagctaaagtttttgaagttgaaaaaacagccacaagccaaggtcacaagtagagagaggtttttttgttattgttttttgtctttctggatgtgtgagaattgcatatttccttagggcagcctctaatggaatttagtttgttgaggaggatgttagattctcaaagctgaagga

SEQ ID NO: 202788 - DNA, 601 bp, Human
tggatgtgtgagaattgcatatttccttagggcagcctctaatggaatttagtttgttgaggaggatgttagattctcaaagctgaaggaggagcaggaatattatatgcatgtctttttttttttttttttttttttttggtgccaggttcgattttgattcagagtgactccctggcctagtaaggttggctagtacagctaatctactttatgcacatggggctgcataccatgtggatcagtgattaaatagcagtacaagaccatgagggaaggaaggaactgatgttgattctgsgttctatataggaaccctacaaagtagtgtttctactttatgaggaagttaggtctgtaagtgaaaagtcctggccagtgagtttggttggggtaggctctggtgggaggcttgggggagcctgttatggggaatgttaagtggctggtgatgtaaccatcgatgagagtagggaagtaacaagcctgattttgatccaagacttgtgattggaacagtgctgggagcagttgcacgggaggcaggttccagctagatacacagatttgtgctttgggcatctggagctgatgctccggg

SEQ ID NO: 202789 - DNA, 601 bp, Human
ggccactacactgggcttggccagcagtcaaagcctttgcatagatcagacaaagacaccccctttccttggcctaagggatgaggttcaccccagctcagccacccaggccagggtcctcgttcactgcacagcctggtcaattacacgcagggtggccttgtctagattgttcgttcaccagcatgggggttcgggttctgttttgtaatgtgccaacagaaccatcttgaggccatttaccaggagtgatgatttgttttatatgctttcaaaacagaaaacatctgttctagccaargagggattgcttaatttcagaatggctcttcagattcagggaaagttctgcctggctcagtacactcaagccacctccacagtgggctggccaaccacacttcagtgacaaacacaaactgaacaaggttagtttatcttaccaagtttgaaatcagatttttttttttttttttgtgaagtagaattcagtcttaaatgttacagttctggggatataattcagaccttcgcttttaatttcctgaaaccaatttcagaatagcaaagcaagctagattattttctgccaaacgacttt

SEQ ID NO: 202790 - DNA, 601 bp, Human
aataaaaaaagtctgtgcaggccagaataagtcatatctgtccactttggcctctaaacttcccgtttgtagccttcattcagtggccttgggaacacagttctaagtcactagagatagactctttatgcatagtgaaaaaatccttaacttcccagttctagtttcggcactacttagtttatggcagaaattctaatgtaattttcttggcaaatcacactgcaatcagctgtgactctttgtttttttcttttacctctgttcaggtcacagagatgtttcattttgatatttttcycctcacaggagccagccttcagagggctggtgggaaagtaaagagtaattcctcttgtcatatcttggttctttgttttacatttattagggaatgcctgctttgtagatagaactagagaagaaaaaattgcatttaccccttattctaagtattgtaatgttggatgttcttgaagatcctggcttcaagtgaacctgcggaggttaatgtactttacctgggaacactgattgcacttttgggagtaggacactgggcaggatgggagacaggaggattggcttctgcgaccatggg

SEQ ID NO: 202791 - DNA, 601 bp, Human
tttaatttttatttatttatttatttatttatttatttatttatttacttatttatttatttttaagctcagtcctcaaactgtgcctcattggccttccttctgaacgtttctttctgaccatcttgccttcttccccttgttctccagctgatggtgagaccattctaaaaggcctccagtccattttccaggagcaggggatggcggagtcggtgcacacctggcaggaccatggctatttagcaacctacacaaacaagaacggcaggtgagcagtctccagtgctgttcttcatayctggtcacttatgagcagagagggtgacagagtggaggatgggggtggcatccggcatttttttttctcctttgacatcttttaggatgggaatggaacttggtgcttctcaaccgtagctgcacatcagaatctcctggtagcgttactgaccacaggttcttaagctctcatgtatatagagattgacaggaggccaaacatgtttcccagacaagttttttgttaagactgatgcccagagtgggcataagggaggcagcccaggaaaagttttgtggcttactcccccaagggcag

SEQ ID NO: 202792 - DNA, 601 bp, Human
actgtgcctcattggccttccttctgaacgtttctttctgaccatcttgccttcttccccttgttctccagctgatggtgagaccattctaaaaggcctccagtccattttccaggagcaggggatggcggagtcggtgcacacctggcaggaccatggctatttagcaacctacacaaacaagaacggcaggtgagcagtctccagtgctgttcttcatacctggtcacttatgagcagagagggtgacagagtggaggatgggggtggcatccggcatttttttttctcctttgacatmttttaggatgggaatggaacttggtgcttctcaaccgtagctgcacatcagaatctcctggtagcgttactgaccacaggttcttaagctctcatgtatatagagattgacaggaggccaaacatgtttcccagacaagttttttgttaagactgatgcccagagtgggcataagggaggcagcccaggaaaagttttgtggcttactcccccaagggcagctgcaggtgatgttttgaagggagtgacgtgaatagttcatgaggtagatgagtgtcattacaggtacgcacccaggga

SEQ ID NO: 202793 - DNA, 601 bp, Human
cgcctgtagtctcaacactttgggaggccaaggcaggtggatcacctgaggtcaggagttcaagacccacctggccaacatggtgaaaccccgtctctactaaaaatacaaaattagccaggtgtggtgggacacgcctgtggtcccagctactcgggaggctgagacaggagaatcgcttgaacccaggaggtggaggctgcagtgagccgagatcatgtcactgcactccagcctgggcaagacagagtgcgactccatctcagaaaaaaaaaaaccaacatgcatataactaaaacaraagtttcatcaaatacatcttggtgcatgtgatacactcaaatatgtttatttcattaagaaaaagggctggtcagaaaattttgtgtaaaggttgctgtcacatttttaaaaatctttaaaaatgtaaaccattcttaacttagcttgcaggctttacaaaaacatactgtgggatggattaggtttgcaggcagttggcctggattttccagagtgcctactaaattaatttacctaccaccagcctgcagttaggaaaaaatggctctggtttgaactctgaatgttaatgagaaaa

SEQ ID NO: 202794 - DNA, 601 bp, Human
tgcctcaaggcgttcaaagaagaaaactttccaagatactaagaattgataggccaccaactttaagctgccataggcaggttattttcaagtgatcatgaggaaaatgaagctctccctatccagtgggatgggcactagccccacatggctatttaaagttaattaaaatacacaattcagttccttagtcacaatagctagtggttagtgtctgccatgtgggacagtacaactacggaacattttcatcatccaaatttctatcggacactgccgaagtgtttgccagtggtgtcasattttaaaagaatgcaattcggacatcgtgggaaggaactagtgtctggtacatcatgggaattaagaagtgctttggatacacagcatgcaaatgcaggacaatttactcttgccctgccttggtggatcctcatcaggccttaaggcatagaaggcctgtcccttgctcataaaattaacctcagttgcagagaccaacacagagggacttcctcattgctgagcaacggaaatacaggtttctccagttcatggcactttccagaagaaggaatccttattggcaagtgttaggatg

SEQ ID NO: 202795 - DNA, 601 bp, Human
atttcttgtattgaaagaacaggccgggcttggtggctcacctgtaatcccagcactttgggaggccgaggtgggtggatcacttgaagtcaggagttggagaacagcctggtcaacatggtgaaatcctgtctctactaaaaatacaaaaattagcccgacgtggtggtgggtgcttataatccagctactctggaggctgaggcaggagaattgcttgaacccgggaggtggaggttgcagtgagccaagattgcaccactgcactccagcctgggtggcagagcaagactccgtctcaaaaaaaaaaaaggaacaatgtctattcttcccaatttattatgagtaatcccaaggaggggggaggggtttaaaagtagaccaactgattttgaagttgatttgtaaaaataagtatctaagaatacccaagaaaacttgaaaaaagaatcagtgtgtgaagcgaaatatgtcctatttgttgttaatgtactataaggcacgataatcaaataggaagtatgaaaggaatacacaaggacctaggaatgtcaaaggaacttgaacaggtctgagtatgtattcctacacactgctaata

SEQ ID NO: 202796 - DNA, 601 bp, Human
tacagccaacctcaaacttcttttctgtgttaactatatatgatctgtatgggaattccagctggtctctttattgactctgatggtgggagctgttatatatagctttattagcagtagcccaagcgttagagaaaattgagaaataacatgttaatagtttgagtaaggtgcaaaagtgaatccataaacaatgaagtcattcagtgcttagtataaaagaaaaattaggctgggtacggtggctcatgcctctaatcccagcactatgagagtctgaggtgggcagattgcttgagcycaggagttcaagaccagcctgggcaacgtagtgagaccctgtctctagaaaaactttttaaaaatagtttattaattaaaaaaataaaaattaaaagaagatgatacagatagtgataggagaggcagtatagattagagatgaaagtatgaagttggctttcagatagtaataggtatacttcgtggatctatgggcaagctggataacacctcaagtttgtttctgcattggtaaaatgggatgataatagtgcctctaggattgttgttttattgaaatgagaaggcatataaagca

SEQ ID NO: 202797 - DNA, 601 bp, Human
tcaagttcctgctgagtttgcaggctctgaatttctctcaggattttgctgcttgcccccttatttaaagcagttttctttcacgtttcagccactgcctttgtgtcaaatctattggtattttgagagcgagcagtgctaggtggatgtgattttggcatccaaaatcaatttcattatcgttcatgaacaagctctttgaatagtgggtcttacactcgtggctctttttctttttcctcttttggtattgagtattcgaatattttacttcagatgttgtggatacatacaaacccayatttatgaaacttgttcttttaaacattcagattccacatgggagtttctcagactgattcttgacctctcaatgaaagtgttgaaacaggatgggaaatattttacacaggtaggctacttaacagttttttccctcaaaacgctctaagactttcctgttttgaaatctgaatgcacatttttgaaatgtatatctattaaggatagagcggcatcatcggattatgttctttcaaacagtaagcttctacgttgacctgttgtctgttgggaattaatgagttatcagccctggtct

SEQ ID NO: 202798 - DNA, 601 bp, Human
ctgtagatggatataactatttaaagcaggagtctgcaaacattgggccaaatctggcctcctgcttgcatgtttgtaaagttttcttggcatgcagacacgcccatttattacatagtgtctgtggctgcttttgtactgagtagttgtggtagatactgtatgatctgcacagcctaaaatattttctatcagaccctttacagagaaagtttgctgatccctgtcttataggaaaccagtgaaacctgctcaaatgaagctttcttattgtaaagaagcaagttggacttatgatggttttttttttttttttttgagatggagttgcgctcttgtttcccaggctggagtgcaatggcgcgatctcagctcaccgcaacctccacctcctgggttcaagcgattctcctgcctcagcctcctgagtagctgggattataggcatgtgccaccacgcccggctgattttttgtatttttagtagagatggagtttctctatgttggtcaggctggtctcgaactcccaacctcaggtgatacgcccccctcggcctcccaaagtgctgggattacaggcgcgagccactgcgcccagc

SEQ ID NO: 202799 - DNA, 601 bp, Human
ctgcctcagccttccgagtagctgggattacaggtgtgagccaccacacctggctaatttttgtatttttagaagagatgggatttcaccatgttggccatgctgctctcgaactcctgacctgaagtgatctgcctgcctctgcctccaaagtgttagcattatagatgtgagccgccacacctggccccttaaaccttttctaataaaaggactgcccgtaagcccaacacagggagacatatttaagctggactcctgtctccttgttagttgacttacaataaaaagcttttcttargccaggcacggtggcttatgcctgtaatcccagcatttggggaggctaaggcgggaggattgcttgaggccaggagtttgaggctgcactgagctatgttcacagcgctgtacttcagcctgggcaacacagcaagaccctgtctctgaaaagaaattaaaataagctttgcttttcttaaaaccccagtgtcctaatattgacttcaagcacattgggcagtgagcccctttttcttcgatagtgccaggtgtgaccccaccccttgttccatcccttcttcttatccttaatgagtgc

SEQ ID NO: 202800 - DNA, 601 bp, Human
cagctccaaatatcacatctaggtcatagcttagaagaaagttgaagaggccggtggctctttctttgttcagaatcaaaagcttttccagcagctaccagcagacttccagtatatctcattgactacccctagctgctggagatgctgaaaatggggtgactgggaagggagaaatgttagaataatgaagttaagagaaagtttttgataaggtgtgcaactaggggatatccctatcgtatatatcctgaataaacttttgttctcttatacacagattctaggaaaaaaatggggktgaatatagttctgtgtcaacattttagactcttaggagaattgtagtttaaaccattgtggaaatcaggaacactatatttttgatacttcatttgtaatataatggtgaccgttattgagaaaatttcctttgaatgagttatttgtatgaatctttgcaaattgcatggttttaattcagtgagtgtcactaataagaaattggtttcactgctttctatcatttcatattctaataatttgaaatggcttggtaaatgaggtagaaggataacgagctctaatgggtctataaata

SEQ ID NO: 202801 - DNA, 601 bp, Human
gaaatggcaggaactgaggtcaaggtacaagagcgttgtatgtttgcggtattttgtatatttcatcatagtaagaatttccagtttagagaaaagaatacaggggttgggtcattaagagttttgcataacatgtaaaatatagatcttataccataggcaagggtttgtcgctgtaagcaatatgtacatgtattttagaaagattaatcattctggctatctgtggggagagattggaagggtaaaatgaggtatggggagaacaactaggagacttttgttatagaccagaagggaracaatagtggtctgtacttcagtgacagcaagcatgaagaaatatgaaataagggaggctctaaaaatgtcaaattgatgagagttataattgactgcatgtggggaagtaggtgatgaagagacacagtcaaagatgaaatctgcctttctgatctggggcaattggaggggtggtgatgttactcaccaagagtttaaatgaatgaaaattagtatctatacagaaaccttcatggagcaatgtccctgaaccatcctactatttttttctgcttagcttattatacaatacttagag

SEQ ID NO: 202802 - DNA, 601 bp, Human
gaataacaatacacacatcataagtttcttgtgagaattaaatgagcttgtgtatctaaagcatttgccacagcagcaggcagatatgaatcagccaataaatattagatacattattgtctatttgcagtttattggtttgtttttgttctggagaaggagatgacattttgcataatgttcgctgaacagagaaatataaggtttaaattctattcctatttttggtattgcttctcttggagaaattttgtttcctcctctaaagctgtcatttgcctttttttttttttttttttttaaatcagaatctctctctgtcgcccaagctggagtgcagtggcatgatcttggctcactgcagcctccacctcctgagttcaagcgattctcctgcctcagcctcctgagtagccgggactacaggcaagcaccaccacacccggctaatttttttgtattttttgtagagacggggtttcaccatattggccaggctcgtcttgaactcctgacctcaggtgatccgcccacctcatcctcccaaagtgctgggattacaggtgtgaaccagcatggctggccacccatttttatattt

SEQ ID NO: 202803 - DNA, 601 bp, Human
tagcattgttaatatgttaactacaagatatgcaattcttaattatttacactgaaatagtttcttcacacagtagttactgatctctcaattataaaaaggaaaaagtgttttcacaagaagatttcattttcagttcatctttgttaattatttattgagaacctgctatgtactgagcactagtatgattaaaattttattacctcaaaacaaagttgctcacattagtatttattttatctgtataatcaggttctcttctgggatttctatttgcattaatattacaattcttttmaatataaagtaaatattaaaattattatatccagcatgcccgttgattatatccatttttaaactttccaattgatttcaaactctttcagcagatgtttgaggctacaaatgttctcttatttatctcatgatttcctaagtacctagcactgatgtacattaatgtgaactcatgatgcatttgctcacatgagttgatagagcgcctagtaacacacttagcatacctgttgaaagaatgaatatattaatgatatgaggtgattattgaaaatctcacattgaaccttaaataaga

SEQ ID NO: 202804 - DNA, 601 bp, Human
gtatctaagtaggaaagtcacatcttcaaggttaaaatatattagcacatggatagtaaagtggtgtgaaaattataaattcttacaatttgtatatgcaaggtggttttttaaaataatatatcttaatagcttattttcttttagttgtctgtacatttataatcttaatgcatattgacaaaaaataatcttgatagcggttaaccaacaataaacatttacaaaatctgctgtgtatatttactctctctctctctctgtagatagatacatagatagatagatagatagacacacmcacagacataatttcctatgttactagagaagagataaatgccgaacattgttgaatgtctctaattctcaagtattttttagtgtttctaattctcaaaagatacataaaaagacaaggcaggcaaaattgttgctgcttatatttcaagattgataacaaaagagaaactgggaaaaactaggttagagaagtcttaatgggagactgctatagagtccagaataagaaatcccaggattaaggaactaatttatgtcactgtaactcaagttggaagagtcatcatctctatggttt

SEQ ID NO: 202805 - DNA, 601 bp, Human
aatgagagtatatgaattgattgacaaattgagattttcttatcctcactaaacatttattaagcacctattatgtatcaagagtaagagactgtatgctccttgaagccagctgccatgtttgtctttattatcgctgtatctccagcattaatatagtcggcatgttgactagtaaatgacaggcatttaataaatatagtttgaagaataacagatgacctataattgcacatacaaaagataatgcaatattttaaatgctataataatatggacaaattcctgtgggatttcaggrtagaaagtgataaatgccagctagagagacttgggtggtgggaggctaatgaaaaaacagaagtctttaaaatggggcttgaataataagtagaagtttgacaggttgagagcaaggagttattctcattagtataattagtatataccaggaagagaaaactcaaatgccttaaggaaccaagtagccagcgttcacgagagaggcaggttgggtaggatctgtggggaacctggtgagcctgagctccacctaaatgggagcagccactcctttcttgccagttgttgctttgtgaga

SEQ ID NO: 202806 - DNA, 601 bp, Human
taagccattttacaacagaggaataagtaaatgaagatgataaatcataccagagagcattcctaaatataataaaaaacatgaaaaattgtaaccttgtcttttgtgcacaaaggcacctttaagggtgtctccagtgagtgctacattaacacagaagtttagttaattacagccactattctcacgtaccttaactgagtgtgaataccaagccatctaatagtgtgcccctgagcattaatacctaatgaaattggattccttgttttctctaatgagctcattgcttttctaaatrtggtcattgcaggtaaatgatcaatagccttgaaactgataccactactgaattattttggcaagatggaaatactcttatttgtgtaaaataagaatttttgaatatgcatttcagatcactttctaaataatgtcatgtatgacaggaatgaccatagtaggctagtttgtttcagtggctggcttatacagtaagaaattgtggagagtcgctgtctgatttacagcacagtgccttcaaacttgtatcacctagcttgagctaaagtgaactggatgcagcgtgttcctgttcatt

SEQ ID NO: 202807 - DNA, 601 bp, Human
ctaaaaatacttaaaaaaaaaaagtagcctggcgtggtggcgcatgcctgtaatcccatctactcgggaggctgaggcaggagaatcgcttgaacccagaaggtggaggttgccgtgagccgatcgcgccattgcactccagcctggggaaaacagcgagactctgcctcaaaaaaaattgtttttaaacatttgtaactgtttaaacaattttttagcacatatgcatcttcttaaatggggtacctagtgatgttttgatacatataatgtatagtgatcccattagggtaattagcayacccatcatctcaaacatttattttttgttggaaacattaaatatccttttttctagctatttgaaattatatcattattaacaatagccatcctagagtgctatagaacaggggtccacaacccccaggccacagaccagtactagtccgtggcctgttagtaactgggctgtgcagtgggaggtgagcagtgagcaagtgagcattaccgcctaatggtggacagaagctccaccttctgtcggatcagcggcagtattcgattctcataggagtgcaaaccctgttgtgaactgcac

SEQ ID NO: 202808 - DNA, 601 bp, Human
actcgggaggctgaggcaggagaatcgcttgaacccagaaggtggaggttgccgtgagccgatcgcgccattgcactccagcctggggaaaacagcgagactctgcctcaaaaaaaattgtttttaaacatttgtaactgtttaaacaattttttagcacatatgcatcttcttaaatggggtacctagtgatgttttgatacatataatgtatagtgatcccattagggtaattagcatacccatcatctcaaacatttattttttgttggaaacattaaatatccttttttctagctawttgaaattatatcattattaacaatagccatcctagagtgctatagaacaggggtccacaacccccaggccacagaccagtactagtccgtggcctgttagtaactgggctgtgcagtgggaggtgagcagtgagcaagtgagcattaccgcctaatggtggacagaagctccaccttctgtcggatcagcggcagtattcgattctcataggagtgcaaaccctgttgtgaactgcacatgcgagggttctgagttgcatgctccttacaagcacctaatgcctgatgatctgagctgg

SEQ ID NO: 202809 - DNA, 601 bp, Human
ctgtgcagtgggaggtgagcagtgagcaagtgagcattaccgcctaatggtggacagaagctccaccttctgtcggatcagcggcagtattcgattctcataggagtgcaaaccctgttgtgaactgcacatgcgagggttctgagttgcatgctccttacaagcacctaatgcctgatgatctgagctggaacagtttcatccaaaagcatccccaaccccctacccactggttccatggaaaaattgtcttgcacgaaaccggtccctggtgccaaaaaggttgaagaccactggtatrgaacactggaacttattcctcttatctagctgcaattttgtatctcttaacaaatctctccttgttccttggcccctacccttcccagccttcagtatcctctgtcttattttttacctcgaggtttttttttctgtttgtttgtttagacggaatctcgctctgtcgccaggctgcagtgcagtggcgcgatctcggctcactgcaacatccgactcagtggttcaagcgatgctcctgcctcccgagtggctgggattacaggcacgcaccaccacgcctagctaatttttgtatttt

SEQ ID NO: 202810 - DNA, 601 bp, Human
aaggttcagggaactggtaccttctagctctaagtggattcttagagtcatctgcacatcatttccaagtaaaaatggattacagtcgtcaagttgtatgaaattaatgctcaatctgcttacatcctttacatagcttaagcatttataatatatcattggagcaataaataagacttggggcctttatatattttatttattggcatcttttcatttattggttttctttgctaattattttatatttataaacttcatatataaagataatatttttcttcatggaactcagtattcrtgataaagaaacaatatatatttttaatagactcaaggtgtcaacagttatcatctattgttatatatatatatattttttggtgagtaaatgtcagcacagtgacatgaaatgatgtttttccataaccataactcaatggtggaagcagccacagatatttaaatatatttagctctggttttatctcttccagacgtgacttatttctctacccccacccttcatgaggaagtggattcatttcctggcccagaaaggcttcaattgtcagtgcttaagggaaaatattctaatacg

SEQ ID NO: 202811 - DNA, 601 bp, Human
ccttatggcttcttctatcctgaactggcaaaaagaagtcttgaaatattttattctgcttccctgtgtcaaattttagccaattattatttttaaataaaaaaaaattaaagtgattatttattcaatatttattaagaaatttttgtaggacagatatgctaccttcgattcagcaatcggctacaatatttgtgaatgagacattttccagagtaggaggcaaaaaggaaaacatttatttagtttccactatctaccaggatgctctctgctagcataccaacaacaaaactaagtrgtgaactgtggttaaacaagcaataatgtcaataatctcatattttttagttttatgaaaacattaggggtacttatgttcaagttcatacaaagtctgacttttaccggaggggtgtgttaatgttacctacttgtctgttttttttgctatgtctctgtgagttaatatggttccttcttctgactctgctttaaccatatgccctggtcttccagtgaagctggtggtaactcgagcgttgatgattactgcagatattctagctgggtttggatttctcaccctgctccttggtct

SEQ ID NO: 202812 - DNA, 601 bp, Human
aaagtaagccccaaacttctacctccttacctatacccaccaccaccaactccaccaattctttttaacaataaactaacaattgtgccaagtcctatgttaaacttgtcccacgtactaacccatttgttcataaatgtaacaataaacagatcatattgttatcctcacttaagatgcagataaataattgaagttctgaggactggtcaagcatatttattagtcaagcatgactaataaacaacatatcaaaaagcactttaagtagtatttattagtgaaacagcaaaaatgataytttattcaggtctgtcttcaacttcaaagcttagtcctcttcttttgcaacataatgtcttcttcttgtctgttagcaggaaaaatcttgtctgctaacaaagcgaatataagtggcagcctgaccaggcagtgtggggtagtacatcgatatggagtttggaactagaaacacttgtagatatgtatgtgtgatatattcacccgtgtctctgtttcctgatctgcaaagaggcatgaggctaaggtagtaacatgtagcctgaattgctatggtgaagatgcaatgtgggcacagcaa

SEQ ID NO: 202813 - DNA, 601 bp, Human
ctgaggactggtcaagcatatttattagtcaagcatgactaataaacaacatatcaaaaagcactttaagtagtatttattagtgaaacagcaaaaatgatactttattcaggtctgtcttcaacttcaaagcttagtcctcttcttttgcaacataatgtcttcttcttgtctgttagcaggaaaaatcttgtctgctaacaaagcgaatataagtggcagcctgaccaggcagtgtggggtagtacatcgatatggagtttggaactagaaacacttgtagatatgtatgtgtgatatmttcacccgtgtctctgtttcctgatctgcaaagaggcatgaggctaaggtagtaacatgtagcctgaattgctatggtgaagatgcaatgtgggcacagcaaactgttagctgactgcctaaccctttgtatgctcagaacttgggcctccctgacttttgacacagaaatgttaagtcaacgtcctaataatcctcagattgtattataaagttacaaaaatttagaattcttcccttctgtaagtcatttatttaattatcccacctactgacagcatagaactttttaatatacaat

SEQ ID NO: 202814 - DNA, 601 bp, Human
attcaggtctgtcttcaacttcaaagcttagtcctcttcttttgcaacataatgtcttcttcttgtctgttagcaggaaaaatcttgtctgctaacaaagcgaatataagtggcagcctgaccaggcagtgtggggtagtacatcgatatggagtttggaactagaaacacttgtagatatgtatgtgtgatatattcacccgtgtctctgtttcctgatctgcaaagaggcatgaggctaaggtagtaacatgtagcctgaattgctatggtgaagatgcaatgtgggcacagcaaactsttagctgactgcctaaccctttgtatgctcagaacttgggcctccctgacttttgacacagaaatgttaagtcaacgtcctaataatcctcagattgtattataaagttacaaaaatttagaattcttcccttctgtaagtcatttatttaattatcccacctactgacagcatagaactttttaatatacaatgtaattcatttaacagatttaaacattatttaatctaattatttacggctatataattttgttcgagaatatttttgagctatcatcagtaaataacccatcttat

SEQ ID NO: 202815 - DNA, 601 bp, Human
tgcaatgtgggcacagcaaactgttagctgactgcctaaccctttgtatgctcagaacttgggcctccctgacttttgacacagaaatgttaagtcaacgtcctaataatcctcagattgtattataaagttacaaaaatttagaattcttcccttctgtaagtcatttatttaattatcccacctactgacagcatagaactttttaatatacaatgtaattcatttaacagatttaaacattatttaatctaattatttacggctatataattttgttcgagaatatttttgagctatmatcagtaaataacccatcttatgtaaaacaacaaaacaaatagcatttaaaaaataagtcactgaagaaaatcctgataggaatgactgaagaaataactaaattgaaagacaaagcatgtcctaagctttggaaactttagaattagtgtgctataaaatttatttttaaagtctataatctgttttgaaggtttagaaagggaatttctaactgaaaactgcagataatggcattatagcaatgctattgcaatatatactgcgttttctaaaggttatgtgtttattatctggcttt

SEQ ID NO: 202816 - DNA, 601 bp, Human
atatacccttgtatatatacgtatacatagtacatatgtatacacatatacacatatgtatatgcatatatgtatatgtatacatatatgtataattgtaatacatcaaaataactattgtacatttgaatattggacatagttgtagttgtggattttttcaattaatgtaacactaacttggtaataatgtttgagtattgtaattcagttgcccttgaacaattggaatttttaatggtaattggaatttttaatggtaacaggtaggaatacacccatgtatatgcatgtatatatrcacacacgtatatgcatgtatatatgcacacacgtatatgcatgtatatatgcacacacgtatatgcatgtatatatgcacacacgtatatgcatgtatatatgcacacatgtatatgtatgtatatatgcacacatgtatatgtatgtatatatgcacacatgtatatgtatattagaattatacatatatgtgtgtctatatatacaattatacctttataattgtatgcatatatgtagatatacatataattgtaatacattaaaataactattatacatttgaatattggacatg

SEQ ID NO: 202817 - DNA, 601 bp, Human
tagttgtagttgtggattttttcaattaatgtaacactaacttggtaataatgtttgagtattgtaattcagttgcccttgaacaattggaatttttaatggtaattggaatttttaatggtaacaggtaggaatacacccatgtatatgcatgtatatatgcacacacgtatatgcatgtatatatgcacacacgtatatgcatgtatatatgcacacacgtatatgcatgtatatatgcacacacgtatatgcatgtatatatgcacacatgtatatgtatgtatatatgcacacatgyatatgtatgtatatatgcacacatgtatatgtatattagaattatacatatatgtgtgtctatatatacaattatacctttataattgtatgcatatatgtagatatacatataattgtaatacattaaaataactattatacatttgaatattggacatggttgtagttgtgaattttctatatatatatattttgatgtattacaattatacatgcatatatatcttcacccactcaactaaatgtatatttagtgttaaactgagaagtggactaagatccagccaaatacttcttt

SEQ ID NO: 202818 - DNA, 601 bp, Human; identical to SEQ ID NO: 40035

SEQ ID NO: 202819 - DNA, 601 bp, Human; identical to SEQ ID NO: 40036

SEQ ID NO: 202820 - DNA, 601 bp, Human; identical to SEQ ID NO: 40037

SEQ ID NO: 202821 - DNA, 601 bp, Human; identical to SEQ ID NO: 40038

SEQ ID NO: 202822 - DNA, 601 bp, Human; identical to SEQ ID NO: 40039

SEQ ID NO: 202823 - DNA, 601 bp, Human; identical to SEQ ID NO: 40040

SEQ ID NO: 202824 - DNA, 601 bp, Human; identical to SEQ ID NO: 40041

SEQ ID NO: 202825 - DNA, 601 bp, Human; identical to SEQ ID NO: 40042

SEQ ID NO: 202826 - DNA, 601 bp, Human; identical to SEQ ID NO: 40043

SEQ ID NO: 202827 - DNA, 601 bp, Human; identical to SEQ ID NO: 40044

SEQ ID NO: 202828 - DNA, 601 bp, Human; identical to SEQ ID NO: 40045

SEQ ID NO: 202829 - DNA, 601 bp, Human; identical to SEQ ID NO: 40046

SEQ ID NO: 202830 - DNA, 601 bp, Human; identical to SEQ ID NO: 40047

SEQ ID NO: 202831 - DNA, 601 bp, Human; identical to SEQ ID NO: 40048

SEQ ID NO: 202832 - DNA, 601 bp, Human; identical to SEQ ID NO: 40049

SEQ ID NO: 202833 - DNA, 601 bp, Human; identical to SEQ ID NO: 40050

SEQ ID NO: 202834 - DNA, 601 bp, Human; identical to SEQ ID NO: 40051

SEQ ID NO: 202835 - DNA, 601 bp, Human; identical to SEQ ID NO: 40052

SEQ ID NO: 202836 - DNA, 601 bp, Human; identical to SEQ ID NO: 40053

SEQ ID NO: 202837 - DNA, 601 bp, Human; identical to SEQ ID NO: 40054

SEQ ID NO: 202838 - DNA, 601 bp, Human; identical to SEQ ID NO: 40055

SEQ ID NO: 202839 - DNA, 601 bp, Human; identical to SEQ ID NO: 40056

SEQ ID NO: 202840 - DNA, 601 bp, Human
cactggggcagggcagtgctgacgatggcgccgatccatcccaggaaggcgagaatgaagcccaacagctgcagccccgcgttggccatgactcgctcgggcgcccgcgctggctcaggggtggcaggtgcagaaggcggagagtttgcaggtgggcaacccggactcccgaaggtggctgggccccgcggaggaagttaaggcggggagccctgctcgctgcgccgccgctggagaagctctgggtcggggttggggtccgcgcccggggcggcgctggagtctggatactagaagctgmggttgctcccaggctcgggaactgagacgcagaaccgctgggcgccgcgatttaaagcagctccgcccgcctcagccccggcagccggggagcgccccctggcggtttcagggcggctcaccgagagggcgccgggagcgcccggttggggaacgcgcggctggcggcgtggggaccacccggcaggaccaggcaccagagctgcgtccctgctcgctttctctcgtggatcttctcgctcctgtaaggcgtttcacgcttttcattcattcactccaattatccaaaaattactatgca

SEQ ID NO: 202841 - DNA, 601 bp, Human
agtgcaatggtgcgatcccagctcactgcaagctccgcctcccgggttcaagtgattctcctgcctcagcctcccgagtagctgggattacaggcatgcaccaccacacctggctaattttgtattttttagtagagatggggtttctccatgttaggctggtctagaactccagacctcaggtgatcagcccaccttggcctctcaaagtgctgggattacaggcgtgagccaccgcgcccagccttaattggctcttttaagaaaacaatttcattgagtatctgatagcaggagaagrgagaaggataattattcatgttccttatttgtaattttaaaatatttcattttgggatgaataaatttacagacaattctgccataatgtgacatatgtattcctaaaaattaccacgctatgcaaaatcaggcaatccaaaaccacagggcttatgagaaaaatggggttagggacataacattcaaaaacttcctcagtgacccattaaaaaatcataggaatgttatatagattgagcatcccttatcagaaatgcctgggacaacaagtatttcagattttttttttttttttttt

SEQ ID NO: 202842 - DNA, 601 bp, Human
tggcaaatggagtgcaggagagggggcagggaatccccggatggcagctgtgcacaggcagagagataacccaggcctgccacccctgggagggatgcctgcaagacgatgaaatgcagatgggacttgaggcctctgatcttgggagattttgattgttagtgaagggtttagggtggaatctggattcaggattcagaaaacttagcagataaaaaggtaagagaatgacctccagggaaaataaaaagaaaagatgtgcataaaaagaaaatacaagcattcgtttaagttaattgcrtggcagagctctgagcagcatttgcgcagttaaaaacgtacagtcaatctttaatgtgaatattgatctatattgggatgatggcgagatgggaagtttacattgcaagtgatggaactgaatggaaatggagttcagtcctcatcttccatagtgagaagtcaatacactttgcctaaaatgaaaaatcaagacacagcaatacacacatagtagctagacttgaaggaaagtatccaaaaaccctatcaagagttgaaattggtggcctctgggcactttctctgttatacgtcttac

SEQ ID NO: 202843 - DNA, 601 bp, Human
aaaaggtaagagaatgacctccagggaaaataaaaagaaaagatgtgcataaaaagaaaatacaagcattcgtttaagttaattgcatggcagagctctgagcagcatttgcgcagttaaaaacgtacagtcaatctttaatgtgaatattgatctatattgggatgatggcgagatgggaagtttacattgcaagtgatggaactgaatggaaatggagttcagtcctcatcttccatagtgagaagtcaatacactttgcctaaaatgaaaaatcaagacacagcaatacacacatagwagctagacttgaaggaaagtatccaaaaaccctatcaagagttgaaattggtggcctctgggcactttctctgttatacgtcttacagaatggtttgaattttttaagcaatatgactgtataactttaataaaaaactaaaactaaatgtagtattttgcagaaaagagttaacattagcaggcctgagacttaggcctgttcgcaaggttggcccttggctggcctctgggagcttacattttgcaagggtacccaccatttcccagtaaggatggctcactgcataaactcttaaac

SEQ ID NO: 202844 - DNA, 601 bp, Human
gtgagaagtcaatacactttgcctaaaatgaaaaatcaagacacagcaatacacacatagtagctagacttgaaggaaagtatccaaaaaccctatcaagagttgaaattggtggcctctgggcactttctctgttatacgtcttacagaatggtttgaattttttaagcaatatgactgtataactttaataaaaaactaaaactaaatgtagtattttgcagaaaagagttaacattagcaggcctgagacttaggcctgttcgcaaggttggcccttggctggcctctgggagcttasattttgcaagggtacccaccatttcccagtaaggatggctcactgcataaactcttaaacaattgataaacaatgtggttcatgctgaatgcctgtgagtctgacattttggtacgtgctaggcagagggtgcttatatgaccagcccacaatacaaaccctgggacttgagtctctaagcagcttccctggtagagagcccttcacacgtgttgtcacagctcactactggggcattaagctctacctctgactcccctcagggaggagtcttggaagcttgcaccctgtttcccccaa

SEQ ID NO: 202845 - DNA, 601 bp, Human
gtgttgcaactattcaactctggttgtacttcaaaaagagcaatagacaatatgtaaatgaatgggtatggctgtgttccaataaaactttatttatggacactgaaatgtgaatttcatattattttcacatgccttgaaatactattttgaatttttttcaaccatttaaacatgtgaaagccattattagctcacaagcagtaccaaaacaagtggctggtggctggtggctagctggatttggcctataggctacagtttgccaacccctgtattagaccattgatagattgcgtgygcacgtgtgtgtgtgtgtgtgtgtgtgtgtgtgtgtatgtgtgtgtgtgtttatgatctaaacttgaccttgggcagccaaaaccttaggtcacatacactgctgtgaagctgtatcctcccactagctatttatacagacagctccttttattttaaacttgatttaaactgtatttttagctgttaaatttcaattttctaattttgtcccattggtataatctgttgtcttagctattcttcccatctgtgtgtttccacaggattgtttagcatctttctccttgtcatatcacat

SEQ ID NO: 202846 - DNA, 601 bp, Human
agcctccatcccctagttgccagtagtgctcccagccaccactaacaagagccctatggatttctggaactccagtggctataacttgtgttttgttttgttttgttttgttttgttttgtttgagatggagtttcgctcttgttgcccaagctggagtgcagtggtgccgtctcagctcactgcaacctctgcctcccaggtttaaggattctcctgcctcagcctctcaagtagctgggaagcatgcgccacgacgcctggctaattttttgtatttttagtagagacagggtttcacygtgtgggccaggctggtctcgaactcctggcctcaagtgatctgcccgcctcagcctcccaaagtactgggattacaggcatgagccatcgcgcccagccggctttaactgttttgtggaactgtgttgtctaactagctagtagcagctttcctgatgttagacagatgtgttttccattttgacccattgtgaaaacatatttcttttctttcttctaccctttctttaatcactttgctgtaagtgtgtttcttggtaataacattgtagctgcttttaattttttatcccagtcag

SEQ ID NO: 202847 - DNA, 601 bp, Human
gctgttctgacaccattatttctgacatgtctgtgtagtcagtgtgactcattatagtgaggagacaattttgttctttccccaaacttctgaaaggggaattcttaattcttaattttatctagtatttgaggtgtgcctttgctttatttttttaagacagagtctcgctctgtcacccaggctggagtacagtggcacaatcttggctcactgcaacctctgcctccggggttcaagcaattctcctgcctcagcctcccaagtagctaggattataggtttgcgccaccacacctgrctaattttagtatttttagtagagacagggttttgctatgttggccaggctggtctcgaactcctgacttcaaatgatctgctcacctcggcctcccaaagtgctgggattacaggtgtgaaccaccgcgcctggcccacctttgcattttttaaatggctgataatacttttcctaactattccttccttaccttggatcacgtggcttggctttgtactgagaaactgtactttggtgaggggaactgggatttagtaagcacctaagagagatggccagagcctgtcagcatacttc

SEQ ID NO: 202848 - DNA, 601 bp, Human
gttactattttgaatgaaatctttttttaagcttttattttcttttttgtggctgatatatagaaatactgttgtttacaacaaaatgctgaacgccacctaggtctaatcatgtgtctatataatttcttggatttctttgatgtgggcagttgtattgtccataatttatgatgtggaaaccaaagctatagaaaagttaggtaattttacaaagaacataatatcagtaaatgacactaagtatgaaattaaatagtaactattatcaatccccttacagtattcattctttgacctwgtttttttccatttgtaatagtgttagcgtccaactgtcagctcatgtccaaatgtcggctcatgaattcctctttaatagctggacttcttttagcctctggctgtgtgagggtctcttgacctcagtgatctcacatgtgccactctgtccttctagaacactattctcctcgcctttgctaaacttgccttaaaagtgatttcctcagagggaccgctaataatgatcttgtttaaactttatgcccttcctactactatcatctctctctctcggtaccttttatttctacacact

SEQ ID NO: 202849 - DNA, 601 bp, Human
taatgttcttacttgtagagtcgtgccccaatttctgcaaaacttgtggccaatatgctgtcggtggctggggcggatcacatcatcaccatggacctgcatgcttctcagatacaggtatccgtgttttccttctgcaaatggttaaatcaagtctgttaaattaaataatcttaggtaacattacttgtgtttgagtttatatatggctactctcttggatttttgtctttactaaacttgaaaatataatttgatattagtacttccagtctctatcaccaccttgccccccagtcarttttggaggagtggggatggctttttggtagtaagctctatatagttccatctcagcttatggaaaataattagaacggcagtcataatgtacactttttaacttcttcataacttattttctttgtctctaaaacaggccaaattatactgtgccactttgtgttatataatgaacgtgaagtatttgatttataataactacttaagagacaacaaaccttttccctcaccgtcctgcatagccattctattcctcagaatataggccatcataagacaatggaatatgtcccaagag

SEQ ID NO: 202850 - DNA, 601 bp, Human
accctaggtgggcagtcacggggtggagggcagcgctgtgtcacgtagcctattactgtacggtgtgtaatgttcacaaaaatgcccttggccaagaatcaaggttgaatgacgctgagagtcctctgcaaaagattgtgagcaacattttggagtcatatctactagaaatgcttgcagttgacttggaaacttctgcaagtcacatggaatctgcattcaaatgaggcaaatgcactggcccagtggaaggttagaggcaaagaatccagccaaaggggtacaggagcgagcgtcagakgtaactgggttataataacagctttgttacaatgtaattcaaatacgtacaattggccgggtgtggtgactcacacttgtaaccccagcactttgggaggccaaggcaggtggatcgcttgaggtcaggagttcgagaccaacctggccaacagggtgaaaccccgtctctgctgaaaatacaaaaattagctgggcttggtggtgcacgcctgtaattccagctattcaggaagctgaggcaggagaatcacttgaacctgggaggtggaggttgcagtgagccgagatcacgccactg

SEQ ID NO: 202851 - DNA, 601 bp, Human
ctgcattcaaatgaggcaaatgcactggcccagtggaaggttagaggcaaagaatccagccaaaggggtacaggagcgagcgtcagatgtaactgggttataataacagctttgttacaatgtaattcaaatacgtacaattggccgggtgtggtgactcacacttgtaaccccagcactttgggaggccaaggcaggtggatcgcttgaggtcaggagttcgagaccaacctggccaacagggtgaaaccccgtctctgctgaaaatacaaaaattagctgggcttggtggtgcacgccygtaattccagctattcaggaagctgaggcaggagaatcacttgaacctgggaggtggaggttgcagtgagccgagatcacgccactgcactccagcgtgggtgacagggcgagagtccgtctcaaaaaagaaaaagaaaataccaaaaaactccaaatacgtacagtttacccatttaaagtgtacagttcagcagtgttttacatattcagagatttgtgcaaccatcactatctaattccagagcatttttatcaccccaaaaagaaaccctgtacccattagcagtcactccccatt

SEQ ID NO: 202852 - DNA, 601 bp, Human
taacactttatatctcaaccagtgatgccactatgaataatttggtgtactatgtatctgtctctcctgggggagctgatatggcacatgcacccacagagaaaagattgtaaatatgtgcccagaagaaatccaaaactgtatgtatataattttcgttctgcctttttctgcctaagatttcagtgtggtatgttgtgtcaacatcatttgttaggagtatgtattaggtctccatgatatacaaggaaaagaagagttacctatagctttttcaggaaatcatagcgttctaacaacscaggaagctgtttgcaggggtattttctcttatcttcttcttctgacattaccattggataccttttagtggctagggctccccactcaagtgagatgtctgtgtcccccactgccaagaaccacagagctcaccttctttcccagtcccacttccatgcctaccctgctgtctgcttgtgagcaggctcgtgagaacaggcgccacctggcagagagatgaaaacaggttctgctttaacttctccggtatagaacttccaccacaaagggcagtgcttcccagtgctgggctgtggat

SEQ ID NO: 202853 - DNA, 601 bp, Human
gatatacaaggaaaagaagagttacctatagctttttcaggaaatcatagcgttctaacaacccaggaagctgtttgcaggggtattttctcttatcttcttcttctgacattaccattggataccttttagtggctagggctccccactcaagtgagatgtctgtgtcccccactgccaagaaccacagagctcaccttctttcccagtcccacttccatgcctaccctgctgtctgcttgtgagcaggctcgtgagaacaggcgccacctggcagagagatgaaaacaggttctgcttyaacttctccggtatagaacttccaccacaaagggcagtgcttcccagtgctgggctgtggattggtatcctgtcatgcccaaatctgcctagtcgttaccaaataagcagacggtaatgtatgtggacattttgtgcgaggtgttcatgtgtcttgggaaaacctgtctcatgttcccagaaagtagctttccttacctggagtttgagtggcttttatgacattggcatgtagataatagaactgtacgtgtttttttgtttgtttgttttttgagatggagtctcgctcagtcgccca

SEQ ID NO: 202854 - DNA, 601 bp, Human
aacactggctgggcacagtggctcatgtccgtaatcccagcactttgggaagctgaggtgggcggatcacctgaggtcaggagttcgagaccagcctggccaacatggagaaaccctgtctctactaaaaatacaaaattagccgggagtggtggtgcatgcctatcaccccagctactcaggaggccgaggcaggagaatcacttgaacccaggaggcagaggttgcagtgagccgagattgtgccattgcactccagcctggtcaacaagagtgaaactgtctcaaaaaaaaaaaaaaraaaagaaaagaaaagaaacactggttgtgttgtgaaaatcctcagaaatagggaggggagcctggagcacctaactgcccttcccactgccttctcagccccagagagtgtcccctctgtccttcatcagagcacgcgaggagctccattcctggtcgtcatctgaggatgacacaatgagtaggactaggactttaaaactagtgtgtggaggttatatcctccatgtactgcgtcttaagttgggccatgtgtgtattggtccccaaagcattttttcagctaaattgcataatgact

SEQ ID NO: 202855 - DNA, 601 bp, Human
tctgtgccacaaactgggcaaatagtagttcctaaataacttactttaagttgtacctgtcatggttttaaaatgctacccacaaatactaacaaactgaatatcaaattcttacccagtagttctatccagtggccagggtgccctgacggtcattcctagctgccccaattgcaaggtccgccattagcacatttctccctgtggattgctaagtgcctgccccagaccatgcctgggctgatcaagagaggcctgattcttgcatcatctctcgggtgtggttgcctgctacattccyaaaatacaactttaaaggcgagatctctagttgactgtatgaacatgttcatttgtgcctttgccagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagtacgcagggcggtggggaaagcgttaggacttctcactaggaaagggaaacacatcag

SEQ ID NO: 202856 - DNA, 601 bp, Human
taaatgtgagtgaaatttgttgcatttttcttttacggagcacactttgtgcttttaccattcatactaggggagagtattccaagaatatttgcatacccttaatttttatcttctgctgttctacaggctgctgtcagctggagccaccaaagtgtatgctatccttacccatgggatcttctctggaccagctatttccagaataaataatgccgcctttgaggctgttgtcgtcacaaacacaattccgcaagaggacaaaatgaaacactgcaccaagattcaggtactgtctatrcaccaaaggcagccaagcagccaggcacctactttagatccttaaaaatagcatcatgtcttgtgtgtgtgtggctccttgctaaggcacatgcttggcagaggcggcagcttctcatgacggcaggatataaatcatattagatccctgaaaaaggccaggaccagcagaggtcaacgttcgctatttagaaatagagagtgaagaaaatcacaatggaaaaacagtcagaaacgggttgtgctaaagctaaacttagaattatcatatgatccaataattccacccctaggtatatgc

SEQ ID NO: 202857 - DNA, 601 bp, Human
ttttagtagagatgaggtttcactattttggtcaggctggtttcgaactcctgacctcgtgatccacctaccttggcctcccaaagtgttgggattacaggcgtgagccactgcacctggcttcagtggacttcttatgcaaccattaaacatgatcattgtggatattatgcaaatgttatactatcagattacaaaatggaacactaaattgtcttttttttttttttttttttgagacagagttttgctcttgttgcccaggctggagtgcaatggcgagatctcagctcaccacaayctctgcctccctggttcaagcgttctcccgcctcagcctcctgagtagctgggattacaggcatgcatcaccatgcccggctaattttgtatttttagtagagacggggtttctccgtgttggtcaggctggtctcgaactcctgaactcaggtgatccgcccgcctcggcctcccaaagtgctgggattacaggtgtgagctaccgcacccggccctaaattgtctttatactatcattacactgtatgattatgtaaatgttaacaagactagactgaaactgaaatgtagaaaaact

SEQ ID NO: 202858 - DNA, 601 bp, Human
tctctggttcaagcaattctcctgcctcagcctcccgagtagctgagattacaggcatgccaccacacccagctaattttctgtatttttagtagagatgaggtttcactattttggtcaggctggtttcgaactcctgacctcgtgatccacctaccttggcctcccaaagtgttgggattacaggcgtgagccactgcacctggcttcagtggacttcttatgcaaccattaaacatgatcattgtggatattatgcaaatgttatactatcagattacaaaatggaacactaaattgkcttttttttttttttttttttgagacagagttttgctcttgttgcccaggctggagtgcaatggcgagatctcagctcaccacaatctctgcctccctggttcaagcgttctcccgcctcagcctcctgagtagctgggattacaggcatgcatcaccatgcccggctaattttgtatttttagtagagacggggtttctccgtgttggtcaggctggtctcgaactcctgaactcaggtgatccgcccgcctcggcctcccaaagtgctgggattacaggtgtgagctaccgcacccgg

SEQ ID NO: 202859 - DNA, 601 bp, Human
tagcctaagggaaataaaagacagagacagagagaagcaaaatgctcaaagatgcccattccagtgttacttataatagaggtaaataaaaatctgaatgcttgcctaagcatgtactttcattcagtggacttcctttttttttttttttctttgagatcgagtctcacactgtctcccgggctggagtacagtggcaagatctcggctcactgcaacccccgcctccctgcttctctggttcaagcaattctcctgcctcagcctcccgagtagctgagattacaggcatgccaccacrcccagctaattttctgtatttttagtagagatgaggtttcactattttggtcaggctggtttcgaactcctgacctcgtgatccacctaccttggcctcccaaagtgttgggattacaggcgtgagccactgcacctggcttcagtggacttcttatgcaaccattaaacatgatcattgtggatattatgcaaatgttatactatcagattacaaaatggaacactaaattgtcttttttttttttttttttttgagacagagttttgctcttgttgcccaggctggagtgcaatggcg

SEQ ID NO: 202860 - DNA, 601 bp, Human
cgcagagcccggaatggtgtttctagtttctgtggggccacctcgttattatctgagacgttggcacagaagcactggaatccgaacctaatccatccatgttttccaaccctgcatcatctctgcccacccctttccctgtccttcttggagaggaaatggagaagaagaagacagggaaaggccgggagcggtggctcacacctgtaatctcagcactctgggaggccgaggcaggaagatcacctgaggtcaggaatttgagaccagcctggccaacatggagaaaccccgtctctasaaaattacaaaaattagctgggcgtgatggtgggtgtctgtaatcccagctactcaggaggctgaggcaggagaatcgcttgaacccgggaggcgaaggttgcagtgagccaagatcacaccactacactccagcctgggtgactgagcaagactccatctcaaaaaaaaaaaaaaaaaaaaaaaaaaaagacagggaaagacagggagaagagggagaaaagcaagacttcccgtaccccaagcagcctggataatttgaggtttctgtcactcagtgagcaaacattcatttaatgcc

SEQ ID NO: 202861 - DNA, 601 bp, Human
ccagcctccagaacagtaagaaataaatctctactctttatcaattatccagactcaggtattctgttatagcagctcacagtgaagtaagaaaataagtcactgagtgtgaggtactagacggtgaggggtgacatgaggaggagacacagccccgtcctcaggcagccccagtctgaggggggaatgcagccctgtcctcagggagccccagtctgaggggagatgcagccctgtcttcaggggaccctagtttgagggaaacacagccccatcctcagggagccccggtctgaggggracacagccccatcctcagggagccctggtctgaggggagacatagcccagccctcaggaagccccaatttgaaggggagacacagctctcttcaaagagttcccgtctgagaggggagaaaccccatagagtcaagttctaatcttctccttgagatgtctacgaattgtttaagaagagcaagcaggtacctgtagtctgtgggttccctgggaagaatggtgaagagcaagagcttggtgccagcttctccctcagactggggaccccaggctgggccttcctggctggtagttcctg

SEQ ID NO: 202862 - DNA, 601 bp, Human
cccagcctccagaacagtaagaaataaatctctactctttatcaattatccagactcaggtattctgttatagcagctcacagtgaagtaagaaaataagtcactgagtgtgaggtactagacggtgaggggtgacatgaggaggagacacagccccgtcctcaggcagccccagtctgaggggggaatgcagccctgtcctcagggagccccagtctgaggggagatgcagccctgtcttcaggggaccctagtttgagggaaacacagccccatcctcagggagccccggtctgagggagacacagccccatcctcagggagccctggtctgaggggagacatagcccagccctcaggaagccccaatttgaaggggagacacagctctcttcaaagagttcccgtctgagaggggagaaaccccatagagtcaagttctaatcttctccttgagatgtctacgaattgtttaagaagagcaagcaggtacctgtagtctgtgggttccctgggaagaatggtgaagagcaagagcttggtgccagcttctccctcagactggggaccccaggctgggccttcctggctggtagttcct

SEQ ID NO: 202863 - DNA, 601 bp, Human
cctcagtctgcaggctgggcttgcggacattccccgtctccccacctcgcctccctgagcccccagacaagtcaccctaatggtctccaccaggctgtctcccctcacactggggctccctgagtcagggctgtgtctccccctcagactggggctccctgaagacggggctgtgtctccccatcagactggggttccctgaggacggggctgtgtctcccctcagactggggccccctgaagatggggctgtctcccctcaaactggggcttcctaaagacagggctgcgtctccctcayactgggaacttcccagtgtattcccaggggcaacatccaggtcagcctgggggaaaaggccaagcttggtgaacgttgggacctgcctgggtcaccagcctgggaactcctggggtctctcacttctggagctatccctcccccactccaaacatcatcttgtttactcagtgcttgccctcattccaaccacagattaaggctcctctcaccctcttaagacaaagccaggcagaggagagcgccttagtggtgagccggctatttatatcacagcgtgtttcccaggctacgaatttc

SEQ ID NO: 202864 - DNA, 601 bp, Human
cccctcttccctgtcccaggagtcctttcctagccaccaccacctaccctcaggtacctaccaggtggccctaaggtggagcaaaccttgcacacccgcctcatgcacactaaggtgtctgtgatgtgagggtcaggcctaaaactgtgtgggctgaggccagcagaggctctgagccaccctcagtctgcaggctgggcttgcggacattccccgtctccccacctcgcctccctgagcccccagacaagtcaccctaatggtctccaccaggctgtctcccctcacactggggctccckgagtcagggctgtgtctccccctcagactggggctccctgaagacggggctgtgtctccccatcagactggggttccctgaggacggggctgtgtctcccctcagactggggccccctgaagatggggctgtctcccctcaaactggggcttcctaaagacagggctgcgtctccctcatactgggaacttcccagtgtattcccaggggcaacatccaggtcagcctgggggaaaaggccaagcttggtgaacgttgggacctgcctgggtcaccagcctgggaactcctggggtctct

SEQ ID NO: 202865 - DNA, 601 bp, Human
aggcctggaagttaaatttcctggaaaactgtgtgttttctcccctcttccctgtcccaggagtcctttcctagccaccaccacctaccctcaggtacctaccaggtggccctaaggtggagcaaaccttgcacacccgcctcatgcacactaaggtgtctgtgatgtgagggtcaggcctaaaactgtgtgggctgaggccagcagaggctctgagccaccctcagtctgcaggctgggcttgcggacattccccgtctccccacctcgcctccctgagcccccagacaagtcaccctamtggtctccaccaggctgtctcccctcacactggggctccctgagtcagggctgtgtctccccctcagactggggctccctgaagacggggctgtgtctccccatcagactggggttccctgaggacggggctgtgtctcccctcagactggggccccctgaagatggggctgtctcccctcaaactggggcttcctaaagacagggctgcgtctccctcatactgggaacttcccagtgtattcccaggggcaacatccaggtcagcctgggggaaaaggccaagcttggtgaacgttgg

SEQ ID NO: 202866 - DNA, 601 bp, Human
tgacaccccagctccctcaccaacctcatctcccccttacaggtcactggtggccaaggccctttccagccaggtgtttccaggcctggaagttaaatttcctggaaaactgtgtgttttctcccctcttccctgtcccaggagtcctttcctagccaccaccacctaccctcaggtacctaccaggtggccctaaggtggagcaaaccttgcacacccgcctcatgcacactaaggtgtctgtgatgtgagggtcaggcctaaaactgtgtgggctgaggccagcagaggctctgagccrccctcagtctgcaggctgggcttgcggacattccccgtctccccacctcgcctccctgagcccccagacaagtcaccctaatggtctccaccaggctgtctcccctcacactggggctccctgagtcagggctgtgtctccccctcagactggggctccctgaagacggggctgtgtctccccatcagactggggttccctgaggacggggctgtgtctcccctcagactggggccccctgaagatggggctgtctcccctcaaactggggcttcctaaagacagggctgcgtctccctc

SEQ ID NO: 202867 - DNA, 601 bp, Human
ctggacatgctggaggcctcagaaaatgttgtccctccttccgcttagagccattggataagacctggaaaaccatcggattgtcctacagaggagcaagtggggcccagaggagggcaaggcctcgcccaaagccacacaagaagtcggggtccagccgggcgcggtggctcacgcctgtaatcctagcactttaggaggctgaggtgggcagatcatgaggtcaggagttcgagaccatcctggccaacgtggtgaaaccccgtctctactaaaaatacaaaaaattagccgggcgtgstggcgggcgcctgtaatcctagctactggggaggctgaggcagaagaatcacttgaaccagggaggtggagattgcagtgagctgagatcatgccattgcactccagcctgggcaacagagtgagactctgtctcaaattaaaaaaaaaaaaaaaaaaaaacttgggtccagcccacagcagttgcccactggtcccattggagttccccacctcccttgtccctcctgacttgacctttcattcattcactcacttgataaatatttgctgtgcacctgctacctgccagctgctattc

SEQ ID NO: 202868 - DNA, 601 bp, Human
agcttaaactctgtggacctgcgtgagctgggagtgatagcagctgcctctcaggggttatgggggatataaatgagacaattcgagtcacgcatttgacacaggctggacatgctggaggcctcagaaaatgttgtccctccttccgcttagagccattggataagacctggaaaaccatcggattgtcctacagaggagcaagtggggcccagaggagggcaaggcctcgcccaaagccacacaagaagtcggggtccagccgggcgcggtggctcacgcctgtaatcctagcactttrggaggctgaggtgggcagatcatgaggtcaggagttcgagaccatcctggccaacgtggtgaaaccccgtctctactaaaaatacaaaaaattagccgggcgtgctggcgggcgcctgtaatcctagctactggggaggctgaggcagaagaatcacttgaaccagggaggtggagattgcagtgagctgagatcatgccattgcactccagcctgggcaacagagtgagactctgtctcaaattaaaaaaaaaaaaaaaaaaaaacttgggtccagcccacagcagttgcccactggtc

SEQ ID NO: 202869 - DNA, 601 bp, Human
gggccttcagctcgggcctcccgctcccctctactggccctctggaggggccagtagccctggacacactgagcagatggcatctctgcagtggtctctcccttcttcccccaagaccttccccaaagtgtcctcctcaaggctaggggcctcccaacccaaatgctgtctgtcccacctcctgacctacaggctgtccctggagccttcccctcagtacagtgtcccagctgagccattgccagtgtcctgtggacagggtgggggtggttgaaagcacaccactgagtcctaaatatgyatttgggagccatggagcttaaactctgtggacctgcgtgagctgggagtgatagcagctgcctctcaggggttatgggggatataaatgagacaattcgagtcacgcatttgacacaggctggacatgctggaggcctcagaaaatgttgtccctccttccgcttagagccattggataagacctggaaaaccatcggattgtcctacagaggagcaagtggggcccagaggagggcaaggcctcgcccaaagccacacaagaagtcggggtccagccgggcgcggtggctcacgcctg

SEQ ID NO: 202870 - DNA, 601 bp, Human
ggtgggaagacaagctggagcagtgtgaggggggccttcagctcgggcctcccgctcccctctactggccctctggaggggccagtagccctggacacactgagcagatggcatctctgcagtggtctctcccttcttcccccaagaccttccccaaagtgtcctcctcaaggctaggggcctcccaacccaaatgctgtctgtcccacctcctgacctacaggctgtccctggagccttcccctcagtacagtgtcccagctgagccattgccagtgtcctgtggacagggtgggggtgrttgaaagcacaccactgagtcctaaatatgtatttgggagccatggagcttaaactctgtggacctgcgtgagctgggagtgatagcagctgcctctcaggggttatgggggatataaatgagacaattcgagtcacgcatttgacacaggctggacatgctggaggcctcagaaaatgttgtccctccttccgcttagagccattggataagacctggaaaaccatcggattgtcctacagaggagcaagtggggcccagaggagggcaaggcctcgcccaaagccacacaagaagtcg

SEQ ID NO: 202871 - DNA, 601 bp, Human
caccctccatggtgggcctgacacggagcacctgcccgctggcactgcctgcccaccactcaaagccccactccagccatgtgcgtggggaaggcagaaactgtgtcttgctcagctgtccttctgcagcccctctctgggcaccgggctgttggtgacggaagtggggcaggggtgggaagacaagctggagcagtgtgaggggggccttcagctcgggcctcccgctcccctctactggccctctggaggggccagtagccctggacacactgagcagatggcatctctgcagtggtcyctcccttcttcccccaagaccttccccaaagtgtcctcctcaaggctaggggcctcccaacccaaatgctgtctgtcccacctcctgacctacaggctgtccctggagccttcccctcagtacagtgtcccagctgagccattgccagtgtcctgtggacagggtgggggtggttgaaagcacaccactgagtcctaaatatgtatttgggagccatggagcttaaactctgtggacctgcgtgagctgggagtgatagcagctgcctctcaggggttatgggggatataaatgagacaa

SEQ ID NO: 202872 - DNA, 601 bp, Human
tcttttttcccttagcaatatcttggagatctttttttttttttttttggcatggatgggggatggagtcttgctctgtcacccaggctggagtgcagtggtgtgccaccatgcccagctaacttttgtattttcagtagagatggggttttgtcatattggccaggctgctctggaactcctgatctcgagtgatccacctgcctcagcctcccaaagtgctgggattacaggtatgagccactgcgctcggctgagatattttcgtatctgtctgtggagtgtcctggatttttgtttkttaatgagctgcatggtattcccattgcgtggatggcacatgggtcctagccagttccagactgatggaagtttgggtttttcccagtctctcgttaatacaaacatggacatcagtcattttgcatattgtgactatatggagcaggtaaattccttgaagatggatccttgcatcaaagggtgatcttgccagatacctgccatttttctcctctggtctctcctgctgggggctgaggtgggggcgcggttcacaaagcccaaccagccatgctcaggagaacctgtcctccacagc

SEQ ID NO: 202873 - DNA, 601 bp, Human
ggagaatggcgtgaacccagggggcggagcttgcagtgagccgagatcacgccattgtactccagcctgggcgacacagtgagactctgtctcaaaaaaaataaaaataaaaaataaaaaaataaaaataaaaatacaaaaaaattagccaggcgttgtggtgcatgcctgtagtcccagctactcgggaggctgaggcacgagaatcacttgagcccgagacgcagaggttgcagtgagccgagatcacgccagtgagactctgtctcaaaaaacaaaaaaaaaagaaagaaaggaaaaagaaaaaaaaattgcacgcgaagaatgcgttacataatagacttttagaacataatagaaagcataactgtttccaatagagattattttaaacaatgttcattgaattggtcacgaatctcttaaaagatgtccatcttttgcttctaaataaaatctctttaatataaaatgcctctcactcctcatctctcagcctccaggtcctgaccgctatggccagttccaccagagagaggcttcatgcatggacaagcaaacatgttttcatttttcctgttctttttttattactgcaaat

SEQ ID NO: 202874 - DNA, 601 bp, Human
tcccagatactcgggaggctgaggcaggagaatggcgtgaacccagggggcggagcttgcagtgagccgagatcacgccattgtactccagcctgggcgacacagtgagactctgtctcaaaaaaaataaaaataaaaaataaaaaaataaaaataaaaatacaaaaaaattagccaggcgttgtggtgcatgcctgtagtcccagctactcgggaggctgaggcacgagaatcacttgagcccgagacgcagaggttgcagtgagccgagatcacgccagtgagactctgtctcaaaaaacaaaaaaaaaagaaagaaaggaaaaagaaaaaaaaattgcacgcgaagaatgcgttacataatagacttttagaacataatagaaagcataactgtttccaatagagattattttaaacaatgttcattgaattggtcacgaatctcttaaaagatgtccatcttttgcttctaaataaaatctctttaatataaaatgcctctcactcctcatctctcagcctccaggtcctgaccgctatggccagttccaccagagagaggcttcatgcatggacaagcaaacatgttttcattttt

SEQ ID NO: 202875 - DNA, 601 bp, Human
tgcagccaggcgcggtggctcacgcctgtaatcccagcactttgggagacgaagatgggcagatcttcatcaaggtcaagagatcgagaccatcctggccaatatggtgaaaccccgtctctactaaaaatacaaaaattatctgggcgtggtggcacgcgcctgtagtcccagctactcgggaggctgaggcacgagaatcacttgaacccgggaggaagaggttgcagtgagccaagatcacaccactgcactccagcccgtacgatacagtgagaccccgtctcaaaaaaaaaaaaaagaaaaagttgcatgtaggccaagtgcagtggctcacacctgtaatctcagcactttgggaggcccaggtgggcagacgacctgaggtcaggagttcaagaccagcctgggcaacatggtgaaacctcatctctacaattaataaaaatacaggccgggcacggtggctcaagcctgtaatcccagcactttgggaggctgaggcgggtggatcacgaggtcaggagatcgagaccatcctggctaacacggtgaaaccccgtctctactaaatatacaaaaaattagctgggcgttgtgg

SEQ ID NO: 202876 - DNA, 601 bp, Human
ttgactgggtgcttgtcatctaaataaaaagttgcagccaggcgcggtggctcacgcctgtaatcccagcactttgggagacgaagatgggcagatcttcatcaaggtcaagagatcgagaccatcctggccaatatggtgaaaccccgtctctactaaaaatacaaaaattatctgggcgtggtggcacgcgcctgtagtcccagctactcgggaggctgaggcacgagaatcacttgaacccgggaggaagaggttgcagtgagccaagatcacaccactgcactccagcccgtacgayacagtgagaccccgtctcaaaaaaaaaaaaaagaaaaagttgcatgtaggccaagtgcagtggctcacacctgtaatctcagcactttgggaggcccaggtgggcagacgacctgaggtcaggagttcaagaccagcctgggcaacatggtgaaacctcatctctacaattaataaaaatacaggccgggcacggtggctcaagcctgtaatcccagcactttgggaggctgaggcgggtggatcacgaggtcaggagatcgagaccatcctggctaacacggtgaaaccccgtctctac

SEQ ID NO: 202877 - DNA, 601 bp, Human
tggcgagctaggattgcagcagctgaaagggacgccgtccaccaggtaccgcccatccacgttgctcttgattcgacttaaagggaaacagacagctggagatgggcttcccgggcttctcaacaggggccacttcctcccaacccctgcctctggaaacctagaatagtcattcactcgcacacttggtatatatttgctgtgcgcccgctacgtgccagtcactgttctaggcgctgaagacaaaaaaatgaataaatgcccctgccttcctcgaccttgaggtagacggtaatccaaracccaagtcaatagggagtatagaaattcacccaaccactctgtgctgccaggcgctttcttggggccatgcctggtgcataggtgggtaggaggagcagcaggatgggagctgttgatggacaagcatctggctgccactggtgatgcccacagctccctcaccaacctcatctcccccttacaggtcactggtggccaaggccctttccagccaggtgtttccagaaggcctgctcagtcccagggcctgtgcagaggcaggggatggagacccgaggcaggcacagtccttgccctc

SEQ ID NO: 202878 - DNA, 601 bp, Human
cccatggagttcatgaggctgctgtagtagctcagcagggcagccctgcagccacgcacccacaggttgagctcctccgtctggtggtcgtaactgtagtgtgctgagttgttggtgatctgatactggatgcagggccgtggcgagctaggattgcagcagctgaaagggacgccgtccaccaggtaccgcccatccacgttgctcttgattcgacttaaagggaaacagacagctggagatgggcttcccgggcttctcaacaggggccacttcctcccaacccctgcctctggaaacytagaatagtcattcactcgcacacttggtatatatttgctgtgcgcccgctacgtgccagtcactgttctaggcgctgaagacaaaaaaatgaataaatgcccctgccttcctcgaccttgaggtagacggtaatccaagacccaagtcaatagggagtatagaaattcacccaaccactctgtgctgccaggcgctttcttggggccatgcctggtgcataggtgggtaggaggagcagcaggatgggagctgttgatggacaagcatctggctgccactggtgatgcccacagctccc

SEQ ID NO: 202879 - DNA, 601 bp, Human
atgaggagcgtgacgacacccatggagttcatgaggctgctgtagtagctcagcagggcagccctgcagccacgcacccacaggttgagctcctccgtctggtggtcgtaactgtagtgtgctgagttgttggtgatctgatactggatgcagggccgtggcgagctaggattgcagcagctgaaagggacgccgtccaccaggtaccgcccatccacgttgctcttgattcgacttaaagggaaacagacagctggagatgggcttcccgggcttctcaacaggggccacttcctcccawcccctgcctctggaaacctagaatagtcattcactcgcacacttggtatatatttgctgtgcgcccgctacgtgccagtcactgttctaggcgctgaagacaaaaaaatgaataaatgcccctgccttcctcgaccttgaggtagacggtaatccaagacccaagtcaatagggagtatagaaattcacccaaccactctgtgctgccaggcgctttcttggggccatgcctggtgcataggtgggtaggaggagcagcaggatgggagctgttgatggacaagcatctggctgccactg

SEQ ID NO: 202880 - DNA, 601 bp, Human
aagagccaaatgaggagcgtgacgacacccatggagttcatgaggctgctgtagtagctcagcagggcagccctgcagccacgcacccacaggttgagctcctccgtctggtggtcgtaactgtagtgtgctgagttgttggtgatctgatactggatgcagggccgtggcgagctaggattgcagcagctgaaagggacgccgtccaccaggtaccgcccatccacgttgctcttgattcgacttaaagggaaacagacagctggagatgggcttcccgggcttctcaacaggggccacytcctcccaacccctgcctctggaaacctagaatagtcattcactcgcacacttggtatatatttgctgtgcgcccgctacgtgccagtcactgttctaggcgctgaagacaaaaaaatgaataaatgcccctgccttcctcgaccttgaggtagacggtaatccaagacccaagtcaatagggagtatagaaattcacccaaccactctgtgctgccaggcgctttcttggggccatgcctggtgcataggtgggtaggaggagcagcaggatgggagctgttgatggacaagcatctgg

SEQ ID NO: 202881 - DNA, 601 bp, Human
tcgggtgcagtgctcacacctgtaaacccagacttcgggaggccgaggcaggcagatcacgaggtcaggagatcgagaccatcctggctaatgcagtgaaaacctgtctctactacaaatataaaaaattagccgggcatggtggcacatgcctgtagtcccagctatcgggaggctgaggcagaaggatcccttgaacccaggagagggaggttgcagtgagctgagatcatgccactgcactccagcctgggcaacacagagagactcagcctcaaaataaaaaaaaaataaaaaaaataaatttaagtggtgggaaagaaaccaaaaaagaaataaatgaataaataaataaataaataaatacaaaaggtggaggccctgggtggggttcaagcccagactgatctgacccacagctccactgaaggctgtttccaaagagggaggcatgctctccaagcctggctccgcccccattagacccaaatgggaccggaggctctccttaccctctacccccagctggcccagggcctacctcgaagagccaaatgaggagcgtgacgacacccatggagttcatgaggctgctgtagta

SEQ ID NO: 202882 - DNA, 601 bp, Human
caattgtcggtcgggtgcagtgctcacacctgtaaacccagacttcgggaggccgaggcaggcagatcacgaggtcaggagatcgagaccatcctggctaatgcagtgaaaacctgtctctactacaaatataaaaaattagccgggcatggtggcacatgcctgtagtcccagctatcgggaggctgaggcagaaggatcccttgaacccaggagagggaggttgcagtgagctgagatcatgccactgcactccagcctgggcaacacagagagactcagcctcaaaataaaaaaaaaataaaaaaaataaatttaagtggtgggaaagaaaccaaaaaagaaataaatgaataaataaataaataaataaatacaaaaggtggaggccctgggtggggttcaagcccagactgatctgacccacagctccactgaaggctgtttccaaagagggaggcatgctctccaagcctggctccgcccccattagacccaaatgggaccggaggctctccttaccctctacccccagctggcccagggcctacctcgaagagccaaatgaggagcgtgacgacacccatggagttcatgaggc

SEQ ID NO: 202883 - DNA, 601 bp, Human
acaaatccaaacagtacccatttcctgaacacctgcacatgctgttcatgttgcctcccaatagtccccaaagctaagtgctgtcaccccatataacagagaggttaaatgactaagacctcggtaccaaaaagtggggacacaggatgaacctccaaaacatgctaactaaaagaagccaaacgtaatatgggtccatttatatgaaatgtccaaaatacataaatccagagaacagttgccaggggctggagggcaggttgggaggtggtgactgcttcatgggtgtgagattttcttrggggctgatggaagtcttttggaactaggtagaggtgcttgcacaacattgtaaatcaactagatgacaccaaattgtttaccttttataaatctcacctcaattaaaaaaacaattgtcggtcgggtgcagtgctcacacctgtaaacccagacttcgggaggccgaggcaggcagatcacgaggtcaggagatcgagaccatcctggctaatgcagtgaaaacctgtctctactacaaatataaaaaattagccgggcatggtggcacatgcctgtagtcccagctatcgggaggctg

SEQ ID NO: 202884 - DNA, 601 bp, Human
ggctgaggtgggaagagccctgagcccaggagttcaaggctgcagtgagctacgatcatgcccctgcactccagcctgggcgacaggtgaatttttcttcttgtctctaaaaaaaataataataaacaatttaaaataataaaaataaaaaatgaatatctctttaaccaaagagcgaattcagcacactcaccgaggatttgcttacattgcaagccctatagctacagagaaactgagcgttgcagataagatgaacccacacataactagactaacaggtaaatgaggaccagcatcscaagaagcacaaatccaaacagtacccatttcctgaacacctgcacatgctgttcatgttgcctcccaatagtccccaaagctaagtgctgtcaccccatataacagagaggttaaatgactaagacctcggtaccaaaaagtggggacacaggatgaacctccaaaacatgctaactaaaagaagccaaacgtaatatgggtccatttatatgaaatgtccaaaatacataaatccagagaacagttgccaggggctggagggcaggttgggaggtggtgactgcttcatgggtgtgag

SEQ ID NO: 202885 - DNA, 601 bp, Human
tgcatgtgcctatagtcctagctactcagaaggctgaggtgggaagagccctgagcccaggagttcaaggctgcagtgagctacgatcatgcccctgcactccagcctgggcgacaggtgaatttttcttcttgtctctaaaaaaaataataataaacaatttaaaataataaaaataaaaaatgaatatctctttaaccaaagagcgaattcagcacactcaccgaggatttgcttacattgcaagccctatagctacagagaaactgagcgttgcagataagatgaacccacacataaytagactaacaggtaaatgaggaccagcatcccaagaagcacaaatccaaacagtacccatttcctgaacacctgcacatgctgttcatgttgcctcccaatagtccccaaagctaagtgctgtcaccccatataacagagaggttaaatgactaagacctcggtaccaaaaagtggggacacaggatgaacctccaaaacatgctaactaaaagaagccaaacgtaatatgggtccatttatatgaaatgtccaaaatacataaatccagagaacagttgccaggggctggagggcaggt

SEQ ID NO: 202886 - DNA, 601 bp, Human
cttgtctaatgcagtccactagattcctgtaaaggtggggccactaagaggctgccaatggaaccccattcattttcccactgacttttctttctttttttttttttttggagatagagtctggctctgttagagtgcagtgttgagatcatggcttacagcagccttgacctccagggctcaggtgatcctcctgcctgagccaggaggatccaggactacatgtgtgcaccaccacacaaagctaatttttatgtttttgtttttgttgctcaagctggagtgcaatggcgtgatctcrgctcaccacaacctccacctcccaggttcaagcaattctcctgcctcagcccccaagtagctgggattacaggcatgcaccattaggcccggctaatcttgtatttttaggtagagacagggtttctccatgttggtcaggctggttgcaaactcccaacctcaggtgatcccccgcctcggcctcccaaagtgctgagattacaggcataagccaccgcgcctggccgtcatttttgtgttttttgtagagatgagatcttgctatgttgcccgggctggtctaaactcctgggctcaa

SEQ ID NO: 202887 - DNA, 601 bp, Human
agctgatccttgtctaatgcagtccactagattcctgtaaaggtggggccactaagaggctgccaatggaaccccattcattttcccactgacttttctttctttttttttttttttggagatagagtctggctctgttagagtgcagtgttgagatcatggcttacagcagccttgacctccagggctcaggtgatcctcctgcctgagccaggaggatccaggactacatgtgtgcaccaccacacaaagctaatttttatgtttttgtttttgttgctcaagctggagtgcaatggcrtgatctcggctcaccacaacctccacctcccaggttcaagcaattctcctgcctcagcccccaagtagctgggattacaggcatgcaccattaggcccggctaatcttgtatttttaggtagagacagggtttctccatgttggtcaggctggttgcaaactcccaacctcaggtgatcccccgcctcggcctcccaaagtgctgagattacaggcataagccaccgcgcctggccgtcatttttgtgttttttgtagagatgagatcttgctatgttgcccgggctggtctaaactcct

SEQ ID NO: 202888 - DNA, 601 bp, Human
ctggagtgcagtggcgtggtctcagctcactacaaactctatctcctgtgttcaaggaattctcatgcatcagcctcttgaatagctaacgttgcaggtgcctgccaccatacctgactaatttttgtattttttttttgttattgttgtagatatgtggtttccccatgttgccagctggcctcgaactcctggcctcgagatccacccgcctcgacctcccaaagtgctgggattacaggtgcgagccaccgtgcccagcccttccattattttgatgagcacagtgatgaatggatgstggtaaaaaataatttggatttgttcactagcattcactgtgtggcagacttggtgccaaaatgcctgggttcaaacccgggcacttagccagccgtgtgaccaggaaacctcactttattcatccggtttgcagattttcagatgaagtggtgcccaccccgtgtggatactgtgccactttaatatgtgtaaaacacacaggccaagtgcaatggtgcatgcctgtaatcccagcactttgggaggccaaggtggagggaggattgcttgagctcaggagttcgagaccagcctgggc

SEQ ID NO: 202889 - DNA, 601 bp, Human
tgggtggaattaagaggtcacctccttttctgcatctgatgtgtggtacttttttttttttttgagacaagtctcactctgtcacccatgctggagtgcagtggcgtggtctcagctcactacaaactctatctcctgtgttcaaggaattctcatgcatcagcctcttgaatagctaacgttgcaggtgcctgccaccatacctgactaatttttgtattttttttttgttattgttgtagatatgtggtttccccatgttgccagctggcctcgaactcctggcctcgagatccaccckcctcgacctcccaaagtgctgggattacaggtgcgagccaccgtgcccagcccttccattattttgatgagcacagtgatgaatggatggtggtaaaaaataatttggatttgttcactagcattcactgtgtggcagacttggtgccaaaatgcctgggttcaaacccgggcacttagccagccgtgtgaccaggaaacctcactttattcatccggtttgcagattttcagatgaagtggtgcccaccccgtgtggatactgtgccactttaatatgtgtaaaacacacaggccaagt

SEQ ID NO: 202890 - DNA, 601 bp, Human
cccatgccccatactttctcccctctaggtctttaccatctgctatgctctctgcctagaaccttgttcctctccacgttcatctgttaattcatcttcagcccttggtgagctcccctgcagctcatcctccctccccatcccctcgggtcgcccccatcccaggtgcattattcctgggtgccttcacctctacaccccattgcttggcacatattgggtagttcagtaactgccttgggtggaattaagaggtcacctccttttctgcatctgatgtgtggtacttttttttttttttgagacaagtctcactctgtcacccatgctggagtgcagtggcgtggtctcagctcactacaaactctatctcctgtgttcaaggaattctcatgcatcagcctcttgaatagctaacgttgcaggtgcctgccaccatacctgactaatttttgtattttttttttgttattgttgtagatatgtggtttccccatgttgccagctggcctcgaactcctggcctcgagatccacccgcctcgacctcccaaagtgctgggattacaggtgcgagccaccgtgcccagcccttccattat

SEQ ID NO: 202891 - DNA, 601 bp, Human
ttgatttttaaatgaatatgggtgttgcaaaaacattcaactaacgttaaaccaaatcccctaaggacctcctctgaagtgtcactcacaggcctattgtgagttgttgaaaagatttaaaagtagtaacatgatgcctgtttgaaaatattttcaaagtcatatttcgtactaacgtcccagaatggcccatgtccctatgagttcaaattgtgctttttggttttggtaaattttatgagatacaaatatcataagccatgaatattacagtatgaggtattacaggtataaagcctgmattaaatctttatatgagtgatctctcttccccatcagaaaactaaggaaaattttcaaaatcaaattcaattaagttacttaaaagaatgcttgcaataaaaaagatctccaatattaacaaccaaaacctttctaccatataacttaggtcattaaaaaattagtcttaccttacttcagctggtggatttggggaataaggatttgcagaacaagcgagaattctaatgactgctccgggatgataggtttctagaacatgtacagctgtaggatacacctgttgttcaaaagtaag

SEQ ID NO: 202892 - DNA, 601 bp, Human
ctaaatcttttcagatttttggaaaaaagtaggtaactttgtaagaagaatgtcagagtcctaataaaacaattctcatataagaaaagatcctgccatgcacagtggctcccatctgtaattccagcactttgggaggccgaggcaggcggatcacctgaggtcaagagttcgagaccagcctgcccaacctggtgaaaccccatctctattaaaaatacaaaaattagccaggcatggtggcacgcacctgtaatcccagccgctcaggtggctgaggcaggagaatctcattaacccsagaggcagaggttgcagtgagccaagatcgtgccactacactccagcctgggcgacagagtgagaccctgtctcaaaacaaaacaaaagatcctactccattttttcctcttagggagaaaacaaaaatctgattttaattaaggtatgctggctttctgagtttaaaaaacgactaataacattatttgcaatgaattattaggtagttctggaaaaaaaagtaaagattataccagcaatctccaagttgagctgtactctgtatgttttctggcaggccctggaagtattcccttag

SEQ ID NO: 202893 - DNA, 601 bp, Human
ttggtagcaaattctatgaaagcctctttttttctccctgctttcttaatttcaatattatatagttggagtgctttgaacactgaaaaaaaattccacatcattaaatttcattcccaaataactttattccaattggtttctttaatctgacctctatttgtcatcttcttcttccccgtttccttgtctctctcttccaaatggtaaccctgagctagcctattttctgagtcttacataagcatccattaagatattattcacaggactagggcactctataaaacctgcaacctcygccttctggtttcaagtgattctcccgcctcagcctcccgaatagctggaattacaggtgcccgccaccacgcctggctaatttttgtgtttttagtagagacggggtttcaccatgttggccaggctggtctcaaacgcttgaccttgttatccgcccccctcggcctcccaaagtgctgggattacaggcgtgagccaccatgccaggcctttttcttttgctcttaataaggtactaggcaagaaatgaggagactttaagatctggtagaactacctgtaacttctccacttcatt

SEQ ID NO: 202894 - DNA, 601 bp, Human
ctactcgggaggctgaggcaggagaatggcatgaacccaggaggcggagcttgcagtgagccgagatggcaccactgcactccagcctgggcaacagagcgagactccatctcgaaaaaaaaaagaaaaaaaaaaagtattgtggggggaggagccaagatggccgaataggaacagctcgagtctataggtcccagcgtgagcaacgcattagacgggtgatttctgcatttccatctgaggtaccgggttcatctcaccagggagtgccagatagtgggcgcaggacagtgggtgcagygcaccgtgcgccagccgaagcagggcgaggcattgcctcacttgggaagcacaagggatcagggagttccctttcctggtcaaggaaaggggtgacagacggcacctagaaaatcgggccactcccacccaaatactgcgcttttccgaaggccttaggaaacggcgcaccaggagattatatcccgcacctggctcggagggtcctacgcccacggagtctcgctgattgctaggacagcagtctgagatcaaactgcaaggtggcagcctggatgggggaggggcgcctgccattgcc

SEQ ID NO: 202895 - DNA, 601 bp, Human
accccagtagggacacactgaaaacaggacttcagactagacaaacaaaaaagtattaataattccaggccgggcacggtggctcacgcccataatcccagcactctgggaggccaaggtgagtggatcacgaggtcaggagatcgagacaatactggctaacacagtgaaaccctgtctctactaaaaatacaaaaaaaaagttagccaggcatggtggcaggcacctgtagtcccagctactcgggaggctgaggcaggagaatggcatgaacccaggaggcggagcttgcagtgagcygagatggcaccactgcactccagcctgggcaacagagcgagactccatctcgaaaaaaaaaagaaaaaaaaaaagtattgtggggggaggagccaagatggccgaataggaacagctcgagtctataggtcccagcgtgagcaacgcattagacgggtgatttctgcatttccatctgaggtaccgggttcatctcaccagggagtgccagatagtgggcgcaggacagtgggtgcagcgcaccgtgcgccagccgaagcagggcgaggcattgcctcacttgggaagcacaagggatca

SEQ ID NO: 202896 - DNA, 601 bp, Human
gatgaattgctcccactgctgcaacaacagacccaccgcagagccctgaggagcaacactgtcagtatctcatgctcctctctctccccaaacccagcttttccttcatctttcctccctcctcccagtaaaggccagttttgtccaatctgtgaagctccctttccatcacatgaggtctgggtgggatcctggtcccatggcttaaagaccaaattaacttggacacttaaattcacctttatgtggcaactttagctacttcacaggatgtgccatggcattttaactgtaatatgtyggagaggcattatagttactattactctaagacattcaaaaggctatcttactgtttcatgaaagttaagctatttgtgttatttccatgaaatctgaaatacacatcaatttggaaaagggatatctaagttggttaaaatttgagtctataaagtttccttaaaaagaaaactgatatacatttttaaccacacagtagttttcagtgggagacagaaatgcttggccctactctcacccctaggaatatttcgaaactggtggggagaggttttcatgtcacacagccctagaatgc

SEQ ID NO: 202897 - DNA, 601 bp, Human
cccaggggagttgtcgatacatttcccactatcctcttgacctgttcctggactctattctgttccatttatctatatgctatttctcccatatcaatagtcctccaagtaaaataactaagttttttaaagcatatgtgttggaatgtcatggattgtttgactgcaaatgagaatcaggactaatactcctctatcacacttcttttccagaatgttcctgagtattttcatatttttaggcaaacttttcaattttaaaaaattctgtttgcattttaattgggacttcattgaatayactgattaaggaaaaccgatatttttactttattgtattttcctactctagggcatgttctaattttttagcaaaagtaaattatctgcaaagtctaaagtatctgtgactccccttgactaatttggctgtatactggaccaccctgaagatcactggctgaagggataaaatgcaaatctcttggtgaaacccaaacagacctctatgacgcagcagaatagactccacactgccaaagacagggagtcccaatcactgtcatctatgtgcatggagctgtgcactgaggcagccctg

SEQ ID NO: 202898 - DNA, 601 bp, Human
atttatctagctaaactttttgttttgcaattaacctaaatgctcttcttcaatttattttgttatctaggctcagtattaatttcaggtcagattttcactgttttaagccaaaatatcacaaaacgcagagtaacaacaacatgatctttaaaataagtttaaagagggtgtagccagaatctcccttactcctgatgtttcttagtaattttcttagtaatttactgactttctaatctgctccttggctattaattcccacttgcccatgctgttgaacccaatctctctcagacaytgcaaaatcccattgtagtggtccctatacctagaacgattgaataatttttctttaacaaatctcatcatccagatacacctgttgatgtgtaaaatattacacaaacaaaaatcaaaaatttcaagtaaaaagtaaacccaaacattaaagaaaggtctaaaataagaagtttcttcctctctacactcagttctaaccatccctctccccaaagataatcattgtttttctgatctcttccaaataaatgtgtatgaaattctgttcttgaatttgcactaaaagaatgatactata

SEQ ID NO: 202899 - DNA, 601 bp, Human
caaagactgtgttatgaaagcctcacagaggagcttggatttatcctgaaagcaatgaggagtcctgaagggttttaaactaggggttttaaactagagtgacatgttcacatttgtgtttcagaaagatcattgtgggcgtgctactgggagcaaggaggcaggaagagaaaccagccatggggctaatacagaattctaggaaataggaaataaggggtctgcttaaggcagctggcagtgatgatggagtagcaaacagatacaagaattattaagaaggcagaattcaagagattgwtatctctaattaaaattatcttcttgaactagtccaaggtttattttttctaaacagttgggggcttctagtttcaaagaactgcttaaatagcctattctgaactaacaaatataaaggaaaagatattaaatatttgctaaatgttaaaaatcttatttagatgagagagggttttttttaatttaatgtatttatctagctaaactttttgttttgcaattaacctaaatgctcttcttcaatttattttgttatctaggctcagtattaatttcaggtcagattttcactgtttta

SEQ ID NO: 202900 - DNA, 601 bp, Human
gatttgcatttctctaatgaccagtgatgatgaacattttttcttatgtttgttggctgcataaatgtcttcttttgagcagtgtctgtgcatattctttgcccactttttgatggggttgtttctttcttgtaaatttgtttaacttctttgtagattctggatattagccctttgtcagatggatagatcgcaaaaattttctcccattctgtaggttgcctgttcactctgatgatagttttttgctggaacattcagcttcaaagagtcaggggcaaaccaggtgaaaagagagtcyagtggcaaagactgtgttatgaaagcctcacagaggagcttggatttatcctgaaagcaatgaggagtcctgaagggttttaaactaggggttttaaactagagtgacatgttcacatttgtgtttcagaaagatcattgtgggcgtgctactgggagcaaggaggcaggaagagaaaccagccatggggctaatacagaattctaggaaataggaaataaggggtctgcttaaggcagctggcagtgatgatggagtagcaaacagatacaagaattattaagaaggcagaattcaaga

SEQ ID NO: 202901 - DNA, 601 bp, Human
agtaatgggattgctgggtcaaatggtatttctagttctagatccctgaggaatcaccacactgtcttccacaatggttgactaatttacactcccaccaacagtgtaaagacattcctatttctccacattctctccagcatctgttgtttcctgactttttaatgatcaccattctaactggcatgagatggtatctcattgtgattttgatttgcatttctctaatgaccagtgatgatgaacattttttcttatgtttgttggctgcataaatgtcttcttttgagcagtgtctgtkcatattctttgcccactttttgatggggttgtttctttcttgtaaatttgtttaacttctttgtagattctggatattagccctttgtcagatggatagatcgcaaaaattttctcccattctgtaggttgcctgttcactctgatgatagttttttgctggaacattcagcttcaaagagtcaggggcaaaccaggtgaaaagagagtctagtggcaaagactgtgttatgaaagcctcacagaggagcttggatttatcctgaaagcaatgaggagtcctgaagggttttaaactagg

SEQ ID NO: 202902 - DNA, 601 bp, Human
aatagtttttaaaatgtgttaatcatctgtgctgcaaatatgaaaaagaagaaacaggagctctgctgaaagttacttgggatttaagaaacatgaagtaaagggtatagtttcccttcatattcatataaaatttagctgaagaggatagtaaaacacttatttttttataagcagcagcattctaaacatgacactcaaaatatatttcctttttatttttgtaagtacatgttacataatttcaaacttttattatgaaaaccactacataataagtataacctgctgctgggggggraaaaaacttcatcaaggctttgtactaacctgctaaatcctgcaacagagatgaagcctctattgccagtccaagataaattaagccactggacaagagtgcagcgagactgtagaaattccagagaagtgtcatctagttttgcccagtatggttgcagattgaggtggatgtattgcagaggatcacagcaatgctggctcagtagtttgcaagtctgtgctaatctacacaggtctggtagtgtaagatgattcagaatcagctgaataagctaaataagacagagaaaccaagatc

SEQ ID NO: 202903 - DNA, 601 bp, Human
agcaatttactaaatggtaacttgcatcctaaaataattaagatcacgtgaatgacttgagtttacttatcacaaaataaaaggtaatagtcctcagaaattgcctgaagtataaaagagaagaattagatataaatatctatgacttctaaattcctaatctcatgtttttttagctgaccctcaccgagttttctaaaacaatatattcaagataattttaatcccaaataacttggaacattatttaatatagctgatccaaaataaagccattaaaaacaaaacttcctgcttaacygtatatgggtactatccaacaatgatagaaagaagggaaaagaacaccttaaaatggtctctactttctagagttgacaatctaagacacaactgtataaaatataggcaggcaactgaataaatatattagtgggaaataagctctttataccataaaactttagctctatgtcaaaatacctaataaagttctcgaatctagaacgcatccaagaatgtttcctaaaggaatgaatataaactaccgagaacaagtaagaggagtttagagtaaaaacctacacataactgaggggga

SEQ ID NO: 202904 - DNA, 601 bp, Human
tgcatacggacttgtctaagtcttgtaaaatggcataaatatactatatttattaatgcaaattatgtaaaggcacataaaatgtaacagtattgtatcataaactggtctctgtgaagttaatatgctataatacaatccatatttttaatactaatttttgcttattttagaattttgtagggttcaggaaaacagggttaaagtggtaccagataatttgtagcccttttaaaacaaaataacctctccaagaaaactaaaattattatcttctttttcttttcacgtatgtccttaragcaagcagaggcatttgaaatcaattactgctccttcttcaaaacagagtctagaatgagaatatactgccagtgattttgtggaacatttaaagagagaccagtctcctacaccttgtcttctcattctctgtttgctctcatacaccatcattaggtgcaaggtaaaaggagtgtgtgtatcaaaggaagaaggaggtgacataacgctttgcttaagtgacaatggaggtgtttacagattgccatgaatactagtgctgtagcttctgtttgtttttaaagaaatcagctgatta

SEQ ID NO: 202905 - DNA, 601 bp, Human
tccgttttcctgcagaagatatttataaaacataaacataatagtctgtattttatcatggattataatgttgtatatgttagttactatgttgtatctccttaccaactacaaattagaaatagtaagtagtaaagaaaatccttgttttaggtaaatagccaagctatcagaataactactattctatgcttttatatatgttataattttaactacaacaccaaggccacaagacctgagttcaaatcctgactctattgcttgtgccagcaggcaatttattaatcttttgagaccwtaatttaattatgtgtaaagatgagaataccaccaaccctattcagactggtgtaaagaaataataatgcaaaatatctaggacagccaacagaatatattcagtagctttttcccaaactttgggactaaaaatccaggtcttcaaaatcctcaaaagctttatgcattatgcatacggacttgtctaagtcttgtaaaatggcataaatatactatatttattaatgcaaattatgtaaaggcacataaaatgtaacagtattgtatcataaactggtctctgtgaagttaatatgct

SEQ ID NO: 202906 - DNA, 601 bp, Human
tacagatatatgcccttttaggggcaaattatgtctttcacttataatgccccaggggtaaagggttattatgttttcaacttatattcaaatggttcactaaaacaattatgcatatagtaggggaacctgggtgaaaatacataagaaatcattttttttttcaatttctctgtaagtcggaaattatttcaaaataaaagtttttttcaagtatttaaaaatcaatttaatgagtcagatttattttatttttgagacagggtcttgctctgtcactcaggctggagtgcagtggcayaatcacagctcactgtagcctcgacctcctgggctcaagtgatcctcccacctcagtctcctgagtgggactacaggggcatgtccagctaattttttaaattttctgtagagatggggtcttgctatgttgcttaggctggtcttgaactcctgatctcaagtgatccttctgcctcagcctcccaaagtgctgggattacaggcatgagcccctgagcccagctgaatgggctagatttttacagctctactttcacgaaaatacatcatcatgtatggttaaagaagtacttgcaat

SEQ ID NO: 202907 - DNA, 601 bp, Human
ctaatgacctcatttaaccttaattacctctttaaaaaccctgtctcaaatacagtcacattcttaggtactggggggtaggacttcaatgtacgaatttcagggagatacaattcagcccataacacaagtatttgaaagtacattacagatatatgcccttttaggggcaaattatgtctttcacttataatgccccaggggtaaagggttattatgttttcaacttatattcaaatggttcactaaaacaattatgcatatagtaggggaacctgggtgaaaatacataagaaatcattttttttttcaatttctctgtaagtcggaaattatttcaaaataaaagtttttttcaagtatttaaaaatcaatttaatgagtcagatttattttatttttgagacagggtcttgctctgtcactcaggctggagtgcagtggcacaatcacagctcactgtagcctcgacctcctgggctcaagtgatcctcccacctcagtctcctgagtgggactacaggggcatgtccagctaattttttaaattttctgtagagatggggtcttgctatgttgcttaggctggtcttgaactcct

SEQ ID NO: 202908 - DNA, 601 bp, Human
gttacccataaactttataacttcccaccctccaggcttctaaagtgctaagcaaaactacttaataaaaataaccaatatttattatactcaaatataacttttagatagtccagatttatagcttagaattatatttatgcatacctgtacattttataatatactgagaccttgtataatcaatgtatgcagtaatatgtttgctattttacattaatgtaagtttttagctgttacaactagtttatgactttttttgctcagtgttaagaattgttggttatctttaataaagaawgtaacccttaattataacactcaatataggacagtaggattccaaattagtattctccattctaaaacatgattcctagaaagcatattaataagggataggtaacaagtgtacatattacagacaaagactagctaaaatatagactagttatataacgtgatcagaaacaaatgtactttcattgattatactacatttcaaacacatcagagcactatctcagagtaaggtggtgaaattttataaaagtatattcactaaatgaaaattcataaatttgcataacaaatgtctcca

SEQ ID NO: 202909 - DNA, 601 bp, Human
gtttacaatgtctttaaatccagtcaacccgtttcctcctaaaatatctttaaaatattctttctccatgctattagtattcagaattaaaatgttgttactgatgtcaaagcaaagagaataaactacggagaaattaactcttcatttccagatacagaaggacctgattttgtagagaccaccaactcaatagtttggagcaggagttggcaaactactgtccacaggccaaatccagcctactgcctgtttttgtaaataaagttttactggaacacagacatacccactcattaaygtattgtctgtgactgttttcacactacaacagcaggattgagtagctgtgatagagcccatagggcctgcaaggcctaaagtatttactacctagcccttcacagaaaaagtttgccaatctctacttaggagaacaaaacgattctactataatgagtatatgcagcactgctacatatctagaacacacaaatggatggatcaaagctatattattaggtgtactgtgaaaatggcacagtatttattcagaaatgaaaagtgaaaaattctatgaacctcttatttaagacataaa

SEQ ID NO: 202910 - DNA, 601 bp, Human
gcctatggaatcagtttacaatgtctttaaatccagtcaacccgtttcctcctaaaatatctttaaaatattctttctccatgctattagtattcagaattaaaatgttgttactgatgtcaaagcaaagagaataaactacggagaaattaactcttcatttccagatacagaaggacctgattttgtagagaccaccaactcaatagtttggagcaggagttggcaaactactgtccacaggccaaatccagcctactgcctgtttttgtaaataaagttttactggaacacagacatwcccactcattaacgtattgtctgtgactgttttcacactacaacagcaggattgagtagctgtgatagagcccatagggcctgcaaggcctaaagtatttactacctagcccttcacagaaaaagtttgccaatctctacttaggagaacaaaacgattctactataatgagtatatgcagcactgctacatatctagaacacacaaatggatggatcaaagctatattattaggtgtactgtgaaaatggcacagtatttattcagaaatgaaaagtgaaaaattctatgaacctctta

SEQ ID NO: 202911 - DNA, 601 bp, Human
tgatctttgctgaataagagacgtgagatcaaatgctgagaccaagatattgcgagatggaagtgatggtaatggaaagaacaatgataaccttggaagagatactgtgaggaattaacaagaggtcaaatagaaataaatcaaagggctgacaggtagcactgaggtgactaagcacaaattaacacagtttcatggctttctccagcaaagctcatcagcaaaagccagagactctgggagtacccaggtttagagaacatgcctatggaatcagtttacaatgtctttaaatccagtyaacccgtttcctcctaaaatatctttaaaatattctttctccatgctattagtattcagaattaaaatgttgttactgatgtcaaagcaaagagaataaactacggagaaattaactcttcatttccagatacagaaggacctgattttgtagagaccaccaactcaatagtttggagcaggagttggcaaactactgtccacaggccaaatccagcctactgcctgtttttgtaaataaagttttactggaacacagacatacccactcattaacgtattgtctgtgactgttttcaca

SEQ ID NO: 202912 - DNA, 601 bp, Human
acagtaacttagtctgtacattaaactgggaattaaaaaatcatttaatattagaactatcatttttaaaatcctcagcttgaaaaggaattaacatagaataaaagagatttatgttgaatgatataactgatctttgctgaataagagacgtgagatcaaatgctgagaccaagatattgcgagatggaagtgatggtaatggaaagaacaatgataaccttggaagagatactgtgaggaattaacaagaggtcaaatagaaataaatcaaagggctgacaggtagcactgaggtgastaagcacaaattaacacagtttcatggctttctccagcaaagctcatcagcaaaagccagagactctgggagtacccaggtttagagaacatgcctatggaatcagtttacaatgtctttaaatccagtcaacccgtttcctcctaaaatatctttaaaatattctttctccatgctattagtattcagaattaaaatgttgttactgatgtcaaagcaaagagaataaactacggagaaattaactcttcatttccagatacagaaggacctgattttgtagagaccaccaactcaata

SEQ ID NO: 202913 - DNA, 601 bp, Human
aaaacatttgtgaaatggtagatgcattattttctctgggagaatttcaagtcatagaagaggaattcacagcaaatattttacagtaacttagtctgtacattaaactgggaattaaaaaatcatttaatattagaactatcatttttaaaatcctcagcttgaaaaggaattaacatagaataaaagagatttatgttgaatgatataactgatctttgctgaataagagacgtgagatcaaatgctgagaccaagatattgcgagatggaagtgatggtaatggaaagaacaatgatraccttggaagagatactgtgaggaattaacaagaggtcaaatagaaataaatcaaagggctgacaggtagcactgaggtgactaagcacaaattaacacagtttcatggctttctccagcaaagctcatcagcaaaagccagagactctgggagtacccaggtttagagaacatgcctatggaatcagtttacaatgtctttaaatccagtcaacccgtttcctcctaaaatatctttaaaatattctttctccatgctattagtattcagaattaaaatgttgttactgatgtcaaagc

SEQ ID NO: 202914 - DNA, 601 bp, Human
tccccagactgggacaataagattctcatgatacagtttgagataaattccctatacaatcagttctttgaattaaaagtaagagtaaggccaggtgtggtggctcacgcctataattctaacactctgggaggccaaggagggaggacagcttgagcccaggatttcaaaaccagcctgggcaacatggtgtgaactcatctctacaaaaaatgtaaataaataaaaataaaaaaaattagccaggaatagtggcacatgcctgtggtcccagctacttgggaggctgaggtgggaagaytgcttgagaccaggaggtcaaggctgcaataagctgtgaccatgccactgtactccagcctaagcgaatgagcaagaacctgtctgcaaaagaaacaaacaaaaaaagtaagataatggtaagaaaaaatatttattgtcaagaatactatattaacctgtctggactgttcttcagagaaatcacaacttctgcttattgtgtatcttaaagattgtaactttaaggcacagacctaacagcatatcctcctaactcacttttgaactgaagtctaattatatatgtctagaaaacatt

SEQ ID NO: 202915 - DNA, 601 bp, Human
aaaatgagttcagtagtcaggcaaggtttgaaaacactggttttagcaaaggtaaacagtttctttgttgtagcacacaccattgtaaaactctaagaccaggctggagtgcggtggtataaccatagctcactgcagcctcaaactcctgggctcaagcaatcctcctacatcagcctccagagtagttgggactataggtttgagcaaccatacctggcttcctaatttcattaggaatctccactccacccccaaatacacagcctttaaaattgattatcctttagaggtaattttccatgggtcaactctggaaaatgctaactgaaaataacacaatttcaattataagcatatatataattccaacagtaaagagtctatggccagaggcttgattttctaaggaatgttgctccagtttaaggggaggtaaataacaagcagaataaggtacatctaagcaaagttaaatggtccttaccaatctaaagagagcaggctagcaataaggaagatccaagtggcagtaactggctggtttgttgtgacagaaactgccatcaaatgtcatcgggtccatcaagaagagtcactg

SEQ ID NO: 202916 - DNA, 601 bp, Human
ttgcttcataaatatcacaaatctaaacattgctattatattgacagtcaacaataaaatgtaatatggaaaatgtaatatagaaaaatgagttcagtagtcaggcaaggtttgaaaacactggttttagcaaaggtaaacagtttctttgttgtagcacacaccattgtaaaactctaagaccaggctggagtgcggtggtataaccatagctcactgcagcctcaaactcctgggctcaagcaatcctcctacatcagcctccagagtagttgggactataggtttgagcaaccatacstggcttcctaatttcattaggaatctccactccacccccaaatacacagcctttaaaattgattatcctttagaggtaattttccatgggtcaactctggaaaatgctaactgaaaataacacaatttcaattataagcatatatataattccaacagtaaagagtctatggccagaggcttgattttctaaggaatgttgctccagtttaaggggaggtaaataacaagcagaataaggtacatctaagcaaagttaaatggtccttaccaatctaaagagagcaggctagcaataagg

SEQ ID NO: 202917 - DNA, 601 bp, Human
ggacgggctatggagggcagagtcacgcagtggccaggacatttagaccatgaaggagttagatttttctttcaagtactaaggaagtcaatggagggttctaagcaaaggagtgacatattattatttacataaaaactgacacaaaaccacctctggcttctgtctggaggatgggcctatagtggggaggaacggagaaggaagctcattgaagaggtctgcaacagtgtaaaggacagatgacagggacttggattaaggtggcaatggtggaatgaagaaatccgacagatttggrgctgcatttttgagttagaaccaaaggctgacagattagatatagaggtaatgatttctaaggttctggatgtcagtgtatgtatggtggaatcatgcggaagtctatgagaaacaggtttgggggaacatatctccttaagtgagtatacctgaacaatacaaaactgtgggtttgataattagggcagccaattagcttacttagaaaaaaaaaatttaaaaactttatgaaacctatgattctgactgtgcccaatttgtgcctgggcaatctcagcagcatttgaacaaattctct

SEQ ID NO: 202918 - DNA, 601 bp, Human
ccatacagtccaagggtggtgagggagaggacgggctatggagggcagagtcacgcagtggccaggacatttagaccatgaaggagttagatttttctttcaagtactaaggaagtcaatggagggttctaagcaaaggagtgacatattattatttacataaaaactgacacaaaaccacctctggcttctgtctggaggatgggcctatagtggggaggaacggagaaggaagctcattgaagaggtctgcaacagtgtaaaggacagatgacagggacttggattaaggtggcaatgrtggaatgaagaaatccgacagatttggggctgcatttttgagttagaaccaaaggctgacagattagatatagaggtaatgatttctaaggttctggatgtcagtgtatgtatggtggaatcatgcggaagtctatgagaaacaggtttgggggaacatatctccttaagtgagtatacctgaacaatacaaaactgtgggtttgataattagggcagccaattagcttacttagaaaaaaaaaatttaaaaactttatgaaacctatgattctgactgtgcccaatttgtgcctgggca

SEQ ID NO: 202919 - DNA, 601 bp, Human
tcttcagtctctcatgaagaattaaaggattatatgttcttcttttatgcccaccatttcaaccttgctgctgctactcattgacagcacctactttcctccgttttatatatggctaatatactttggcaagtatatatgatctccctgatgtgtatctggtaggctctaaaacactatgtggaaatgctgataatactaataaggatactagttttggcttaaatgaggcatttggggactgcatatacaacatgaaaataatttagattacaatatgttaatcaactgtcagttattrgaggtgtccagtgcttacctcatgattacaggacaagactctactaatcaaggattaaacatttcagttattgggctttacatgctttaataatgtttctttaaataggttattttaagaggttcatttgattttgctaaaatcagatattaaaattatcacaaggaaaattatcaaaaggaaacaaaatagtaaacaattacaatgattatttctttttgttcttttgtttaattgtattttcaacaaacatctacgcaccactccagatgctaggaccagcagtaaactgaaaaaagg

SEQ ID NO: 202920 - DNA, 601 bp, Human
aatcaaaagagagaacgagcaaaaaaactctctctattctgatatcagttcgtgggggaagaccattttaccgcgcctccctcttcaatctgggagctcccccagaagaggccctgtgtccattcagatcttctgccttccattactgacccaccacccaccctgaccccagcctgggtctgcgctcaataggcgctcagtaagtgttgttgaatgcgtctgaagaagcaatcgcatttccatcggcatccctggctctgcttccccggctttctgccctcctccaccaccctctagcccrttcgtgggcaaaacttggcaacgcggaaacgtcccagcccgctctccaagccgcgagctgaccactgcgaaacggctgcgacaggcggctgggaaacctagagcaacaagtgccttctcgccggctgatgcctggcggccccccggccaccagttcccagtcccgctgcccgctcttcgcttcaggccttcccttgggcgagcagccccctcccgcctagacaggggtgggaaggggagagggaaaagagaagggagaggcaggtgggggcctcatctttaacctgttgggggaccaaaa

SEQ ID NO: 202921 - DNA, 601 bp, Human
tctttgtaagtaactttatttttatttacaacagaattggtggctttattcctccatctttagggacacttggcattagcagctagatggaaagtccgcagtgaagtcaaactcattctgccccagccacagctccggaagctcattggctcggtccaaccccagttccaccaccagcgacatcagcacttcctcatccactgggtccgaatcgatgatagcagggctctgggcaccagcagaaggagagagtgattctgcccctcccgcctgggccccaaagtcccagttttgcaggggycctgcctccccgggttggcctggagtggcagcagccatcccctgatactggctattaagtttctgcagctgcatactagccagcaagtgaggggcggggtgcaggttgaaggatgggggtttagtgggaggggtggttgtaggagagcctattggagatcccgaggaactagtgggagccccactggccttggttccatttgaggctaccccagggtagtgcagaatggccactgctttgcgatctttcaccgcaaggttggagtaggccacggagctcatctcttggttggcatcctag

SEQ ID NO: 202922 - DNA, 601 bp, Human
aaaacttgttgaattaaaaataagtaataaaattgataatcttgacatgcaacctgtaaaatcattttgtgaataggatgcatgaataggcaatgtatttgattgttagtttcatatttactactagggatgcatgggaaatgcataaagtggtgggcaaggtcattcttcttttcctatttttgaataaaaaatgaagaggaaagtgaaagaataaattagctatataatatatatgtaccatctgaaattgtctctaactttttataactacaggttgagcatcctaaatctgaaaatytgaaatccagaatgctctaaaatccaaaactttttgaacaccaatatagtgctcaaaggaaatgctcattggagcattttggactttggatttttggattgaggatgctcaactggtataatgtaaatattccaaaatctaaaaaaaaaaaaaaaatctaaaatccaaaacaattctggtcccaagcattttagataagggtgcttaacctgtacttttagttaaaaacaaacctttggagaaaaacaaagcttttttttcttctatgttttaaaaacaaagcagtcaaaaaatctgagt

SEQ ID NO: 202923 - DNA, 601 bp, Human
gttaccgcataaaatattgtcatcgagttatctggcagctccgcagagaaacttcacaggcatatgcgttatatgacataatttgcatggggaagggggtcccttcacgattcttttatatggcaacctgttcttggacctggcagggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgyctccagccgctctcctctgacggtcagtttcaaagaaacacagtctgggatccggagtagaaagaggccgtttcccgtgaaggccatagaggcagtttccaggcgcctgggtgacctgtctctgcacttccctctctgcttctccatccctgtttcctttccccactgtcccctgcctggcctttctttggctcattttctaccttcctggggtcttctggttaaaaagaccattggttccattcattggctgtaaccgcgggtctttaaaaaactttgtgacttccttgaatagaaaga

SEQ ID NO: 202924 - DNA, 601 bp, Human
ttactgatcttaaaattaacgcaaacttattgtaaaaacaaacaaacaaaaaaacccaaaaaccaaaaatcaaatatataacagaaaatgaaacttctaggttttcctcttccctaaagataaacaacaaacattcttcttccttctcctctctctctcacacacatttgcttttgaaatatgttcattcaaaaaagtattttaaatgtttacaagctaagttatttatgcaagtaacttaccaatctgatttgagtttaacgggttaaaactaaaaaaaaaaatcaaaaacatcttcagttttttttttttttttaagtaagatggatctggctggtaataggtagagagccccaggtgatcaccgaaaagactcttccttggggagccaaatcctaagccaggtttaggatttccctgggaggtagaatttgcagcccaggtaaaaccagcaaaactctcctgttatgtggggaggggagcgaagagcatggctttctagagaggtgagagaagacttgttgagaaactgaatttcatttccttacggaagttggagaacattgtggtacaatgttaggagaaaggttttctaaaatca

SEQ ID NO: 202925 - DNA, 601 bp, Human
ttacggaagttggagaacattgtggtacaatgttaggagaaaggttttctaaaatcagtgcagtctgacatcttcaacaccagggtcttttccactggagcactgcagacatctgcaactttctctgcctacgtgggtgtggttaaatagaccctccctgagtgcagggctgaaaagtggagagaagttagttcttgggacactcacacccaggaggggggatcctgcaggtactaagattgcaaagggaaagagagagtgaggctggtcctggagcccactaggaaggagccagcggaargcagtgactggacaagggaactgatttctctgctgatgtggccttggtttctctggttcagagtaaagaaaagcaaccaaacctagagagaaacatccttactctacaaggccagatgggaagttctgtctttggcttggtttccttttccacaaacggggttggattctctctggagagctttccgggggccactcagcagtctctgattcagtgggatgttctcagctgctggcccaagggagctcacctcttagctcttcccctgcctggttcactggggggctgctccctcccatt

SEQ ID NO: 202926 - DNA, 601 bp, Human
actttctctgcctacgtgggtgtggttaaatagaccctccctgagtgcagggctgaaaagtggagagaagttagttcttgggacactcacacccaggaggggggatcctgcaggtactaagattgcaaagggaaagagagagtgaggctggtcctggagcccactaggaaggagccagcggaaagcagtgactggacaagggaactgatttctctgctgatgtggccttggtttctctggttcagagtaaagaaaagcaaccaaacctagagagaaacatccttactctacaaggccagaygggaagttctgtctttggcttggtttccttttccacaaacggggttggattctctctggagagctttccgggggccactcagcagtctctgattcagtgggatgttctcagctgctggcccaagggagctcacctcttagctcttcccctgcctggttcactggggggctgctccctcccattagctccctacccctaaagacaaaaatagcagcctggagggggcagagttttaggggaggttgtaagagggcacattcttcagaggagccactcttacgggggaatgttcctgcccca

SEQ ID NO: 202927 - DNA, 601 bp, Human
ccctccctgagtgcagggctgaaaagtggagagaagttagttcttgggacactcacacccaggaggggggatcctgcaggtactaagattgcaaagggaaagagagagtgaggctggtcctggagcccactaggaaggagccagcggaaagcagtgactggacaagggaactgatttctctgctgatgtggccttggtttctctggttcagagtaaagaaaagcaaccaaacctagagagaaacatccttactctacaaggccagatgggaagttctgtctttggcttggtttccttttcyacaaacggggttggattctctctggagagctttccgggggccactcagcagtctctgattcagtgggatgttctcagctgctggcccaagggagctcacctcttagctcttcccctgcctggttcactggggggctgctccctcccattagctccctacccctaaagacaaaaatagcagcctggagggggcagagttttaggggaggttgtaagagggcacattcttcagaggagccactcttacgggggaatgttcctgccccacagaaactggccctggggatcaggactctgcctg

SEQ ID NO: 202928 - DNA, 601 bp, Human
gggacaggttctctggaggtgtgaggtgcctgtccacttaggcttttggcacattttcagcacctcctctctgaaactagcaatgctataaacacacatacacactctcctctctctctgtttctatttctcacacaattcacacacttacatcaggtgtgtaaggaattccacttcattgcactgactttctacatattagtggggctctgcacgatcttggtttctactgagtggattcactccattctgtgattttttttccttagggtcctgcctcagttggcggaatggcggccaygggagccaatgcagagaaagctgaaagtcacaagtaaggctccatttcattccaggttgggttgggtggggttggggttgtttatagagcatatgttgtgccacacatttttctaaggacttgacatatattaacacatttgatgcttgtgaaagagactgaggcctggagggattaatgactcaggaggttcgtacattagatggttaaagacctccggggtcgggtgctggggcctcagctcttgattcttaggacatgttgtttcagaaaaccagacaagtccctgctcaaatctct

SEQ ID NO: 202929 - DNA, 601 bp, Human
gagccactgtacccggccaaattttcatgttttaaaataattgcctgtcttcacggttacaccctacttccttcttcttcatttctcagaatcaaggagaaaagacaagtattttattttgaaatatgtgacaaagttgtcttaatcacatcctgttttgttattttgaagcatgactcttagcccttctatgttgtactctgtgtatttctaacatcctgaaggaggagaatggaaatgttacttacatgaaaaatagttgtcactaaaggatcctaaaatactgtggggtgtgcagatygtcagaatttcagattggcctagagatcaaaaaggttttctgagaaaagttcaaggatggtccttaccacacgtgattctggatttggtcgcttgaaaaatggccttgccccacatcccagagtagaatgaaccctgattctggagatccccccaatagcttgtcaggaagaggtgggcttaggggcaggcgggtgtggctctgtgcttcaggcaggctgctgtgccttcctgagcagggttttcagcagattcactagtgcagtcagcagagtccctgcctgcccatacaggagacagt

SEQ ID NO: 202930 - DNA, 601 bp, Human
agcaggatggaaggagagcctcaaagtaccaggcctctaatcccctctaccacctcacagtgagttacttcaaaacacattttgatttagcaaggagcatggtgaacacagaaatctccagattctaccatagaagtcttttcatttttcagttttgattttgtcaggagcaatataaatgaacagctgcagagtaaggaaagggaaccccttttgttgagatgtgcacccctacctctccagtcagctgaggacactagctatgtcaaccaactagaacatatcagggagccaagacatkactaggttactgataatctgcgcaagcctttcctgtgtgtaaggctccgtgaccgattctagcagggatgcctccactgtatggctctgccacaggaacagcccctggaaagtgctgagttcatccggggagaggcatcacagaagttgtgacactagggggggtgctctgaagaggagagcaggagaaggaggtatgcagagaccccaaagagaggaaaaggcacaggcagacaagatcagcaaagcatcctgtgtccagtgggctgaggaaccagctgattacttagtttgtctgaag

SEQ ID NO: 202931 - DNA, 601 bp, Human
ccaacggccatgagctgtctcggtcctgcaagcttagtctccgatgctgcccacctgacacagctgtgcatagcatgctggcctctgccaggaactctagtgaatggttcttgagttcttgctctggagtgatttttaaaacaatgatcagataattctggagggagtagtatagattttgaattttcctcaattgctctgtaaaaatggaaagagcaactagggagcaaaaccaaaaaccactggacacagttgataataaaaggtgatgtgctatcctcacaaaccccaaagtatgaaygggtggagacaaaaagcctcaggatctggttgtgttggcagctgctcagggggaagctcaaggcgatggacagacctgagaacaagagtcccaggcactcctaggaaggtgcagggggacatggtgaagatggcagctgacactggagggggcctgtgcgtcccaatgtgagtgatgctggaattccaaggggcttgaccactccaggccctgtgggttcaccaaggcatcagccaagctctcctctagctccagccccagtgctgggagaagctgctgaaatgagactctgaattgccc

SEQ ID NO: 202932 - DNA, 601 bp, Human
aaaagtttctgtcccaatatgactgatgtttctgaagatctgggatttggaatggactgggtcatggctggaagagcaaggaaacttttgagtttagtcatttacttgtctttgtaggcagcctattcttcatttgatacatgatttaaaaatgtatgaatttgaaaggtatggtttttaaagtgcttgaatgaaccatgtttcatgttatttaataaccatgtaaaacgaaattcagctgattatcacccctggacaattgcagtcacctttagttaacagcatgacttttaggaaatgrtgtgactaattaataggttgttttgttttgttttgttttttgagacagagtctcactctgttgccccaggctggagtgtggtggtgcaatcttggctcactgcaacctccacctcctgcgtttaagcaattcttgtgcttcagcgtcccaagtagctgggactacagacacccaccacaacacccggctaatttttgtatttttagtagggacaaggttcggccctgttggccaggctggtctcgaactgctgacctcaggtgatctgcttgccttggcctcccaaagtgctgggattgc

SEQ ID NO: 202933 - DNA, 601 bp, Human
gaatgatattgtcaggtatgtgtttaaaaaataataacaaaacttggaattttaaaaatcttagattagatgagagtgacattgaccctaggaagacaccgtggaaactgttgtcatattgcagatgggacattgaagaaggcctgaatcgggcagtgacaatgcagatgggaaaagagggaaggggctggtagaggtttaataggtggaaccctgtcgggtgtgtgtaatgaggaggtaggagcagttgagatgactcccatgtttctaatgaatgactaggataagaatatcctactcrgtggaagaataggtttgggctaaagggtggtgaggagctcacacagtacttggcacataatcagtgctcattaagatttttcaaatgaatgctagtaatagctaaaatttattgagtgcttattaagggccatgtactatcctagactcactatgtgcgttaagccttttactcgtcagtacaatcctgtgagataggtactcaaattaactgctttgactggtgaagaaagtgcagtgttagtaactgacagagccagaaatggatcccaagcacttggttccagagcttgcattctga

SEQ ID NO: 202934 - DNA, 601 bp, Human
tgcagatgggaaaagagggaaggggctggtagaggtttaataggtggaaccctgtcgggtgtgtgtaatgaggaggtaggagcagttgagatgactcccatgtttctaatgaatgactaggataagaatatcctactcggtggaagaataggtttgggctaaagggtggtgaggagctcacacagtacttggcacataatcagtgctcattaagatttttcaaatgaatgctagtaatagctaaaatttattgagtgcttattaagggccatgtactatcctagactcactatgtgcgttmagccttttactcgtcagtacaatcctgtgagataggtactcaaattaactgctttgactggtgaagaaagtgcagtgttagtaactgacagagccagaaatggatcccaagcacttggttccagagcttgcattctgaagcaccctgctgtgatgtgctgtcttgatgaatgaatcaatgaggttttggactttgtggtaagctcaggttgaagtcactctcctgcccctaacaattcttccttatccaagaatggccttgatgcataagatgggccttcagtgtccctactgtgctaca

SEQ ID NO: 202935 - DNA, 601 bp, Human
tctgaaggttccaagtgcttcaatcattgtgtctacagagctgccttggttaccacccctcctaaacactgaatgctcaacttttcatatttctcagatgcactcaatgttttgttgctaagattttccatagggaagcagaaaggctagcaagggaggcattaatctacagagcagggtcaaatggtggaagaaccactaacaaatgcagacaggtacataacaactccagatattacattcctgacttgtgatctgccttttgaatcctattttgttctagttttaccctgaagcaggygccttacctgcctctaacttccagaattttattaagtgagtctggtcctgctgtgtctcctgtcctcttgattttaacttggcaaaatgattcaagtatcttgcattcagaacttgctttccatttggggcacctgggtagattcttttgtctgaacagcagtattttgaccaacaaccctgtccacccgcccccaccgcctccaaaaaaatgatcccaactcttaactgttctcattgttgataattcaacctaccctgacttggattaatatcctgatttttgttcagcaatcaggga

SEQ ID NO: 202936 - DNA, 601 bp, Human
aagcagaaaggctagcaagggaggcattaatctacagagcagggtcaaatggtggaagaaccactaacaaatgcagacaggtacataacaactccagatattacattcctgacttgtgatctgccttttgaatcctattttgttctagttttaccctgaagcaggcgccttacctgcctctaacttccagaattttattaagtgagtctggtcctgctgtgtctcctgtcctcttgattttaacttggcaaaatgattcaagtatcttgcattcagaacttgctttccatttggggcaccwgggtagattcttttgtctgaacagcagtattttgaccaacaaccctgtccacccgcccccaccgcctccaaaaaaatgatcccaactcttaactgttctcattgttgataattcaacctaccctgacttggattaatatcctgatttttgttcagcaatcagggactaagaattgatctaggaagaaactggaataatcagaccttttctcctgggaatttacattttaatggagactgtctgaagattcccagagcttcaaccattatgtccacaaagctgccttggttatcttttcct

SEQ ID NO: 202937 - DNA, 601 bp, Human
aggcgccttacctgcctctaacttccagaattttattaagtgagtctggtcctgctgtgtctcctgtcctcttgattttaacttggcaaaatgattcaagtatcttgcattcagaacttgctttccatttggggcacctgggtagattcttttgtctgaacagcagtattttgaccaacaaccctgtccacccgcccccaccgcctccaaaaaaatgatcccaactcttaactgttctcattgttgataattcaacctaccctgacttggattaatatcctgatttttgttcagcaatcarggactaagaattgatctaggaagaaactggaataatcagaccttttctcctgggaatttacattttaatggagactgtctgaagattcccagagcttcaaccattatgtccacaaagctgccttggttatcttttcctcaaagacctcgactttggaccatgtaaggtttaaaacgcccaattaatgttgtacccaaactgaatcagcaaactcacttattgaagctttaaaatgttcaaatgtccactttgggaggctgaggcaggaggattgcttgagcctgggggcagcggcagggg

SEQ ID NO: 202938 - DNA, 601 bp, Human
gcattcagaacttgctttccatttggggcacctgggtagattcttttgtctgaacagcagtattttgaccaacaaccctgtccacccgcccccaccgcctccaaaaaaatgatcccaactcttaactgttctcattgttgataattcaacctaccctgacttggattaatatcctgatttttgttcagcaatcagggactaagaattgatctaggaagaaactggaataatcagaccttttctcctgggaatttacattttaatggagactgtctgaagattcccagagcttcaaccattrtgtccacaaagctgccttggttatcttttcctcaaagacctcgactttggaccatgtaaggtttaaaacgcccaattaatgttgtacccaaactgaatcagcaaactcacttattgaagctttaaaatgttcaaatgtccactttgggaggctgaggcaggaggattgcttgagcctgggggcagcggcaggggcgggggagaatgttcaaatgtctaaagcttgaagttttaaaatagtttctccacacatgcattgaatgttttgttcagcatttcttcagattcattgggaaatcaa

SEQ ID NO: 202939 - DNA, 601 bp, Human
ctggaataatcagaccttttctcctgggaatttacattttaatggagactgtctgaagattcccagagcttcaaccattatgtccacaaagctgccttggttatcttttcctcaaagacctcgactttggaccatgtaaggtttaaaacgcccaattaatgttgtacccaaactgaatcagcaaactcacttattgaagctttaaaatgttcaaatgtccactttgggaggctgaggcaggaggattgcttgagcctgggggcagcggcaggggcgggggagaatgttcaaatgtctaaarcttgaagttttaaaatagtttctccacacatgcattgaatgttttgttcagcatttcttcagattcattgggaaatcaacatatttatagttgcccatgaaatgagagtgacatgaagcctcgcagggtaatagagcccacatgtctaccccttggcctgagcttttatgtgcctgcctataattcattcagtgctcagatcacaagaaagggaagggttttggctaatatttcatatcggtttgtcttggctgttcaattcaactgtggtttccctgagagaagagaatagctagagtt

SEQ ID NO: 202940 - DNA, 601 bp, Human
ttctcctgggaatttacattttaatggagactgtctgaagattcccagagcttcaaccattatgtccacaaagctgccttggttatcttttcctcaaagacctcgactttggaccatgtaaggtttaaaacgcccaattaatgttgtacccaaactgaatcagcaaactcacttattgaagctttaaaatgttcaaatgtccactttgggaggctgaggcaggaggattgcttgagcctgggggcagcggcaggggcgggggagaatgttcaaatgtctaaagcttgaagttttaaaataktttctccacacatgcattgaatgttttgttcagcatttcttcagattcattgggaaatcaacatatttatagttgcccatgaaatgagagtgacatgaagcctcgcagggtaatagagcccacatgtctaccccttggcctgagcttttatgtgcctgcctataattcattcagtgctcagatcacaagaaagggaagggttttggctaatatttcatatcggtttgtcttggctgttcaattcaactgtggtttccctgagagaagagaatagctagagttgggggctctgttaagcca

SEQ ID NO: 202941 - DNA, 601 bp, Human
atcaattaatttctctgctgctttgtgatcagcagatgcttcatcaccacacatctttgaaaatttgatgctgtgtcttttctaaaatttccgtaaccagccttttgattatttacagtttccttcaattttcagttcactgtgatagatctagcatgtttatggccagcataccattaaatggcatgtgttcagtgtaaggctgatggatccaccctttcaatacatgatcaagatcttcatttctagctttatacagtgttttcctccctcctccccttccttttttctctccttttcttttccctccctccctcccttccttccttccttccttccttctttctttccttcctacctatgaggtcttgctctgtcacccaggctggagtgcagtggcacaatcatagctcactgcagcctcaaactcctgggctcaagtgatactctgacctcatcctcttgagtagctaggactacaggcacacaccaccacacctggcttttgtttgttttttgtagagccatagtctcactatgttgctagtattgaactcctgggctcaagtgatcctcctgccttggcctcccaacacactga

SEQ ID NO: 202942 - DNA, 601 bp, Human
aattaatttctctgctgctttgtgatcagcagatgcttcatcaccacacatctttgaaaatttgatgctgtgtcttttctaaaatttccgtaaccagccttttgattatttacagtttccttcaattttcagttcactgtgatagatctagcatgtttatggccagcataccattaaatggcatgtgttcagtgtaaggctgatggatccaccctttcaatacatgatcaagatcttcatttctagctttatacagtgttttcctccctcctccccttccttttttctctccttttctttcccctccctccctcccttccttccttccttccttccttctttctttccttcctacctatgaggtcttgctctgtcacccaggctggagtgcagtggcacaatcatagctcactgcagcctcaaactcctgggctcaagtgatactctgacctcatcctcttgagtagctaggactacaggcacacaccaccacacctggcttttgtttgttttttgtagagccatagtctcactatgttgctagtattgaactcctgggctcaagtgatcctcctgccttggcctcccaacacactgagat

SEQ ID NO: 202943 - DNA, 601 bp, Human
tgctgctttgtgatcagcagatgcttcatcaccacacatctttgaaaatttgatgctgtgtcttttctaaaatttccgtaaccagccttttgattatttacagtttccttcaattttcagttcactgtgatagatctagcatgtttatggccagcataccattaaatggcatgtgttcagtgtaaggctgatggatccaccctttcaatacatgatcaagatcttcatttctagctttatacagtgttttcctccctcctccccttccttttttctctccttttcttttccctccctccctcccttccttccttccttccttccttctttctttccttcctacctatgaggtcttgctctgtcacccaggctggagtgcagtggcacaatcatagctcactgcagcctcaaactcctgggctcaagtgatactctgacctcatcctcttgagtagctaggactacaggcacacaccaccacacctggcttttgtttgttttttgtagagccatagtctcactatgttgctagtattgaactcctgggctcaagtgatcctcctgccttggcctcccaacacactgagattacaggtgtgag

SEQ ID NO: 202944 - DNA, 601 bp, Human
gctgctttgtgatcagcagatgcttcatcaccacacatctttgaaaatttgatgctgtgtcttttctaaaatttccgtaaccagccttttgattatttacagtttccttcaattttcagttcactgtgatagatctagcatgtttatggccagcataccattaaatggcatgtgttcagtgtaaggctgatggatccaccctttcaatacatgatcaagatcttcatttctagctttatacagtgttttcctccctcctccccttccttttttctctccttttcttttccctccctccctcccttccttccttccttccttccttctttctttccttcctacctatgaggtcttgctctgtcacccaggctggagtgcagtggcacaatcatagctcactgcagcctcaaactcctgggctcaagtgatactctgacctcatcctcttgagtagctaggactacaggcacacaccaccacacctggcttttgtttgttttttgtagagccatagtctcactatgttgctagtattgaactcctgggctcaagtgatcctcctgccttggcctcccaacacactgagattacaggtgtgagc

SEQ ID NO: 202945 - DNA, 601 bp, Human
ctgctttgtgatcagcagatgcttcatcaccacacatctttgaaaatttgatgctgtgtcttttctaaaatttccgtaaccagccttttgattatttacagtttccttcaattttcagttcactgtgatagatctagcatgtttatggccagcataccattaaatggcatgtgttcagtgtaaggctgatggatccaccctttcaatacatgatcaagatcttcatttctagctttatacagtgttttcctccctcctccccttccttttttctctccttttcttttccctccctccctctcttccttccttccttccttccttctttctttccttcctacctatgaggtcttgctctgtcacccaggctggagtgcagtggcacaatcatagctcactgcagcctcaaactcctgggctcaagtgatactctgacctcatcctcttgagtagctaggactacaggcacacaccaccacacctggcttttgtttgttttttgtagagccatagtctcactatgttgctagtattgaactcctgggctcaagtgatcctcctgccttggcctcccaacacactgagattacaggtgtgagcc

SEQ ID NO: 202946 - DNA, 601 bp, Human
caggtgtgagccaccatgcatggagtgtttactattttttaacttaacttctgttcatcattttcaggatggaacttcaacaatttatctttttgtttcttcaggtcatataaggtggtcattccaacaccatatttttctgtctggtttctccaatagcttgattttctttgctacagataaacataaacgcttcccctttttcttgtcactgttactcatagaagtatctgcaggcctttttgaaattttcaaaaatgtcagagcagagtataagcaaagagtcatagtgattaatacmtgaagttcttggtgctatgtggagcatggtggagaatctgctattggtgcatccagcctgctgcacacatgccattttattaccttttgtctgtgtgtgtgcgtgggaaggggaatctggacatgtgcagaaaagatgtattgcagctgaagggggatgggagggtcttttttgccttggggacactgagtaaattgtgtgttatgtacttgtgttttgactgcgacttgtcacaggaggtcaagtgtggaatagtccccttgtggccaatgctcaaaaagttttagattttggagcatt

SEQ ID NO: 202947 - DNA, 601 bp, Human
caggtgctagtcttaagagctttacatggcttacctcatttaatcccctctactatcctatgaggtaattatttatacatggagaagaccaggtatagagaagatggcctacaacaatacagaacatagcagaggcttgaaaagcactcttcgattaagaattgcactcatctgttcagaattgccctaactgctgagaaccctgaaaccagtgaggaaacccaggcaagacccagtagcgggagagctgagatctggatatgtctccacataattccccaggcttgaacacttagccccyctcctatacgtccctgagtagatgtggagttctaaactgattctacagctctgaaaagaagtgtcctgattgccattaacattttgaagggggtcagtaaggccataataagcttctgaaattccttagaaacctagttcacatcccactaatttttgctctttttagcatggcatcaggaaacttctctggtccagtctttgatgatgaaggaaactttgggatgtggcagtggagttgtgttttttgggaagttgcactgtgcctacatactgtttattttggtgagctgaatgatag

SEQ ID NO: 202948 - DNA, 601 bp, Human
tatgttcataattgttttcatgttagacctctgtctacttcaggctgaggatcaggttgtttgagacaacacacttagagtcttagagctcactttgtctagctgagaaggtctgcgaggcagcttattcaattttaccgaggtctaaggccatttcttacttagaattgtttcttccagttgaagagactggagagataaaaagtttttattttcctatcttgtgagttctggtttctctctattttctctaaataatgcttgcaaactagatgattcaatttttagtttgtctctatcrtgcagaacttctatgtagttatagacacactcaaaacactttcaacattgtctggagatctttgcagcgagatgcaaaattcataccaacattttcagcctttggagctgccataggcaacagtgttgccaagtgtttggctgcctatgatatgggctgccttttcccctgactgctctcgcagtttcctcaccacttccaccctcctctgacagtctgcatgccatctttccagttttacttaacagttacatcactgcttttcacctgctatctggtgccaaagccaaggtggaatgt

SEQ ID NO: 202949 - DNA, 601 bp, Human
ccaacattttcagcctttggagctgccataggcaacagtgttgccaagtgtttggctgcctatgatatgggctgccttttcccctgactgctctcgcagtttcctcaccacttccaccctcctctgacagtctgcatgccatctttccagttttacttaacagttacatcactgcttttcacctgctatctggtgccaaagccaaggtggaatgttttaggtttctgttctggcagcatgccacttctaggtaccaatttttctgtcatttagcttatgctatgtaagaagctgctacccrttttggtggtttcaaacacaacgatttattatttctcactatcctgttgattggctgagcagtcttctgttgggctctccgcggctccttcattttcagtcttttgttaggttagctggtggttgtgctcagcctcgagtactgctcagctgggcatcatcttcctgcaggctagcccaggcttcgtcatatagtggaattaagctacccaatagcaagcccttttgcacaaatgcttttcaaacctctgcttgcatcatatttgctaatgtctcaatggtcaaagcaaatctcagtctc

SEQ ID NO: 202950 - DNA, 601 bp, Human
ggactgtgcattctgatcttgaagccagcattagctggatttaccctccctggccacagctgatttcacccaccccacccaggggtagtgcagagacaacacaggttctctgctaaacccacttttaggaaaaagaaagaagtggctgggctactgcagacaggttcttcttttagattcactaattagataagcaactccatgcccctttgcaggaggaggtggagagggatgccagagaagggaagaaacagagcagagaatattgctccttaacaacactagcgcctcccgacctagyacctccccacactagcgcctcccaccctaactcccccaacagcttcagtgcatgattaagtggaaagggcatgaactcaggacctggacagatgtgagtttaaatcccagacttctctcttactcactgggtgaacttaacttctccgagacccagttattagtaaatcgaaaatgatgttaccctcctcccaaggttattgtgaggattgtggtggattttatatcagttctcaagcacaatgactggtttggggtgcacacagtctgtcactgagattcgtttttccttccttgcttt

SEQ ID NO: 202951 - DNA, 601 bp, Human
tgtttgcaaaatcattaagttgcaaaaacaaagacaccacaggagttttaaattagacttttttttaatctagaaaaaaaatttaatgtacttgcttagttcagcagaagctgagagaggtctcaagaccctgaacaataatactgattttattattttatcttattttatgtttttaagttccggggtacacgtgcaagatgcgcaggtttgttacagaggtaaacatgtgccatggtggtttgctgcacagatcatcccatcacctaggttttaagctcagcatgcatcagctcttttycctaatgctctcccctcccccgcacttccccgacaggccccactgtgcattattcccctccctgtgtccaggtgttctcattgttcacctcccacttataagtgagaacatgcagtgtttggttttctgttcctgcattagtttgctgaggataatggcttccagcttcatccatgtccctgcaaagaacatgatctcattcctctttatggctgtatagtacagtctaacattgatgggcatttgggttggttccgtgtctttgctattgtgaatagggctgcagtgaacattgacatg

SEQ ID NO: 202952 - DNA, 601 bp, Human
aaattagacttttttttaatctagaaaaaaaatttaatgtacttgcttagttcagcagaagctgagagaggtctcaagaccctgaacaataatactgattttattattttatcttattttatgtttttaagttccggggtacacgtgcaagatgcgcaggtttgttacagaggtaaacatgtgccatggtggtttgctgcacagatcatcccatcacctaggttttaagctcagcatgcatcagctcttttccctaatgctctcccctcccccgcacttccccgacaggccccactgtgcrttattcccctccctgtgtccaggtgttctcattgttcacctcccacttataagtgagaacatgcagtgtttggttttctgttcctgcattagtttgctgaggataatggcttccagcttcatccatgtccctgcaaagaacatgatctcattcctctttatggctgtatagtacagtctaacattgatgggcatttgggttggttccgtgtctttgctattgtgaatagggctgcagtgaacattgacatgcatgtgtctttataatagaatgatttatattcctttgggtatataccca

SEQ ID NO: 202953 - DNA, 601 bp, Human
aattaatctgtgtttcttacataagactgggtacttttctactataatattacaaataagagtttagaaaatttagagatttagagaatatttagagacagatatttaatttgtctgtttttattttttcaatcgagggaacatgatctctttagaaatgaaagctgaatacttgggttcgcatgggaagctctgaatcagatattagttaaaccagcttgcatttccttgttcttgtaattatctttttcctctccaattaccataatttttcttggttactttttggtaccctgaaagytcattgaaggagaggaagagaagaaagaggtagaggaagaggaggagaaggaggactcctttttgcccaacatgcctcaaatccctgcaaaataatcagcttgaggccaggcacggtggctcacttctgtaatcctagctttgggaggccaaggtcgtggggatcacttgagcccagggttcaagaccagctggggcaatatagggagactctatttaaaataaaaataaataatcagcttattgatgacataccctagtattttatatgaactagtaaaacattcttatgggtttgggt

SEQ ID NO: 202954 - DNA, 601 bp, Human
attgggatatatagcactttttttaatccattcgcctattgatggaaacttaggtaatttcatatcttggctatgtgttgtgagtagtgctgcaataaacatgggaatacagatatctctttaacatactgatttcctttcctttggatatatacccagtagtgggattgttggatcatacggtagttctatttttaattttttgaggaaccttcaaactgttttccataatgggcatatatatgcatatattccaaataacatataagagtttgtgtttcaccaaatccttgtcagcatwttttttttgtctccttggtaatagccattctaactggggtgagattatatcttcttgcggttttgatttgcattaccctgatgattaatgacattgaccattttttgtacctacctgttggccatttgtatgtcttctttagagagatgtctattcagcttatttgtctgctttctaatgtgattttttatttgctattgagctcattttatattatgaatattaaactcttgtcagatgaatagtttgcaaatactttctcctgtcctgcaggttgtcttttttctctgttgactgttt

SEQ ID NO: 202955 - DNA, 601 bp, Human
ttgtggtttcatataaattgtaggagtttttttctgtttctgtgaagaacatcactggtattttgataacattgcattgaattggtagatcacttttagtagtattgtattaatttttacaatattaatgtctacaattcatgaacatgagatatctttccattttttgtgtcttcttcaattttttttatcagtgttttgcagtttttattgtagagatctttcacctccttggttaaatatattcctacatggctttttttgtagctattataaatgcaatttgtttcttgatttttttccactagtttgtttttggtgtatagaaaagctactggtttttgtattctttttttttttttttttgtatcctccaactttactgaatctgtttatcagttctgagatttttggtggagcttttatgattttctatatagaagctcttgttatttgcaaatgaggacaatttgacctccttttcaatttagatgctccttatctctttctctagcctaagtgctctgcctagggcttccagtactcttttgaataaaagtgagatgattgtcttccaaatcttagaagaaaagctttaaac

SEQ ID NO: 202956 - DNA, 601 bp, Human
ataacattgcattgaattggtagatcacttttagtagtattgtattaatttttacaatattaatgtctacaattcatgaacatgagatatctttccattttttgtgtcttcttcaattttttttatcagtgttttgcagtttttattgtagagatctttcacctccttggttaaatatattcctacatggctttttttgtagctattataaatgcaatttgtttcttgatttttttccactagtttgtttttggtgtatagaaaagctactggtttttgtattctttttttttttttttttgtatcctccaactttactgaatctgtttatcagttctgagatttttggtggagcttttatgattttctatatagaagctcttgttatttgcaaatgaggacaatttgacctccttttcaatttagatgctccttatctctttctctagcctaagtgctctgcctagggcttccagtactcttttgaataaaagtgagatgattgtcttccaaatcttagaagaaaagctttaaacttttctccattcagtgtgatattggctgtgggtttgtcatacatggctttaattatgtggaagta

SEQ ID NO: 202957 - DNA, 601 bp, Human
gcctacgcttagaggtttgtggcaatggcactggcaacataagtttttaatgttctttgtgttaagggcttctggggtcctcctattctggttttctctaaaataaggagacttagctgagcgcatcccttttggtgtcaagtctgacatggcctacaagcagctgcagtggcatgggttctacgtgcagtgatcaggattctacatgcagtaggagttttcagctcagtatctcataaagctattgaggcaactgggcttggggtgcagcttcaccccttgtggcagggttggatgtagkttacccatagagccaggatctatgattctgagggaccccctagcagctcaggctcagggtgccaggttgtagctgtgattctacccctggggggcagggcacagcactggcctgactccagggaataaggagtgctctggaactttggccttgggagcagggtatggctgcaattcagaaacctgagtcaatagggctcagtgtcaactcaggttccaagggatgaggcactgggtagtagtgattgtagaccctgggatagtggtgctcagcagtatcccagaatgtgtggggccaagt

SEQ ID NO: 202958 - DNA, 601 bp, Human
tagagcaattccacctccacttgaccccacaggaaaaagtgttaacagctgttaacagcacatattggggatgtggggctctggggatggggtggttcaggggtggtttagtctcagggatgaaggggagccatgactacttactccttgagtaaggctcagtctagctgtagttcctgttccaagatgccatagccaatagtcacatgggccacagcaggtggggcacagtgtcaactccttctctggctaagcacagctatatagactccaggcagcttcaccatgtgggcttggtgcmtaagaagactgcagagaacaccagtgggaaggtctgttggtgtccagggtgttgatggagattgttggagtcatcctgcttacctcctcaccataagaagttcctcctggcttccagctgatcccacttgggggatgggatggtgaaggcctggcatttccttattctctatgtagccatcctgagtttttgtgctcacccaagtttctattagttttaaaatgcagctgcttttccattgttctggctgtctttgacagaggcataagcactaggggcttctagttggctatcttgctg

SEQ ID NO: 202959 - DNA, 601 bp, Human
agtgttgggattacaggcatgaaccaccgcgtctggcccaaaatattctaatttttgacctataattgttttttaaattaaacaattatactcccatttttttcaatatttttcttatgtttccttattaccaaagtgatagattacagtatacaatttgaaaggtactgaaaagtaaaattttaaatactccttaacttcaattaagagccttaacatttcagcatattttcttctaaacttgtttctacttaaaaaaaaaattatataattgaggtcatactgattattctatttcacrctttttttcccacttagagaattataagcatttcaccatgccattaaatactcttccgaataccatgttaatgacttctagtattatttttaaaaccatttagtaaatatatattctttaaagtagtgtacagaaagttcttttcaaatcctaattaaacttaagcatactttaacaaacacccagcaaaatacaattaaaagcagaaaatgtacttttaaacttgagattagggatcagcaaaatgttttctacaaagagccagataatactttagtcttcaaaattactcagctctac

SEQ ID NO: 202960 - DNA, 601 bp, Human
actccttaacttcaattaagagccttaacatttcagcatattttcttctaaacttgtttctacttaaaaaaaaaattatataattgaggtcatactgattattctatttcacactttttttcccacttagagaattataagcatttcaccatgccattaaatactcttccgaataccatgttaatgacttctagtattatttttaaaaccatttagtaaatatatattctttaaagtagtgtacagaaagttcttttcaaatcctaattaaacttaagcatactttaacaaacacccagcraaatacaattaaaagcagaaaatgtacttttaaacttgagattagggatcagcaaaatgttttctacaaagagccagataatactttagtcttcaaaattactcagctctactgttgtacctggaaataagccatagatagtatgataatgaatgagtgtggctgtgttccaataaaactttacttatgaacaccaatatttaaatttcatatgtcaaaaatattcctcttttggtatttatcatttaaaaatgtaaaagcgatgcttaggtttcagaccatacaaaaacaggcagtggc

SEQ ID NO: 202961 - DNA, 601 bp, Human
aatgtacttttaaacttgagattagggatcagcaaaatgttttctacaaagagccagataatactttagtcttcaaaattactcagctctactgttgtacctggaaataagccatagatagtatgataatgaatgagtgtggctgtgttccaataaaactttacttatgaacaccaatatttaaatttcatatgtcaaaaatattcctcttttggtatttatcatttaaaaatgtaaaagcgatgcttaggtttcagaccatacaaaaacaggcagtggctagatttggcccttgagctayatatagtggcagatctctactgtagagcctgattccaagaaccctgccttcccagggtttgagaaatttctgtgaacatatgcattcatatatatttttaagaagaggtaaatagcttttattatatgctaaatagttattaaatataaaatggttaagagtcactattccaaataatatatataaagtcactttataaaccataatttcttattaaaatatatactggtacttcacttataatattcttcacttagataccaaatgatctgaaaaagattgattagtagaaataaattt

SEQ ID NO: 202962 - DNA, 601 bp, Human
agaaggagtagagagcctggatcttacagtgctccctcatgagctgggactgagcagttggagtgaactcactgcagagagggaacacaggcccatgctttggcaacttccaatggagtaagggaaacaatgtggctccacatgaagtgccttttgcccagttacttaccagttaagtcactcctcaagtggcatagaatgagtgaatactttcaaaagagagaaactcctttaaagggcaagcacagaaaccagggggaatgagaagttctctcttacgatctttaactcaaaaaaaaaytcttgatctgttttaaatttaggatgtcagtgaaaattgttgaaataccaagagagacttttagttaacagaatacgtcatagatctaccttttcagtatggtgtttagttggccaaaaagaaaacagtgggccaaataaatccatagcaatgtgtagttaagtttttaaagctctgacatgtaaaaagaactagttttatatgtgacctttttgttatccaagtatggataccaccctccagttctagtggtgcttgtgagcttgcagaccactcccctgctcatgctaagtcactacc

SEQ ID NO: 202963 - DNA, 601 bp, Human
ttcataggtaaagacctttactttactgccaagcaccatggatggcccagagttggccctcaagagctttttatgaaacctacagaactaaagtgtatatattcagggagctgtttgataacatatatattcagggagctgtttaaagtgaaaaagacagacaggattctagaaccaaacatctgacttcttcctttctgcattcattcagcatgtatttgtgccaggctgtcttgtaggtgccacggacacaaccctaaacaggacaagaaaggtctctgctctgtgtgatgcattggcrtgccttaagaattcacatattaagtgatgtttagaatgaagattaacactaaattgtaaccatatttagctactaatactgtgaacactttggtttccaagggaatggtaacagattttccccatttccttatatacagaattagcataaaaacctgagatcaacatgttgtgtttccaaagcctcaaacatacaactgctgagtgaaagctccaagtattttggctatgatcattttcctttgatggatgctgagaatcaactttgcctaaatttctgagagggaaaacagataaaaat

SEQ ID NO: 202964 - DNA, 601 bp, Human
gaaaaactagttaacatcaatctccaccattcaaccccaactcaaacacccccccaacacacatacacacagtacacattctcacaaatacatacacacagacacacacatcccacacaacacacattctcacaaatacacacccatacaccacacatgtacacacatcactaacctcattttatcagatgagaatgcagaaaataaagccaaatatgattttgggcttatctttccaactttcacagtaatccaatagtaacttgagttgccccaaatgttacaggggatttgtacttcyttttgaagatagctatttcattttgtacagctagaagcagcttggttttaggcatggaatgaacctctctgctcatgcttatgaagctgttacttggtcaacaattaaaacttagaaggatagatgcaaataaggagagaaagttttcatctttttctatgttttgaaaaattacagcctaactaaagctgtcattttaaacaagctttttacctttttaccaacttctacgtggaaaacaaaacaaatggcttctgtgagaagcctggaaacctgaattctggttgaggcttttttact

SEQ ID NO: 202965 - DNA, 601 bp, Human
attgagatttgatttatagtaaactattacagaaaagactcactgattgcacaattaatttactgcaaagtagaagttaattttttttcttcttaagaaaacaaggtcataaagagcaaagctgagagacaaattgtacaaaataaccaaaacgagaaatgtaagttgtctttaaatgagtcactaaactggcatctaattttggctgatcttctcttttacttctgttaacaacgtggtcctaaataagtcaatcattgcaaactggcaatctagtctaaaaagaagcttgttaaaattratttggcaccacgcacagtggctcacgcctgtaatcccagcactttgggaggtcgaggtgggagaatcacttgaggtcaggagttcgagactaccctggccaacgtgtcgaaaccccatctctacaaaaaatacaaaaataagccaggtatagtggcatgcgcctgtagtcccagctactccggaggctgagacacaagaatcgcttgaacctgggaggcggaagctgcagtgagccgagattgtgccactgcacttcagcctcagccacagagtgagaccctgtctcaaaaaaaaataa

SEQ ID NO: 202966 - DNA, 601 bp, Human
cattatgctttatgacaaactcttagtgacaggctgctgggctctacagaagtgtctggggttgaggtctccccaggtctgtaaaaggacagataggactcctgttatcaaagtctagcccttccctccccagccttctgcagactcagtaagagtctaaagtctgtagggaccactatttctgaaaaaggaataaaaaggtttaaagagacatccaccagtaaaactgctggtagacttgcaaagagataggatacttgtatccttcaacttggcccaccagttcaaaggaaaagaaacygaatatatctggagacttctccctgtaaatcaaagaaaggatgcttaccacacccttacctagactgcttgtagttactatggaatcataatgatgtctcccaaaagaaagttctacctcgtgctgcagcatgttttcttggccttgagccatcatcactttcaattaagtagaaatcctttacaagttgtcatcagttttatccaagacctttttagagatcacccagtatacaatggctattgcttggctctaattgaagtatagaaatgagtaagatataatggttgctctcaatga

SEQ ID NO: 202967 - DNA, 601 bp, Human
tctctgcactgctgaaaacagctaccagaattcagaggataatgaaggtgatctccaaatagaaaagcaaatgaaagtaaaacattttttaaaaaccctggcacaattaatagtcttaaaaaaatgttatagaatacttgttgaattttccaaggagcatgaagaggtggaggggaatacttgctgatttatattagatctatagcatccatctacagactcaatctccaggaaacagtgttgatttgaggattcatatacaagaaacaccctgccccaaccatgtgctgagcctatgctraatacttttagataaattgtatttttagtcttgtccttacctatactaaaccttgtcactaaatcagatcctcaaacaagcctttgaggagaccctgaggcaacccagcaactatattggctcttccagaacatctttaaaatgaataacagagcaggtttgaagggagtagaagggcagacttatatctgctgaaatgattgcggtttctttggaattaacattgcagaagcaagactaatggtagatttaaaagcagaaggttgggctctggttagacagagtcctagataatccaat

SEQ ID NO: 202968 - DNA, 601 bp, Human
atatcaatgtgattattttatatggtgttacctatctccatggggaacaaaaagctgcaatcaaatcaatgcagtaacttataattggtatttagaataagaatatatggtaattcacctccctgaaattatagcacaaaagtaaaattcctcaaaaacacatgaacagagagtcattattggaaaccagaagaccgtaattatatcctagtgcacttcaactttaccataagaaagtaaaagccctctttaaaaacatgtaatctatagcaggaaagtaataagacacatataagtagcrtatttatttgcacaatgctgtgttaactgaaacttgtgcatattgtaaacatattcttgccttgcacagttccatggtagctgagtattgagaacgggaagagaaacgagaggggagagggaagaaaggaaaaaaaagaaataacttcattgtcttcctcttccctctgttgcatctacaatggtcttcctcacaattcactcatctgctcaattcacaagcatcccagctcttcgtgagcacaacttccatgaccactatgagcacacaaagccctttcttgttttattaaaaataatc

SEQ ID NO: 202969 - DNA, 601 bp, Human
tgcacagttccatggtagctgagtattgagaacgggaagagaaacgagaggggagagggaagaaaggaaaaaaaagaaataacttcattgtcttcctcttccctctgttgcatctacaatggtcttcctcacaattcactcatctgctcaattcacaagcatcccagctcttcgtgagcacaacttccatgaccactatgagcacacaaagccctttcttgttttattaaaaataatccaaatggatgtagaaatataaaggctggtttaatacatactattacttattcatgatccactygttttttaaaaaacattgaatctgtgagaggacttcaaatagttcatggaaaatacacattatttaaaaactaagcatgtgtttaaaaattttttacactgaaataaactcatactaatttgttataacatgtctgaaaaggatctagtttgaggcaacaagaaggataagacatcagtttgaggagtctctatcagagcaacataaattcttctaaaattgaagcatgagcaaacatcaaatttacagtgaagcttgggaggaagaaaggtgaactaatttatactttatgtaaagata

SEQ ID NO: 202970 - DNA, 601 bp, Human
tgaactaatttatactttatgtaaagataatagggacaatgccccaaagaaattagcagtttacaaatggataacttgtctcaagaagggatgagatgatgttaaaatgaagcctgcagcagcaaaccattcacataaatttgcaaggaaaaaattaatcctttgtgccctaattggagaggactgacaattgacagcagaaacaatagccaacaccatagacatctcaattggttcagcttacacaattctgactaaaaaaaaataagatgagcaaacttaacacttgtgtgccaaaacrattgcacagatcagctgcagacaagagtagagctttcaatggaaattttagacaagtgagatcaagatcttgaagcatttatttgaagaactgtgataagagatgaaacacggctttgccagtccgatcctgaagacaaagcacaatcaaaggaatggcctccaagagacggaagtggtccagtcaaagccaaaggagaacattcaagagcaaaggtcatggcaacagctttttgggatgctcagggcattttgcttgttgactttctggagggccaaagaacaataacatctgtttatt

SEQ ID NO: 202971 - DNA, 601 bp, Human
tgcttttgagctctctattctgttctggtgatctaagtatttaatcctgtgtttataccataccatccactatagtagctttataatgtcttgatatctgacttagcaagtcttccaatcttgttcttgttcaaaggtgattacactattcctggccctctgcatttctttataagttatggaattagcttgtaaaaaaataacctgatggaattttattttgcatctatagggcaaatgaaggggaaataataccttcacaatagtaagtcttcaagtctaagagcatggtattttcctyccatgtatttattttggttttctgtttattctttcaaagtcttataattttctatgtagagagctcatacattcttattaggtttctcagggaatttaaatatcataaatgattttttttcatttcactgtttgttattgttaaataggaatacaattgatttttatatatagacattttactgagcaactctaataactaacttgtaaattctaatcaggtattatagaatttttttgattttctccacaattagaacatcagcaaataatgagtttgtttccttttaactcttgtact

SEQ ID NO: 202972 - DNA, 601 bp, Human
ttgcctctctcccacatgaaatgttctcaactacacttcttgtgagtctattcattctgcatagcatagtaaaaatgttaagaatgttaagtggatatattactcatagcattaggcttttcatcaataactcactataaaatacaaaaatagctatttaaaaaatagcacctaagaaataacattctcagctacagaaactattaccagtgaacttacatctttttttttttttttttttttgagatggagtctcactcttgttccccagactagagtgcaatggtgcgatctaggctcrctgcaaccttcacctcctgggttcaagtgattctcctgcctcagcctccctcgtagctgaaattacaggcatgcaccaccacacccagctaattttatatttttagtagagcaggggtttctccatgttggtcaggctgctctcaaactcacgacgtcaggtgatctgcccaccttggcctcccaaagtgctgggattacgggcgtgagccacagcacagccaaacttacatctttttagggagaaatctaaaatttaaaggagcaaactagaaaaacaaagccaagtctattcacgcca

SEQ ID NO: 202973 - DNA, 601 bp, Human
aaataacattctcagctacagaaactattaccagtgaacttacatctttttttttttttttttttttgagatggagtctcactcttgttccccagactagagtgcaatggtgcgatctaggctcactgcaaccttcacctcctgggttcaagtgattctcctgcctcagcctccctcgtagctgaaattacaggcatgcaccaccacacccagctaattttatatttttagtagagcaggggtttctccatgttggtcaggctgctctcaaactcacgacgtcaggtgatctgcccacctyggcctcccaaagtgctgggattacgggcgtgagccacagcacagccaaacttacatctttttagggagaaatctaaaatttaaaggagcaaactagaaaaacaaagccaagtctattcacgccattgaatttctgaactactcatctgtcttctactcattgtcttcattatgttctttgatatatcagtgcacctctaaataaaccttctaaaatcccaatatgcaaagataaaaattccgggcttaaatgttgtgttagttgctgaataactttgaaagaagtttgacaagaatgtct

SEQ ID NO: 202974 - DNA, 601 bp, Human
aaacagaattgaataagaagtgaatttcttctttccagaggccaggcgcggtggctcacgcctgtaatcccagcacttcgggaggccgaggcgagcggatcttgaggtcaggagattgagaccatcctggccaacacggtaaaatcccatatctactaaaaatacaaaaattagccaggcacggtggcatgagcctgtagtcccagctactcaggaggctgaggcaggagaatggcttgaacccgggaagtagaggttgcagtgagccgagatcacaccacagcactccagcctgggcaayagagcaggactctgtctcaaaaaacaaaacaaaacaaaaaattaagaaatatggtctatattgtaaggcattttctgtggatccaggcctgttatgtaattaggactggggtgggagaaggaccgtcttgtcttatatttagacttctgatctgatcactaaataagttacaggtattttgatgttgtcatgtttaaagtgtcatttaaaataaacaattgaaatattatcaatttggtaatcccttttgtggttttatatgttttatatattcattttataatacactaaaagcctcac

SEQ ID NO: 202975 - DNA, 601 bp, Human
gtaattaggactggggtgggagaaggaccgtcttgtcttatatttagacttctgatctgatcactaaataagttacaggtattttgatgttgtcatgtttaaagtgtcatttaaaataaacaattgaaatattatcaatttggtaatcccttttgtggttttatatgttttatatattcattttataatacactaaaagcctcacaaaatggcagtagactgcagttcctaacccctgaggggccgtgtttcatgatgctattatacacatctaaaactaaaataaatattaatgaaaacracgttttccatattaagtgaagagagttaaaggtacatattttatttctataaagtgacaaacacttgatcgctgtaaatgtgaatacaacttttatttttaaacctttcaagggaattagatctattttcctgctgtttccaagccttcggtaaccctctgagtgtgtttgtattcactaggaaggaacatttctgtggaattaatcaaatggagaattcaatgttccttttagataattttggccatgttccattgcgaactttctagtctgcatttcatctctttcctgggaaaaga

SEQ ID NO: 202976 - DNA, 601 bp, Human; identical to SEQ ID NO: 39411

SEQ ID NO: 202977 - DNA, 601 bp, Human; identical to SEQ ID NO: 39412

SEQ ID NO: 202978 - DNA, 601 bp, Human; identical to SEQ ID NO: 39413

SEQ ID NO: 202979 - DNA, 601 bp, Human; identical to SEQ ID NO: 39414

SEQ ID NO: 202980 - DNA, 601 bp, Human; identical to SEQ ID NO: 39415

SEQ ID NO: 202981 - DNA, 601 bp, Human; identical to SEQ ID NO: 39416

SEQ ID NO: 202982 - DNA, 601 bp, Human; identical to SEQ ID NO: 39417

SEQ ID NO: 202983 - DNA, 601 bp, Human; identical to SEQ ID NO: 39418

SEQ ID NO: 202984 - DNA, 601 bp, Human; identical to SEQ ID NO: 39419

SEQ ID NO: 202985 - DNA, 601 bp, Human; identical to SEQ ID NO: 39420

SEQ ID NO: 202986 - DNA, 601 bp, Human; identical to SEQ ID NO: 39421

SEQ ID NO: 202987 - DNA, 601 bp, Human; identical to SEQ ID NO: 39422

SEQ ID NO: 202988 - DNA, 601 bp, Human; identical to SEQ ID NO: 39423

SEQ ID NO: 202989 - DNA, 601 bp, Human; identical to SEQ ID NO: 39424

SEQ ID NO: 202990 - DNA, 601 bp, Human
gaaaccctgtctctactaaaaatacagaaatttagctgggcgtggtggcgggcgcctgtagtcccagctactcgggaggctgaggcaggagaatggcgtgaacccaggaggcggagcttgcagtgagccatgatcgtgccactgcgctccagcctgggagacagcaagactccatctcaaaaaaaaaaaaaaagactgtcatctggagcatgacatcctcagacaacacctctgttccctcaccccccaccccaaagaggtcatttctgaatctatggggaggggcttttgtacctccacrtgactctggaccaccatgaaggaccatgacttttgcatatttccaggaattttttatttttttgagatagggtctcactctgttgctcaggctggggctgcaacctcaacttcccaggctcaagtgatcctcccacctcagcctcccgagtagctgggactataggcgcatgccaccatgcttggcttttttttttttttaattagcagagacgaggtctcgctctattacccaggctggtctcaaactcctgagctcaagcaatcctcctgcctcggcctcccaaagttctgggattac

SEQ ID NO: 202991 - DNA, 601 bp, Human
ctaacatggtgaaaccctgtctctactaaaaatacagaaatttagctgggcgtggtggcgggcgcctgtagtcccagctactcgggaggctgaggcaggagaatggcgtgaacccaggaggcggagcttgcagtgagccatgatcgtgccactgcgctccagcctgggagacagcaagactccatctcaaaaaaaaaaaaaaagactgtcatctggagcatgacatcctcagacaacacctctgttccctcaccccccaccccaaagaggtcatttctgaatctatggggaggggcttttstacctccacgtgactctggaccaccatgaaggaccatgacttttgcatatttccaggaattttttatttttttgagatagggtctcactctgttgctcaggctggggctgcaacctcaacttcccaggctcaagtgatcctcccacctcagcctcccgagtagctgggactataggcgcatgccaccatgcttggcttttttttttttttaattagcagagacgaggtctcgctctattacccaggctggtctcaaactcctgagctcaagcaatcctcctgcctcggcctcccaaagtt

SEQ ID NO: 202992 - DNA, 601 bp, Human
aggcaggcagatcacgaggtcagaagatcgacaccatcctggctaacatggtgaaaccctgtctctactaaaaatacagaaatttagctgggcgtggtggcgggcgcctgtagtcccagctactcgggaggctgaggcaggagaatggcgtgaacccaggaggcggagcttgcagtgagccatgatcgtgccactgcgctccagcctgggagacagcaagactccatctcaaaaaaaaaaaaaaagactgtcatctggagcatgacatcctcagacaacacctctgttccctcaccccccrccccaaagaggtcatttctgaatctatggggaggggcttttgtacctccacgtgactctggaccaccatgaaggaccatgacttttgcatatttccaggaattttttatttttttgagatagggtctcactctgttgctcaggctggggctgcaacctcaacttcccaggctcaagtgatcctcccacctcagcctcccgagtagctgggactataggcgcatgccaccatgcttggcttttttttttttttaattagcagagacgaggtctcgctctattacccaggctggtctcaaac

SEQ ID NO: 202993 - DNA, 601 bp, Human
ataaaaatataggctgggcacagtggctcacgcctataatcccagtactttgggaggctgaggcaggaggattgcttgagcctcggagttcaagaccagcctgggcaacatggtgagacttctttaccaaaaaataaaaaaattagctgggtgtggtggcacacacctgtagttgatctcagcactttgggaggctgaggcgagaggatcacttgaccccaggagatcgaggttgcagtgagtcatgatcgcactccagcctgggaaacagagcaagactttgtctcaaaaaaaaaaaaaacaaaccaaaaaactataaacaaagagatgcaacaataaacaaaatgtgctacattcatacaatgaaatattattcatccttaaaaagtaaggacattttgggccgggtgtggtggctcacgcctgtaatcccaacactttgggaggctgaggtgggcggatcacctgaggtcagaagttggagaccagcctggtcaacgtggtgaaaccctgtctgtactaaaaatacaaaaaaaaattagccaggtgtggtggcgtgtgcctataatcccagctacttgagaggctgaggcaggagaat

SEQ ID NO: 202994 - DNA, 601 bp, Human
agggaaaataattttacttaggaataaaaatataggctgggcacagtggctcacgcctataatcccagtactttgggaggctgaggcaggaggattgcttgagcctcggagttcaagaccagcctgggcaacatggtgagacttctttaccaaaaaataaaaaaattagctgggtgtggtggcacacacctgtagttgatctcagcactttgggaggctgaggcgagaggatcacttgaccccaggagatcgaggttgcagtgagtcatgatcgcactccagcctgggaaacagagcaagrctttgtctcaaaaaaaaaaaaaacaaaccaaaaaactataaacaaagagatgcaacaataaacaaaatgtgctacattcatacaatgaaatattattcatccttaaaaagtaaggacattttgggccgggtgtggtggctcacgcctgtaatcccaacactttgggaggctgaggtgggcggatcacctgaggtcagaagttggagaccagcctggtcaacgtggtgaaaccctgtctgtactaaaaatacaaaaaaaaattagccaggtgtggtggcgtgtgcctataatcccagctac

SEQ ID NO: 202995 - DNA, 601 bp, Human
tacagacagggttttaccatgttggcaaggctggtcttgaactcctgacctcaagcaatccgcccgcctcagcctcctacattgctgggattacaggcatgagccactgcaccaggccttgtctattctttttttcttaagtttgtgatcagattcctacttccccagggaggaggggaataatgttccttaactggctgagtcagtgccatgctagactgcggctgccggccacatgtggctgtttacatttatactaaaattacttgaaatgaaataaaatttaaaatgcagctcctcrgctgcactagccatatctcgggtgctcatgagccacaaggctgggggctgctggactggatggtgcagagaccgcttccatcactgcagaaagctctttgagcccagtggttctcaagcaggggcaatctaccccacctcccctgggcacatgtggcaatgtccagagaccccgcgactggagcgggtgctgtggcatgtagagggtgggggccagggatgcagctgaatatcctataatgcataaggtaggcccccacaacaaagaatggtccatccccaaatgttaatagtgctgaga

SEQ ID NO: 202996 - DNA, 601 bp, Human
aattgtcttgtctcttctttcttttctcttttttttttgtgagatggggtcttgctcagtcacccaggctggagtacagtggcgtgatctcagcttgctgcaatctctgcctcctgggttcaaatgattctcatgcctcagcctcctgagtagctgggactacaggcacttgccaccacgcccagctaatttttgtatttttagtacagacagggttttaccatgttggcaaggctggtcttgaactcctgacctcaagcaatccgcccgcctcagcctcctacattgctgggattacagscatgagccactgcaccaggccttgtctattctttttttcttaagtttgtgatcagattcctacttccccagggaggaggggaataatgttccttaactggctgagtcagtgccatgctagactgcggctgccggccacatgtggctgtttacatttatactaaaattacttgaaatgaaataaaatttaaaatgcagctcctcggctgcactagccatatctcgggtgctcatgagccacaaggctgggggctgctggactggatggtgcagagaccgcttccatcactgcagaaagctc

SEQ ID NO: 202997 - DNA, 601 bp, Human
tagtaccaggctaggggaattgtcttgtctcttctttcttttctcttttttttttgtgagatggggtcttgctcagtcacccaggctggagtacagtggcgtgatctcagcttgctgcaatctctgcctcctgggttcaaatgattctcatgcctcagcctcctgagtagctgggactacaggcacttgccaccacgcccagctaatttttgtatttttagtacagacagggttttaccatgttggcaaggctggtcttgaactcctgacctcaagcaatccgcccgcctcagcctcctamattgctgggattacaggcatgagccactgcaccaggccttgtctattctttttttcttaagtttgtgatcagattcctacttccccagggaggaggggaataatgttccttaactggctgagtcagtgccatgctagactgcggctgccggccacatgtggctgtttacatttatactaaaattacttgaaatgaaataaaatttaaaatgcagctcctcggctgcactagccatatctcgggtgctcatgagccacaaggctgggggctgctggactggatggtgcagagaccgcttcc

SEQ ID NO: 202998 - DNA, 601 bp, Human
ctgggcacctaacaggtgctcactaagcacacattgatttttagaagggaaaaaagtacatgtcacctaaaccagaagaaaatcccccaatcatggatatttggatttggagtatatgtttatgattacagttgccttttggaacaaactatagtaccaggctaggggaattgtcttgtctcttctttcttttctcttttttttttgtgagatggggtcttgctcagtcacccaggctggagtacagtggcgtgatctcagcttgctgcaatctctgcctcctgggttcaaatgattctcrtgcctcagcctcctgagtagctgggactacaggcacttgccaccacgcccagctaatttttgtatttttagtacagacagggttttaccatgttggcaaggctggtcttgaactcctgacctcaagcaatccgcccgcctcagcctcctacattgctgggattacaggcatgagccactgcaccaggccttgtctattctttttttcttaagtttgtgatcagattcctacttccccagggaggaggggaataatgttccttaactggctgagtcagtgccatgctagactgcggctgcc

SEQ ID NO: 202999 - DNA, 601 bp, Human
gtttcactgtgttagccaggatggtctcaatctcctgacctcatgatctgcccgtctcggcctcccaaagtgctaggattacaggcgtgagccacctcgcccggccccttttgcaccttctaagcattcacttactattcacaattctccacaagcaaaatctattttctttcttttccagtctccccattcggaacatctgtgtgctccatgatgaccagagccaaggatctcaccgtgggaatctcccattgtctctaacacggggctgggcacctaacaggtgctcactaagcacacrttgatttttagaagggaaaaaagtacatgtcacctaaaccagaagaaaatcccccaatcatggatatttggatttggagtatatgtttatgattacagttgccttttggaacaaactatagtaccaggctaggggaattgtcttgtctcttctttcttttctcttttttttttgtgagatggggtcttgctcagtcacccaggctggagtacagtggcgtgatctcagcttgctgcaatctctgcctcctgggttcaaatgattctcatgcctcagcctcctgagtagctgggactacag

SEQ ID NO: 203000 - DNA, 601 bp, Human
gcacgatctcggctcactacaagttccgcctcccgggttcacgccattctcctgcctcagcctcttgagtagctgggactacaggcgcccgccaccacgcccggctaattttttttttgtattttcagtggaaacggggtttcactgtgttagccaggatggtctcaatctcctgacctcatgatctgcccgtctcggcctcccaaagtgctaggattacaggcgtgagccacctcgcccggccccttttgcaccttctaagcattcacttactattcacaattctccacaagcaaaatcgattttctttcttttccagtctccccattcggaacatctgtgtgctccatgatgaccagagccaaggatctcaccgtgggaatctcccattgtctctaacacggggctgggcacctaacaggtgctcactaagcacacattgatttttagaagggaaaaaagtacatgtcacctaaaccagaagaaaatcccccaatcatggatatttggatttggagtatatgtttatgattacagttgccttttggaacaaactatagtaccaggctaggggaattgtcttgtctcttctttcttttct

SEQ ID NO: 203001 - DNA, 601 bp, Human
cttcctccctgcaatgacctcctccccatccataggcaaggacaccaccttcttccagcagcaagtctgtctagacccttggacctgtgagagtctctcttccttttgtaccttctttttttttttttttttttgagatggagtctcactctgtcgcccagactggagtgcagtggcacgatctcggctcactacaagttccgcctcccgggttcacgccattctcctgcctcagcctcttgagtagctgggactacaggcgcccgccaccacgcccggctaattttttttttgtattttyagtggaaacggggtttcactgtgttagccaggatggtctcaatctcctgacctcatgatctgcccgtctcggcctcccaaagtgctaggattacaggcgtgagccacctcgcccggccccttttgcaccttctaagcattcacttactattcacaattctccacaagcaaaatctattttctttcttttccagtctccccattcggaacatctgtgtgctccatgatgaccagagccaaggatctcaccgtgggaatctcccattgtctctaacacggggctgggcacctaacaggtgct

SEQ ID NO: 203002 - DNA, 601 bp, Human
gagagggatagaagtcttgatgaccgagatacccagcaaagcaggagctgtgagcatgttaaggaagggagggaagatcttacccaaggggagataacaggagtcttccctgcccaactcacagccctgcatcttcctccctgcaatgacctcctccccatccataggcaaggacaccaccttcttccagcagcaagtctgtctagacccttggacctgtgagagtctctcttccttttgtaccttctttttttttttttttttttgagatggagtctcactctgtcgcccagactggagwgcagtggcacgatctcggctcactacaagttccgcctcccgggttcacgccattctcctgcctcagcctcttgagtagctgggactacaggcgcccgccaccacgcccggctaattttttttttgtattttcagtggaaacggggtttcactgtgttagccaggatggtctcaatctcctgacctcatgatctgcccgtctcggcctcccaaagtgctaggattacaggcgtgagccacctcgcccggccccttttgcaccttctaagcattcacttactattcacaattctccacaagc

SEQ ID NO: 203003 - DNA, 601 bp, Human
aggttgtggtgagttgagaccacgccattgcactccagcctgggcaacaagacagaaactctgtctcaaaaaaaaaaaaaaaaaattagctgggcgtggtgttgggcacctgtaatcccagctacttgggaggctgaggcaggagaactgcttgaacccgggaggcagagattgcagtgacccgagattgtgccactgcactccagcctgggcaacagagagagactccatctcgaacaaaaacaaaaacaaacagagagcttcagcatgggcgaggattcagctgggtatgtttggacascggtgctggctcagaccaaggtcacttttgcacccaagagtccttccgcagcgctgcagtttggccagaaagcccctagagggcagtgtgacgaaactgagctgggacggctgggacttactttaaaggctgttccctgtggataggaacaaacaggatgcagaaaactggaagtaagttccctgcaccacgggggattctgtctcctttcttgtctctccagattttatttttctgatgacaaacgtaataaatgccataattttaaaggtttaatacaggaaagaactgaaaaggaga

SEQ ID NO: 203004 - DNA, 601 bp, Human
ctactaaaaatacaaaattagccaggcgtggtggcacatgcctgtaatccctgctactcggaaggctgaggcaggagaatcacttgaacccgggaggcagaggttgtggtgagttgagaccacgccattgcactccagcctgggcaacaagacagaaactctgtctcaaaaaaaaaaaaaaaaaattagctgggcgtggtgttgggcacctgtaatcccagctacttgggaggctgaggcaggagaactgcttgaacccgggaggcagagattgcagtgacccgagattgtgccactgcaytccagcctgggcaacagagagagactccatctcgaacaaaaacaaaaacaaacagagagcttcagcatgggcgaggattcagctgggtatgtttggacaccggtgctggctcagaccaaggtcacttttgcacccaagagtccttccgcagcgctgcagtttggccagaaagcccctagagggcagtgtgacgaaactgagctgggacggctgggacttactttaaaggctgttccctgtggataggaacaaacaggatgcagaaaactggaagtaagttccctgcaccacgggggattc

SEQ ID NO: 203005 - DNA, 601 bp, Human
cgcccaggtgcggtggctcacacctgtaatcccagcactttgggaggccgaggtgggcggatcacctgaggtcaggagttcgagaccagcctggccaacacagagaaatcccgtctctactaaaaatacaaaattagccaggcgtggtggcacatgcctgtaatccctgctactcggaaggctgaggcaggagaatcacttgaacccgggaggcagaggttgtggtgagttgagaccacgccattgcactccagcctgggcaacaagacagaaactctgtctcaaaaaaaaaaaaaaaaaattagctgggcgtggtgttgggcacctgtaatcccagctacttgggaggctgaggcaggagaactgcttgaacccgggaggcagagattgcagtgacccgagattgtgccactgcactccagcctgggcaacagagagagactccatctcgaacaaaaacaaaaacaaacagagagcttcagcatgggcgaggattcagctgggtatgtttggacaccggtgctggctcagaccaaggtcacttttgcacccaagagtccttccgcagcgctgcagtttggccagaaagcccctagagggc

SEQ ID NO: 203006 - DNA, 601 bp, Human
aacttgaggacattatgctaagtgcaatgcttcagctatggaaggaggtatgactctacctgtacgaggtgtctagaatgggcaaattcatggagacgaagtagaaaggtggttgtcaggggctgggcaaacagaggaacagggaattattggttaatggggagagagtttcagtttgggatgatgaaaaacttctagaaatagatagtgatagttacacaacactgtgaatgtacttaatgccgcccaggtgcggtggctcacacctgtaatcccagcactttgggaggccgaggtgggyggatcacctgaggtcaggagttcgagaccagcctggccaacacagagaaatcccgtctctactaaaaatacaaaattagccaggcgtggtggcacatgcctgtaatccctgctactcggaaggctgaggcaggagaatcacttgaacccgggaggcagaggttgtggtgagttgagaccacgccattgcactccagcctgggcaacaagacagaaactctgtctcaaaaaaaaaaaaaaaaaattagctgggcgtggtgttgggcacctgtaatcccagctacttgggaggctgaggcag

SEQ ID NO: 203007 - DNA, 601 bp, Human
aatgttaacaatttgaaaacatatatagaattcaacttagaagagtattacatattttggaaactttaaaatgtatgcacataaaaagaaataaaatctaccagccgggtgcagtggttcaagcctgtaatctcagcactttgggaagccaaggcaggcggatcacctgaggtcaggagttcaagaccagcctgaccaacatgatgaaaccccgtctctactaaaaaaatacaaaaattagctgggcgtggtggtgcatgcctgtaacctcagctactcaggaggctgaggcaggaaaatygcttgaacctggggggcggaagttgcagtgagccaagatcgcgccactgcactccagcctgggctttgttgcctccgtctcataaataaataaaataaaataaaatctgacccatgctacaacatggatgaacttgaggacattatgctaagtgcaatgcttcagctatggaaggaggtatgactctacctgtacgaggtgtctagaatgggcaaattcatggagacgaagtagaaaggtggttgtcaggggctgggcaaacagaggaacagggaattattggttaatggggagagagtt

SEQ ID NO: 203008 - DNA, 601 bp, Human
actagctgggcatggtggctcacacctgtaatcccagcactttaggaggccagggtgggcagatcacttgaggtcaggagttcgagaccaacctggccaacacggtgaaaccccgtctctactaaaaatataaaaattagctgggggtggtggtgcatgcctgtaatcccagctactcaggaggctgaggcaggagaatcgcttgaacccgggaggtggaagttacaaagagccaagatcgcgccattgcactccagcctgggcaacagagcaagactccgtctcaaaaaaaaaaaaaaaatcaaaattagatatataactttccccactagacctatagctattttctgtgagttcagaatagatcaggaaggagcaaaacagacagatggaaaggaacccattcctgtatcctggttgattctggcatttggcgcccatacaggtataccgcagccccttccctgtccagcctgggcacctgccactacagacaggctgaagctctatcctggcttcccagcttctatggtgatttccactgtatgtatcacttgaccagcattaactcccactttctattagatttgcctttcttctg

SEQ ID NO: 203009 - DNA, 601 bp, Human
ggcgtggtgatgcatgcctgtaatcccagctactcaggagactgaggcaggaggatcgcttgaacccgggaggtggaggttgcagtgagccgagattgcaaactgcactccagcctgggcgacagagacagactccatctcaaaaaagaaaataaataaaaaataaataaaataaaaactaatctttcaggcagggcatggtggctcatggctgtaatcccagtactttgggaggctgaggtagggacatcactcgaggtcaggcatttgcgactagtctggccaacatggtgaaaccccrtctctactacacatacaaaaattagctgggcatggtcgtgggtacctgtaatcccagctactcgggaggctgaggcaggagaatcgcttgaacccagtgggcagaggttacagcgagaagaggtcatgccactacattccagcctcagtgacaagagcaaaactccatctcaaataaatacataaaataaaaaaaatacaaaaaattagccgggtgtggtggcgggtgcctgtagtcccagctactcaggaggctgaggcaggagaatcacttgaacccaggaggtggaggttgcagtga

SEQ ID NO: 203010 - DNA, 601 bp, Human
gtctcctggtcccagactcactgggagtgacccagggtgggaggtgcccagcactcagccatgcttcctgcagggagggtggggatagggtgctaggagcccacagggtaggagccagcctgggagccctggaggcggtaatctcaccttccacagccacatctaggcgctgcactgctccagctgtgcctggcacaacctccgggctcattttaagaggagcaggtgttcaggtgttctcaacacacagaccccacatagacaccaacccaggtgtgaaaatgtcgggaatgttggaaamagcgtaaggcctgcagtgccttctcataagccacacaggcgtttgcacttgcacatttgtagaaaattctccatgggaccatattctctctccccatacagctcctttttctggaagctacaggtaacagagctgaattcatgctcttactctcaaatctcctagccttccagacatctccctcttttttttttgggacagagtctcactctgtcaacccaggctggggtgcagtggtgtgatctcaactcactgcaacctccacctcccacattcaagcaattcttaagcctcatcctc

SEQ ID NO: 203011 - DNA, 601 bp, Human
gcggtaccacgcacaggagccgtcacttctcttgatgcaggcgaagaacttggcctggtgcccgttgatgttcttctctgtgacccagtccatccagaggcactcgtccggggaggagatgtagcacgggatcatggggcagcgcgtgatctggggaggggcacacggagggggacggagtcagggacccaggaaggggtgggcagaggctgctctgggggcatgtccagaacccggcaatgtgcctacctgtcatgtgcagggatggcagcctctcccgagacccacggttcctgcaggrgcaggcagctggcctgcgagggggtctaacctgcagggaagctgtgccctgcccaccgctgccccccctcctactgcaggtgtgcttccctttgggccatcttctaccttcctgagcatgacagaatggcctcagcttggccctgccctctgggggacacagcaacaataaaagggcctgggtttcctggagacagattccagcccagtgttgctcgcaagccgagccccgaggtcatcggcaactagcaatttggccaaggaaccctaggctacaagaggatgaccgccttcaccaccg

SEQ ID NO: 203012 - DNA, 601 bp, Human; identical to SEQ ID NO: 26559

SEQ ID NO: 203013 - DNA, 601 bp, Human; identical to SEQ ID NO: 26560

SEQ ID NO: 203014 - DNA, 601 bp, Human; identical to SEQ ID NO: 26561

SEQ ID NO: 203015 - DNA, 601 bp, Human; identical to SEQ ID NO: 26562

SEQ ID NO: 203016 - DNA, 601 bp, Human
tctttcctgaaggaggagttaagttttttgtgttagctgtttctctttagaaaaacgctctggagaagtggtagctttggttgattgtgatcacccagtgttctttgactctttagggactttgttaaaattcaggatttctaattttctgctgctaataggactgctgatggataaatcctgggaaaaaatcagccaagttcttcaagtctataacgtggcacctgatccttgacctagcttgctgacatcttttgaaagtgggtgaggtaatattgccacataaaagcacctgttaaakttcagtacatcacattctttcaggattatccccagttcccaccttctccaatacgccgtaccacattcctgcaatacattgtaacttatttttttctttgtctttcaataacttgagtttcctagcgggcaaacgacgggtcttaatcatctctttgttatccataccttttacaatagctgctttatgctagtaggtgctcaaaagtatactgaattgattaaaaacagcactaactccagatgtcttaaaagaaagatgttttgtgttttagaaacacagtggaaatttctgaagtaa

SEQ ID NO: 203017 - DNA, 601 bp, Human
aagtgttagatctcaccaaataggcagcaggaagctccaagaaagcagatagataacatgttatacagttaaattgtctcacgctcccaatcactgagggttgattaatccacttactgtaactgcttttagaggaaagtggttggttcttggtgctgctggtctttgaccagctgagttcagtgggtattgatacccactgaactcagctatgaaaatgataagagctatgaaggcaaaagttgttattgatacaactagttgttcagcagtcttaggtgacagcaacgaaaagtattgyggttgtgtgtcaagttactaccttctatcttttgtaatatatagatccaaatcctacatttgctgttggataacctcaaatttgtttcacagtttttccagttattctgatccactgcattattggattactaatagatatctcataattatatcatatacaaatttcattaatcttttctagatgaagtagaaaacacaatgaggatatctaaatatttttaggtggactggctaactgtgggccctttgtgactttgatcttgaaagcaaactaaaggtcagtatgtaaaacagtggt

SEQ ID NO: 203018 - DNA, 601 bp, Human
tcaccaaataggcagcaggaagctccaagaaagcagatagataacatgttatacagttaaattgtctcacgctcccaatcactgagggttgattaatccacttactgtaactgcttttagaggaaagtggttggttcttggtgctgctggtctttgaccagctgagttcagtgggtattgatacccactgaactcagctatgaaaatgataagagctatgaaggcaaaagttgttattgatacaactagttgttcagcagtcttaggtgacagcaacgaaaagtattgcggttgtgtgtcwagttactaccttctatcttttgtaatatatagatccaaatcctacatttgctgttggataacctcaaatttgtttcacagtttttccagttattctgatccactgcattattggattactaatagatatctcataattatatcatatacaaatttcattaatcttttctagatgaagtagaaaacacaatgaggatatctaaatatttttaggtggactggctaactgtgggccctttgtgactttgatcttgaaagcaaactaaaggtcagtatgtaaaacagtggttaggttgttttg

SEQ ID NO: 203019 - DNA, 601 bp, Human
tggtgctgctggtctttgaccagctgagttcagtgggtattgatacccactgaactcagctatgaaaatgataagagctatgaaggcaaaagttgttattgatacaactagttgttcagcagtcttaggtgacagcaacgaaaagtattgcggttgtgtgtcaagttactaccttctatcttttgtaatatatagatccaaatcctacatttgctgttggataacctcaaatttgtttcacagtttttccagttattctgatccactgcattattggattactaatagatatctcataatyatatcatatacaaatttcattaatcttttctagatgaagtagaaaacacaatgaggatatctaaatatttttaggtggactggctaactgtgggccctttgtgactttgatcttgaaagcaaactaaaggtcagtatgtaaaacagtggttaggttgttttgtgagatctagatcagagctgccccatggtttcttgagcatttccaatgagttagaattacatagtaagacttcacctaaaaggtggatctactattgaaacaatttcaattatagagttagggtagcataatgcttag

SEQ ID NO: 203020 - DNA, 601 bp, Human
ctgaactcagctatgaaaatgataagagctatgaaggcaaaagttgttattgatacaactagttgttcagcagtcttaggtgacagcaacgaaaagtattgcggttgtgtgtcaagttactaccttctatcttttgtaatatatagatccaaatcctacatttgctgttggataacctcaaatttgtttcacagtttttccagttattctgatccactgcattattggattactaatagatatctcataattatatcatatacaaatttcattaatcttttctagatgaagtagaaaacasaatgaggatatctaaatatttttaggtggactggctaactgtgggccctttgtgactttgatcttgaaagcaaactaaaggtcagtatgtaaaacagtggttaggttgttttgtgagatctagatcagagctgccccatggtttcttgagcatttccaatgagttagaattacatagtaagacttcacctaaaaggtggatctactattgaaacaatttcaattatagagttagggtagcataatgcttaggagtaggggctccagggccagattgcctgcattcagatcctagttcctc

SEQ ID NO: 203021 - DNA, 601 bp, Human
atctaaatatttttaggtggactggctaactgtgggccctttgtgactttgatcttgaaagcaaactaaaggtcagtatgtaaaacagtggttaggttgttttgtgagatctagatcagagctgccccatggtttcttgagcatttccaatgagttagaattacatagtaagacttcacctaaaaggtggatctactattgaaacaatttcaattatagagttagggtagcataatgcttaggagtaggggctccagggccagattgcctgcattcagatcctagttcctccctttttagsttagaggctaaaaagtttgacttctcaagtaaaaaattgacataataattctaatcacctcatgaagaataaacgagttaaataatgtaaagtgttcagaacagtggctggcagaaagtgaacacttaataatttcatttgatcatttctgaagaatcttttctaattccatcttgcctttcttttttttttttttttgagatggagtctcactctgttgcccaggctagagtgcagtggtgtgatctcagcttactgcaacctccggtccccaggttcaaacgattctcctgcttcagc

SEQ ID NO: 203022 - DNA, 601 bp, Human
tgtttgtaccccaaacctcggcattatgcaatatacccaggtaacaaacccgcacatatacatcctcaagctaaaataaaagtttaaaatgttagttgaagaattgtgtaatgggctgggtccagtggcttacacctgtaatctcagcactttgggagactgaattgggtggatcgattgaggtcacgagtttcagaccagcctggccaaaatggtgaaaccccatctctactaaaaatacaaaaattagctgggtgtggtggtgggtgtctgtaatcccagctatttgtgaagctgaggygtgagaatcacctgaacctgggaggtggagattgctgtaactgagatcatgccactgcattccagcctgggtaatctgggtgatggaaagagccctgtctccaaaaaaaaaaaaaaaaaaaaaaaagagaatctaatggatgaaaaattataataaatatgtctaaatactccttttagaatatacggctaataggctgggtgcagtggctcacgcctgtaatcccagcactttgggaggctgaggcgggcggatcacgaggtcaagatatcaagaccatcctggccaactaacgtggtg

SEQ ID NO: 203023 - DNA, 601 bp, Human
tgcaatatacccaggtaacaaacccgcacatatacatcctcaagctaaaataaaagtttaaaatgttagttgaagaattgtgtaatgggctgggtccagtggcttacacctgtaatctcagcactttgggagactgaattgggtggatcgattgaggtcacgagtttcagaccagcctggccaaaatggtgaaaccccatctctactaaaaatacaaaaattagctgggtgtggtggtgggtgtctgtaatcccagctatttgtgaagctgaggtgtgagaatcacctgaacctgggaggyggagattgctgtaactgagatcatgccactgcattccagcctgggtaatctgggtgatggaaagagccctgtctccaaaaaaaaaaaaaaaaaaaaaaaagagaatctaatggatgaaaaattataataaatatgtctaaatactccttttagaatatacggctaataggctgggtgcagtggctcacgcctgtaatcccagcactttgggaggctgaggcgggcggatcacgaggtcaagatatcaagaccatcctggccaactaacgtggtgaaaccccgtctctactaaaaatacaa

SEQ ID NO: 203024 - DNA, 601 bp, Human
aaaatgttagttgaagaattgtgtaatgggctgggtccagtggcttacacctgtaatctcagcactttgggagactgaattgggtggatcgattgaggtcacgagtttcagaccagcctggccaaaatggtgaaaccccatctctactaaaaatacaaaaattagctgggtgtggtggtgggtgtctgtaatcccagctatttgtgaagctgaggtgtgagaatcacctgaacctgggaggtggagattgctgtaactgagatcatgccactgcattccagcctgggtaatctgggtgatsgaaagagccctgtctccaaaaaaaaaaaaaaaaaaaaaaaagagaatctaatggatgaaaaattataataaatatgtctaaatactccttttagaatatacggctaataggctgggtgcagtggctcacgcctgtaatcccagcactttgggaggctgaggcgggcggatcacgaggtcaagatatcaagaccatcctggccaactaacgtggtgaaaccccgtctctactaaaaatacaaaaattagctgggcatagtggcgcacgcctgtagtcccagctgctcgggaggctgaggca

SEQ ID NO: 203025 - DNA, 601 bp, Human; identical to SEQ ID NO: 105716

SEQ ID NO: 203026 - DNA, 601 bp, Human; identical to SEQ ID NO: 105717

SEQ ID NO: 203027 - DNA, 601 bp, Human; identical to SEQ ID NO: 105718

SEQ ID NO: 203028 - DNA, 601 bp, Human; identical to SEQ ID NO: 105719

SEQ ID NO: 203029 - DNA, 601 bp, Human; identical to SEQ ID NO: 105720

SEQ ID NO: 203030 - DNA, 601 bp, Human; identical to SEQ ID NO: 105721

SEQ ID NO: 203031 - DNA, 601 bp, Human; identical to SEQ ID NO: 105722

SEQ ID NO: 203032 - DNA, 601 bp, Human; identical to SEQ ID NO: 105723

SEQ ID NO: 203033 - DNA, 601 bp, Human; identical to SEQ ID NO: 105716

SEQ ID NO: 203034 - DNA, 601 bp, Human; identical to SEQ ID NO: 105717

SEQ ID NO: 203035 - DNA, 601 bp, Human; identical to SEQ ID NO: 105718

SEQ ID NO: 203036 - DNA, 601 bp, Human; identical to SEQ ID NO: 105719

SEQ ID NO: 203037 - DNA, 601 bp, Human; identical to SEQ ID NO: 105720

SEQ ID NO: 203038 - DNA, 601 bp, Human; identical to SEQ ID NO: 105721

SEQ ID NO: 203039 - DNA, 601 bp, Human; identical to SEQ ID NO: 105722

SEQ ID NO: 203040 - DNA, 601 bp, Human; identical to SEQ ID NO: 105723

SEQ ID NO: 203041 - DNA, 601 bp, Human
tggaatgaaaaagttactctttgtttagcgttcaagttgggagtttgccctgcaagagacagtcaacaactgacttcactcgaatgtgcttggaaagggaagaacttaaaccagccatgaacaggagaagaaagccaggttttctggaaacatcgccaaaacccaacaatttctcagaatgttcagaggcgccaggggggtgtttgcatttcaatggaaaaagttctgaaagcgcctttccggctgtgacgacataacccacacgagaacatgcctctcgcaaaggatctccttcatcccwctccagaacaggagaagaggaaacacaagaagaaacgcctggtgcagagccccaattcctacttcatggatgtgaaatgcccaggatgctataaaatcaccacagtctttagccacgcacaaacggtagttttgtgtgttggctgctccactgtcctctgccagcctacaggaggaaaagcgaggcttacagaaggttattccttcacgaggaagcagcactaaaagcactctgaatcaagatgagtgggaaaccatctcaataaacacattttggataaaaaaaaaaaattctgaaagc

SEQ ID NO: 203042 - DNA, 601 bp, Human
agatatatgatattaggcaagttaatttacctagcccagtctcaatttcaacatctataatctgggattaaaaattaaaatctctagctgggcacagtggctcgtgcctataatcccagctactcagaaggctgaggtgggaggattgcttgaggccaggatttcaagacttgcctgagcaacataatgagatgccctctctcaaaaatttaattaattaatttaaaaagaaaatcccagctactcaggaagctgagatgggaagatcacttgaacccaggagctcaagaccagcctgggmaacataacgagactcaactcttaaaaaaaaccttgaagttatgaagacaaaatgagaatctagctctagtgtttggcacttagtaaccatcaataaacattatccaccccagcccccctcagaaagagatgctataatctttccagacagcaggtttccttgtatgtcactcagctttgtggcctcacctttaatactcccctgtcttttttggaggtaatatcctctccctgctcagcaacagtggctgtggggctttcttcattgttcttggcaccttcatcagtagtcattgtcttt

SEQ ID NO: 203043 - DNA, 601 bp, Human
gtaacctatttgtatactctgagaatagggaaatatagccctttagagtgagatataacttggacctgaaccccaggtaaatctgcattactaagatatatgatattaggcaagttaatttacctagcccagtctcaatttcaacatctataatctgggattaaaaattaaaatctctagctgggcacagtggctcgtgcctataatcccagctactcagaaggctgaggtgggaggattgcttgaggccaggatttcaagacttgcctgagcaacataatgagatgccctctctcaaaartttaattaattaatttaaaaagaaaatcccagctactcaggaagctgagatgggaagatcacttgaacccaggagctcaagaccagcctgggcaacataacgagactcaactcttaaaaaaaaccttgaagttatgaagacaaaatgagaatctagctctagtgtttggcacttagtaaccatcaataaacattatccaccccagcccccctcagaaagagatgctataatctttccagacagcaggtttccttgtatgtcactcagctttgtggcctcacctttaatactcccctgtct

SEQ ID NO: 203044 - DNA, 601 bp, Human
cttttgatgtcatgccaagaaaccactgcaaaatccaatgtcatgaagcctttcctccatattctttatcttttcttttttcttttttttgagacatagtttcgttcttgttgcctaggctggagtgcaatggtgtgatcttggctcactgcaacttctgcctcccgggttcaagcgattctcctgcctccacctcccaagtagctgggattataggcatgcgccaccatgcccagctaatttttttttttttttttttttttagtagagacggggtttcaccatattggtcagggctggkcttgaattcctaacctcaggtgatccgcccgcctcggcctcccaaagtgctggcattacaggtgtgagccactgtgcccggccttcctccatattcttatgggaaggtttctaatgcaaggtttagatcttgcatttaggtctttgatccattttgagttaatttttgcagatggtgtaagataaggacccaatttcattcttttacatgtggatatctagcttttccaacaccatttgttgaaaagactgttctttctcccactgaatggtcttggcacccttgttgaaaaatcactac

SEQ ID NO: 203045 - DNA, 601 bp, Human
gctgtttgaagctggcctagggatcatagggaggccatattattctcctgtgggacataaacaatctcgcaaaatatcaacatgagacaaggtcactctgagactgtgttcaagtgagacaaaacaaaaatacttcaaaattttgtctggccgggcacggtggctcacgcctgtaatcccagctacttgggaggctgaggcagaagaattgcttgaacctgggagctggaggttgcagtgagctgagatcacgccactgcaccccagctccatttcaaaaaagaaaaaaaaatttttttttgtctaagcccagaggaaaaaaacaaggtcactgagcattttcacaaaataccaaacatccccctctcctggctaatatgagtgactgctgcttctctaccagttctagctttggtctcactctactctagttggcccacgtcctaataagatttattaagatacccaaacatcaatcaccccacatcctaacagcatccaatcgagaaagctctgctttcttaaactccccaaaatcacctaatacaagcacaagtcctataaaatattcctcctaacactcttactgagatactccaca

SEQ ID NO: 203046 - DNA, 601 bp, Human
gacctcagtgctgtttgaagctggcctagggatcatagggaggccatattattctcctgtgggacataaacaatctcgcaaaatatcaacatgagacaaggtcactctgagactgtgttcaagtgagacaaaacaaaaatacttcaaaattttgtctggccgggcacggtggctcacgcctgtaatcccagctacttgggaggctgaggcagaagaattgcttgaacctgggagctggaggttgcagtgagctgagatcacgccactgcaccccagctccatttcaaaaaagaaaaaaaawtttttttttgtctaagcccagaggaaaaaaacaaggtcactgagcattttcacaaaataccaaacatccccctctcctggctaatatgagtgactgctgcttctctaccagttctagctttggtctcactctactctagttggcccacgtcctaataagatttattaagatacccaaacatcaatcaccccacatcctaacagcatccaatcgagaaagctctgctttcttaaactccccaaaatcacctaatacaagcacaagtcctataaaatattcctcctaacactcttactgaga

SEQ ID NO: 203047 - DNA, 601 bp, Human
gcccagaggtgaagtctagttgaagccagcctgaggccagggctgaggctggaaccctatctcccaactcctagtctggagctatttccctggtattctacatttaaagctcttcatgtattcaaaaacttatcccaaatggcaatttgggataaataatatttgtaactgcttcccaaaacaacagaatttaaactgatttgccagactcgtagaaatgaaatatgggttgaaaatagtatatactttaaaagaaagaaactcagctattcttgttttctgtttaaatgaactctttacyttttttttttaaggagacaaggtctcactatggtacctaggctagagtgcactggctattcactggtgtaaccatagcacgctatagcctcgaactcctggcctctagtgatcctcctatctcagcctcccaagtagctgggactacaggtgcacaccattacacctggcttttgaaataattattttaaacagaccttttataataatagttcatgttcccatccttgttgaatgatttgatttttgttcttaatggaagtatttctctgttttctcacaactctcttttgaaggattt

SEQ ID NO: 203048 - DNA, 601 bp, Human
aaaaatgtgggcttccttctgccacggccaccattggagagcagcggccatggctctgtgctgccctatggccatgggcctcaacaagggccacaaggtgaccgagaacatgaggacgcccaggcacagccactgctgcaggcacctgaccaaatataccaagttcgtgccggacatgatctgagagctgtgtggcttcaccccatacgagcggtgcaccatggagttactgaaggtctccaaggacaaatgggccctcaagttcatcaagacaagggtggggatgcaccaagaggaagcrggaggagctgagcaatgtcctggccaccatgacaaaagccgctgccaaggactgagcactctgccctgccctctctccgaaataaagaatagcttgacagacttgaaataaaaaaaaaaaaagaaaatgtggtacatatataccatgaaatactatgcagccataaaaaagaatgaaaggatgtcccctacagcaacacagatgcagctggaggccagtaacctaagtgaattaacacagaaacagaaaaccaaatactgcatgttctcacttataagtaggagctaaaccctgagtata

SEQ ID NO: 203049 - DNA, 601 bp, Human
cccagtttggtcttaaactcctgggctcaagtgaccatcccaccttggcctcccaaagtgctgggattacaggcatgagccacacacagcacttactcttaagcacagttatattcttaatagcaaagacacggagtcaacctaggtgtccatcaatggtggattggataaaaatgtgggcttccttctgccacggccaccattggagagcagcggccatggctctgtgctgccctatggccatgggcctcaacaagggccacaaggtgaccgagaacatgaggacgcccaggcacagccrctgctgcaggcacctgaccaaatataccaagttcgtgccggacatgatctgagagctgtgtggcttcaccccatacgagcggtgcaccatggagttactgaaggtctccaaggacaaatgggccctcaagttcatcaagacaagggtggggatgcaccaagaggaagcaggaggagctgagcaatgtcctggccaccatgacaaaagccgctgccaaggactgagcactctgccctgccctctctccgaaataaagaatagcttgacagacttgaaataaaaaaaaaaaaagaaaatgtg

SEQ ID NO: 203050 - DNA, 601 bp, Human
actcaaatgatcctcccactacagcctcctgagtagccggcactacaggcatgcaccaccatgcttggccttttttttttttctgtagaaatggggtcttactatgttgcccagtttggtcttaaactcctgggctcaagtgaccatcccaccttggcctcccaaagtgctgggattacaggcatgagccacacacagcacttactcttaagcacagttatattcttaatagcaaagacacggagtcaacctaggtgtccatcaatggtggattggataaaaatgtgggcttccttctgcyacggccaccattggagagcagcggccatggctctgtgctgccctatggccatgggcctcaacaagggccacaaggtgaccgagaacatgaggacgcccaggcacagccactgctgcaggcacctgaccaaatataccaagttcgtgccggacatgatctgagagctgtgtggcttcaccccatacgagcggtgcaccatggagttactgaaggtctccaaggacaaatgggccctcaagttcatcaagacaagggtggggatgcaccaagaggaagcaggaggagctgagcaatgtcctg

SEQ ID NO: 203051 - DNA, 601 bp, Human
atgaataaaattcttagtaggcaaaggcagtatcttgtacttcttttgtgcctcacagtacccagcacagagttcagggccagcaagtaaatatttatttaatgactaatcttaaaatagggcattaaggacagggtggtaattttcactaatttatacaaattttcctttttgaatctattagtattcctattttaataaattctaggaagctatacaaattttatattgatatggaaactttgttttttaatactattctaaaataaatggccaattggctggaattttttttttttttgtaacaacaacaacagcagcagcagcaacaaaagactgttttctttctttttttgagacagagtctcgttctgttgcccaggctggagtgtagtggcgtgatcttgcctcactacaaccttcacttactgcaaccatctgcctcccgagttcaaggacttcttgtgcctcagactcccaagtagctgggactacaggcccgcaccaccatgcccagctaatttttgtgtttttagtagagatggggtttcgccatgttggccaggctggtcttgaactcccgacctcaagtgatcctcca

SEQ ID NO: 203052 - DNA, 601 bp, Human
gggctagagttggagtggcttggtagagctcgcatatggcattttagtttatgtcccacactcataaatgctgataattccttctgttagacttacttttagaatgctctagataaaattaacttgtagcaaattgaaagttcattctgaattggaaaacatttaaaaaataaattcaaatttaaactttttcaaatacagtcatgcttcacttaaggatggggatacattctgagagatgtgtcatcaggtattctcatcactgtgggaacatcttagaatgttcttacacaaatctagrtggaacagcctactataacctcggctaagtggtatagcatattgctcctaggctataaatctgtatagcatgttattgtactgaatattgtaggcaactgtaacacaatggtaagtacttgtgtatctaaacattgagaaggtaaagatatggaattataatctcacgggaccactgtcctatgtgcaatctgctgttaaacaaaatgttatgcagcatatgactgtacatgcatactagagaggttctacagggagtctgaggcttaagatatttttactgaattcgctgagggtggtg

SEQ ID NO: 203053 - DNA, 601 bp, Human
atcttgatgtgttccccttgcagacacagaatggggtctaagaaacttgggccaaactagaaagggcctaactcttgagtcagctcctccaaacaagggctagagttggagtggcttggtagagctcgcatatggcattttagtttatgtcccacactcataaatgctgataattccttctgttagacttacttttagaatgctctagataaaattaacttgtagcaaattgaaagttcattctgaattggaaaacatttaaaaaataaattcaaatttaaactttttcaaatacagtcaygcttcacttaaggatggggatacattctgagagatgtgtcatcaggtattctcatcactgtgggaacatcttagaatgttcttacacaaatctagatggaacagcctactataacctcggctaagtggtatagcatattgctcctaggctataaatctgtatagcatgttattgtactgaatattgtaggcaactgtaacacaatggtaagtacttgtgtatctaaacattgagaaggtaaagatatggaattataatctcacgggaccactgtcctatgtgcaatctgctgttaaacaa

SEQ ID NO: 203054 - DNA, 601 bp, Human
aaaaataaaaaagaaagaaaatcctttattcctacttctgtaacataatagcctatattcaaatctagagatttcctaaaatgcttcttttctaacactggctgatctactttagatcaacaacttgtagagagactaaaaatcactcgttctgttatactcattccatgcccaataaaacaactattaccttccaaataaaaattcaaatctaacttattctacttttgaactacatgatctcaatgaagctctaaaattctatgattctatgacctggtaatatcactctcaatatcartatagtccagaaaccagcttcaaatctaattcctgcagttaataatttaattgaattacccctagcccaggcctgagaaatgagaaaaactgaagaatgaacagaaatggtgtagacactaggggccgaaatgtcccctggacatttatgctctaaagcgttctacccttttcttctcttttttcgatttgctaaatcttctctgtattgttccaattttagtatatgtgctgccgaagtgagtactcactactcttttttaactcaccagtattaataccatcttgatgtgttcccctt

SEQ ID NO: 203055 - DNA, 601 bp, Human
actggaaataataaatgtaaagtgtgaaagaatcaatagtctactataacttcacaaatcaaattacttaataacctcccctgaaatattaggaggtcaattttgggaggcctaattccccgttccaccccaatttaccaagctctttcccagagtaatttcatattaaaataagaggctttttctcatattttaagacaaaatagaaaaaatgcatacagatatctattttttcttgatgagttagacttttttgagacgcagtcttgctctgtctcacccaggctggagtgcagtggcrtgatatctgctcactgcagcctccacttcctgggttcaaacaattctcctgtctcagcctccgaagtagctgggattacaggtgtgtgccaccacacccagctaattttgttatttttagtagagacagggtttcaccatgttgcccaggctggtctcgaactcctgacctcaggtgatccacccgcctcagcctcccaaagcgctgggattacaggtatgcgccaccaggtctggcctagactctttatttctaggaaaaacaattctctgaaactttacaactacttttaatattaag

SEQ ID NO: 203056 - DNA, 601 bp, Human
aaagacaacaacatcaataactatcttagctatatcccttactggaaataataaatgtaaagtgtgaaagaatcaatagtctactataacttcacaaatcaaattacttaataacctcccctgaaatattaggaggtcaattttgggaggcctaattccccgttccaccccaatttaccaagctctttcccagagtaatttcatattaaaataagaggctttttctcatattttaagacaaaatagaaaaaatgcatacagatatctattttttcttgatgagttagacttttttgagacrcagtcttgctctgtctcacccaggctggagtgcagtggcgtgatatctgctcactgcagcctccacttcctgggttcaaacaattctcctgtctcagcctccgaagtagctgggattacaggtgtgtgccaccacacccagctaattttgttatttttagtagagacagggtttcaccatgttgcccaggctggtctcgaactcctgacctcaggtgatccacccgcctcagcctcccaaagcgctgggattacaggtatgcgccaccaggtctggcctagactctttatttctaggaaa

SEQ ID NO: 203057 - DNA, 601 bp, Human
aaaaatggtaaatccaaagacaacaacatcaataactatcttagctatatcccttactggaaataataaatgtaaagtgtgaaagaatcaatagtctactataacttcacaaatcaaattacttaataacctcccctgaaatattaggaggtcaattttgggaggcctaattccccgttccaccccaatttaccaagctctttcccagagtaatttcatattaaaataagaggctttttctcatattttaagacaaaatagaaaaaatgcatacagatatctattttttcttgatgagttrgacttttttgagacgcagtcttgctctgtctcacccaggctggagtgcagtggcgtgatatctgctcactgcagcctccacttcctgggttcaaacaattctcctgtctcagcctccgaagtagctgggattacaggtgtgtgccaccacacccagctaattttgttatttttagtagagacagggtttcaccatgttgcccaggctggtctcgaactcctgacctcaggtgatccacccgcctcagcctcccaaagcgctgggattacaggtatgcgccaccaggtctggcctagactc

SEQ ID NO: 203058 - DNA, 601 bp, Human
tttaaaaaaattccttaactacccaggtaggtaggtgagtccttgctaagcacatattttctgagagcatgttatatttggagtcctgtgctaagcagttgcaaatgcaacaaatgatctggcatttgccttagaccagcagatctcaaccaggttgattttaactcctcttccctccaggaaacctttggcaatgtctagaaatattatgggttgtcacaactatgggggtgctactggtatctggtgggaagaggccaggaatactgctggatattctacaatgcacgtgacagccccctatgaccaaggattagcaagcccaaagtgtcaacagtgctgaggatgagaaaatctgcctgtggggaatgtggggctgtatcaagggaggcaccaagtgtcctattattgatgggattaaagaagactaaagaaaaatattatttctacaatctctcccaggttaaaatgaagcgattcagtcaagatacgtgtggcgcacatgatcctgcagaggtggaagcccacgccaagatattctggcagcacctaccctgacttccatattacacagaaagttgtcagcctgggtgaagaagga

SEQ ID NO: 203059 - DNA, 601 bp, Human
gacttcattatcatctgctagcttgtattgtgtgtattattacttccaccattacagatacaaatccagaaataactgcacttgccatttacaagctggatttagaaggaccagagtcaagagaacaatctgggagcctttaggaaaagtgacagtgggtgtggtcagtgctatttactgcatataaattatgaagtttaaatgggtaactaaaattctctctattcaaaagataacgagtgtgtgttcctggtgtcacagcccctgctatcctctacttttattattattattattatttttttttttttgagacggagtttcgctcttgttgtccaggctggagtgcaatggtgtgatcttggctcaccacaacctctgcctcccgggttcaagtgattctcctgcctcagcctccggagtagctgggattacaggcatgcaccaccatgcccggctaattttttgtatttttagtagagacggggtttctccatattggtcaggctggtctcaaactcccaacctcaggtgatccacccacctcagctgggattacaggcgtgagctaccgcgcccagtgactatcctctacttttta

SEQ ID NO: 203060 - DNA, 601 bp, Human
gcactccagcctgggtgacagagtaagaccctctctctctaaaaacaataccaacaacaaaaccttttgctatcattgggagcaaaaaatgtgtgggtggaaatgaaaagtgttgtttcactgagatgagataggaaggacaggcatttcccctgtcatgcctcatttcttcatcctctctcctcctccctctctaatgcattgattaacttaacttttctgattatctcctaatatattgtatagggaaagaaaagaagagccagggaggacaaaaacctagatcttaacatttcaataagttctgaataatcagaatggtagaaggccatggtaaaacaaaacaaaacacaaaaaacaggtattagacttcttaatagttccttcacatagggcattttaattttttgaaagctcttgcatatatatcatgtaactttatttagacttcaacttccaattagcgaaaagtctgtcttgtactccctgcttctgaggtactaaagcagttctcaactggggggtgattttgccccccagggaacacctggcaggtctggaggcatttttagttgtcataactgggtaggatgctactggc

SEQ ID NO: 203061 - DNA, 601 bp, Human
tggctcacgcctatagtcccagcactttgggaagctgaggcaggaggatctcttaagtccaggagttcgaagctgcagttagctatgcttgtgccactgcactccagcctgggtgacagagtaagaccctctctctctaaaaacaataccaacaacaaaaccttttgctatcattgggagcaaaaaatgtgtgggtggaaatgaaaagtgttgtttcactgagatgagataggaaggacaggcatttcccctgtcatgcctcatttcttcatcctctctcctcctccctctctaatgcatygattaacttaacttttctgattatctcctaatatattgtatagggaaagaaaagaagagccagggaggacaaaaacctagatcttaacatttcaataagttctgaataatcagaatggtagaaggccatggtaaaacaaaacaaaacacaaaaaacaggtattagacttcttaatagttccttcacatagggcattttaattttttgaaagctcttgcatatatatcatgtaactttatttagacttcaacttccaattagcgaaaagtctgtcttgtactccctgcttctgaggtacta

SEQ ID NO: 203062 - DNA, 601 bp, Human
tattgaaatcaaaggaatgtaaatatggaatcaagactttttctaaagtggtgtggtggctcacgcctatagtcccagcactttgggaagctgaggcaggaggatctcttaagtccaggagttcgaagctgcagttagctatgcttgtgccactgcactccagcctgggtgacagagtaagaccctctctctctaaaaacaataccaacaacaaaaccttttgctatcattgggagcaaaaaatgtgtgggtggaaatgaaaagtgttgtttcactgagatgagataggaaggacaggcayttcccctgtcatgcctcatttcttcatcctctctcctcctccctctctaatgcattgattaacttaacttttctgattatctcctaatatattgtatagggaaagaaaagaagagccagggaggacaaaaacctagatcttaacatttcaataagttctgaataatcagaatggtagaaggccatggtaaaacaaaacaaaacacaaaaaacaggtattagacttcttaatagttccttcacatagggcattttaattttttgaaagctcttgcatatatatcatgtaactttatttaga

SEQ ID NO: 203063 - DNA, 601 bp, Human
ggttgatcaccaagctgtcctacaaaactaaagaataaattctgtacctcaagtaggtaaaattggtctatgatgcagcctctcctttcccttaactgggcctctgtctcctttgatgcccacacccaacccctacagccccttcttgctctcagcaggtgacacagctaatccaaagattcccaccttttaaaatttccagtgttcctccatgatagtagttatgcttttctagtaacccactagaatacatttggtaactcttaaaaggagctgtgtctttttttttttttttttttttaagacagagtcttgctctgtcacccaggttggagtatagtggtgcaatctcagctcactgcaacctccacctcccaggttcaagtgattctcctgcctcagcctcccaagtagctggaatcacaggtgcccaccaccacgcccagctaatttttgtatttttagtagagccggggttttgccatgttggccaggctggtcttgaactcctgacctcaggtgatccacctgccttggcctcccaaagtgctgggattacaggcgtgagctactgcacctggctggatctgtgtcttttaaa

SEQ ID NO: 203064 - DNA, 601 bp, Human
tggcagggctacctgtggaagcgagggcacctgagaaggaactgggccgaacgctggttccagctgcagcccagctgcctctgctactttgggagtgaagagtgcaaagagaaaaggggcattatcccgctggatgcacactgctgcgtggaggtgaggggcaggatgggggtggaggacatctcagggcccagagtgtcctcaggggcatgagaagacaagggggtcaggagaggggcaaatggagaaaagccacagtgacacaaattcctgcttagattagtgtgacccaaatatatcyggatgcctcaaggccattctcatccacgtcagcacttaaaactaaaactgcaactcaagcaccaaagtaattggtgaataatatggaatttgctcaagatttcagaggaagtggcttatatctatactacacagcaaatctttctaaaaatcccttttaaaggtttttcttcttcacccatattccattccctttagcaactctgtacttccctattctccttccatacccctctcctctgtcttccccttctgtttcctcccttgtgttcatcactattttagaggcttaaaacacaag

SEQ ID NO: 203065 - DNA, 601 bp, Human
actcaggaggctgaggtaggagaatcgcttgaacctggagatggaggttgcagtgagtcaagattgcaccattgcacttcagcctgggtgacaggagtgaaactctatctcaaaaaaaaaaaaaaaaaaagatgttctctattttttttgtaaaaagccattttaactgggatgaaatgatatctcatttaattttgatttgcttttctctgatgattagtgacattgagcattttttcatatctctgttgaccatttgtatgtcttcttttgagaaatatctattcagatcttttgcccrtttttaaactggattatttggttttttgttacagagttgtttgagctccttatatattctggttattaatccctcgtcagattgatactttgcaaatattttctcctattctgtgggttgtctcttcactttgttgattgtttccatggctgtcctgaagctttttagcttgacataatcccatttttctatttttggtttggttgcctatgcttttgaggtcttccacaaaaaatctctttgcccagaccaatgtcctggaatatttctccaatgttttcttctagtagtttcatagtt

SEQ ID NO: 203066 - DNA, 601 bp, Human
tgacaggagtgaaactctatctcaaaaaaaaaaaaaaaaaaagatgttctctattttttttgtaaaaagccattttaactgggatgaaatgatatctcatttaattttgatttgcttttctctgatgattagtgacattgagcattttttcatatctctgttgaccatttgtatgtcttcttttgagaaatatctattcagatcttttgcccatttttaaactggattatttggttttttgttacagagttgtttgagctccttatatattctggttattaatccctcgtcagattgatastttgcaaatattttctcctattctgtgggttgtctcttcactttgttgattgtttccatggctgtcctgaagctttttagcttgacataatcccatttttctatttttggtttggttgcctatgcttttgaggtcttccacaaaaaatctctttgcccagaccaatgtcctggaatatttctccaatgttttcttctagtagtttcatagtttcaggtcttacatttaaatgtttaatccatttttatttgatttttttatatggtgagagataggggtctagtttcattcatctgcatg

SEQ ID NO: 203067 - DNA, 601 bp, Human
atgtttaatccatttttatttgatttttttatatggtgagagataggggtctagtttcattcatctgcatgtggttatttagttttcccagaaccatttattgaaaggactgttctttccccattgtgtgttcctggagcctttgtcaaaaatgagttctctgtaaatgcatggatttatatctaggttatctattctgttccattggtctttgtgtctctttttatgccagtactatgctgatttggttactatagctttgtactacattttgtttttttgttttattttagagacaggrtttttctctggtgtccaggctggagtgcagtggtatgatcataggtcactgcagcctcagtctccttgggctcatgggatcctcctgcttcagcctcctgaatagctggggctataggtgtgtaccaccgtggccagttcgtagtgtattttgaagtcaggaaatgtgatgcctccagcttcgttctttttactcaggcttactttggctatttgaggtcttttgtagttccgtataaattttaggattttttttctatatctatgaagaatgcctttgctattttgacagagattgcac

SEQ ID NO: 203068 - DNA, 601 bp, Human
aactcctcatactccctgaccccagctcctagtatcctctattctgctttctgtctccatgaatttgccttttctaggtatcttacataaatagaatcataaaatatttgtccctttgtgtctggtttcttttacttagaaatgttttcaggcttcatctatgttgtcaaatatatcagaatttcattcctttttaaggctggataatatccctaacagtgtgtgaggatctcagtttctccatttccttaccaacagttgttgtttttccttttaaaaaattatcatagccatcctaggrtctgtctaattttgtcacataaggtgttactgtggaaaggagcacggatctacgcagaagtccaagcctcatcactaacagactaacagtgtgaggtggacaatcctggagctcttagtgcctcagtttctttctctgtaaagtggagctaataatgcctgcctggcaaagctgtataggtggagtgaagataatgatgcatataaaatactagtacagactctagaatgtggtagctattattttccacagaatgtaaacttaatggaggcagagatttggtctgttaggcacacctta

SEQ ID NO: 203069 - DNA, 601 bp, Human
cagggtgcagctcctaacttgatcacagaattgtaactgcatggaggtagggtaaggtgttgaaatacgcagaatgtgcaataaatccaactcccttttgcatggaccagaacagccaaattgggtgacaatacatctggaaaaaagaatgtttcccttgaacctggatattaagtgcctgtggcttcaagtcctggatatagtcagtcagttgatgggagaagagttgccgagcagagccatgaacacatctagctctggttctcacctgtgtctcacagggaccatggtgagaaccacyacacaaggggacagggttatctggtgcccataataagaaagacagggaggtgttctctattgggggtagagatgatctcatgtctaaaatttctggtgtgacaaaaaagtatggtattcactgtttttgactattagttttattgaaattgaggcagatttctttgttttaaaggaatggatagatgtaaaattaagatggaaccctgatgactatggtggaataaaagttatacgtgttccttcagactctgtctggacaccagacatcgttttgtttgataagtaagttatattctaa

SEQ ID NO: 203070 - DNA, 601 bp, Human
tttgcatggaccagaacagccaaattgggtgacaatacatctggaaaaaagaatgtttcccttgaacctggatattaagtgcctgtggcttcaagtcctggatatagtcagtcagttgatgggagaagagttgccgagcagagccatgaacacatctagctctggttctcacctgtgtctcacagggaccatggtgagaaccactacacaaggggacagggttatctggtgcccataataagaaagacagggaggtgttctctattgggggtagagatgatctcatgtctaaaatttctgstgtgacaaaaaagtatggtattcactgtttttgactattagttttattgaaattgaggcagatttctttgttttaaaggaatggatagatgtaaaattaagatggaaccctgatgactatggtggaataaaagttatacgtgttccttcagactctgtctggacaccagacatcgttttgtttgataagtaagttatattctaaatatagttttatattttcaaaagaaaacatttgtatttctattaggcactaataatttttctcccttttgaaattgtttaggtataaaaatcaaat

SEQ ID NO: 203071 - DNA, 601 bp, Human
gttttatattttcaaaagaaaacatttgtatttctattaggcactaataatttttctcccttttgaaattgtttaggtataaaaatcaaatgacatgaccgcatgtgcctgggtatgattacatgttttatagatgaggaaacagaggcttagggtggttgttcttttccaagatcacagagctagcacatggcagagtaggggggtcacaccaaggggactgatacctccatttactctttgttttactagactacatatttggcagacttctagatttttttgtatgttttttacgtcrttgaggtcatattttatgttgaattgtgcatccttctagttgtgtttaaatactgtatcgtcattttcccacaatgaggaatgctgggttaattatcaattcatctttagaggcatcctacctaggtgtgttttgaggatttttttttttttttaacttaggggagaggaaaattctgggtaccagttttatttttttctaagaccactcctgggcaaatctgggaatttgtgcttatcttaaagcactttgtctgattcgaaagaaggccatttggcatgaggacagagcaactgctat

SEQ ID NO: 203072 - DNA, 601 bp, Human
tcagcctggtcaacatggtgaaactccatttctactaaaaatacaaaaattagctgggcatggtggcacatgcctatagtcacagctactcgggaggctggggcaggagaatcgcttgaacccaggaggcggagattgcagtgagccgagatcacgccattgcactccagcctgggcgaccgagcaagactccgtctcaaaaaaaaaaaaaaaaaaaaaaagttcttttaaagaatgagcctaatgtggaatttataagtataaaattcagtcttgtcactgttatttcttctattgtgtrttattttaaacctatgactatagtaaattttcataattgaatgtacattaaaattatgtgaattataatctgtaaagctattttaaatggaaaatttccatcaggtatgaggagacagaataaatctggcaaaatcacagcctttatcccaaaagggacatttgatgtatatatttttaaaactttttttcatatgttaatgatttaatttcaataagactttccttccttattttattgtatttcaataggtttttggggaacatgtgtttggtcacatgcataagttctttcatgctg

SEQ ID NO: 203073 - DNA, 601 bp, Human
ggttggttttattttcagataaaaacagaggcagaggtggccaggtgcggtggctcacgcctgtaatcccagcactttgggaggctgaggcaggtggatcacgaggtcaggagtttgagaccagcctggccaatatggtgaaacactgtctctcctaaaaatagaaaaattagctgggcatggtggtgtgtgcctgtagtcccagccacctgggaggctgaggcagaagaatcacttaaacttgggaggcagaggttgcagtgagccgaggtcacgccactgcactccagcctgggggacrgagcaaggctctgtctcaaaataaaataagcagagaagtaacagggtttacaatgccctaaattctaaattatcctacactttggaggcacagttcccatagaggacaccatccttcatagaggttcagggccagggaagcccctggtcaaggaaatggccttgtagaaaggggagcccctgctgcttagtggctgggctcatccttctttttccttgtggtggctccgagctgctgagccagctccctactaaagctggctccagggaagactgttctgtgctcatgaaattagactga

SEQ ID NO: 203074 - DNA, 601 bp, Human
ctctcaggctttactctctctccccatccctgtccccttcttatctgtggtctgatccctcctagtattatgggtccccatcctcttccccagggtgttcctaggctttttccaactccgtgcctgcagtccctgtctccctaagactctcaccttggttccctgagaggccctgtttttgctcctttttccgatttccttcgtatcaattctgtcccctacattcctgtcgcccacctccttttctctccctgttcctttcccctgcttcagggagaagccttagctccacactctactctactttcacttgacctgcagttgacataaccatggggtgggggtggaggtgttcagaccttgatcgaattaagaggctgattgactaaaggaaataacagattgtgtgggagaatgtacgtgggtgttgcatcagagatgatgtccaatttgtaggccattcttcttatctcagctttaatacttcccctttatggggctgttgacttccaggaacccttgggggagacggcgctgagctggatgtgtgccacgggtagccggaggctttgtccaattcttttccccttccaggaaccgg

SEQ ID NO: 203075 - DNA, 601 bp, Human
ggctgttgacttccaggaacccttgggggagacggcgctgagctggatgtgtgccacgggtagccggaggctttgtccaattcttttccccttccaggaaccggggttttgtgtctttccactctggatgtgtggaatacacttataccatgataccccagcctctctctgccctcactcccaccctccaccctgtgctccatccgaaaggactaagagaattctccagaagctgtgctccagaaaatacttgtggtcctcaaccttttttctgtgtactggctccagaacttttttttttcccgtttgagttttgaaatagattgctggcctgatagccctggggctggcgggcatctgtccccttttattattggtggcttgaaacagctgctgattttctctcatatctctttgacaatctttggccaactgaatgtgcctctgatgttggtcactgaacatgttctcttggagtctcttctccctcttttttctttgttcttttctgaatctagggaatccaaattgtccctctttttccctgggagcttaatttcctctgtatccaggaggaacggcaatcccagagctctgttcc

SEQ ID NO: 203076 - DNA, 601 bp, Human
tgcgccaccacatctggctaaattttgtatttttagtagagacggggtttcaccatgttagccagactggtctcaaactcctgatgtcagatgatctacccgcctcagcctcccagagtgctgggattacagatgtgagccactgtgcccagccgggaacaaatatttttaagtgccaactatgtgccaggcacttgggaaatgataatagtaaaaaacagatccaatctctgcctcatgggtctgtggtttgctggtatatatgagagctggccataacacacagaattgtttcttccayctctgcaggggtaggaggttctcaccaagagtctgaacaatgctctgggttcccattgctgtttccatgttctcaggatgcctggcaggttttataaactctcagaagtggagctccagggaatacaatgttcattgtcctatttggaaggctgggttgttgtgggtccctgctgggggccggggaaacgtgggcctcctgcctgatttgttttaatctctgaagttcagtggttccagtagctgtttgtgggcttcacttccccttctctgcctttaacaccctgcaggttttcctgtt

SEQ ID NO: 203077 - DNA, 601 bp, Human
ctgggccacattggaagaagaattattatcttgggctatacataaaatacactaacactaacaatagtgatgagctaaaaataaaaatggcaaaagaatctcatgttttaataaagtttacgtatttgcgttgggatgcattcagagctctcctgggctgcatgcagtcatgggccatgggttggataagcttggcctccctaggcagtcctctcaccacagcctcccaagtagctgggactacaggtgcacaccactgtgcctggctaagttttttttttgtttgtttttgtttttttttaatttaatgggtacatagtagtaggtgtatatttctttttttcttttcttttttgtttttttgagatggaatcttgctcttgtcacccaggctggagagcaatggcacaatcttggctccctgtaacctccacctcctgggttcaagcgattctcctgcctcagcctcccaagtagctcagattacaggcgcccgccaccacgcccagctaatttttgtatttttagtagagatggggttttgtcatgttggccaggctggtctcgaactcctgacctcaagtgatctgcctgcctcagc

SEQ ID NO: 203078 - DNA, 601 bp, Human
ttgggatgcattcagagctctcctgggctgcatgcagtcatgggccatgggttggataagcttggcctccctaggcagtcctctcaccacagcctcccaagtagctgggactacaggtgcacaccactgtgcctggctaagttttttttttgtttgtttttgtttttttttaatttaatgggtacatagtagtaggtgtatatttctttttttcttttcttttttgtttttttgagatggaatcttgctcttgtcacccaggctggagagcaatggcacaatcttggctccctgtaacctscacctcctgggttcaagcgattctcctgcctcagcctcccaagtagctcagattacaggcgcccgccaccacgcccagctaatttttgtatttttagtagagatggggttttgtcatgttggccaggctggtctcgaactcctgacctcaagtgatctgcctgcctcagcctcccaaaatgttgggattacaggcatgagctaccacacccggccttgtatgtcttcttttgagaaatgtctattaaaatcttttgcccatccttttattagattattcgtttttttcctatagagttgt

SEQ ID NO: 203079 - DNA, 601 bp, Human
tctatgtgtcttttttttttttttttttttttctctgagacagagttttgctctgttgcccaggatggagtgcagtggcgtgatgttggctcactgcagcctctgcctcccgtgttcgagcagttctcctgcctcagtctcccaagtagctgggattacaggcatgtgtcaccatgcctggctaattttttgtgtttttagtagagatggggtttcaccatgttggtcaggctggtcttgaactcctgacctcaggtgatctgcccacctcggtctcccaaagtgctgggattacaggcawgagccaccgcgcctgggcgaaagatggcttattttgaagtcaactttagaatattaaaacagcattctcaaactttttggcctcaagatccctttagattctttttttgtttgtttgtttgtttttgttttttgagacggagtctctctctgtcacccaggctggagtgcagtggcacaatctcggcttactgcaagccccgcctcccgggttcatgccattctcctgcctcagcctcccgagtagctgggactacaggtgcccgccaccacgcccagctaattttttgtgtttttagta

SEQ ID NO: 203080 - DNA, 601 bp, Human
tgggactacaggcgcccgccaccactcctggctaattttttgtatttttggtagagacagggtttcacggtgttagccaggatggtctcgatctcctgaccttgtgatccgcccgtctcagcctcccaaagtgctgggattacagtcatgagccacgatgcccgacctctttcttatataatttttttttttaatcgggcagccctcagaatcacagcagattcagaaagactccccagaaaagttctttcactcctaacttctacccagcctcatggtcacctcagcagctctcctgagrccgttactaagttctccacagctaatggtaactcagcttggaaagagttctcttgtaggaggatgctgaagggaggttgccaagtggtgtgggaaactgcttcatgcttaagttcacttccatatcatgatactaaaaggtatctaacagctgattttcattgctttcatttgtgatctgctaggaccacttgatccttatcactgcttttggcacactcctcatccaagagttgatcgcagaggcagagttccttgccaccagtccagtggaagtacaagccaactttgctctccaaat

SEQ ID NO: 203081 - DNA, 601 bp, Human
gaactcttaagagaaaaaaaaaatctctgctgtgattaatcaacagcttcagtctggtgaagtgaaaagagaaaagttggcccagatgtgcacatagggagagaaataagggagggaaattgcctttattcatgttctcccttaggccagtcgttaccccacggatgagatcaccttccttttacaccagcctgcaagaggtgtgtagtggtagtctcattttacagacaaggtgtaggatcagagaggttaactcgcccaagtcaaacagctaacaagtggtggaattggaatttgagcsctgttcttctcagttcagtagccctgctgttcttgctgatgtcacctcagcatgggctctccaggtatgtgcaaatagttatgcaagtgttgcatccacaggcttgtgagcagaggctgaaagggagccagggctcttggtacttgccctctcaacatgggccctgcctaagctagcaggactcactatacccaaaccagcagtggcattatatttttctcttttcttgcaccttgccatccccgatttatttttagagagccttttctatttctgttcccatttcttggcttggatgca

SEQ ID NO: 203082 - DNA, 601 bp, Human
tgccaccaatggcatttttaatttagttaaaaatgttttagttatataaataatgctcattcgttatagatgattagaaaatacagataagcactgaggagaaaaaagtaatatattatcacacataagtggctgctttgatatatgatttttttttcttacctaggttcttttcaaattgtgtatacctagttattttttctgtctttcgaaatgggatgctgtttaacatttagttttgtgacttgcctttcccatttttcaggtggttttgtggtgtctgcttgtcctccgacctccyctcccatttgtgggaaaggcatttggcctggagggaggcacttgggaagaactgtctggttgttccttgatgttattgccagacttgcagagggtagagaggtgcatgaagtcttactctgcctctccccatctgtgtctctccctgtccctgtccagcgccccatctgctctgcctactcaccactcctgccttttttttttttccttccatacaaatccagaaaaggataccacctccagtctgaaggtttctttctatggcttttagggatgaatctctcaggagtttagaaaaaaa

SEQ ID NO: 203083 - DNA, 601 bp, Human
acacataagtggctgctttgatatatgatttttttttcttacctaggttcttttcaaattgtgtatacctagttattttttctgtctttcgaaatgggatgctgtttaacatttagttttgtgacttgcctttcccatttttcaggtggttttgtggtgtctgcttgtcctccgacctcctctcccatttgtgggaaaggcatttggcctggagggaggcacttgggaagaactgtctggttgttccttgatgttattgccagacttgcagagggtagagaggtgcatgaagtcttactcygcctctccccatctgtgtctctccctgtccctgtccagcgccccatctgctctgcctactcaccactcctgccttttttttttttccttccatacaaatccagaaaaggataccacctccagtctgaaggtttctttctatggcttttagggatgaatctctcaggagtttagaaaaaaagatgcacagacagtatataggaagggtaatgccagggctgggggtgggggtcttgggaagagcaactgagaggagggcctgggtccctggtgctgtcttgagtcagtgagaagaagctgc

SEQ ID NO: 203084 - DNA, 601 bp, Human
ctttcgaaatgggatgctgtttaacatttagttttgtgacttgcctttcccatttttcaggtggttttgtggtgtctgcttgtcctccgacctcctctcccatttgtgggaaaggcatttggcctggagggaggcacttgggaagaactgtctggttgttccttgatgttattgccagacttgcagagggtagagaggtgcatgaagtcttactctgcctctccccatctgtgtctctccctgtccctgtccagcgccccatctgctctgcctactcaccactcctgccttttttttttttccttccatacaaatccagaaaaggataccacctccagtctgaaggtttctttctatggcttttagggatgaatctctcaggagtttagaaaaaaagatgcacagacagtatataggaagggtaatgccagggctgggggtgggggtcttgggaagagcaactgagaggagggcctgggtccctggtgctgtcttgagtcagtgagaagaagctgcgtgggtgatgggttggggcggggtaggcagcaggtgactgcagggacctctctgaaacagcaagcaagctggccaggaagacgcc

SEQ ID NO: 203085 - DNA, 601 bp, Human
agggtagagaggtgcatgaagtcttactctgcctctccccatctgtgtctctccctgtccctgtccagcgccccatctgctctgcctactcaccactcctgccttttttttttttccttccatacaaatccagaaaaggataccacctccagtctgaaggtttctttctatggcttttagggatgaatctctcaggagtttagaaaaaaagatgcacagacagtatataggaagggtaatgccagggctgggggtgggggtcttgggaagagcaactgagaggagggcctgggtccctggygctgtcttgagtcagtgagaagaagctgcgtgggtgatgggttggggcggggtaggcagcaggtgactgcagggacctctctgaaacagcaagcaagctggccaggaagacgcctggagaataaggggcccagataggggccagacataggggagaagaaaatgtgtctcagtggcacctgctcctccaccctggccccactctttccatgatctttccagagattctctctttttctgcctgatctgcttccctcacctggcagtgcccagccccagtagtttgacacatctggtatat

SEQ ID NO: 203086 - DNA, 601 bp, Human
acctgctcctccaccctggccccactctttccatgatctttccagagattctctctttttctgcctgatctgcttccctcacctggcagtgcccagccccagtagtttgacacatctggtatatctggctactgtgctctactgacacctgtgtggcagcagctgcacagcttcttggcatctccctgggcagtaggcagggatccgagcatagaggaagatgttccatgcatcagtaactcagattccgttccagaaacgcatctcaaagcaagggagaaaattgaagatggggtatttygtggggaacaagctatgccttcctgtcacttcttacagaataaaatggggtctctggcagtaggcaaggagaaggcctttctgagcactgagggtcagtggcttctcaggtcttttctgggccactttggcctgcacacaggttgggctaggaattcatgcttaaaagcaggctgatttccataggctgtgcgttcctgtgggcctgcctggatcatatctgttctgctgtgatcccaggcctggtgagacccactggcttcctgtacgtcccctcaaagcctgcgccaccgcctctccc

SEQ ID NO: 203087 - DNA, 601 bp, Human
gagcatagaggaagatgttccatgcatcagtaactcagattccgttccagaaacgcatctcaaagcaagggagaaaattgaagatggggtattttgtggggaacaagctatgccttcctgtcacttcttacagaataaaatggggtctctggcagtaggcaaggagaaggcctttctgagcactgagggtcagtggcttctcaggtcttttctgggccactttggcctgcacacaggttgggctaggaattcatgcttaaaagcaggctgatttccataggctgtgcgttcctgtgggccygcctggatcatatctgttctgctgtgatcccaggcctggtgagacccactggcttcctgtacgtcccctcaaagcctgcgccaccgcctctcccttcaccactcccaagctataattaagttcccatgtgaaactgtatccctcagctgacacacgcttgtaactacagccctggccattggacggctcatctggggtgacttctggggctggtgcctcagcctccagacgctctccagtaggtctgagtaggtggtgtggacccaccaggaaagggtggatccagtgaggcgggggcca

SEQ ID NO: 203088 - DNA, 601 bp, Human
cccttggctgctaatctacttcccttctctatggctttccctatcctggacatttcatatgaatggaattatataatatgtagccttttgtgtctgaacaatttcacttagcatgttttcgaggttcatccatgttgtagcatataatagtactgtattcctttttgtggctgagtattccattgtgtgtatatattccattttatttattggtaaattggtggacatttgggttgtttccattttttgactgctgtgaacattcatgtacaagcttttgtgtggacatatgctttaggtwctcttgggaatatacttagtgaaattgctgggtcatatagtattccatgtttaacttttttttttttttttttttgagacggcatcttgctctgttgcccaggctggagtgcagtggcacgatcttggctcactgcaacctgaacctccctggttcaagcaatttccctgcctcagccacctgagtagctgggattacaggtgcatgccaccacgcctggctaattttttttttgtatttttagtagagacgaggtttcaccgtgttggccagactggtctcaaactcctgacctcaggc

SEQ ID NO: 203089 - DNA, 601 bp, Human
atatgtagccttttgtgtctgaacaatttcacttagcatgttttcgaggttcatccatgttgtagcatataatagtactgtattcctttttgtggctgagtattccattgtgtgtatatattccattttatttattggtaaattggtggacatttgggttgtttccattttttgactgctgtgaacattcatgtacaagcttttgtgtggacatatgctttaggttctcttgggaatatacttagtgaaattgctgggtcatatagtattccatgtttaacttttttttttttttttttttgagacggcatcttgctctgttgcccaggctggagtgcagtggcacgatcttggctcactgcaacctgaacctccctggttcaagcaatttccctgcctcagccacctgagtagctgggattacaggtgcatgccaccacgcctggctaattttttttttgtatttttagtagagacgaggtttcaccgtgttggccagactggtctcaaactcctgacctcaggcaatctccccgccttggcctcccaagtgttactctttgttttttgtttgtttttttttttgagacggggtctcact

SEQ ID NO: 203090 - DNA, 601 bp, Human
tagccttttgtgtctgaacaatttcacttagcatgttttcgaggttcatccatgttgtagcatataatagtactgtattcctttttgtggctgagtattccattgtgtgtatatattccattttatttattggtaaattggtggacatttgggttgtttccattttttgactgctgtgaacattcatgtacaagcttttgtgtggacatatgctttaggttctcttgggaatatacttagtgaaattgctgggtcatatagtattccatgtttaacttttttttttttttttttttgagayggcatcttgctctgttgcccaggctggagtgcagtggcacgatcttggctcactgcaacctgaacctccctggttcaagcaatttccctgcctcagccacctgagtagctgggattacaggtgcatgccaccacgcctggctaattttttttttgtatttttagtagagacgaggtttcaccgtgttggccagactggtctcaaactcctgacctcaggcaatctccccgccttggcctcccaagtgttactctttgttttttgtttgtttttttttttgagacggggtctcactctgtc

SEQ ID NO: 203091 - DNA, 601 bp, Human
tagttttagaacattttcttagtcccaaaaagacatcttataatccattagcgtgcattcccgcctcgatgccccatcccgcccttactccagcccaagactaccactcatctgctttctctacgtacagatttacctgttctggacatttcatataaatgggatcatacaatatgtgatcttttgtgattggcttctgtcactggacataatcatggtactgttttgaaacctgctttaaacatttatatcctagcaatttgaatatagttttcaagaatgcacttttaatagcagagcrgtattcattcttatgagaatatctaatcttatttaatcagtcctgccaacagacgtttaggttatttctcatcttttgctcttatagccagtgctctctgcactcagaaattattttgttgatttattggttaattgtccgaatctgtgactagaacaaaagctctttgagaacagtcaccttctctgtctcccctactacttggcatagttcctggcacttggtaggtattcagtttttaaaggatgtgtatgtgtgtatatgtgcaaattttgaatgaatcaaaatgtaaggatatta

SEQ ID NO: 203092 - DNA, 601 bp, Human
atcacatttcccttggggtttcttccaggccttcccctactcaccccacaccctctcagaagatgctgcctcatgtaacttggccaagctctcaagcattacagatgcctttaccttcttttctttgcatcttagaaatcactcacatgttggtctctctcacataattgctttttattattacttcagcggttgccaagtgcctactctatgcctagtaccttgttagactcgggaatgatgcagaagaaagagactggaccctgccccctaggagggtaaatgtctgttctcccatggyctctgtttcccttcctctctgactgcgcctttgctgccctggttcctcttcctctttccgctgcctgagtgtcaacattcttcaggcttctgccctctctcctctccctccacgcgcttgtcccttcctgtggctgtgaccatctgctcttatagctaccaaatactaaagttcttttctcctgaaaaccaggtccctgtgtccacctgcctgctggagtgtgcagccttaaaagcagagtccatctttgtctctgctctttgcatatcccctttctgttaataatccgtcattctctca

SEQ ID NO: 203093 - DNA, 601 bp, Human
gagttggatggttgcccctccaaaagatatgtccaagtcctaacccctagaacctgtgaacatgaccaccttgtttggaaaaaaactcattgcagagattctttcctatgctgcagacgtacatgaacctgtgctcattgacctcctctctgggcctggccttgttggtctctggcttgaaatagtgactgtacttctagtccacacagtgattacatatttattactctgtttgagctcccctagtccaaaggcaaagttcactgcctgccctttccactaactcctaggtcagacttgmtaggttgtgtgcacagcagctacaagtgtggtttctaaggtgggtctgggtttgaatcctggttctgtcatttattagccaagggcctttgacagattgtaacctttctgggcttcagtttcctcttctggaaaatggagctaatggattgttgtgagaattagattgcatagtgtctagcactgtgcctgacactctgagctttatttttatttatttttattttttgagacggagtctcgctctgttgcctaggctggagtggagtggcatgatctcggttcactgcaacctccacct

SEQ ID NO: 203094 - DNA, 601 bp, Human
actgatttctcacagttctggaggctgggaagttcaagatcaaggcattggcagacttgatgtctggtgaaggctgctgtccacttccaagatggcaccttgttgctgtgtcctccagaggggatgaatgctgtgtccttacatggcagaagggtgaaagtggcccagctagttccctggagcccttttataagagcactaatccgttcctgagggcagagccttcatgacctaaacacctccaaaggccacacctcttaataccgttgtattggggattaagtttcaacatgaattttggagggttcacaacattcaaaccatagcaatgtcttatagagtaatcgggatgattaaatgaaagaatgcccataaaacattgaacacatgcctgactctttgtaaacaataattattaggtatcgctattatagagaccagcttctgctgtggagagtgttaagtgccttgatgccacaagccactggacacgcagctgcatggatcaatgtacccctgtaattatgtaacaaggggacatggagaaaaaaacatttccaatgttgcctcctctgtaacatgattgtacccctaaactgca

SEQ ID NO: 203095 - DNA, 601 bp, Human
aatcagccaccaagtcttgtttgtccttcctccctaatgtcactcctgttttttgccgtgaggtctgatggcactagtgctgcctggggttgctactgcctcatctcttcaacctttttgtgtcacgatgtttaggagtttctttcataaacagaatgtggctggatttaaatcaaatctgacaatctgtcttaagtaatttatgtacatttttgggatttaacttaacgtattactgtattatattttttagtactttccatgtatttccatttttgcctatttttctccttccgagttwttttttttttttttttttttttggagatggagtcttgctctgtcacccaggctggagtgcagtggtgtaatctcagctcagcgcaacctctgcctcccaggttcaagtgattctcctgcctcagcctcccaagtagctgggactacaggcacgtgccaccacacgcggctaatttgtatttttagtagagacagggtttcgccatgttggccaggctggtcttgaactcctgacctcaggtgatccacccacctcggcctcccaaagtgctgggattacaggcatgagccactgctcccg

SEQ ID NO: 203096 - DNA, 601 bp, Human
tgtatgttaggtggactgtggcttataaaacctcttcatagctgttttccagtgcgatccttctagccctgtgaggaagacagaccagaagaaattttttgcagcttaggatactctgcaaacaaggaggaagtgagaggagttggggctcatttaatgcagactaaaacaggatctttcctttgagagactgagacaggatgaggagcaggctgtagatgtgcacacatatccactcagagagaacatgagaggcagcatctgcagaggagcctggtgggcagcacgtgccgcgggggcrggaaggggagagcttccgggaaggggatggaacttgagccaaacctttttctcaaaaagaggggaggccgggtgtagtggctcacacctgtacccagcactttgggaggctgaggtgtgcagatcacttgaggtcaggagtttgagaccagcctgggcaacatagcaaaaccccatgtctattaaaattacaaaaagtagccgggcgtggtggcgcacacgtgtaatcccaactactcaggaggctgaggtgggacgatcacttgaacctgggatgcggaggttgcagtgagccgagatc

SEQ ID NO: 203097 - DNA, 601 bp, Human
gtagccgggcgtggtggcgcacacgtgtaatcccaactactcaggaggctgaggtgggacgatcacttgaacctgggatgcggaggttgcagtgagccgagatcgcgccactgcactccagcctgggtgacagagtgagactctgtctcaaacaaaagaggggaaggtaggaatgagacaaaggaaaaggggaggcgggcatttcaggcaggagagcagcataggcagaaggtgcaaacatgtggcagagggtcggtgtccatggacacgcttccaccacctggtctaatcattgacttakcagacatctaaatgcctgctgcgtgcccagcactgtagagggccacaaggcagcaggaacctctcagtgcctgccctctgtgggctctgactccaaccaggagaaactggacgcacaacagcaggcaaaactagctgatggtgatagaggtcagaagagtggtttacagccaggcacagtgactcacacctgtaatcccagtactttgggaggctgaggtgggaggatagcttgagcctaggaggctgaggctgcagtgagctgtgatcaggccaccactgcattccagcttggcctgga

SEQ ID NO: 203098 - DNA, 601 bp, Human
cttctcaaatatttgttaagtgggtgcttatatgggaccttagaaagcaaccagctaggcatgcacttggaaagggacaggaggactgagaacaagactaaacatttctgtgagattgagcagcaggagagctttgcttctttactggtgtcagtatgtgcctgcagctcctgggctgcctttactcgagtgagatccatttacaagactcctgactcttctactccactttattacaaaagatgttgatgctcgttttaaaaacaatttaaactacaaacatgaataaaggtatttatcyccccaccagtccccctcattctcccttccctcctgttcttagactggtttcccctcccagtagtttaggttgtggggcaagtgtgtgtagctctgcatcagtgtcttaaacaaaatgagtgtgtcgcggatgcgcagctcggccacttcctgttttcttcggctgtatgtcacggccatcctgccatggcaccatgtctgtgccacctgctgctcttgggcatctgcagagaattccatgacatggatcttgaggtagtcttcttcagctttttctacttcatcttattttctacaatca

SEQ ID NO: 203099 - DNA, 601 bp, Human
agaacaagactaaacatttctgtgagattgagcagcaggagagctttgcttctttactggtgtcagtatgtgcctgcagctcctgggctgcctttactcgagtgagatccatttacaagactcctgactcttctactccactttattacaaaagatgttgatgctcgttttaaaaacaatttaaactacaaacatgaataaaggtatttatctccccaccagtccccctcattctcccttccctcctgttcttagactggtttcccctcccagtagtttaggttgtggggcaagtgtgtgyagctctgcatcagtgtcttaaacaaaatgagtgtgtcgcggatgcgcagctcggccacttcctgttttcttcggctgtatgtcacggccatcctgccatggcaccatgtctgtgccacctgctgctcttgggcatctgcagagaattccatgacatggatcttgaggtagtcttcttcagctttttctacttcatcttattttctacaatcatttatatctgcttgtaaaacctttttttaaaaaacttgcttactagacacagcacatgttcattttagaaaatgtagaaaaatcagat

SEQ ID NO: 203100 - DNA, 601 bp, Human
ctgaagaaggtgaggcagtgagctgtggaggtgggtaactggggagggggaagaactttagctagagagaaaagccgctgcaaaggcccactgaaggcaggatatgcctgctgtgtcgagaccagcaggaggccgtgtgcctggtacttaatataccagaaggagtggagcaggcaggggtaccagttccagaaggacttgctggcaggtattaagatgggctttttctctgtgataggaagctccaggaaggatttgatcacaggagggacagaatctgaattgtattttagaaggatcmctttgactgctgtacagagagtgggtggtgaggtgggaggcagaagccagaaagccagttaggaggctgttaagtaatccaggcaggagatggtgttggctgggaccagggtcatagcagtagaggtggtgagaagtaattagattccgtatatttattaaaggcaaagccagcaagattccttgactctaacttaaaggttggagttgtcatttactgagatgagagagaccatggggggaaggtaaagggctcggttttggatgtgttaggcttgtgctgccattggacatccgtgtg

SEQ ID NO: 203101 - DNA, 601 bp, Human
gtctgctccccagatacctgtgtttgtatgtgtgtgtcatagtcgggaatcactgagaccaggacctctgggaggctgaaccctgggagggcagagcaggaacaggccttggagatgatctaattctgacattttactcagtgaggacacaggtggggcagccagagaggtactcagctctgagtcagggccccatccctcaactcctcagcctgagtcttcccaggaacacaacaggcagctgcttcccagaccttgcagggctccaggtggccttcccctcctgccgactcccttgccrggtttgctgtaactattgctcctccgagcctggctgaaatcatcttcagtctgttatcaccttcagtctgttctcatcttcagtctgttctccacagcagcctgaaaagtctttgtaaaaatgcagctctgttcctccccatcctcttcataacccccttggctctctgctcctcccagaataaatacccacatcctcagcttacccttcaagacgctgagtgacctctagccacagcccttctctctacccacagacagcccaggtcctcattccttgggccttttcacatcactgttc

SEQ ID NO: 203102 - DNA, 601 bp, Human
tcctctgtcacccaggctggagtgcagtggtgcgatctcggcccactgcaacctctgtctcccaggttcaggcgattctcgtgcctcagccacccacgtagctgggattacaggcgtgcgccaccatgcctggctaatttttgtatttttagtagagatggggtttcaccatgttggccaggctggtctcgaacacctgacctcaagtgatccacccaccttggcctcccaaagtgctgggattacaggcatgaaccaccgcacctggacttttttttttgtttttgagacagggtctcartctgtcctcaggctggagtgcagcagtgcgatcttggctcactgaaacctctcccctccgggttcaagtgattctcgtgcctcagcctccgagtagctgggattacaaatgtgcaccaccgcacctatctgatttttgtgtttttagtagagacagggttttgccatgttgcccaggctggtctcgaactcctagcctcatgtgatctgcctgcctcagcctctcaaagtgctgggattacaggcatgagccatgcccagcccagcctgtgctatctttagtgccagggcttaagaaagg

SEQ ID NO: 203103 - DNA, 601 bp, Human
ctggctgggcaagctgagaacagggagcaaccttggctcagggtagatgacagacctcagctgtagatggagcaaggaggccatatgaaaatggcaggcttctggcaaaatgcagggatgggctgcagcacagcagttcaatctaaataggagcagcccaagggacgtgggtaggttttagaacagccaggctacagctccccttcctcttcactggtgtccttgagaggccacagtcagaagagacaattccaggctagggagagatgtcagcgtgggaactagagaccctggtcccaarttcaaaactctagccagagtccagaactgcatctgagtctaagaggcaaccacttacttacacctcccgaaactgagaacagttttaccggttctggtgaaaaaaacccactaccagctcatatgtgggagtgggagctgaggctctgctgagtaacacggcccagtgcacacagctgtcagggcctggcccggctcgagtcctgctgtgtccgaagctctgccgttttctgcttcgtcctctagcatgttctgagatgccctgttgggatcctcaggcctgtcacttttgtcatctgca

SEQ ID NO: 203104 - DNA, 601 bp, Human
tgggcaagctgagaacagggagcaaccttggctcagggtagatgacagacctcagctgtagatggagcaaggaggccatatgaaaatggcaggcttctggcaaaatgcagggatgggctgcagcacagcagttcaatctaaataggagcagcccaagggacgtgggtaggttttagaacagccaggctacagctccccttcctcttcactggtgtccttgagaggccacagtcagaagagacaattccaggctagggagagatgtcagcgtgggaactagagaccctggtcccaagttcaraactctagccagagtccagaactgcatctgagtctaagaggcaaccacttacttacacctcccgaaactgagaacagttttaccggttctggtgaaaaaaacccactaccagctcatatgtgggagtgggagctgaggctctgctgagtaacacggcccagtgcacacagctgtcagggcctggcccggctcgagtcctgctgtgtccgaagctctgccgttttctgcttcgtcctctagcatgttctgagatgccctgttgggatcctcaggcctgtcacttttgtcatctgcaagggg

SEQ ID NO: 203105 - DNA, 601 bp, Human
cctgcttttttgtttttgtggtttttgagacaaagtctccttctgttgcccagactagagtgcagtggcacagtctcagctcactgcaacctctgcctcctgggttcaagtgattctcctgcctcagcctcccgagtagctgggattataggcgtgcaccaccacgcccggctaatttttgtatttttttagtaaagatggggtttcaccatgttggccaggctggtctcgaaccgctgggctcaagcaatccacccacctcagcctcccaaagtgctgggattacaagcaggagccaccrcgcctggcctgatccctctgcttcttgctttctcccaccacttctctccttacccaagtgctgcaggcctgcacatgcagctcatcctcgctcctccccttagagggaactcagggtcataaggatatactgctgggagtagacaccctgcactcgctgctgctttcagctgcaggagatcctagccacaggcggtgactcaggcagaggagcaagcccaccccgcagaaatgggctctggacccctgtgactgcatggagcaggaggaggcagttagtgtccaagctaaggcagggtga

SEQ ID NO: 203106 - DNA, 601 bp, Human
aaagtaaatagaccaatcgggcgcctcctggctgtcttcacagccatgacaacggcattctcccagcattggaggctagatatgcaggagagctctcagccacaaatgatgtgaataaggtcaatagtgtctatttgctgaacttgtcatcaaagatggtgaaactgatactttactctctgggtgagagggctagtgtttacactgaatccaaacatttggataatgacatggtgcctcctcagcagtgactgtgtcttcttgttcatcataataatgttattgattagcggtactgaayatgtaggtatgcgtagtagtgagatgccgaggttaagagctcagctccaggaattgcatggttctaggttataattcttgctctgtcactgtattagtcagggttctccagagaaggagaacctgtgtgtgtgtgtgtgtgtgtgtgttgaaagaaagagatgtgttttaacgaattggttcacacagttgttggagtggcaagtccaaattttgaaaggcaggcaggctggagagccggggaagttgatgttgcagctcaagtccaaaggcagcctggaggcagaatttcctgttccac

SEQ ID NO: 203107 - DNA, 601 bp, Human
tttaaaattttttatagagatagagacagggtctcactatgttgcccaggctggtctcaaactcctgggctcaagtgatcctcccgcctcagcctcccaaagtgttgggatcacaggtgtgagccactgcacctggccttttgttttttttaagtagagacagtcttgctttatcacccaggctggtatacgatggcacaatcacagctctcctaggctcaaggattttcctgcctcagcctcctcagtagctggcactataggcaggtgccacgacacccaactatttttttttttttaytttttatagagacagggtctcactatgttgctcctggcctcaggtaatcctcctgccttggcctcccaaagtactgcgattactggcgtgagccaccacactcagccgagtgcaatggcgcgatctcagctcactgcagcctccgcccccctgcccccgggttcaagtgattctccttccttagcctcccgagtagctgggactacaggcatgtgccaccacgcccagctaatttttgtatttttagtagagatggggtttcaccatgttggccaggatggtttcaatctcttgacctcg

SEQ ID NO: 203108 - DNA, 601 bp, Human
aaacctcaccagccaggaggggagcagcccactgggtcctctctgccacagttgggtgcttcttgtgctccccctcctgtggtcaggataggggaagcaggctttcctgctgccactcctaggacccaaggggaagctgggggagtggggagaccatgtgggaaggatggagtgcactttgattggtagcaggtggataggtactcccatggtggggaaatcaaagttgcttggcctgtgtagtagacaggtattaccacaggcctggaaaacattagcctgggtttatctctgtggcttyggtcccccaacatccccttctactcaaaatggctgattctctggtttggaggtttggcacctgcttttggggaggttgctcagtcattagagaagagtgcagaggttggacggtcatcatggcagaggtaggacagctggtatgtggggccatgaaaccagctttgggctaggagtcaggaagctgagactcagttcaggtcccctttccaagatgaagagatcatttccgagtgtccaaagggcactgggaagagaatcctagcagttcttatgaaatcatctgacagcagatatatcc

SEQ ID NO: 203109 - DNA, 601 bp, Human
gaaaaattgtctgcattttttctgcatttttaaaattccaacacaataaatacaataataactatgctaactaacagtggtctagagcttacttcatgccaggcactgttcttttcatcgatgatgactcacttgatcctcacaacaaccctgtgcaggaagaatgttttgtgtctccattttacacatcagagaggctgaatgacctgcctatagcctcacaggcagacacaggatttgaattaagcattgagtctcttaaccacaatactacgttgcctaatcgggggggaggtggggrcaaattggcaaaaaacaaaagaagtggattaagaccaggggtagggagattagaacacccagtggagcattgctgatgggacagggcttggtctgtcacggccaaggaggcctgccgtcccctgggccaagtcacctcttggggtggaagtaggggagctccactgcctttctgagctccctggcgtgccctgtgtccccacagaccggccaggcctcatgaacgttccacgggtggaggctatccaggacaccatcctgcgtgccctcgaattccacctgcaggccaaccaccctgatg

SEQ ID NO: 203110 - DNA, 601 bp, Human
cctctcagctgcggggtgagctctgacttccagggcagcccctaccacgtgcaccggacagggggccgggcttctgcccggagctgcctgcaacgaccacgttcgccatcacagacacctgagccaccttcagtgggcaggaaagcgccacccaccaactggcatcaaacccaagtgggtttgtctgtgcccagctctagtggactccagagaatggagacagaacgttaacctgtggggagcccacatggatggccacgtgtgagcctttgcaggcaagagcaacgaaaccaccctcccrgccttcgcggacacatatcaccaaactgtccatagagtcacagcggccactgcagacatccagggcactgaaggagctgtgggctgtgtgacaacacagggttcgcgagtttcgtgggctctggagaaagtctgccccagaacccaagtttcaggacaagacttggaactttctctttaataaaagctctaaaaagacctttggttccttcaactttatccaacacttcactggctttttctagtcagaggtttaatttcctgggcaccttgcaatggcaatagactaatttagcaactc

SEQ ID NO: 203111 - DNA, 601 bp, Human
ttttcctgggttgcagtgcctgctagggaaggaagggaagagcaggcaagagcgggccacacaagagcacccgactcagccaggctgcccactgtggccactgcacacacaggaaggcctcactcactttgagggatgggggttaacagcctggtggaaaaggaacaagttggactcatcctctcagctgcggggtgagctctgacttccagggcagcccctaccacgtgcaccggacagggggccgggcttctgcccggagctgcctgcaacgaccacgttcgccatcacagacacctgrgccaccttcagtgggcaggaaagcgccacccaccaactggcatcaaacccaagtgggtttgtctgtgcccagctctagtggactccagagaatggagacagaacgttaacctgtggggagcccacatggatggccacgtgtgagcctttgcaggcaagagcaacgaaaccaccctcccagccttcgcggacacatatcaccaaactgtccatagagtcacagcggccactgcagacatccagggcactgaaggagctgtgggctgtgtgacaacacagggttcgcgagtttcgtgggctc

SEQ ID NO: 203112 - DNA, 601 bp, Human
gtatggctcacgcctgtaaccccaatgttttggcaggctgaggcaggaggattgcttgagctcagaagttcgagaccagcctgggcaacacggtgaaaccccatttccacagaagtattaaaaaatagccaggtgcggtggtgcacacctgtggtcccagctactcagcaggctggggtgggaggactgcttgagcccaggaggtcgaagctgcagtgaagtgtgattgtgccaccgcactccagcctggtaacagagcgagaccctttctcaaacaacaataacaggcccagtgctgccrgctgggggagaagaaaaagtgaaatatcagaagctctcacacccatggtgccagtgaccagcagcccccgcagaggttttcctgggttgcagtgcctgctagggaaggaagggaagagcaggcaagagcgggccacacaagagcacccgactcagccaggctgcccactgtggccactgcacacacaggaaggcctcactcactttgagggatgggggttaacagcctggtggaaaaggaacaagttggactcatcctctcagctgcggggtgagctctgacttccagggcagcccctac

SEQ ID NO: 203113 - DNA, 601 bp, Human
cgcctacgctggagtgcagtggtgcttctcggctcactgcaagctccgcctcctgagttcacgccattctcctgcctcagcctcctgagtagctgggactacaggtgcccgccaccacgcccggctaattttttgtatttttagtagagacggggtttcaccgtgttagccaggatggtctcgatctcctgacctcgtgacccgcccacctcagcctcccaaagtgctgggattacaggcatgagcccctgcacccggcctcctcaaacttcttaaatgagacttggggaaataaatcacrcatcctttcttactggccgtttccatgtatgcgtctgcagagtaacttagagaccaggtgccactccctgctcttgtgcacgctgtgcctgggccaccctggcctggcctgactgccaaggagctgatgttaaaccagggcacaagcaccaaccaccctgcccgaacccgaggggcagaggcttctaagcctgctacctcttccccagaggggcaaaggcgggtaaggagaggcagaaaagccaagttcaggaggcccttggagggaatcctttggaacatgagctgctgatcacagccg

SEQ ID NO: 203114 - DNA, 601 bp, Human
ggctggtcccggcccagagccaatctcctggcattggctcctcctccctagagaaaggcagagcaggcccggtccggtggctcacacccggaatccagcacattgggagttcaaaaacagcctaggcaatatagtgagatcccatctctctcgaaaaacaaaggtgggtgcttctgaaggagctcccacagctcttctcccacctgactagccccaggctccttccagagaggcacccaggctggcgtggggaccactgctcttcccagagcccgccccagccccgtctggagggaaggcrcaccgtcctgtcggcactggcaggaaagaacttgagtgtggggaagctgtgcactttgacggcctccacctcgttggcagtcgagtccatcttggcgatgacgatgttctcatggtccttgtacgtctctcccagtttatcccaaatgggagccaactgtttgcagtgaccacaccatggggcatctgaaaagaaagcagttctagggtgtgtcctggacacaaagccactggcagacgcttccccaggagtctgcctaccttgcgcgtgccctggtggcacggacctggggagctgaaa

SEQ ID NO: 203115 - DNA, 601 bp, Human; identical to SEQ ID NO: 32960

SEQ ID NO: 203116 - DNA, 601 bp, Human; identical to SEQ ID NO: 32959

SEQ ID NO: 203117 - DNA, 601 bp, Human; identical to SEQ ID NO: 32958

SEQ ID NO: 203118 - DNA, 601 bp, Human; identical to SEQ ID NO: 32957

SEQ ID NO: 203119 - DNA, 601 bp, Human; identical to SEQ ID NO: 32956

SEQ ID NO: 203120 - DNA, 601 bp, Human; identical to SEQ ID NO: 32955

SEQ ID NO: 203121 - DNA, 601 bp, Human; identical to SEQ ID NO: 34011

SEQ ID NO: 203122 - DNA, 601 bp, Human; identical to SEQ ID NO: 34010

SEQ ID NO: 203123 - DNA, 601 bp, Human; identical to SEQ ID NO: 34011

SEQ ID NO: 203124 - DNA, 601 bp, Human; identical to SEQ ID NO: 34010

SEQ ID NO: 203125 - DNA, 601 bp, Human; identical to SEQ ID NO: 34011

SEQ ID NO: 203126 - DNA, 601 bp, Human; identical to SEQ ID NO: 34010

SEQ ID NO: 203127 - DNA, 601 bp, Human
cagagaaaaagagacagagagagaggagagagagagagacagaggtagacagagatacagacagagagagaaaaagagagaggaaagagagacacaggtagagacacagagagagacagagaaaaagagacagagaggagagagacaaagagagacagagacagacagagagacagagacagaaaaagagagagaggagagagagaaagagagacagagatagagatacagagacagagaaaaagagaggagagaaagagagacagaggtagagacacagagagagacagagaaaaagagwcagagagagatgagagagagaaagagagacagagatagacagagatacagagacagagaaaaagagagagaggagagaaagagagacagagtcagagatacagagagaggagagaaagagagacagagacagagatacagagagaggagagaaagagagacagagacagacagagatacagacagagacagagaaaaagagaggagagaaagagagacagaggtagagacacagagagagacagagaaaaagagacagagagagaggagagagagaaagagagacagagatagacagaga

SEQ ID NO: 203128 - DNA, 601 bp, Human
acgcacgtccgattcatggcacactttctgcctttccaacaccccgcttttcctaagagtttctggctacgcgaaagagatctcatctttctgtaaaactccaactcttcctgtgggatgagcacggaggcggcctcacccctctcacctaaagacctttcccttctctgaccagagcttttacgttctctccctgcccttccctttaaagacaggcaggaaacacccagcgtttgagtgcttgataacatgttagaaatccagacgagagctttttctaccccacacgtttttcgttgcmaattcaagacgctgtccgagaggccgcagctccagtctgcagagtgggtggactgtatgaaatgttttgcattgacattttacagcaggcggctgcaggcagaaagcagggtctgcacctctcttggcctgggctgtgtacaagggggtgcttgttggaggttttactgatgcttccctgagacagggagagagagaaaaagagagagagaggagagagggaaagagtcacagagatagagagacagaaagacagagaaaaagagacagagagagaggagagagagagagacagaggtag

SEQ ID NO: 203129 - DNA, 601 bp, Human
gctgctcactgtctccctaccgaaaaccctccgtcctcccagctcagctgtcttctccaaccccaaggaccaggctttcctggggggtcccgtgaggcccaggctttccccgacctgaggttccttcttgggccgcaatctggacccctttgtctagtaggaaactccgctctaccagggtgtccgagcctccaggaatgagcatggggacaccagtcaggagctgtgtggctattcaaggcccctcggcctcggagaaaaagcaaaggccctttttcaactgaagccccaattgtaattctcactgcagacaagtggctttgaaatcacgcacgtccgattcatggcacactttctgcctttccaacaccccgcttttcctaagagtttctggctacgcgaaagagatctcatctttctgtaaaactccaactcttcctgtgggatgagcacggaggcggcctcacccctctcacctaaagacctttcccttctctgaccagagcttttacgttctctccctgcccttccctttaaagacaggcaggaaacacccagcgtttgagtgcttgataacatgttagaaatccagacgagagct

SEQ ID NO: 203130 - DNA, 601 bp, Human
cgtaaacctctcacagctgctcactgtctccctaccgaaaaccctccgtcctcccagctcagctgtcttctccaaccccaaggaccaggctttcctggggggtcccgtgaggcccaggctttccccgacctgaggttccttcttgggccgcaatctggacccctttgtctagtaggaaactccgctctaccagggtgtccgagcctccaggaatgagcatggggacaccagtcaggagctgtgtggctattcaaggcccctcggcctcggagaaaaagcaaaggccctttttcaactgaarccccaattgtaattctcactgcagacaagtggctttgaaatcacgcacgtccgattcatggcacactttctgcctttccaacaccccgcttttcctaagagtttctggctacgcgaaagagatctcatctttctgtaaaactccaactcttcctgtgggatgagcacggaggcggcctcacccctctcacctaaagacctttcccttctctgaccagagcttttacgttctctccctgcccttccctttaaagacaggcaggaaacacccagcgtttgagtgcttgataacatgttagaa

SEQ ID NO: 203131 - DNA, 601 bp, Human
cttagagcaactttctgggtcctcagaggccgggtaacttttctgcttctaaaggcctccccatctctgcctctgctgggaaactgggtccccagggactgcgccgtaaacctctcacagctgctcactgtctccctaccgaaaaccctccgtcctcccagctcagctgtcttctccaaccccaaggaccaggctttcctggggggtcccgtgaggcccaggctttccccgacctgaggttccttcttgggccgcaatctggacccctttgtctagtaggaaactccgctctaccagggtstccgagcctccaggaatgagcatggggacaccagtcaggagctgtgtggctattcaaggcccctcggcctcggagaaaaagcaaaggccctttttcaactgaagccccaattgtaattctcactgcagacaagtggctttgaaatcacgcacgtccgattcatggcacactttctgcctttccaacaccccgcttttcctaagagtttctggctacgcgaaagagatctcatctttctgtaaaactccaactcttcctgtgggatgagcacggaggcggcctcacccctctcacctaaag

SEQ ID NO: 203132 - DNA, 601 bp, Human
tacaccttggtgcgaagggggaaagatcccatttttggaagggagagcgcgcgcgcaggaggggggcgcaggcgcccgagccccccacacaggttacccgcgttctctccgtggccggaggaaaagcaaactccagttttcctgcagagagagacagagagacaaggagttcacggctggagagaggagggtcccagtcgtccggccgccctcgctcccgggaggagcgcagagcccggcgcctggatctttccaggaagcgcccgggtcgcgccggggttgagatggcgaggggggggayccgggcgccccggggacgcacgatcttgggagaagatgagctccaagttggtggcggcgcgcccttggatggagagttggtgagatggaacgcggctggagaatccccgaaagtgagaagaaggggccgggtgtccccaaaccgggacgcgggcgcttgggaggcggcggcggcggaggccgaggatccccggggccgcctcccgggtctccagcgcccgcagaaagaagcccaggtccccgggagatccggttcgtaaagatctatattctttccgcccgcgccagatcccggcggacc

SEQ ID NO: 203133 - DNA, 601 bp, Human
tggcgtccgtacaccttggtgcgaagggggaaagatcccatttttggaagggagagcgcgcgcgcaggaggggggcgcaggcgcccgagccccccacacaggttacccgcgttctctccgtggccggaggaaaagcaaactccagttttcctgcagagagagacagagagacaaggagttcacggctggagagaggagggtcccagtcgtccggccgccctcgctcccgggaggagcgcagagcccggcgcctggatctttccaggaagcgcccgggtcgcgccggggttgagatggcgaggggggggacccgggcgccccggggacgcacgatcttgggagaagatgagctccaagttggtggcggcgcgcccttggatggagagttggtgagatggaacgcggctggagaatccccgaaagtgagaagaaggggccgggtgtccccaaaccgggacgcgggcgcttgggaggcggcggcggcggaggccgaggatccccggggccgcctcccgggtctccagcgcccgcagaaagaagcccaggtccccgggagatccggttcgtaaagatctatattctttccgcccgcgccagatcc

SEQ ID NO: 203134 - DNA, 601 bp, Human; identical to SEQ ID NO: 19113

SEQ ID NO: 203135 - DNA, 601 bp, Human; identical to SEQ ID NO: 19114

SEQ ID NO: 203136 - DNA, 601 bp, Human; identical to SEQ ID NO: 19115

SEQ ID NO: 203137 - DNA, 601 bp, Human; identical to SEQ ID NO: 19116

SEQ ID NO: 203138 - DNA, 601 bp, Human; identical to SEQ ID NO: 19117

SEQ ID NO: 203139 - DNA, 601 bp, Human; identical to SEQ ID NO: 19118

SEQ ID NO: 203140 - DNA, 601 bp, Human; identical to SEQ ID NO: 19119

SEQ ID NO: 203141 - DNA, 601 bp, Human; identical to SEQ ID NO: 19120

SEQ ID NO: 203142 - DNA, 601 bp, Human; identical to SEQ ID NO: 19121

SEQ ID NO: 203143 - DNA, 601 bp, Human; identical to SEQ ID NO: 19122

SEQ ID NO: 203144 - DNA, 601 bp, Human; identical to SEQ ID NO: 19123

SEQ ID NO: 203145 - DNA, 601 bp, Human; identical to SEQ ID NO: 19124

SEQ ID NO: 203146 - DNA, 601 bp, Human; identical to SEQ ID NO: 19125

SEQ ID NO: 203147 - DNA, 601 bp, Human; identical to SEQ ID NO: 19126

SEQ ID NO: 203148 - DNA, 601 bp, Human; identical to SEQ ID NO: 19127

SEQ ID NO: 203149 - DNA, 601 bp, Human; identical to SEQ ID NO: 19128

SEQ ID NO: 203150 - DNA, 601 bp, Human; identical to SEQ ID NO: 19129

SEQ ID NO: 203151 - DNA, 601 bp, Human; identical to SEQ ID NO: 19130

SEQ ID NO: 203152 - DNA, 601 bp, Human; identical to SEQ ID NO: 19131

SEQ ID NO: 203153 - DNA, 601 bp, Human; identical to SEQ ID NO: 19132

SEQ ID NO: 203154 - DNA, 601 bp, Human; identical to SEQ ID NO: 19133

SEQ ID NO: 203155 - DNA, 601 bp, Human; identical to SEQ ID NO: 19134

SEQ ID NO: 203156 - DNA, 601 bp, Human; identical to SEQ ID NO: 19135

SEQ ID NO: 203157 - DNA, 601 bp, Human; identical to SEQ ID NO: 19136

SEQ ID NO: 203158 - DNA, 601 bp, Human; identical to SEQ ID NO: 19137

SEQ ID NO: 203159 - DNA, 601 bp, Human; identical to SEQ ID NO: 19138

SEQ ID NO: 203160 - DNA, 601 bp, Human; identical to SEQ ID NO: 19139

SEQ ID NO: 203161 - DNA, 601 bp, Human; identical to SEQ ID NO: 19140

SEQ ID NO: 203162 - DNA, 601 bp, Human; identical to SEQ ID NO: 19141

SEQ ID NO: 203163 - DNA, 601 bp, Human; identical to SEQ ID NO: 19142

SEQ ID NO: 203164 - DNA, 601 bp, Human; identical to SEQ ID NO: 19143

SEQ ID NO: 203165 - DNA, 601 bp, Human; identical to SEQ ID NO: 19144

SEQ ID NO: 203166 - DNA, 601 bp, Human; identical to SEQ ID NO: 19145

SEQ ID NO: 203167 - DNA, 601 bp, Human; identical to SEQ ID NO: 19146

SEQ ID NO: 203168 - DNA, 601 bp, Human; identical to SEQ ID NO: 19147

SEQ ID NO: 203169 - DNA, 601 bp, Human; identical to SEQ ID NO: 203127

SEQ ID NO: 203170 - DNA, 601 bp, Human; identical to SEQ ID NO: 203128

SEQ ID NO: 203171 - DNA, 601 bp, Human; identical to SEQ ID NO: 203129

SEQ ID NO: 203172 - DNA, 601 bp, Human; identical to SEQ ID NO: 203130

SEQ ID NO: 203173 - DNA, 601 bp, Human; identical to SEQ ID NO: 203131

SEQ ID NO: 203174 - DNA, 601 bp, Human; identical to SEQ ID NO: 203132

SEQ ID NO: 203175 - DNA, 601 bp, Human; identical to SEQ ID NO: 203133

SEQ ID NO: 203176 - DNA, 601 bp, Human; identical to SEQ ID NO: 19113

SEQ ID NO: 203177 - DNA, 601 bp, Human; identical to SEQ ID NO: 19114

SEQ ID NO: 203178 - DNA, 601 bp, Human; identical to SEQ ID NO: 19115

SEQ ID NO: 203179 - DNA, 601 bp, Human; identical to SEQ ID NO: 19116

SEQ ID NO: 203180 - DNA, 601 bp, Human; identical to SEQ ID NO: 19117

SEQ ID NO: 203181 - DNA, 601 bp, Human; identical to SEQ ID NO: 19118

SEQ ID NO: 203182 - DNA, 601 bp, Human; identical to SEQ ID NO: 19119

SEQ ID NO: 203183 - DNA, 601 bp, Human; identical to SEQ ID NO: 19120

SEQ ID NO: 203184 - DNA, 601 bp, Human; identical to SEQ ID NO: 19121

SEQ ID NO: 203185 - DNA, 601 bp, Human; identical to SEQ ID NO: 19122

SEQ ID NO: 203186 - DNA, 601 bp, Human; identical to SEQ ID NO: 19123

SEQ ID NO: 203187 - DNA, 601 bp, Human; identical to SEQ ID NO: 19124

SEQ ID NO: 203188 - DNA, 601 bp, Human; identical to SEQ ID NO: 19125

SEQ ID NO: 203189 - DNA, 601 bp, Human; identical to SEQ ID NO: 19126

SEQ ID NO: 203190 - DNA, 601 bp, Human; identical to SEQ ID NO: 19127

SEQ ID NO: 203191 - DNA, 601 bp, Human; identical to SEQ ID NO: 19128

SEQ ID NO: 203192 - DNA, 601 bp, Human; identical to SEQ ID NO: 19129

SEQ ID NO: 203193 - DNA, 601 bp, Human; identical to SEQ ID NO: 19130

SEQ ID NO: 203194 - DNA, 601 bp, Human; identical to SEQ ID NO: 19131

SEQ ID NO: 203195 - DNA, 601 bp, Human; identical to SEQ ID NO: 19132

SEQ ID NO: 203196 - DNA, 601 bp, Human; identical to SEQ ID NO: 19133

SEQ ID NO: 203197 - DNA, 601 bp, Human; identical to SEQ ID NO: 19134

SEQ ID NO: 203198 - DNA, 601 bp, Human; identical to SEQ ID NO: 19135

SEQ ID NO: 203199 - DNA, 601 bp, Human; identical to SEQ ID NO: 19136

SEQ ID NO: 203200 - DNA, 601 bp, Human; identical to SEQ ID NO: 19137

SEQ ID NO: 203201 - DNA, 601 bp, Human; identical to SEQ ID NO: 19138

SEQ ID NO: 203202 - DNA, 601 bp, Human; identical to SEQ ID NO: 19139

SEQ ID NO: 203203 - DNA, 601 bp, Human; identical to SEQ ID NO: 19140

SEQ ID NO: 203204 - DNA, 601 bp, Human; identical to SEQ ID NO: 19141

SEQ ID NO: 203205 - DNA, 601 bp, Human; identical to SEQ ID NO: 19142

SEQ ID NO: 203206 - DNA, 601 bp, Human; identical to SEQ ID NO: 19143

SEQ ID NO: 203207 - DNA, 601 bp, Human; identical to SEQ ID NO: 19144

SEQ ID NO: 203208 - DNA, 601 bp, Human; identical to SEQ ID NO: 19145

SEQ ID NO: 203209 - DNA, 601 bp, Human; identical to SEQ ID NO: 19146

SEQ ID NO: 203210 - DNA, 601 bp, Human; identical to SEQ ID NO: 19147

SEQ ID NO: 203211 - DNA, 601 bp, Human
aggacacagaaaagtttaaagtaaaaggataggccctagcactttgagaggccaaggtgggtggatcacctgaagtcaggagttcgagaccagcctggccaacatggagaaaccctgtctatgaaaaacacaaaaattagctgggcgtggtggcgcacgcctgtaatgtcagctacttgggaggctgaggaaggagaatcacttgaactcaggaggtggaggttgcagtgagccgagatcacgccactgcactccagcctacacgacaggagcgagactccatctcaaaaataaaataaartaaaaataaataaataaagtaaaaggatagaagaaaatagagtaggcaaacagaaaatagagtacgcttagaggcgagcttaatttctagtctaaccaaacagcagtggctccctcagcatggggctcaggctgtcagcaacacaggcctaaacaaagctttgcaagtaagccagcagccatcagtgtcatgcctgcctttctgcttcctagggcctttagccccacaagaccctgtgattattatcacccaccattcccaggggtaacgctgccttatctcttttgctaggaggtccaa

SEQ ID NO: 203212 - DNA, 601 bp, Human
gataaactaaaatctgacttcaatagctacaacggaagctagaagttggataagggccgagtgtggtggctcacacctgtattcccagcactttggaaggccaaggcaggaggattgctttaggccaggagtttgagaccagcctggctaacatagcgagaccttgtctctaaaaacaataataaaataaaataaaataaaacagatgaaaaaagatataccatgcagtcaccaaaagacagctgaagtggctatactaatagcagataaaatggactttaaattagacaagataggccasgcacggtagctcacgcctgtaatcccagcactttgggaggccgaggtgggcggatcacgaggtcaggagtttgagaccagtctggccaacatagtgaaactctgcctctactaaaaatacaaaaaaaattagccaggcacagtggtgtgtgcctgtaatcccagctactcgggaggctgaggtaggagaatcacgtgaacccaagaggcagaggttgcagtgagccaagattgcgccactgcactccagtctgggccacagaacgagactccatctcaaaaaaaaaattaggcaagacag

SEQ ID NO: 203213 - DNA, 601 bp, Human
gggagaccaaggtgggaagatcacctgaggtcaggagttcgagaccagcctggccaacatggtgaaaccctgtctctgctacaagtacaaaatttagccgggcatgatgacacgtgcctttagtcccagctactcgggaggctgaggcaggagaattgcttgaaccagggaggtggaggttgcagtgagttgagattgtcccactgtgctccagcctgggcaacagagcaagactctgtctcaaaaaaaaaaaaaagaaaagaaaaaggtaaaaagaaattcatattggatacactatacyaaaactgcagaaagccaaaatcagagaaaattctaaaggtaatgagagtctgaggataaagttccaaagtatgcttaaaggagtaactgataaactaaaatctgacttcaatagctacaacggaagctagaagttggataagggccgagtgtggtggctcacacctgtattcccagcactttggaaggccaaggcaggaggattgctttaggccaggagtttgagaccagcctggctaacatagcgagaccttgtctctaaaaacaataataaaataaaataaaataaaacagatgaaaa

SEQ ID NO: 203214 - DNA, 601 bp, Human; identical to SEQ ID NO: 33282

SEQ ID NO: 203215 - DNA, 601 bp, Human
acctctgtagtaacacattagcagtcacaggagaaaggtagaggcagagtctttgaggtcacttgtagttctgagggtcttgccatcagaacacaaagaagacagggcaatgccgttgctgaggattcaacaactatttttgagagtttgaggctatgagtttagaagaggctgtgcctaggctgggcatggtggctcacgctcgtaatcccagcactttagtcccagctacccaggaggctgaggcaggatcacatcacctgagcccaggaggttgaggctgcagtgagctgtgatcacrccactgcactccagcctgggcaacagaatgaggccctatctcaaaacaaacaaaccaacaaacaaaccaacaaacaaacacaagaatagactgtgctggtgctgcctaatgcctagttaaaagaagggcttttgctaaaaacaaacagacctgccaccgtaatttttttttgtttttgcttgagacggagtctctctgtcacccaggctggagtgcagtggcacgatctcggctcactgcaacctctacctcccagggtcaagcgattgtcctgcctcaacctctcaagtaactgggatt

SEQ ID NO: 203216 - DNA, 601 bp, Human
agacctctgtagtaacacattagcagtcacaggagaaaggtagaggcagagtctttgaggtcacttgtagttctgagggtcttgccatcagaacacaaagaagacagggcaatgccgttgctgaggattcaacaactatttttgagagtttgaggctatgagtttagaagaggctgtgcctaggctgggcatggtggctcacgctcgtaatcccagcactttagtcccagctacccaggaggctgaggcaggatcacatcacctgagcccaggaggttgaggctgcagtgagctgtgatcrcaccactgcactccagcctgggcaacagaatgaggccctatctcaaaacaaacaaaccaacaaacaaaccaacaaacaaacacaagaatagactgtgctggtgctgcctaatgcctagttaaaagaagggcttttgctaaaaacaaacagacctgccaccgtaatttttttttgtttttgcttgagacggagtctctctgtcacccaggctggagtgcagtggcacgatctcggctcactgcaacctctacctcccagggtcaagcgattgtcctgcctcaacctctcaagtaactggga

SEQ ID NO: 203217 - DNA, 601 bp, Human
gtagtccttccctcactggttgaggctggcttgaggccctcctgagtgacactatcacccttgggacacccacccatggtcaagttacagggcttcatgccagaggcctcagggagccaggcaagacactcaaagctcccctttccagaacagagctaaggccttgagcagcccattgcctgcgtggcatgggattagtcaacatctcctccatgaactcatggctcctggcggccttaccctaccctaaggaaaggtctccctggctgtctctagcctggagttcaggggcccttggggyccatgagagagatcttcctaacattgactctgtagttgggggtggtggctacatgctgatgcctccctaaaatgacaggtatgaagggtaatcctactgcaacaagtagaaggggcaaccaccatcagcccccagagatttccaaaaaattctgggagacaaagcatggccaggggacaagagactgacacagcagccagaacccacaaggagggggtccatgaaggaaagggagggccttgcaaaagcattaaacaggcctgaaaactggaacactgatgaaattgtgagcttggctcc

SEQ ID NO: 203218 - DNA, 601 bp, Human
ccagcgactatcactcactgtgacttctctaggcaaagtttttcgtagtaaccatgctgggagctggagggccgggctgggggagtatccacatcaaaggtagcattgagatcaatatcatcacggaaggatggccggcggagcttcagattcacctccacaggggctgggctgaaggcagagatgacctggttacttggggccacagtggtaacccaggacaacagctcctgaagcatcagagataactcagctccagggacctggagcccactcctgactcaaggccacccctcaagaragccctactctcggccaggcacagtggctcacgcctgtaatcccagcactttgggaggccaaggcgggtggatcaagcggtcaagagatcaagaccacccgggctaacatggtgaaaccccatcctactaaaaatacaaaaattagctgggtgtggtggcttgtgtctgtagtcccagctactcgggaggctgaggcaggagaattgcttgaactcgggaggcagagcttgcggtgagccgagatcgcgccactgcactccagcctgggcgacagagcaagactccgtctcagaaaaaaa

SEQ ID NO: 203219 - DNA, 601 bp, Human; identical to SEQ ID NO: 33283

SEQ ID NO: 203220 - DNA, 601 bp, Human; identical to SEQ ID NO: 33284

SEQ ID NO: 203221 - DNA, 601 bp, Human; identical to SEQ ID NO: 33285

SEQ ID NO: 203222 - DNA, 601 bp, Human; identical to SEQ ID NO: 33286

SEQ ID NO: 203223 - DNA, 601 bp, Human; identical to SEQ ID NO: 33287

SEQ ID NO: 203224 - DNA, 601 bp, Human
aggccacagcacccctgtttttcccattttattagcaggccaattgcagagttgatgggccttctctttagtttctctcctgcttctcttccccataccctccatcctgggcatctcaggccttgcagacagttctctcctccctctcctctaacccacactacaccctctgcaggataaacttccttcctcgtctgactgcctccgccccggatatcctctccaaggcaaagagtcattcactggaagaccgtgagcaggaggaggctggatttaggaaacaatgggtaaaagctgcccwccagcagctgagggctgaggacagtctctctcaaaagaggtagccagaaaccagctggagagtcaggaggcagcagttgagtgagagcagttgaggggaggctcagtacccatccccaaatcccacctggggaaaatccccaacatgcagtctgagaggacagagggagacaaccagcacctccagcctccttagcttctgggaggaaggcaagggatgaggggaggacaagaaagacagtaactgagagatcactcctgtgttggaggttctgtgtaatatgctccccaagtagcatcc

SEQ ID NO: 203225 - DNA, 601 bp, Human
atcaaatgtttgctgatcactcagtcaagtgtcactacactcccaggctgcaactctggcccagtcaggactcactagctccagaggcagatgcacatgtgtgcaattaaaagagcaaacacctgggccaggaaggcaggtgctaagacagaccacaggcaaataggccacagcacccctgtttttcccattttattagcaggccaattgcagagttgatgggccttctctttagtttctctcctgcttctcttccccataccctccatcctgggcatctcaggccttgcagacagttctstcctccctctcctctaacccacactacaccctctgcaggataaacttccttcctcgtctgactgcctccgccccggatatcctctccaaggcaaagagtcattcactggaagaccgtgagcaggaggaggctggatttaggaaacaatgggtaaaagctgccctccagcagctgagggctgaggacagtctctctcaaaagaggtagccagaaaccagctggagagtcaggaggcagcagttgagtgagagcagttgaggggaggctcagtacccatccccaaatcccacctggggaaaa

SEQ ID NO: 203226 - DNA, 601 bp, Human
actcattcatcaaatgtttgctgatcactcagtcaagtgtcactacactcccaggctgcaactctggcccagtcaggactcactagctccagaggcagatgcacatgtgtgcaattaaaagagcaaacacctgggccaggaaggcaggtgctaagacagaccacaggcaaataggccacagcacccctgtttttcccattttattagcaggccaattgcagagttgatgggccttctctttagtttctctcctgcttctcttccccataccctccatcctgggcatctcaggccttgcagrcagttctctcctccctctcctctaacccacactacaccctctgcaggataaacttccttcctcgtctgactgcctccgccccggatatcctctccaaggcaaagagtcattcactggaagaccgtgagcaggaggaggctggatttaggaaacaatgggtaaaagctgccctccagcagctgagggctgaggacagtctctctcaaaagaggtagccagaaaccagctggagagtcaggaggcagcagttgagtgagagcagttgaggggaggctcagtacccatccccaaatcccacct

SEQ ID NO: 203227 - DNA, 601 bp, Human
gcaccttgtaaagctgatgtgtttcacaaatggcagatatttccttagtgagttgatctggaaaaaggaaatgtagaggagcaaagaaaaataataaggtagtgactgagcatacgttttggaaacagtcagcttatgtttgaatggcagctccacaactgatcagctgtgatcctgagcaagtttcttactacctctgagcctcagtttctccatttgtaaaatggagagcatcagtagctacctcataaattgtccaagataacacatgtgaagtatttctcacactgtctggtacacygcaagtgcagatatctggttatccttatcttaaggagaggccaactctaacacttatcgttcaggtttgtatctcttttgatatttgacaatatgccctgagtaatgccaaatggctgacttggaggaaaaagtcttattctcactagcacctctttggatcccaaaatatttaacgcatgtgtcttcatctagcaagccaacgtttcacaataagctaggcttacatacatatttaaaactttaacaacctgccagaaaagccttcccaatttgcttcccacaccagggatggacagtg

SEQ ID NO: 203228 - DNA, 601 bp, Human
acagactgaaaacccggaggtcaggagttctaaccctgatccatccaagtgaaagatatcttccttaaatagtttataagccactgtaaagcaccttgtaaagctgatgtgtttcacaaatggcagatatttccttagtgagttgatctggaaaaaggaaatgtagaggagcaaagaaaaataataaggtagtgactgagcatacgttttggaaacagtcagcttatgtttgaatggcagctccacaactgatcagctgtgatcctgagcaagtttcttactacctctgagcctcagtttytccatttgtaaaatggagagcatcagtagctacctcataaattgtccaagataacacatgtgaagtatttctcacactgtctggtacactgcaagtgcagatatctggttatccttatcttaaggagaggccaactctaacacttatcgttcaggtttgtatctcttttgatatttgacaatatgccctgagtaatgccaaatggctgacttggaggaaaaagtcttattctcactagcacctctttggatcccaaaatatttaacgcatgtgtcttcatctagcaagccaacgtttcac

SEQ ID NO: 203229 - DNA, 601 bp, Human
tgttgtcaccgctgaagactcagacgctgccttctggccctggggaagcactggaaataccagagtctggaaatgctagctgcccccgtatttacacactttaccatacatgggaattactcagtgctggcgtcagacacattcctgggtagctgcgtagtacaggcacgtcattaccatataaattcttgacaactagaaacagcagtcggaacccaggacccctccacctcaccttctctgccctcccctcaagttttgctagctctctctttctcaagcacgctcttttccaggcttsttttctttctgcaaacctggctctgaaactcaaacatgcagagctggtgaaagcatatccattagtggctgggaactaactctcaggggtcccctctgctcctacctggccatgcaacagactgaaaacccggaggtcaggagttctaaccctgatccatccaagtgaaagatatcttccttaaatagtttataagccactgtaaagcaccttgtaaagctgatgtgtttcacaaatggcagatatttccttagtgagttgatctggaaaaaggaaatgtagaggagcaaagaaaaataa

SEQ ID NO: 203230 - DNA, 601 bp, Human
aaagccaggcacacagtcgggggtagggggtgctggctgcctagctggggctgagctccagctgctaaccttccatttcttcccctgttgtcaccgctgaagactcagacgctgccttctggccctggggaagcactggaaataccagagtctggaaatgctagctgcccccgtatttacacactttaccatacatgggaattactcagtgctggcgtcagacacattcctgggtagctgcgtagtacaggcacgtcattaccatataaattcttgacaactagaaacagcagtcggaacycaggacccctccacctcaccttctctgccctcccctcaagttttgctagctctctctttctcaagcacgctcttttccaggcttcttttctttctgcaaacctggctctgaaactcaaacatgcagagctggtgaaagcatatccattagtggctgggaactaactctcaggggtcccctctgctcctacctggccatgcaacagactgaaaacccggaggtcaggagttctaaccctgatccatccaagtgaaagatatcttccttaaatagtttataagccactgtaaagcaccttgt

SEQ ID NO: 203231 - DNA, 601 bp, Human
ttgaacccggaggcagaggttgcagtgagccaagatcgtgccactgcactccagcctgggggacaaaagcgaaactctgtctcaaaaaaaagaagtctgaaggtcaacacaggtagaaatggaggtcgatgacttctttgtagtatttcaaaacttctacaggaaatcctgtattataataaagcctcatagacaaattaacagatggggtttccttgcttttatccagatctgtaatgatgttggttattccatgctgaacaaaatggtctgaatgatttttctttgattaattttttamaagttaaaacacattagcacttaggccttaaaaacacaggtcgtttgcagctgacatcccaggaagcaccaacacacgccacccctgcataaagaaagccaggcacacagtcgggggtagggggtgctggctgcctagctggggctgagctccagctgctaaccttccatttcttcccctgttgtcaccgctgaagactcagacgctgccttctggccctggggaagcactggaaataccagagtctggaaatgctagctgcccccgtatttacacactttaccatacatgggaattact

SEQ ID NO: 203232 - DNA, 601 bp, Human
cttggggaggctgaggtgggtggatcatttaaggtcaggagtttgagaccagcctggccaacagcgtgaaaccccatctctactaaatatacaaaaaaaaaaaaaaaattagctgagtgtgatggtgcacacctgtaatcccagctacttgggaggctgaggcaggagaattgcttgaacccggaggcagaggttgcagtgagccaagatcgtgccactgcactccagcctgggggacaaaagcgaaactctgtctcaaaaaaaagaagtctgaaggtcaacacaggtagaaatggaggtygatgacttctttgtagtatttcaaaacttctacaggaaatcctgtattataataaagcctcatagacaaattaacagatggggtttccttgcttttatccagatctgtaatgatgttggttattccatgctgaacaaaatggtctgaatgatttttctttgattaattttttaaaagttaaaacacattagcacttaggccttaaaaacacaggtcgtttgcagctgacatcccaggaagcaccaacacacgccacccctgcataaagaaagccaggcacacagtcgggggtagggggtg

SEQ ID NO: 203233 - DNA, 601 bp, Human
gtttccttcagaaccgtgcacatgacccgcctctctgaaaaggtaaccagcatcactgagctaccatcaatccaggccccatgggcctccagaacttgactgtcattctaggtcaggaatccttctctctattgaatgagctttctcttttcaaatccatgtccagtggcccttgtgagactgtgagctgacaagggcggtatatgtctctccctttccccacttgcccccagtgccttctagagcagagctccctactcttggagttcagaagtttgcagggcgcagtggctcattcctrtaatcctagcacttggggaggctgaggtgggtggatcatttaaggtcaggagtttgagaccagcctggccaacagcgtgaaaccccatctctactaaatatacaaaaaaaaaaaaaaaattagctgagtgtgatggtgcacacctgtaatcccagctacttgggaggctgaggcaggagaattgcttgaacccggaggcagaggttgcagtgagccaagatcgtgccactgcactccagcctgggggacaaaagcgaaactctgtctcaaaaaaaagaagtctgaaggtcaacacaggta

SEQ ID NO: 203234 - DNA, 601 bp, Human
gactgtacccagatcctcagccttgagacaagaaagccaaggtggcagctcttacagcagcagcaaaaggagaagaaaaaggtcacagactctcagtcaccccaaatctcatgaaagtcaggctcggctgggtgtggtggctcacgcctgtaatccttgcactttgggaggctgaggcaggcggatcacttgaggtcaggagttcgagaccggcctggccaatgtagtgaaaccccatctttaataaaaatacaaaaattagccgggtatggtggcgggcacctgtaatcccagctactcmggaggctgaggcatgagaattgcttgaaacaggagatggaggttgcagtgagcagcgatcttgccactgcactccagcctgggcaataaagcaatactcagtctcaaaataaataaataaataaataaataaataaataaataaagtctggctcaggtgacaggttgaaggaaccatcgcagagatgtaaaatccctaactgccagccaccagtgtctgaaggcaagccccttcttatcaaacccttcaaaaccatcccatatctttatttctacagtggaaaaatcccatctctcccat

SEQ ID NO: 203235 - DNA, 601 bp, Human
ctagaagcctgctgtgtctgctgctgcatcttcctagcctggctgtcccattaggactgtacccagatccccagttaggactgtacccagatcctcagccttgagacaagaaagccaaggtggcagctcttacagcagcagcaaaaggagaagaaaaaggtcacagactctcagtcaccccaaatctcatgaaagtcaggctcggctgggtgtggtggctcacgcctgtaatccttgcactttgggaggctgaggcaggcggatcacttgaggtcaggagttcgagaccggcctggccaaygtagtgaaaccccatctttaataaaaatacaaaaattagccgggtatggtggcgggcacctgtaatcccagctactccggaggctgaggcatgagaattgcttgaaacaggagatggaggttgcagtgagcagcgatcttgccactgcactccagcctgggcaataaagcaatactcagtctcaaaataaataaataaataaataaataaataaataaataaagtctggctcaggtgacaggttgaaggaaccatcgcagagatgtaaaatccctaactgccagccaccagtgtctgaag

SEQ ID NO: 203236 - DNA, 601 bp, Human
acggctggcggctagaagcctgctgtgtctgctgctgcatcttcctagcctggctgtcccattaggactgtacccagatccccagttaggactgtacccagatcctcagccttgagacaagaaagccaaggtggcagctcttacagcagcagcaaaaggagaagaaaaaggtcacagactctcagtcaccccaaatctcatgaaagtcaggctcggctgggtgtggtggctcacgcctgtaatccttgcactttgggaggctgaggcaggcggatcacttgaggtcaggagttcgagaccrgcctggccaatgtagtgaaaccccatctttaataaaaatacaaaaattagccgggtatggtggcgggcacctgtaatcccagctactccggaggctgaggcatgagaattgcttgaaacaggagatggaggttgcagtgagcagcgatcttgccactgcactccagcctgggcaataaagcaatactcagtctcaaaataaataaataaataaataaataaataaataaataaagtctggctcaggtgacaggttgaaggaaccatcgcagagatgtaaaatccctaactgccagccacc

SEQ ID NO: 203237 - DNA, 601 bp, Human
ctctgcatagcacttggcacgtggctgttcatataggtggccaggaaatagctgaggaatgaatgaaggatgcactaatatcgaaagccacagcttctggggccattttctctgcatggtgaatctctgcagagcctggctcctagtggaggtgcttggtaagcgtgtgcaggctgagaggcagagcttactgtggggaagtggtgttagtgatgctgggggatctaggtagaccatgcctgctgcataagcccagttctccctttcccaggttctggagcagccgcacttcctcaggctsccacacatcgctgacatgccccgcaggaatttctgtaactgctcacatccccatctctgtcttcctcagataacccatgcggcctgagcccccagatccagggacagtccccattcccagcctctgatgttgcactgttccttcagcctctttctgtactgaggactgctagctgcccttgtcaagcaaaggtttggagctgaaaaccgtacgatgtgaaggacagttagacaggaacagcaatcagcaatgtgtgttatggtcggcctgatcatcggccatttcccccttcttccttgc

SEQ ID NO: 203238 - DNA, 601 bp, Human
caggtctttacagagcagctgctgcattttcagccctgtgctaggcactctaaaggatgtggatcagcagaagaagcaggctttataaagaaggctccagctgcaataaaaatggactgcctacccctacacacgtcaacatggacggatctcaaagagaatgtggaagaagcagacagaccagagctgggaaaacgcaagtccatttgtaggaaattcacaaatgggctaaactcatattgccaagggatggacatataggtggaaaagttactacagaaaagcaagggaatgatgatcrcaagcttttaccttagaagagttacctctaagagagggaagggaccatgactgggttgggagaccagggaggctggtaaggcactgcctggcaatgctctccttcttaactcagggtggttgtcatatgggggctcactttataattattctttgaactgtacatgtaggttttgtgcacacttttgtatataagctatagctcaccacaagaaaaaagttttttttgttttgttttgttttttaaatgcagggctgggcatggtggctcacgcctgtaatcccagcactttgggaggct

SEQ ID NO: 203239 - DNA, 601 bp, Human
aagtagaatgcctggggggccaccaggcctggcagagcactttctgctagctctcgacagcagcctcgcacgttctcggggatttcctccccccaatctaatcaacaggtctttacagagcagctgctgcattttcagccctgtgctaggcactctaaaggatgtggatcagcagaagaagcaggctttataaagaaggctccagctgcaataaaaatggactgcctacccctacacacgtcaacatggacggatctcaaagagaatgtggaagaagcagacagaccagagctgggaaaaygcaagtccatttgtaggaaattcacaaatgggctaaactcatattgccaagggatggacatataggtggaaaagttactacagaaaagcaagggaatgatgatcgcaagcttttaccttagaagagttacctctaagagagggaagggaccatgactgggttgggagaccagggaggctggtaaggcactgcctggcaatgctctccttcttaactcagggtggttgtcatatgggggctcactttataattattctttgaactgtacatgtaggttttgtgcacacttttgtatataag

SEQ ID NO: 203240 - DNA, 601 bp, Human
ttaagaaagaaaatgcaccttgctgaagttgcctcttcttctaacccagaccttctgctctgatcacaatgaaccaactcatttaggaacctgaggagaggcttcaccaagttgccacatcctggaaacatcacctggcccaggtaccagtgggtgcagcatcacggtgtcaggatccctgggtcgacctgacctctgtcagttgcttggtattcttttgtctgatttcttactcatctaggcttatgactggagcaaaccttgctctggcttcttaggagtagatatcagggaactttgyactccctcttcctctcatcccaggctgagtgggaatgggaagtgaagaactgaacaggccagcctgcaaggggctgaggaaggaggagccccactcttcctccagattcagcttcaccatgaggttgtggcctctgttgcctttgaacaagagataattagggtgcaaagggctgaaagtgttttcctctgaaatggtgaaatcatgacagggagagagagaagagagagctgagtggaaagttttcttaaccaagtctttacagcttggctttcagcccctgaacgcctgccaccccga

SEQ ID NO: 203241 - DNA, 601 bp, Human
tgatactgcttggaaataaagggaaaaggcagccccaggggagaggtcagagcccccttgccccactcagaaatggagaatgattctctgcttctggaaggaaaaccgaggcccacaaaacagttccagatcacgtgttggccagacgcagggccaggccagaacccagcccctgacctccagacctggtggttttctgccagccattgctcccctccagtgggccacacatgtggggccaagagggtgaaaagtgtcagtaagtctcagcctgcgggtgaggagacgctggtgtcagaamgtgtgcaaggcttccgtgagcttcccctgtgctcttggattctagggaacagcccagggccaacctgtggggccctgttccatcggccaccatcacagagttcttctttcctcagggctggctgcttaacccaccttccccagcagggagctgggtacagctcagagatgggcacataacctcagggcaggttcccagccacggagctgagctttcccaccagcctctgaaccaccacctgctcataggatctggcagcccctttcaagaccatgggagtatactgtaggccctctcagt

SEQ ID NO: 203242 - DNA, 601 bp, Human
taagatccaccaaagactcaatcaaggggaattttaaaggcaggcctgaataaatttctaccatatcatggtaagccaataaggggaaaagaaaaaaaaaagactggatttgttggaaacacatacttccagatgccactttggtgggcccttgtgatactgcttggaaataaagggaaaaggcagccccaggggagaggtcagagcccccttgccccactcagaaatggagaatgattctctgcttctggaaggaaaaccgaggcccacaaaacagttccagatcacgtgttggccagaygcagggccaggccagaacccagcccctgacctccagacctggtggttttctgccagccattgctcccctccagtgggccacacatgtggggccaagagggtgaaaagtgtcagtaagtctcagcctgcgggtgaggagacgctggtgtcagaacgtgtgcaaggcttccgtgagcttcccctgtgctcttggattctagggaacagcccagggccaacctgtggggccctgttccatcggccaccatcacagagttcttctttcctcagggctggctgcttaacccaccttccccagcag

SEQ ID NO: 203243 - DNA, 601 bp, Human
tcgtggccctctgcccctctacctccatccaggtgatatactgagagactctgcaactcaccaaagtctttgtaagatccaccaaagactcaatcaaggggaattttaaaggcaggcctgaataaatttctaccatatcatggtaagccaataaggggaaaagaaaaaaaaaagactggatttgttggaaacacatacttccagatgccactttggtgggcccttgtgatactgcttggaaataaagggaaaaggcagccccaggggagaggtcagagcccccttgccccactcagaaatrgagaatgattctctgcttctggaaggaaaaccgaggcccacaaaacagttccagatcacgtgttggccagacgcagggccaggccagaacccagcccctgacctccagacctggtggttttctgccagccattgctcccctccagtgggccacacatgtggggccaagagggtgaaaagtgtcagtaagtctcagcctgcgggtgaggagacgctggtgtcagaacgtgtgcaaggcttccgtgagcttcccctgtgctcttggattctagggaacagcccagggccaacctgtggggcc

SEQ ID NO: 203244 - DNA, 601 bp, Human
ccccagcttcaagagatcattgcttctaactttcacatactcctctcaagagattcaactgcattctttttctttacttgtcctgtaatcctaattcggtttgatcatattccttaaatattggagttcagcatctcagttggacgcatcctcaaacatgtcctgaacatagaaaccgagggataccactggagaagccacgccttttaccaccctcggagaagctctcagctcctttccttgcaactgccatcctcttgcctttaaagggtccatccctctgccagctcctctctcaccytaagccccaggttggagacttcagactaaataaggaccctcttgtcctgctctggagatctccatctcattccagcactctgggccatccaaatatggaacttcccaccatttccccccgggaccagctcccaagaaggagggagagggaaccacaggccaagggctccaacattcccttctagggtgggaagtcaggaattggcctggaattgttttcctgtaagatcccaattgaactgaaaattccaagaccagagagaaggcagaaagcaaagagtgcttgggggaacagaggtgt

SEQ ID NO: 203245 - DNA, 601 bp, Human
agccaatggggggagatgcaggtgatgtgataccccataagaaatgtttaacatttattaagtgcccaacatggtgggctttgaaatgggatgcagctcatgctaatcacaagaggatttgaagattctaatctcagaaatcactttaccacaggaagaagtgagggtcagacacagaagaacttcctgactcctggggtaagagagagtggaacggaaggaactagggattgcaatggtctgagctggaaaggctgtgggcctcatatttcgtcctgttaatctcagaggggagctatgyccagctatccagaataaaacagtttgggctgggtgcagtggctcatgcctgtagttccagcagtgggaagccaaggctggaggattacttgagcccaggagtttgagatcagcctggggaagatggcataaccctgtctctatttatttaaaaataaataaataaataaaacttttaaaaataaaaataaagttaaagcagttcagagcctggggtcatgaagagtcagactgcccagaatcaaatcccagctctctccctttccagccatttgcaagttttttttgcctttccagcctc

SEQ ID NO: 203246 - DNA, 601 bp, Human
ttcagaggcaacagcctaggctgaccccaagccacaggacgcctgttgaggttcctcactctgccctcaacagagaccatatgtcccaatgggggaggaggaaaaagaaaagaagggcagttttcctgccttcaacagtggaatccagaagagactatctgtgcatgttggcagggagccaatggggggagatgcaggtgatgtgataccccataagaaatgtttaacatttattaagtgcccaacatggtgggctttgaaatgggatgcagctcatgctaatcacaagaggatttgaagwttctaatctcagaaatcactttaccacaggaagaagtgagggtcagacacagaagaacttcctgactcctggggtaagagagagtggaacggaaggaactagggattgcaatggtctgagctggaaaggctgtgggcctcatatttcgtcctgttaatctcagaggggagctatgcccagctatccagaataaaacagtttgggctgggtgcagtggctcatgcctgtagttccagcagtgggaagccaaggctggaggattacttgagcccaggagtttgagatcagcctggggaagat

SEQ ID NO: 203247 - DNA, 601 bp, Human
tctgcatatccgactctagaaatgctggccaacaccaattcctcttccaggaatccatatgtgtctcctttggtcctctgcacccctaaacttcctcaggctgcagtgcaacacagggttcagaggcaacagcctaggctgaccccaagccacaggacgcctgttgaggttcctcactctgccctcaacagagaccatatgtcccaatgggggaggaggaaaaagaaaagaagggcagttttcctgccttcaacagtggaatccagaagagactatctgtgcatgttggcagggagccaayggggggagatgcaggtgatgtgataccccataagaaatgtttaacatttattaagtgcccaacatggtgggctttgaaatgggatgcagctcatgctaatcacaagaggatttgaagattctaatctcagaaatcactttaccacaggaagaagtgagggtcagacacagaagaacttcctgactcctggggtaagagagagtggaacggaaggaactagggattgcaatggtctgagctggaaaggctgtgggcctcatatttcgtcctgttaatctcagaggggagctatgcccagct

SEQ ID NO: 203248 - DNA, 601 bp, Human
ggctgactgccaacagccaccatttacccagaggccagggagtgccgtggggtgaggggggtgtggtggggctgatgacaccctatggcatttcgaagaaagggaaatgacttcttctcagtagtgagagatagcagggctgagacagtgagtctggtgtggcaacggtgctgccctgagcccctgatctggctccgacactcactagccgtgggaccccaggcaagtcactgagcctgggctggattttctcatctataaaaagaggaggcaacatggtgaaaccctgtctctacaaaayacagaattagctgggtgtggtggcacatgcctgtactcccagctactcgggagcctgaggcaagaggatcacttgagcccaagaagcagaggctgcagtgagccaagattgtaccactgcactccagcctgggtgacagagcaagactccctttcaaaaaaaaacaaaaaaagaggaaattggactaagtgattcttggggcccctcccagctctgactctcatacaaatatagaatgcacgctccttgcagggaggagcccagcctgttttagtccctgctgcatccccagctcctgca

SEQ ID NO: 203249 - DNA, 601 bp, Human
tctctctgccaaagtcacaaaggctagggcctctagggtcatctcccattttacagatggacaaaccaagcctcagcacaatgttatttccattgtaacatcatacttccctcggtcacccagttaaccccagaatcatttaacaccccatttgctaagaattgccctcctctgcccctcattcctgcagctggtctattatcagattctttacaggagaaatctgctgatgaatcattcccactggggcaatgaccttggctgaaacttggtaattcatccatcatttccgtccaccccscaggccgaggagcaagccaggctgactgccaacagccaccatttacccagaggccagggagtgccgtggggtgaggggggtgtggtggggctgatgacaccctatggcatttcgaagaaagggaaatgacttcttctcagtagtgagagatagcagggctgagacagtgagtctggtgtggcaacggtgctgccctgagcccctgatctggctccgacactcactagccgtgggaccccaggcaagtcactgagcctgggctggattttctcatctataaaaagaggaggcaacatggtg

SEQ ID NO: 203250 - DNA, 601 bp, Human
ttctaagaaacagacaggttcccatgaaactttgtatataatcttcagggctttgtggaccctctgcagcccatccacgtacccttactttctgttctcctatattagagatacagattgatcattgccactccctatgaattgcccattgtccatcaatgctggggatgttactgctcatggctgatatgagctccttggagactggaaagcacaggtacatgcaacccacagggacaaagagaagaggttaaaccccagtgctcaggctgccctgagcagagctaggtcaccaatttamaagttctggaatccacatttcaggaagatatctccccccatccctctcatgcccagcagccaccttaccttcccagcaccaatcaccttctccgcagcatagactgcctggctgcatcgggggcagcgctcggagccaccaatcttctgggcaaatttggatgcattggggttggtggtgggcctgtggccaggggctctgcatggagaagggcatggggtgaggtgacttacactgtaagtacaggtggggctggcactgagagggcatgaccctaccttcatctcatgccagagcagc

SEQ ID NO: 203251 - DNA, 601 bp, Human
gctcaattgggaactgttgatttgctacagtgattctcactgtgcattggtgattgggggctactgtcagaatatcatgggggaagggcatgtgcggcaattctaaacagtgtgaaaaaagcctcctaggaggctctggtaggtctgaaccttgaaaatctctgccctgggggtatttggatgggtttttgggagtccacatcccatgaaacagaatgtatatttttgggatcacaaatcctttgaaaatttaataaaagctatggatcttcttctaagaaacagacaggttcccatgaaactttgtatataatcttcagggctttgtggaccctctgcagcccatccacgtacccttactttctgttctcctatattagagatacagattgatcattgccactccctatgaattgcccattgtccatcaatgctggggatgttactgctcatggctgatatgagctccttggagactggaaagcacaggtacatgcaacccacagggacaaagagaagaggttaaaccccagtgctcaggctgccctgagcagagctaggtcaccaatttaaaagttctggaatccacatttcaggaaga

SEQ ID NO: 203252 - DNA, 601 bp, Human
tgatcagctcaattgggaactgttgatttgctacagtgattctcactgtgcattggtgattgggggctactgtcagaatatcatgggggaagggcatgtgcggcaattctaaacagtgtgaaaaaagcctcctaggaggctctggtaggtctgaaccttgaaaatctctgccctgggggtatttggatgggtttttgggagtccacatcccatgaaacagaatgtatatttttgggatcacaaatcctttgaaaatttaataaaagctatggatcttcttctaagaaacagacaggttccyatgaaactttgtatataatcttcagggctttgtggaccctctgcagcccatccacgtacccttactttctgttctcctatattagagatacagattgatcattgccactccctatgaattgcccattgtccatcaatgctggggatgttactgctcatggctgatatgagctccttggagactggaaagcacaggtacatgcaacccacagggacaaagagaagaggttaaaccccagtgctcaggctgccctgagcagagctaggtcaccaatttaaaagttctggaatccacatttca

SEQ ID NO: 203253 - DNA, 601 bp, Human
gcaaattatgtaatcctcctgactcccagtttcttcatctgtacaacagggatactaatccccatctctgtccaaccatgactgtgagagtagagattctaacactggcctaagtgttaattgtttaacatttcttgatccattcccctatcccattcctcaaggtcaaaaagccttgaaagccaaaacctgaatccagaagagatgaagatgggctccaggcccagacattccataaccttgttgtgtgatcttggccaagtcacttttctatctcaggcctcacgtgatgctccagaawtcctctctggccccacagctgaaagacatctcttctgtgattttctgactgctaatctgacactgcaaaccccaggggcaagagttctgcctcttctctactgcagcctatctgaaggaagtgatcagctcaattgggaactgttgatttgctacagtgattctcactgtgcattggtgattgggggctactgtcagaatatcatgggggaagggcatgtgcggcaattctaaacagtgtgaaaaaagcctcctaggaggctctggtaggtctgaaccttgaaaatctctgccctggggg

SEQ ID NO: 203254 - DNA, 601 bp, Human
ctccagcctaggtgacaagtgtgaaattctgccaaaagaaaacaaaaacaaaaacaaacaaacaaaaaaaactgccttatttgtcaggggccattacttggtccactttgcatttcctccaccatccaggcccactttagagctgaagaactgaggcttaggaaggctaaattttcccaagttcgctcagccaataaatggcaaaactaggattcaaagcaggctgtctagagtccaagctcttaatcaccgtgctaggatcccctcccattttgcagccttggaaatgggtttgaagagkctaaatggcccaaagtagcattaacagtagtaacagcagtaagagcaagggcttcggagtcagacaaacctgggcttgagtctggcttagccccttcctagctagcggatctgggcaaattatgtaatcctcctgactcccagtttcttcatctgtacaacagggatactaatccccatctctgtccaaccatgactgtgagagtagagattctaacactggcctaagtgttaattgtttaacatttcttgatccattcccctatcccattcctcaaggtcaaaaagccttgaaagccaa

SEQ ID NO: 203255 - DNA, 601 bp, Human
tctaggctggagaaaaactgaatcacacctagaccaacacctctcctcatatttcctagccacctccctgccaaaataagctgaatccctttgctcattcataagcacccaaaagtactcccagctcaacatttcttgagcgaggcaatagaaaggtggggcttctccctaccttttccacttgaatgcaaaattctcttatcctactccttagtacagccctaactttaccttatagcctgcctaagtaatggaaatagtgattcttagctattcttaataattttctattctcataatsagatagaacaaaaaacccaacttaataataatattaatgtctcctgttttcatatcctttagtcaatggcaaggatcttcattgtgacctcaaaataatccctgaaaataaacaacaataataataacaatagcaaaactgtactgaggacataccaggcactacattgcacattatacatgtactatctcatttaatcattaaaactgccttgttgttgggtgtggtagctcacacctgtaatcccagcacttttggaggccgaggtgggtggatcgtgaggtccaggctggttcaaga

SEQ ID NO: 203256 - DNA, 601 bp, Human
ccttgcacattggcttctcctccagagagctgaaatggggggacctgggtctaggtcagtgctggtgcaacctcaatagtcacccagcctttgctgcctcctctgtaaagcaggggctgctaccccaagctctctaggctggagaaaaactgaatcacacctagaccaacacctctcctcatatttcctagccacctccctgccaaaataagctgaatccctttgctcattcataagcacccaaaagtactcccagctcaacatttcttgagcgaggcaatagaaaggtggggcttctccytaccttttccacttgaatgcaaaattctcttatcctactccttagtacagccctaactttaccttatagcctgcctaagtaatggaaatagtgattcttagctattcttaataattttctattctcataatgagatagaacaaaaaacccaacttaataataatattaatgtctcctgttttcatatcctttagtcaatggcaaggatcttcattgtgacctcaaaataatccctgaaaataaacaacaataataataacaatagcaaaactgtactgaggacataccaggcactacatt

SEQ ID NO: 203257 - DNA, 601 bp, Human
acaaaacaaggccttttaagggcaaagacactcccagtgcccaggctggtggatgagaaaggaaattcatcccctcagatttcctggttgcctaaccttgcacattggcttctcctccagagagctgaaatggggggacctgggtctaggtcagtgctggtgcaacctcaatagtcacccagcctttgctgcctcctctgtaaagcaggggctgctaccccaagctctctaggctggagaaaaactgaatcacacctagaccaacacctctcctcatatttcctagccacctccctgccaraataagctgaatccctttgctcattcataagcacccaaaagtactcccagctcaacatttcttgagcgaggcaatagaaaggtggggcttctccctaccttttccacttgaatgcaaaattctcttatcctactccttagtacagccctaactttaccttatagcctgcctaagtaatggaaatagtgattcttagctattcttaataattttctattctcataatgagatagaacaaaaaacccaacttaataataatattaatgtctcctgttttcatatcctttagtcaatggcaag

SEQ ID NO: 203258 - DNA, 601 bp, Human
ccaggaaaagcaagaggcaggcagcagtcagataagacaaaacaaggccttttaagggcaaagacactcccagtgcccaggctggtggatgagaaaggaaattcatcccctcagatttcctggttgcctaaccttgcacattggcttctcctccagagagctgaaatggggggacctgggtctaggtcagtgctggtgcaacctcaatagtcacccagcctttgctgcctcctctgtaaagcaggggctgctaccccaagctctctaggctggagaaaaactgaatcacacctagaccaamacctctcctcatatttcctagccacctccctgccaaaataagctgaatccctttgctcattcataagcacccaaaagtactcccagctcaacatttcttgagcgaggcaatagaaaggtggggcttctccctaccttttccacttgaatgcaaaattctcttatcctactccttagtacagccctaactttaccttatagcctgcctaagtaatggaaatagtgattcttagctattcttaataattttctattctcataatgagatagaacaaaaaacccaacttaataataatattaa

SEQ ID NO: 203259 - DNA, 601 bp, Human
tagcgaagaggctcttggttgtaccctgtacccattgcccctgccaccaaaattatagaagcatcatctgctgtaagaacattggactgggagttaggaagccagggtctagccctatgcctgcctcaatttgccagatgatgctggccaagttgctttccccctctggtcttgtttcctcatctgtacaatgaaggaatcatactagatgttcagatcttggatcccaaggccaggaattagtttacattcagcaaaggcaaaactacttagcccccctacccccttgggcctcctgacmctcaattagaagtgaaaacacccacctttgcagtaaatctcgccatccttgtctgccagggtggttgactcaaggcctttgccacacttggcacatcgaaagcaggccttatgccaggactaggcagggaaggaaatagttaatggctgccaccagtgatgagggtaccctccaccccaggcccactccctttgacataaccatggtataagggctcaagccacttctgaagtctactcagctggtgctgctgggaggacatggcctatggtgcaaggcagtagagggagaaggccaggg

SEQ ID NO: 203260 - DNA, 601 bp, Human
tggaagaggcagggtcttgggttaaagggaagattctgaggtctcagggcaaagggaaaggtgtttggatgaagactgaggcagtgcctacctccctccacatctgaggatcaagcaggtgtggcaagaacagagccctggcctgggctctgctggccgcagcctcaggagccagggttaaggccagagataaatgaagatttgagccattgataaatgccaatatatgtttcaggtatttcattaggatcctcccatcaagcagggaactagatgtttgagaagatcaaacaacatcctgactttggggtccttaagacctgggttattctcctcccagtcctagtgggaggctatccattccacaaagactcaaaggcaagaggcctggagaagcaggggctcctaggaccccgcctgcatgcctctctgcctccaatagtgactccctaagctgggactcctcaggcttactctgagggacaccaggaagctcaacctctttcccacagaggagaatctctgagatccaaaaaacccagccttcccccctcctcatcttggtcttgcttccctctccctccagcctgttgctgctgct

SEQ ID NO: 203261 - DNA, 601 bp, Human; identical to SEQ ID NO: 18433

SEQ ID NO: 203262 - DNA, 601 bp, Human; identical to SEQ ID NO: 18434

SEQ ID NO: 203263 - DNA, 601 bp, Human
aaatcctctttcccactggattcttcttaccccacccagcttaggtagaaacaagtgtctcatggggagagtacggaatggcaggttggaaatccccccgggccccagggagacctccagctgaaccctcacgggcacttttccaagctggatcccgggcctggcaccccctcctccagcctctgagaggccagatcccatgactgggggaacctgggagaaaggggcagcacccaggaaactcaaggaggaaggggcagtacctgacaggggagagcttatagaccaagtaaacactttratacaaaggatgcctggtaagaattacacacaagtgagcaaagattccacttgtttatttatttacttattttatttagctaagtttagtaaaatgctaataagactttacccattaccaaacagtacaggtcaaccaagacgtatgtattaagacaggccttaggagagagtgaggggcagggggtaataaggtggaaggagacaaaagaaaccgaccctggcccttccaccacacacacacacacacacacacacacacacacacacacacctcacacttccttctacctgtggcttc

SEQ ID NO: 203264 - DNA, 601 bp, Human
caagctggatcccgggcctggcaccccctcctccagcctctgagaggccagatcccatgactgggggaacctgggagaaaggggcagcacccaggaaactcaaggaggaaggggcagtacctgacaggggagagcttatagaccaagtaaacactttaatacaaaggatgcctggtaagaattacacacaagtgagcaaagattccacttgtttatttatttacttattttatttagctaagtttagtaaaatgctaataagactttacccattaccaaacagtacaggtcaaccaagacktatgtattaagacaggccttaggagagagtgaggggcagggggtaataaggtggaaggagacaaaagaaaccgaccctggcccttccaccacacacacacacacacacacacacacacacacacacacacctcacacttccttctacctgtggcttctgtccccccacctactccctagcccccattcctgagtggccccttgtagagccgagggaaggaaaatggccggcagaggacttcctgggccccagacctaaaggcctttgcttctctgtgtgctctttgcctttgtgtgggct

SEQ ID NO: 203265 - DNA, 601 bp, Human
cctgacaggggagagcttatagaccaagtaaacactttaatacaaaggatgcctggtaagaattacacacaagtgagcaaagattccacttgtttatttatttacttattttatttagctaagtttagtaaaatgctaataagactttacccattaccaaacagtacaggtcaaccaagacgtatgtattaagacaggccttaggagagagtgaggggcagggggtaataaggtggaaggagacaaaagaaaccgaccctggcccttccaccacacacacacacacacacacacacacacacacacacacacctcacacttccttctacctgtggcttctgtccccccacctactccctagcccccattcctgagtggccccttgtagagccgagggaaggaaaatggccggcagaggacttcctgggccccagacctaaaggcctttgcttctctgtgtgctctttgcctttgtgtgggctccaggctcctctcgtcacatttccactcaagatcatgccacctccagagcacttgcctccttcccttttatttggtgccttggtaggtgcctcctagcctctttagaattaggtttgga

SEQ ID NO: 203266 - DNA, 601 bp, Human
caaacgtcccctatttgctctgcggccacctctactcactctgctccctctttcttatgctggtttacctgtcaggagcctgctttggttcctggaatggaatgagctggtagctgtggaaggaccatgccccaggcgttttccctcgccccctggacagattcaggttcttgtttagtctcttccaagagcagagtcagtttacctagggtcttcttgagccccttgaatcccatccaaagtttccctagttaagaagggccaaccataccccacaggttgcctggaagagtagccactsctccttgtaccccaggaaggacagtcaggaccagccatccttggtcctgtgatagaagtggcttctcagttcctctccactagtgctcttttctctcttgtcactgagggagtattgagccactgaggactggaggaagggcccctggagcctgtcacaaaatgcctgtctgcactcatgctctccctgaaatgccacagatcagacaagcaccttgccctggtcatgaaggccccgggcaggaagaaggtggcttctgtggcctggagaccttgcagaaggaggttgctctgaacctgc

SEQ ID NO: 203267 - DNA, 601 bp, Human
tagtctcttccaagagcagagtcagtttacctagggtcttcttgagccccttgaatcccatccaaagtttccctagttaagaagggccaaccataccccacaggttgcctggaagagtagccactgctccttgtaccccaggaaggacagtcaggaccagccatccttggtcctgtgatagaagtggcttctcagttcctctccactagtgctcttttctctcttgtcactgagggagtattgagccactgaggactggaggaagggcccctggagcctgtcacaaaatgcctgtctgcaytcatgctctccctgaaatgccacagatcagacaagcaccttgccctggtcatgaaggccccgggcaggaagaaggtggcttctgtggcctggagaccttgcagaaggaggttgctctgaacctgcctacccatcttgaactgcccctgaagtattgctcccctgtgttttcaggctgtccctgtgtgcctcagggtgtctggcctccttttcttcccagactgtgtggaaggcaaggggaaactgagggggatgtcaccacccagcaaaagatctttgccagggaaatgacctccctgag

SEQ ID NO: 203268 - DNA, 601 bp, Human
ccataccccacaggttgcctggaagagtagccactgctccttgtaccccaggaaggacagtcaggaccagccatccttggtcctgtgatagaagtggcttctcagttcctctccactagtgctcttttctctcttgtcactgagggagtattgagccactgaggactggaggaagggcccctggagcctgtcacaaaatgcctgtctgcactcatgctctccctgaaatgccacagatcagacaagcaccttgccctggtcatgaaggccccgggcaggaagaaggtggcttctgtggccyggagaccttgcagaaggaggttgctctgaacctgcctacccatcttgaactgcccctgaagtattgctcccctgtgttttcaggctgtccctgtgtgcctcagggtgtctggcctccttttcttcccagactgtgtggaaggcaaggggaaactgagggggatgtcaccacccagcaaaagatctttgccagggaaatgacctccctgaggatggggaaggaaacacttatccaccttccagatctttataacttcacttggaatctcttcctaaagctgaacctgaatctcacttgccc

SEQ ID NO: 203269 - DNA, 601 bp, Human
cccatcttgaactgcccctgaagtattgctcccctgtgttttcaggctgtccctgtgtgcctcagggtgtctggcctccttttcttcccagactgtgtggaaggcaaggggaaactgagggggatgtcaccacccagcaaaagatctttgccagggaaatgacctccctgaggatggggaaggaaacacttatccaccttccagatctttataacttcacttggaatctcttcctaaagctgaacctgaatctcacttgccctaacccaagcgctcccccgccactgtgaatacagatcayacccagctcagtgaaaggagcttcctttcacctgtcctgtctccttccagggaagtcctaacaacaccagcaccattgcctgctttgtctcactgcctgcttagccatctgtgattttttatttcagcctttggcctgaaattctctttctcccttcttcatagaagtactgtttcccatctaaaattgctaagcctctatttctctctgatcagaggtaggggctggaggcaacattgagccaggggaggtgcctgctccctttctgtagttcctgtgtctattcagccctcatcaggg

SEQ ID NO: 203270 - DNA, 601 bp, Human
ctcgcctcaggagcccccactttgatggctttttgtatttgtgtttgactatgtctcagcatgagcttctgcccgagtgttctgctcattagagtttctagaaagttgtcctttcctgaccacaggcatcacttctggggttgttttcttgggaccgaagctgagattgcagatggtaatggctatgtgtgctttagcttgttccattggcgaaacataccaattaaacttcaaatgaaccaattcttgtttctttacaatgtaccttggcttgaagttggagttttagccagaatttccrttggcctgttacaacacatgcaaaaatgctgggtattctagggtgttttgcagcaaatgctgcttctctggatcctgctccttgacagagattttttaaaagtacaaattcctcccccgaccccataccattgtaagtatcattgtgccaattgttctaggtttagaaatctgggaagcgcttctgcgatgggccgtgacccttacaagatgtgtaatgtttgaacaaaataaaatggacgaatattagatatcttcatgtgaagttccttctaggcatacgctggacacatgcgcacac

SEQ ID NO: 203271 - DNA, 601 bp, Human
cttgtttctttacaatgtaccttggcttgaagttggagttttagccagaatttccattggcctgttacaacacatgcaaaaatgctgggtattctagggtgttttgcagcaaatgctgcttctctggatcctgctccttgacagagattttttaaaagtacaaattcctcccccgaccccataccattgtaagtatcattgtgccaattgttctaggtttagaaatctgggaagcgcttctgcgatgggccgtgacccttacaagatgtgtaatgtttgaacaaaataaaatggacgaatrttagatatcttcatgtgaagttccttctaggcatacgctggacacatgcgcacacatgtatacacacataggtcacacatgcatatatgcatgtatacacaatacaccccacacatgaatccacacacccacacatgcacacacgtacacacacataacatgcacacacttatgttatgtgtgtgtacatgtgtgtccttgcagctgtgctgtgtcaggagcccagcctggcatctacctggtgtgcgatcttggacaagtcgctgcctctctttgggtctctgcagctgtcagaggttg

SEQ ID NO: 203272 - DNA, 601 bp, Human
tcacctggaaatttaaaacaacacaaatgcgtgagtcccacccccagagattctgacttagtgagtatgaaggatggcacgggcatcaggacttcagaaactcccaggtgattctcatgtgtagccaagttggagaaccactgttctagtccctgtccttcactcacacagatccagcatgggggagcacccctatacaatgacatacacccatgtctttctctcatacacacacacacacgcacacttaatgtagtagttgctggcgagagcctttgactctgaaccccacctgaacccrtcaacccttgcccactctaacccaccaccctgccccctcacgcccatcctgtccccacaggatgctcccatgctctgcccagtcctcaggcttggtggtggccatgaacagatctgctgaaagagcagcaggattgtggcagagctaggtctgaacgcgtcccagcagagcctgagggagtcacatgggctggagagggagaagagagaacacaggccacagcaacccagtttgtttcagcatttctgttcagtacgtacacccaggaaaaggtcaagagccacaccaaagtgcccggtg

SEQ ID NO: 203273 - DNA, 601 bp, Human
atcctgtccccacaggatgctcccatgctctgcccagtcctcaggcttggtggtggccatgaacagatctgctgaaagagcagcaggattgtggcagagctaggtctgaacgcgtcccagcagagcctgagggagtcacatgggctggagagggagaagagagaacacaggccacagcaacccagtttgtttcagcatttctgttcagtacgtacacccaggaaaaggtcaagagccacaccaaagtgcccggtgaggctgtgctgaactccttgccctccccatctcctagaagctgccragttggggaggcatgtccacggtgctcccagcagcccagcagagggggcaggaggctggccagcccagtcctccctccaggagctggaaccatcccgcagacacagtccactcctgcccactccgaaacacctctgagggtattctctcagcagtagcttcctggcagttcttgttatctcatttaaattcctattgctgtgggcctagcttttctgggcaccatgggtgaaagagatttcagagggtgaagtaaaggcattttcaagactaaaagaaaatgagcttcctttctcaagct

SEQ ID NO: 203274 - DNA, 601 bp, Human
tttcaggtgcagtaagtgtgacctatttgaaagcttggaggtggaagaggatgagtcatccctgcaaaggctcacctgcccctactggagagagatttccactcatcctaaagaaggagctgcctccagtttcaaaggttttgaggcgagaaagcttgagttgcaccgatgacacaagaaagaatcagcctgtcgttgtctaaggcaccaaagggaagcagtgtgccaggacactggtgacctgagcggtagattttctgagatggttttacaccctaaaacgcggatgtaaaatcagacragctatgtggacagagcaggttgtgttgcttgtatacctgggaaagtggcagatgctctgaggcacttgctccttgaccttggggttctgtgggtgggcagatgcttcctgaggatggcacacaggttgggcacactgtcagtgtcaccgagaagccaccacatccctgctcatgctgcatgcacccatatggggagaagaggggcaaagcagatgcttagctggagggtaggagtgattctgtggggtgagctgggaactagcccctcccccattccccaggaactaagaatcctcctc

SEQ ID NO: 203275 - DNA, 601 bp, Human
ctcctctcttcctggtttaccccactcaccagggacctctttgagtgggaggagagcctgaccccattctaagcctctaagcaccaggcatcagagcacgttcaccacaagggttgggcaagggagaagaggtcattgacgcaaagagccagctcaagccagtcaggcccagacccagctggggcaatgccctgaactcaaggtcccagggaaagaaagacatggttcgcacttcagagagtgtccaaagtacatggtggtggagacttgtacgggcgtgagatggagatgggagtaggcrtcattcatcaggaaaggcttcctagaagtgcattctagagacatcggggaccaagtggaagagtgagctagcaccattacactcattagaagcccatgctcttgctattgaacttgacttttagagggcattacttaccagtcagacaccccagggtcaagagagggaaaatcacttttgttgtgggagcagtgctcttacagacagagcacacctgcccccagtactccttggttatctggcacactgcgagctgtgatttcaggtgtgtgacaactatggacttttcccctctctcac

SEQ ID NO: 203276 - DNA, 601 bp, Human
tgaggtcttgagcttggcttcaaaagatgagcaagattagaaggtagtggccaaggagggaaggcaggtttggcatggagggagatgtgagtaaagtggtgagcctgtcaccattggccatatttcaaggacagcaggacagtgaacagaccagcttgtgcagagttgatgctatcccttagggtgtccctgctggccagtgaaagggagatgaggggggtggccccactaggagccccaaatccagttctgttttctgtgatgcaaagccactttgccactaataaccctaatgacactytgtcctcctgcggagcctgtcatttgtgggtctccaagcactccgaaaacattaattaatcctcactgggcctttgaggttgatcgccgctcccccttcaccagccagagcatgttagaggtgaaagaatgggaggaagtttggtcactggtaggggctgggctgagatttgaatccagagtcctgtcctgaatcaatctctaatcagctgttgctgctggactgggaatgtcggaatcctgcctgtctcccctgagtgggaatcttatccttgtggaacatggagtgatgattccctgg

SEQ ID NO: 203277 - DNA, 601 bp, Human
agtggccaaggagggaaggcaggtttggcatggagggagatgtgagtaaagtggtgagcctgtcaccattggccatatttcaaggacagcaggacagtgaacagaccagcttgtgcagagttgatgctatcccttagggtgtccctgctggccagtgaaagggagatgaggggggtggccccactaggagccccaaatccagttctgttttctgtgatgcaaagccactttgccactaataaccctaatgacactctgtcctcctgcggagcctgtcatttgtgggtctccaagcactccraaaacattaattaatcctcactgggcctttgaggttgatcgccgctcccccttcaccagccagagcatgttagaggtgaaagaatgggaggaagtttggtcactggtaggggctgggctgagatttgaatccagagtcctgtcctgaatcaatctctaatcagctgttgctgctggactgggaatgtcggaatcctgcctgtctcccctgagtgggaatcttatccttgtggaacatggagtgatgattccctgggctggaatggccgtgctccaaggccctccagaccaagtcctgacc

SEQ ID NO: 203278 - DNA, 601 bp, Human
catggccatccctgtcctaatcccctcctttctcctctaggttccatgtatgatggcttggctgacaattacaactatgggaccaccagcaggagcagctactactccaagttccaggcagggaatggctcatggggatatccggtaaggaactgcttccatcctaaaagacctggagtacttgtggggatggtttgaggtttatagtggagaaaaccggcaccagttgctaaaaagagtgatgtaggctttggtccgtgagttgaggctcatcaactctgactaggtctgttgacttggscattgtttcataggtggctctcgtttgggctgactggatatttttgaatgtctcaaatgataatattttaggaaaagcatttttaaaaggcatttaaaaacaagtccatttcccagtaggtctgatttgatcatggatttgggaaatgtttgcattcttgaggtctattaatggaccagtttagatgtttctaggaaaatcctaaagggtcatctctgttcgttctgtgcctatggtcaaagagccaagagaacatgtccactgcattgactcctgcatatgacactgcatgctagagtg

SEQ ID NO: 203279 - DNA, 601 bp, Human
gcccggtaaactgacagatcaagcacagatgtgaataaaagggcttttacacaaagggtgatgaccaaattgagaaaatggcttaggaatgcagcataaagggattagatgaaacccaaggaaggcagatcactgcaccagcagccggaatggatgattatgctgacagtacagatggtacgtgtctttacttaaatgacattaccagttcagagcttaggaggcttaggttctagtcctagttctgcccctctctggctctgtgactttagatagtttaatttctctgggcctcagtttyctcatccataaaaagggaatgatgatactcgtgtgtctacttcactcacgggttgatatcagatgacattaactgtgaagtattatcaaatgggtaatgtaaccatggaaatttgtaaccaagaactgtaaaggaactctttcggggaaggtgtttctaaagaaaaaaaaaaaatcttcatttggcccatgttgaacatttcacttctggttaattaactcagtcctcagtcatctcactagcttttaatgctcccaaactgtcctcacccctccctgtgcccatttcctgacaaccagt

SEQ ID NO: 203280 - DNA, 601 bp, Human
cacaaagggtgatgaccaaattgagaaaatggcttaggaatgcagcataaagggattagatgaaacccaaggaaggcagatcactgcaccagcagccggaatggatgattatgctgacagtacagatggtacgtgtctttacttaaatgacattaccagttcagagcttaggaggcttaggttctagtcctagttctgcccctctctggctctgtgactttagatagtttaatttctctgggcctcagttttctcatccataaaaagggaatgatgatactcgtgtgtctacttcactcaygggttgatatcagatgacattaactgtgaagtattatcaaatgggtaatgtaaccatggaaatttgtaaccaagaactgtaaaggaactctttcggggaaggtgtttctaaagaaaaaaaaaaaatcttcatttggcccatgttgaacatttcacttctggttaattaactcagtcctcagtcatctcactagcttttaatgctcccaaactgtcctcacccctccctgtgcccatttcctgacaaccagtgaaaatctctttccttctccccaccctaagacccaaccctccttactcc

SEQ ID NO: 203281 - DNA, 601 bp, Human
atccataaaaagggaatgatgatactcgtgtgtctacttcactcacgggttgatatcagatgacattaactgtgaagtattatcaaatgggtaatgtaaccatggaaatttgtaaccaagaactgtaaaggaactctttcggggaaggtgtttctaaagaaaaaaaaaaaatcttcatttggcccatgttgaacatttcacttctggttaattaactcagtcctcagtcatctcactagcttttaatgctcccaaactgtcctcacccctccctgtgcccatttcctgacaaccagtgaamatctctttccttctccccaccctaagacccaaccctccttactccctcgctggcaggactgcagacatgactcatggcagggtagctgctgaggcacgtcccatctcctttcagttcaggagaggctgtgggaagagggaagaactgagcacacatgaagatttggcagagggaggaggccaagtagggaggaagtggaataattgatattggagccagacatataatcagatgaaacctgggcaaaaccaaacgaggtccagacataaggagaaggagagcaggcgaaaaggcaataga

SEQ ID NO: 203282 - DNA, 601 bp, Human
gagataatcctatgtccgtgggattttcccatggatggtacaactggcacaggacgatgttattcctcccctctggtgaaaccaatatggcagcagaaggcagggagggtggggaggagggtgtagtttgtctgcacaagcatcatcagcatattttcaggagcttctgagagctgatgaaggatcatttgctgcagatactttatattcactcggtcagccaacttgtattgagcaattgctggggcacagcagtgagtgaggtgcgctacagaaacacagttgaaaagaatctgacttygccctcaatgaacctgcagtcaagttagaagcacagaggtcaacagacaaataagataaaggcattagtttctgtactggagcataacaccaatactgccattgctcagaatgtttctagaacccctaaaagttcagaactgtcttcagcatcatttcaggagccagacaagaaaaccagtctcatttctttattgtcatgacctgggtttgaccagaaacaatattactcacttggagcacctcactcctcagatctggctctagttctaaatatcaaaccattctcaaatagcaaagc

SEQ ID NO: 203283 - DNA, 601 bp, Human
gacctgggtttgaccagaaacaatattactcacttggagcacctcactcctcagatctggctctagttctaaatatcaaaccattctcaaatagcaaagctttgtcacctcctatacatatctcatttaaatatgtaaaggatctgtaggcaattccaaaaagaaggctctaaaaatatttaaaaagcaatggtcgtaccttatagttttaccttatagtctatatcaataatagccttgtaattaaaaaacaatcatcatactatttataatctatgattattcacatcacaaattgaawgtagagagactttcttataataaaataaaacttaaaacaaagatagtgtgacacacaaaaagcatctaggggcttaaggaaaataaaagactgctccaaagaaagtcattggcccagtccatgttctgctctctgctggccaccccagcctcctcctccttcaggcagaaggatctgctggaggacaatgttggaacctcagagccccacagacctcagggagaggaagcagctggtgagatggagcaaaagatggggcaggttttagcctcgctgcctggtttctcagctgcatactca

SEQ ID NO: 203284 - DNA, 601 bp, Human
aggctctaaaaatatttaaaaagcaatggtcgtaccttatagttttaccttatagtctatatcaataatagccttgtaattaaaaaacaatcatcatactatttataatctatgattattcacatcacaaattgaatgtagagagactttcttataataaaataaaacttaaaacaaagatagtgtgacacacaaaaagcatctaggggcttaaggaaaataaaagactgctccaaagaaagtcattggcccagtccatgttctgctctctgctggccaccccagcctcctcctccttcargcagaaggatctgctggaggacaatgttggaacctcagagccccacagacctcagggagaggaagcagctggtgagatggagcaaaagatggggcaggttttagcctcgctgcctggtttctcagctgcatactcagctatgctcttctggttctcagcaccaaacctgtagaatattagagcccaacactgtttgcattttacagttgaggaaacgcaggcccagagaagagaaattactccttgaaggccacacagctggttactggtacagcggactagatctctgacctcgtaact

SEQ ID NO: 203285 - DNA, 601 bp, Human
ccagtccatgttctgctctctgctggccaccccagcctcctcctccttcaggcagaaggatctgctggaggacaatgttggaacctcagagccccacagacctcagggagaggaagcagctggtgagatggagcaaaagatggggcaggttttagcctcgctgcctggtttctcagctgcatactcagctatgctcttctggttctcagcaccaaacctgtagaatattagagcccaacactgtttgcattttacagttgaggaaacgcaggcccagagaagagaaattactccttgaagkccacacagctggttactggtacagcggactagatctctgacctcgtaactcctaacctagtggagtttgttttcattaccccagacatttgcacttcttatgactgccattctgtgggtttccacaatctcaatatttgaacgttacaactaaacactaaacactaaagtttagggatctgcaagacactcatgagtctgaatccctccatttcctcccttcccatcccctccaaccaggcctactctcaccatggggagtcagcctagctcaaaagaggcaggagagaagctctgtttt

SEQ ID NO: 203286 - DNA, 601 bp, Human
ttgcacttcttatgactgccattctgtgggtttccacaatctcaatatttgaacgttacaactaaacactaaacactaaagtttagggatctgcaagacactcatgagtctgaatccctccatttcctcccttcccatcccctccaaccaggcctactctcaccatggggagtcagcctagctcaaaagaggcaggagagaagctctgtttttcccttcctagactgaggctgggttcacttgggtataagcattaatgggtttcagggcagggttaccagataaaatacaacaaaatacrataattgagacatgtcttaacttagaaattatttgctgtttatgtaaaattcaaatataactacatgccccgtctatctatttgttaaatctggcaaccctctgtcaccatgtctccccactcattcctgtgataaaaacaacactcctttacgtgctcctctcctaggctagggacccagcagaattactttaggctgcagcatttctggtgagaaaaggaggatttttgtcccatcttagttgtccttgtaatatgtcccttgaatatcttcctctgggtcagcaaagacgaggatgc

SEQ ID NO: 203287 - DNA, 601 bp, Human
ctgaatccctccatttcctcccttcccatcccctccaaccaggcctactctcaccatggggagtcagcctagctcaaaagaggcaggagagaagctctgtttttcccttcctagactgaggctgggttcacttgggtataagcattaatgggtttcagggcagggttaccagataaaatacaacaaaatacaataattgagacatgtcttaacttagaaattatttgctgtttatgtaaaattcaaatataactacatgccccgtctatctatttgttaaatctggcaaccctctgtcacyatgtctccccactcattcctgtgataaaaacaacactcctttacgtgctcctctcctaggctagggacccagcagaattactttaggctgcagcatttctggtgagaaaaggaggatttttgtcccatcttagttgtccttgtaatatgtcccttgaatatcttcctctgggtcagcaaagacgaggatgcggggaatagagagctggagccatggaaaggcacagcccttcaactccaaagctgaaaacaggccttgatcacatgggtttgtcctcaatgaagctgaggcgtgtggaca

SEQ ID NO: 203288 - DNA, 601 bp, Human
tgccacattgaatcactcagttaaatccagcctggcatgcctaagagtgagaactcccagaatataacaagggagaattctgtctttgtcttggcattgtcctattcattgaccccatttctcctctttaacgcaggacttactagcaaatctttcttccagcttcttctcagttgtacttgcctaactgatatgtctgtatttgacgatcccattgtgacagagtcttgtggacaatgtgctaggggcccttaccctaaggagaactgatcttggccaccctagacctgaagaaatgtgratgaagcctctgttacagatgagaggactggggttgcatcacactccagcaggggatgggaaagccaagcacagtgctccccaggttggtggttcaccctcagtcacagccatgctaatcgagtgtccacaagggcagagccatgggccaggtactgcagaggggctgccggggagaaacacggtaggactcctaccctagcagcagcagaaacagactgtccttaccaatccgcagtcaacagaggccatgcccagagacagcccggagtggaggaataagccctggactttggccagg

SEQ ID NO: 203289 - DNA, 601 bp, Human
tgcttcaagcctacagatggataaaagcttcttaatttcctctttgctttcatctgagcactccaggcaccaggaaaacagcagttagttagcccttgcaacaggatgaaaagatggtaggacttcatttactttagcttcacagacagggaaactgatgcacaacaagtagctctgctgagtaactaccctaacttaaaacagacccaactccctctttccaaaccatgtgtctcagctccaaatgccactttctaggtgtatgagctgggttccttcggcagtgcctgccgggcctctygtcttttcttgaaaagtccaggtgagggactgatagtagaccacagcctcctactcccaggcaggcatggatcctgctccaagagggagcaattgatgtgtttgccaactcagtgtccccgctgccaactcatgactcacccccacccagccctgggagataggagagtcctacaagggccccaggctctcaccccaacaagaagaggcaatgatcctacttgccaagggacagaatgtgcctctgagagaaaatggaggcaagtgagcgggagcgggcgggccggctccaggggcaccc

SEQ ID NO: 203290 - DNA, 601 bp, Human
atgagctgggttccttcggcagtgcctgccgggcctctcgtcttttcttgaaaagtccaggtgagggactgatagtagaccacagcctcctactcccaggcaggcatggatcctgctccaagagggagcaattgatgtgtttgccaactcagtgtccccgctgccaactcatgactcacccccacccagccctgggagataggagagtcctacaagggccccaggctctcaccccaacaagaagaggcaatgatcctacttgccaagggacagaatgtgcctctgagagaaaatggaggcragtgagcgggagcgggcgggccggctccaggggcacccctccctgtggaaggagcatgccgtgtgctttcacagacaaactgctgccactgggacactccctgtattaaactgaaggagaagcctatggcaaacactggtgtctgggtactccttgggaggggccctcctttctaagccacagtccatcagagtggctctgcttcccctaagaagcttctgttgcccttagggttgggctgagctcggggagcttcctttctgggcttgctctcccctccatggcaggtgagttgaggct

SEQ ID NO: 203291 - DNA, 601 bp, Human
gcagtgcctgccgggcctctcgtcttttcttgaaaagtccaggtgagggactgatagtagaccacagcctcctactcccaggcaggcatggatcctgctccaagagggagcaattgatgtgtttgccaactcagtgtccccgctgccaactcatgactcacccccacccagccctgggagataggagagtcctacaagggccccaggctctcaccccaacaagaagaggcaatgatcctacttgccaagggacagaatgtgcctctgagagaaaatggaggcaagtgagcgggagcgggcrggccggctccaggggcacccctccctgtggaaggagcatgccgtgtgctttcacagacaaactgctgccactgggacactccctgtattaaactgaaggagaagcctatggcaaacactggtgtctgggtactccttgggaggggccctcctttctaagccacagtccatcagagtggctctgcttcccctaagaagcttctgttgcccttagggttgggctgagctcggggagcttcctttctgggcttgctctcccctccatggcaggtgagttgaggctctgcctcctggctgagga

SEQ ID NO: 203292 - DNA, 601 bp, Human
gacaaactgctgccactgggacactccctgtattaaactgaaggagaagcctatggcaaacactggtgtctgggtactccttgggaggggccctcctttctaagccacagtccatcagagtggctctgcttcccctaagaagcttctgttgcccttagggttgggctgagctcggggagcttcctttctgggcttgctctcccctccatggcaggtgagttgaggctctgcctcctggctgaggactgggtaagccagggaggcccctttagagcccagagagaatgtggagaaaaggaasaaacattggtctgaggcctggttccccgtgactgtgttggggactcctcttctgctgggcctcaggcttatcatcagcaagactagatggtggctcagaccacctccttgtaactctgacgtctggcttctgtgtccctcttttggggagagaagtcagagaatggccccatgtcagcagcatgggcttgcaaagggaggaggacacggttccagtgaacaaatgcaagtggtgtcctccaagggcaagctccaggtgcaggaagtcgggatcggctcctggaggagctgagctttgaac

SEQ ID NO: 203293 - DNA, 601 bp, Human
gggacactccctgtattaaactgaaggagaagcctatggcaaacactggtgtctgggtactccttgggaggggccctcctttctaagccacagtccatcagagtggctctgcttcccctaagaagcttctgttgcccttagggttgggctgagctcggggagcttcctttctgggcttgctctcccctccatggcaggtgagttgaggctctgcctcctggctgaggactgggtaagccagggaggcccctttagagcccagagagaatgtggagaaaaggaagaaacattggtctgaggsctggttccccgtgactgtgttggggactcctcttctgctgggcctcaggcttatcatcagcaagactagatggtggctcagaccacctccttgtaactctgacgtctggcttctgtgtccctcttttggggagagaagtcagagaatggccccatgtcagcagcatgggcttgcaaagggaggaggacacggttccagtgaacaaatgcaagtggtgtcctccaagggcaagctccaggtgcaggaagtcgggatcggctcctggaggagctgagctttgaactgagtgtgcaaggagag

SEQ ID NO: 203294 - DNA, 601 bp, Human
cactccctgtattaaactgaaggagaagcctatggcaaacactggtgtctgggtactccttgggaggggccctcctttctaagccacagtccatcagagtggctctgcttcccctaagaagcttctgttgcccttagggttgggctgagctcggggagcttcctttctgggcttgctctcccctccatggcaggtgagttgaggctctgcctcctggctgaggactgggtaagccagggaggcccctttagagcccagagagaatgtggagaaaaggaagaaacattggtctgaggcctgrttccccgtgactgtgttggggactcctcttctgctgggcctcaggcttatcatcagcaagactagatggtggctcagaccacctccttgtaactctgacgtctggcttctgtgtccctcttttggggagagaagtcagagaatggccccatgtcagcagcatgggcttgcaaagggaggaggacacggttccagtgaacaaatgcaagtggtgtcctccaagggcaagctccaggtgcaggaagtcgggatcggctcctggaggagctgagctttgaactgagtgtgcaaggagagaggg

SEQ ID NO: 203295 - DNA, 601 bp, Human
tccctgtattaaactgaaggagaagcctatggcaaacactggtgtctgggtactccttgggaggggccctcctttctaagccacagtccatcagagtggctctgcttcccctaagaagcttctgttgcccttagggttgggctgagctcggggagcttcctttctgggcttgctctcccctccatggcaggtgagttgaggctctgcctcctggctgaggactgggtaagccagggaggcccctttagagcccagagagaatgtggagaaaaggaagaaacattggtctgaggcctggttycccgtgactgtgttggggactcctcttctgctgggcctcaggcttatcatcagcaagactagatggtggctcagaccacctccttgtaactctgacgtctggcttctgtgtccctcttttggggagagaagtcagagaatggccccatgtcagcagcatgggcttgcaaagggaggaggacacggttccagtgaacaaatgcaagtggtgtcctccaagggcaagctccaggtgcaggaagtcgggatcggctcctggaggagctgagctttgaactgagtgtgcaaggagagagggctg

SEQ ID NO: 203296 - DNA, 601 bp, Human
tggcaggtgagttgaggctctgcctcctggctgaggactgggtaagccagggaggcccctttagagcccagagagaatgtggagaaaaggaagaaacattggtctgaggcctggttccccgtgactgtgttggggactcctcttctgctgggcctcaggcttatcatcagcaagactagatggtggctcagaccacctccttgtaactctgacgtctggcttctgtgtccctcttttggggagagaagtcagagaatggccccatgtcagcagcatgggcttgcaaagggaggaggacacrgttccagtgaacaaatgcaagtggtgtcctccaagggcaagctccaggtgcaggaagtcgggatcggctcctggaggagctgagctttgaactgagtgtgcaaggagagagggctgcccttagcagacaggatggagggcagagcaggaatgcccctaggtctggactgtggtctgagagtaccttgctgactgttcacaaagcataggcatcccctgcaaggagggcaactggttccatgttgccagctcctgaggtctcctaagcctcccaggccttcatcacaaacccacaacaatg

SEQ ID NO: 203297 - DNA, 601 bp, Human
tctgcctcctggctgaggactgggtaagccagggaggcccctttagagcccagagagaatgtggagaaaaggaagaaacattggtctgaggcctggttccccgtgactgtgttggggactcctcttctgctgggcctcaggcttatcatcagcaagactagatggtggctcagaccacctccttgtaactctgacgtctggcttctgtgtccctcttttggggagagaagtcagagaatggccccatgtcagcagcatgggcttgcaaagggaggaggacacggttccagtgaacaaatgmaagtggtgtcctccaagggcaagctccaggtgcaggaagtcgggatcggctcctggaggagctgagctttgaactgagtgtgcaaggagagagggctgcccttagcagacaggatggagggcagagcaggaatgcccctaggtctggactgtggtctgagagtaccttgctgactgttcacaaagcataggcatcccctgcaaggagggcaactggttccatgttgccagctcctgaggtctcctaagcctcccaggccttcatcacaaacccacaacaatgctcctcagggccgagtga

SEQ ID NO: 203298 - DNA, 601 bp, Human
cttctcccctaatatgaaactttagagagaagatttgaagaatcaaggataattataaacttttttattttgccccagcagaaattggtggagtttcattttgggcttttttttttttcttttggccctgacaaaaactaatctactcaaccaaccagtatttaaagtccttacgctatagttgaaaacaaataacagacaaaacaacagcacaagaagatataattaaaagctaaattttgcagcacacgctaacttaaacctctccaggcctcggtttcctcatctgtcattgaaggcrtgggaccagatgacctccaagccttgcttccccagcttcagttctgagtcttggacatctggggagggggtcttgggttctggatgagccgcaggtggtggctttcgagcctgtttcagctgcgctgtgtcctcagtcagctctcaagggagaagtgctccaacccgcggcacctggttatttaataatcccttgaattagtgtagcattttgaacttgtacaaactgcttgtgttttcatctcctgacttgatccttcagtctttgtgagctcagtaggtggaccaagctttgttattc

SEQ ID NO: 203299 - DNA, 601 bp, Human
ccttacgctatagttgaaaacaaataacagacaaaacaacagcacaagaagatataattaaaagctaaattttgcagcacacgctaacttaaacctctccaggcctcggtttcctcatctgtcattgaaggcatgggaccagatgacctccaagccttgcttccccagcttcagttctgagtcttggacatctggggagggggtcttgggttctggatgagccgcaggtggtggctttcgagcctgtttcagctgcgctgtgtcctcagtcagctctcaagggagaagtgctccaacccgmggcacctggttatttaataatcccttgaattagtgtagcattttgaacttgtacaaactgcttgtgttttcatctcctgacttgatccttcagtctttgtgagctcagtaggtggaccaagctttgttattctcattttatttgcagggaaatcaaaccacagaaaagtgtaggggcttgcctgtgacctcacagatagatctggcagaactgagtctggaccccagtggactttgagcggggtgtgaagagcaagaggagggagggacctagaagggcagggggagaagtgggccaagc

SEQ ID NO: 203300 - DNA, 601 bp, Human
ctgtagagacacaggtggggagaaaagcagctctagacccggagcccctcccctcccgcccccacagcgtgcccaagggcgaggcctggaaggggatgaagacaggctgggaaggaggccgcttgtgacttcagcaaggggtgaatcacagactgccgaactgccgaactgccttccttcagaagaagccttacagggcatgctgtggttggggaaactgaggttcagagaggcgaggcgacggcctgaggctgcacagctaggcaggggagaccaagactggagcatggtctcctgactmctggctcagggctcctggtcacactggcacatcatggtacttttgccactacgggcaatcatgtttcccagacattcgtcatttgcattctactgtcacaatttttgcaaaatcataccaactattatttacttatttttaagggaattacttatcagttccactgcacttatttatttattcatgtatttattttagagacagggtctcactatattgcccagggtggtcttgaactcctggattcaagcaatcctcccgcctcagacttccaagtagctgcaactacaggcacgtgcc

SEQ ID NO: 203301 - DNA, 601 bp, Human
gtgtccgtgtgtgtgagcatgcatgcacgcatgcttctcttccaaaggtgagatctcttacccaagcactgaaggtcccagtcaagtgtctctcccttcatgtaaaattcttgactaacaggccaggcacagtggctcacacctgtaatcccagcactctgggaggctgaggcaagaggataacttgaggccagaagtttgagaccagcctgggcaacatagggggaccctgtctcataaaacagttaaaaatcagctgggcatggtggtgtgcacctgtggtcccatctgcttgagaggytgaggtggaaggattgtttcagcccaggaggtcaaggctgcagtgagccatgatggcagcactccactccagcctgggctacagatctgtcttaaacaagcaaacaaacaaaaactgtaaccagcaggagtggtttctttccactgttgggtctccagggacctcttttctgggccaggtaagcacctgcccttcaggatgctgccacctcccagcctttggccctcctcttcccagggctgggaagcacctcctgttccagtgcatggggtggctctggggccagccagcctctccctc

SEQ ID NO: 203302 - DNA, 601 bp, Human
ttcccagtatagggtggggggcatctggcccagtgggatcttcctgaccctcaagggtgctcttctgaggtgctggctcgtcatccaggactccaggagttatttcatatcagaacggccccctcagctttccctcttcatgatgaaccatcactgggacaattgaaccagcctctgggtttgaaagccaggagctatgacctcagaacatggagctcctggagggcagaatgaccatgccttccacttctctggggccatggaagggagatggctgagggccagtggtcctccaccactsgggctgtgagagctgcgtctgaagtggcaaacgcctgccagggatttcccttccaaaaggaaacagacatgtctgtgtatgaaaccttaggttcttgtttccaaacccatcctagcagtgttcagagctgagaaaaacctatttctcaggtgtagagggggaaaggtaaaacagaaacatttcggaaaacctgttttttccacagtgcagtaaataggcaaggagcaggaagtggagacagagctgatgcaggagctggcatagttgcgtgttgatggagcaccaggtgtcggctaggcg

SEQ ID NO: 203303 - DNA, 601 bp, Human
gcaggagctggcatagttgcgtgttgatggagcaccaggtgtcggctaggcgctgggctgcacaagtgcgtgttgtccccacaccaggcttaggaactgccatggacctgacctttgcaggcaggcttagagcctggagcccaagaggctaagatgccttctttatcccagaattgtggcctcactggagaaagaagcatcttcccaaaagacccgcaagctacaaagttttataggatattttctacttagaaaagttgtcctcagttatccatagacatttgttaatactggcatgatkgaagtatgctcacagtttctgcttttcaaagcttataagggatactgaccattattaaccagatctctggggaagtctctactctgaggatgggcaccaaaacttttactttttttttttttgagacggagtctcgctctctcacccaggctggagtgcagtggcgcaatctcagctcactgcaagctccaccttctgggttcatgccattctcctgcctcagcctcccgagtagctgggactataggcgcccaccaccgtgcctggctactttttgtttttttgtatttttagtagaga

SEQ ID NO: 203304 - DNA, 601 bp, Human
ccaggcttaggaactgccatggacctgacctttgcaggcaggcttagagcctggagcccaagaggctaagatgccttctttatcccagaattgtggcctcactggagaaagaagcatcttcccaaaagacccgcaagctacaaagttttataggatattttctacttagaaaagttgtcctcagttatccatagacatttgttaatactggcatgattgaagtatgctcacagtttctgcttttcaaagcttataagggatactgaccattattaaccagatctctggggaagtctctacyctgaggatgggcaccaaaacttttactttttttttttttgagacggagtctcgctctctcacccaggctggagtgcagtggcgcaatctcagctcactgcaagctccaccttctgggttcatgccattctcctgcctcagcctcccgagtagctgggactataggcgcccaccaccgtgcctggctactttttgtttttttgtatttttagtagagatggggtttcatcgtggtctcgatctcctgacctcgtgatccgcccgcctcggcctcccaaagtgctgggattacaggcatgag

SEQ ID NO: 203305 - DNA, 601 bp, Human
aggcttagagcctggagcccaagaggctaagatgccttctttatcccagaattgtggcctcactggagaaagaagcatcttcccaaaagacccgcaagctacaaagttttataggatattttctacttagaaaagttgtcctcagttatccatagacatttgttaatactggcatgattgaagtatgctcacagtttctgcttttcaaagcttataagggatactgaccattattaaccagatctctggggaagtctctactctgaggatgggcaccaaaacttttactttttttttttttgagacggagtctcgctctctcacccaggctggagtgcagtggcgcaatctcagctcactgcaagctccaccttctgggttcatgccattctcctgcctcagcctcccgagtagctgggactataggcgcccaccaccgtgcctggctactttttgtttttttgtatttttagtagagatggggtttcatcgtggtctcgatctcctgacctcgtgatccgcccgcctcggcctcccaaagtgctgggattacaggcatgagccaccgcacctggactacatttttttaacatttaaaaaa

SEQ ID NO: 203306 - DNA, 601 bp, Human
aatgctctggatttctgtctggctgtccagtctagcctgctgtctggcagagtgaccaactctgctctcaggaaattgagtttccagcctctggaatgttctgatccatgggataaccagacaagaggttgtgtgtgtgtcactgtcctttgtattcaaacagccagacgctgccagcagattgctatctgagtgtgggggtgtggctgggagagccggcattggcggtgaagctctcccacctgcagcgggcgcacgtgcactgcccgtgcatcctcttctggctgcagctgctctctckggacctggaagacagtgtttggaaacgtgtggggacattttgcaatgactgtgaggcattactagcatttagaacctggaggctggggcactaaacatcctgccatgcttgggacagcctatacaaagaattgtcctgcctcaggtgccgacagcacccaagtaaagaaacactgcaccattcatcataaagcctggcttcactcgaagtgccccatctgggcagaccatgctcctccacttttctgagacatatttagacccattctatgtctgtggggtgagactagcacggggctct

SEQ ID NO: 203307 - DNA, 601 bp, Human
atctgagtgtgggggtgtggctgggagagccggcattggcggtgaagctctcccacctgcagcgggcgcacgtgcactgcccgtgcatcctcttctggctgcagctgctctctcgggacctggaagacagtgtttggaaacgtgtggggacattttgcaatgactgtgaggcattactagcatttagaacctggaggctggggcactaaacatcctgccatgcttgggacagcctatacaaagaattgtcctgcctcaggtgccgacagcacccaagtaaagaaacactgcaccattcatyataaagcctggcttcactcgaagtgccccatctgggcagaccatgctcctccacttttctgagacatatttagacccattctatgtctgtggggtgagactagcacggggctctgatactggtgcatacactttcctgggctgtcttggcttcctgggttcatcctctctcttatgacacctggtatcccatttaggtatgtcacaggtgacataaaatctctcctttaggagccaagtcctaaggcagccagcctgtgcccaatctaagagtcagagggatatgatgtccctaccgagc

SEQ ID NO: 203308 - DNA, 601 bp, Human
gtgtgggggtgtggctgggagagccggcattggcggtgaagctctcccacctgcagcgggcgcacgtgcactgcccgtgcatcctcttctggctgcagctgctctctcgggacctggaagacagtgtttggaaacgtgtggggacattttgcaatgactgtgaggcattactagcatttagaacctggaggctggggcactaaacatcctgccatgcttgggacagcctatacaaagaattgtcctgcctcaggtgccgacagcacccaagtaaagaaacactgcaccattcatcataaarcctggcttcactcgaagtgccccatctgggcagaccatgctcctccacttttctgagacatatttagacccattctatgtctgtggggtgagactagcacggggctctgatactggtgcatacactttcctgggctgtcttggcttcctgggttcatcctctctcttatgacacctggtatcccatttaggtatgtcacaggtgacataaaatctctcctttaggagccaagtcctaaggcagccagcctgtgcccaatctaagagtcagagggatatgatgtccctaccgagcaaacac

SEQ ID NO: 203309 - DNA, 601 bp, Human
tggctacaattatactagttttacagatggaaaaactgaggcacgttgggcttaagtaattgcccaaggccacccattgggcaacgacaaggccaggcaggctggctccagagtctgtgttcttgaccttgggtcttcctccagtttgtagatctcagcccagtgagctggaggaagcacctggattcccaggcagttgctgccgtttcagccttcaaggctgcaggcttcatccaggtcccaggccaatttgtgcagggagagctggtggcagttcacctccttgtgccttggagggaayccaggccccctcatggtacttggggaggacggggtctgagaggaggctttactcctgcttgtcaaagtgacagcaaagggccatgatgatgggagagagtcatacccagctgtcgtcaggcagcacagcccaccagcaccatgacactaggagctggggtggggttcccaggaatgggtgacgccactagggtgtggctgatggtggtaggctgggaaatgcagtcccacggggatgtctctgccttccccaccttgcccgctcccctgcaggtgcagccaatgcccattccctgtgggc

SEQ ID NO: 203310 - DNA, 601 bp, Human
gagaggagaatggagggtgtggccatttgtaaaggctttcatggcatattttgcctgtaatctgcaggacacgcattccatacccagatgctcagaaaattgcccagctgctctccccatgccttgtgattgtccatctatgcctctcccaacaaccagacaccaattctctttggagtaggttggttgacccagtttggggaagaaaattatgcctgcctgagtgcacagctgggcgtgtgggtgaaggggatgagcaggctattgccaaggttaacagtctgtggcttctgagttttgratgcaacttctgactggtggtttgacacccagtctttctgggagctcaaaccatgggagtttcctgctgtctgtgactccctgcagagatgaaaaaggaccaagtcgagtgccagcccctccccagcttgtgtggctagatctggtgcagaagggaattacccagttgcctaacgacctcccctacacacacatactctctctctctcagggaggggcaggggtgggcgggcaggccctaggttgctgggtttggccctggcccatcccagcaaaggtgagtcccaagtcagcacctgtg

SEQ ID NO: 203311 - DNA, 601 bp, Human
gtaaaggctttcatggcatattttgcctgtaatctgcaggacacgcattccatacccagatgctcagaaaattgcccagctgctctccccatgccttgtgattgtccatctatgcctctcccaacaaccagacaccaattctctttggagtaggttggttgacccagtttggggaagaaaattatgcctgcctgagtgcacagctgggcgtgtgggtgaaggggatgagcaggctattgccaaggttaacagtctgtggcttctgagttttgaatgcaacttctgactggtggtttgacamccagtctttctgggagctcaaaccatgggagtttcctgctgtctgtgactccctgcagagatgaaaaaggaccaagtcgagtgccagcccctccccagcttgtgtggctagatctggtgcagaagggaattacccagttgcctaacgacctcccctacacacacatactctctctctctcagggaggggcaggggtgggcgggcaggccctaggttgctgggtttggccctggcccatcccagcaaaggtgagtcccaagtcagcacctgtgtggagatgtttttttatcatacttgatg

SEQ ID NO: 203312 - DNA, 601 bp, Human
gacacccagtctttctgggagctcaaaccatgggagtttcctgctgtctgtgactccctgcagagatgaaaaaggaccaagtcgagtgccagcccctccccagcttgtgtggctagatctggtgcagaagggaattacccagttgcctaacgacctcccctacacacacatactctctctctctcagggaggggcaggggtgggcgggcaggccctaggttgctgggtttggccctggcccatcccagcaaaggtgagtcccaagtcagcacctgtgtggagatgtttttttatcatactygatgttgatcctctactatgagaacaagttggagcaggccagacccaccagcttgtgagctcctgggaaagtcctcctcagacagttctgttccagaactgattcgcaccaagtctccaacctcacaggcccctcccaaggaggccgactccccacttgggctcacacagagctcatgaggcacctcattgtctgttgtatgtttttgtgccggattgagcctctgcccagcttctccccattgccagcctgacaacaaagcccaggaggccctccctgtaccccaccttgcagccccag

SEQ ID NO: 203313 - DNA, 601 bp, Human
tttctgggagctcaaaccatgggagtttcctgctgtctgtgactccctgcagagatgaaaaaggaccaagtcgagtgccagcccctccccagcttgtgtggctagatctggtgcagaagggaattacccagttgcctaacgacctcccctacacacacatactctctctctctcagggaggggcaggggtgggcgggcaggccctaggttgctgggtttggccctggcccatcccagcaaaggtgagtcccaagtcagcacctgtgtggagatgtttttttatcatacttgatgttgatcytctactatgagaacaagttggagcaggccagacccaccagcttgtgagctcctgggaaagtcctcctcagacagttctgttccagaactgattcgcaccaagtctccaacctcacaggcccctcccaaggaggccgactccccacttgggctcacacagagctcatgaggcacctcattgtctgttgtatgtttttgtgccggattgagcctctgcccagcttctccccattgccagcctgacaacaaagcccaggaggccctccctgtaccccaccttgcagccccaggcctgcctcca

SEQ ID NO: 203314 - DNA, 601 bp, Human
gtcgagtgccagcccctccccagcttgtgtggctagatctggtgcagaagggaattacccagttgcctaacgacctcccctacacacacatactctctctctctcagggaggggcaggggtgggcgggcaggccctaggttgctgggtttggccctggcccatcccagcaaaggtgagtcccaagtcagcacctgtgtggagatgtttttttatcatacttgatgttgatcctctactatgagaacaagttggagcaggccagacccaccagcttgtgagctcctgggaaagtcctcctcrgacagttctgttccagaactgattcgcaccaagtctccaacctcacaggcccctcccaaggaggccgactccccacttgggctcacacagagctcatgaggcacctcattgtctgttgtatgtttttgtgccggattgagcctctgcccagcttctccccattgccagcctgacaacaaagcccaggaggccctccctgtaccccaccttgcagccccaggcctgcctccatgtgtgcacgcaggcccctagctcacagtcccttgtaaaagggcccagggagcaggaatattgtccctc

SEQ ID NO: 203315 - DNA, 601 bp, Human
ccctaggttgctgggtttggccctggcccatcccagcaaaggtgagtcccaagtcagcacctgtgtggagatgtttttttatcatacttgatgttgatcctctactatgagaacaagttggagcaggccagacccaccagcttgtgagctcctgggaaagtcctcctcagacagttctgttccagaactgattcgcaccaagtctccaacctcacaggcccctcccaaggaggccgactccccacttgggctcacacagagctcatgaggcacctcattgtctgttgtatgtttttgtgcmggattgagcctctgcccagcttctccccattgccagcctgacaacaaagcccaggaggccctccctgtaccccaccttgcagccccaggcctgcctccatgtgtgcacgcaggcccctagctcacagtcccttgtaaaagggcccagggagcaggaatattgtccctctttggcctttgaggtgacctgttaccctttgcttcttgccctggaagaggggaggcaagatgaagagtttagcagaaaagaacagtagaaaacagtcctggccagaatagaagtttctgtgtgctgagtata

SEQ ID NO: 203316 - DNA, 601 bp, Human
tttcctcaccgagtgactactagaaggtcactcttctctgggcctccaactccccctcctggactgtaccatgtgggaccagatcagaggttgtcaaacttttttgacagcaattcacagtaataaatgcgaaggattgttctgcctcaggtgccgacagcacccacgtaaagaaacactgcaccattcgtcataaagcctggcttcactcgaagtgccccatctgggcagaccatcctcctccacttttctgagacatatttagacccgttctgtgtctgtggggtgagactagcatggrgctctgatactggtgcatacacctttcctgggctgtcttggcttcctgggttcatcctccctcttatgacacctggtagctcctttaggtatgtcacgtatgttgcaacccagtacccatacactgtttcacaaaacaatgtgtgactttactacctgcactgcactctgatattttatattccaggatatattattctattccatctttttaaaaatgatggccatagtcttctaaattgattttataatccacaatgggtcacagcctgcagttagaaaagtaatatatcagatgatg

SEQ ID NO: 203317 - DNA, 601 bp, Human
atacacctttcctgggctgtcttggcttcctgggttcatcctccctcttatgacacctggtagctcctttaggtatgtcacgtatgttgcaacccagtacccatacactgtttcacaaaacaatgtgtgactttactacctgcactgcactctgatattttatattccaggatatattattctattccatctttttaaaaatgatggccatagtcttctaaattgattttataatccacaatgggtcacagcctgcagttagaaaagtaatatatcagatgatggctcaggttccttccasgccaaacattctgggattctgtaagcgttattatgggggctggggagggctgtatctcatgccctgctggatccaggacccccatttaggaaccttgactgagcttttctccctttccctggccagatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctac

SEQ ID NO: 203318 - DNA, 601 bp, Human; identical to SEQ ID NO: 18435

SEQ ID NO: 203319 - DNA, 601 bp, Human; identical to SEQ ID NO: 18436

SEQ ID NO: 203320 - DNA, 601 bp, Human; identical to SEQ ID NO: 18437

SEQ ID NO: 203321 - DNA, 601 bp, Human; identical to SEQ ID NO: 18438

SEQ ID NO: 203322 - DNA, 601 bp, Human; identical to SEQ ID NO: 18439

SEQ ID NO: 203323 - DNA, 601 bp, Human; identical to SEQ ID NO: 18440

SEQ ID NO: 203324 - DNA, 601 bp, Human; identical to SEQ ID NO: 18441

SEQ ID NO: 203325 - DNA, 601 bp, Human; identical to SEQ ID NO: 18442

SEQ ID NO: 203326 - DNA, 601 bp, Human; identical to SEQ ID NO: 18443

SEQ ID NO: 203327 - DNA, 601 bp, Human; identical to SEQ ID NO: 18444

SEQ ID NO: 203328 - DNA, 601 bp, Human; identical to SEQ ID NO: 18445

SEQ ID NO: 203329 - DNA, 601 bp, Human; identical to SEQ ID NO: 18446

SEQ ID NO: 203330 - DNA, 601 bp, Human; identical to SEQ ID NO: 18447

SEQ ID NO: 203331 - DNA, 601 bp, Human; identical to SEQ ID NO: 18448

SEQ ID NO: 203332 - DNA, 601 bp, Human; identical to SEQ ID NO: 18449

SEQ ID NO: 203333 - DNA, 601 bp, Human; identical to SEQ ID NO: 18450

SEQ ID NO: 203334 - DNA, 601 bp, Human; identical to SEQ ID NO: 18451

SEQ ID NO: 203335 - DNA, 601 bp, Human; identical to SEQ ID NO: 18452

SEQ ID NO: 203336 - DNA, 601 bp, Human; identical to SEQ ID NO: 18453

SEQ ID NO: 203337 - DNA, 601 bp, Human; identical to SEQ ID NO: 18454

SEQ ID NO: 203338 - DNA, 601 bp, Human; identical to SEQ ID NO: 18455

SEQ ID NO: 203339 - DNA, 601 bp, Human; identical to SEQ ID NO: 18456

SEQ ID NO: 203340 - DNA, 601 bp, Human; identical to SEQ ID NO: 18457

SEQ ID NO: 203341 - DNA, 601 bp, Human; identical to SEQ ID NO: 18458

SEQ ID NO: 203342 - DNA, 601 bp, Human; identical to SEQ ID NO: 18459

SEQ ID NO: 203343 - DNA, 601 bp, Human; identical to SEQ ID NO: 18460

SEQ ID NO: 203344 - DNA, 601 bp, Human; identical to SEQ ID NO: 18461

SEQ ID NO: 203345 - DNA, 601 bp, Human; identical to SEQ ID NO: 18462

SEQ ID NO: 203346 - DNA, 601 bp, Human; identical to SEQ ID NO: 27504

SEQ ID NO: 203347 - DNA, 601 bp, Human; identical to SEQ ID NO: 27505

SEQ ID NO: 203348 - DNA, 601 bp, Human
gctgagccctcaaggtgggcagggatcaagcaggtgcctgagggcaggtggagcagaggagtctgcagtccagaactgcaaaggcagggaggcgtgggggtggtgggagaggcaccctcccggcatgtcctaggcagggtgagcctgagaggggggcaggcccgcccaccctcagcctccaggcagcattttgtcttttatccccaggggaatcaggagccattgaagaagttgatttgctttataaaactttcattacattttcctgttatacaggtaatatatatgctagtatttttaraaaattagtgaggccagaaacaaatttgtaaaaagccatctccatctcacagcctagatggggccttttggccattagcgtttgaccgctgctttcagacttttcagtgtgaggtgtctgggctgcaatgaaacccacactggcactggaaaaccccaccctgtctgcagagcagggaagggagcttgggtgagaggccacaggggccggtgcagagcaggggagggagcctgggtgagaggtcacaggggctgacaccaagcttcaggggtgggctcagaaaacagacagggtcaagag

SEQ ID NO: 203349 - DNA, 601 bp, Human
aaaagactcctggagagctggacccttctcttggccactttttctccagtcttggcttagacatgattccccgccaggtgctgtggctcacgcctgtaatcccagcactttgggaggccgaggcggccggatcacgaggtcaggagatcgagaccatcctggctaacacggtgaaaccccgtctctactgaaaatacaaaaaaattagccgggcgtggtggtgggcacctgtagtcccagctactcaggaggctgaggcaggagaatggcgtgaacccgggaggcggagcttgcagtgagyggagaccgcgccactgcactccagcctgggcgacagagcgagactctgtctcaaaaaaaaaaagacatgattccctccagcagaggagccgctgatgtcccgtgtatgccaggcatcttcctggggtgagaaacagcccagcctgcaggctgacccccaccctgctgtgccacgaggacaggggcatgtccacaaagccgaccctgcacctgcacaggacctgggacccgtggggccacccacccgtgcctcccttcatcccggcgcactgcctgtcccggcccccagtcccgaagccct

SEQ ID NO: 203350 - DNA, 601 bp, Human; identical to SEQ ID NO: 203348

SEQ ID NO: 203351 - DNA, 601 bp, Human; identical to SEQ ID NO: 203349

SEQ ID NO: 203352 - DNA, 601 bp, Human
agccctcgagtgaggcaagggacttacagggttaaggggaagagggcgctgagggtcagtctggactgtgactctgatgccaggctgctggacaggctcatggacgctcgcccacgctgctccttccctgagcccctgcagggtacagtgaggaccaggttcctgccttgacctctggctccctctcctcaggaacaagtcactttcatgtagactccttggaatggcaaaggtctggtccctggctgagggctcctcagctttaaggcctagggggtcttcacaccgctccactctcagygcctgtccatgcccttgcctgctcccaaggagccatgactttggcagattctggccaatccacagaggcttacccagataaatggcatgggagggtaagggttgatgcagggtaaggttgagaactcactgagtaggactgggaaggagagatggagagatgaatgctgaatttccagagccatgtgcacatgctggtgtgcacgtgctcacacccatcacacctcacccctcccagacacacccaccccgccacagccatttccagagggtaccccaggcccatggctttctcgacttt

SEQ ID NO: 203353 - DNA, 601 bp, Human
accaggccgaggttcagagagttgttgtcatcttccggcatgggcaggtacacggccagggccacacaattggcaaagatggtgagcaagatgatcgtctcgaagggcctggagccagggttaaggagagccctcgagtgaggcaagggacttacagggttaaggggaagagggcgctgagggtcagtctggactgtgactctgatgccaggctgctggacaggctcatggacgctcgcccacgctgctccttccctgagcccctgcagggtacagtgaggaccaggttcctgccttgacmtctggctccctctcctcaggaacaagtcactttcatgtagactccttggaatggcaaaggtctggtccctggctgagggctcctcagctttaaggcctagggggtcttcacaccgctccactctcagcgcctgtccatgcccttgcctgctcccaaggagccatgactttggcagattctggccaatccacagaggcttacccagataaatggcatgggagggtaagggttgatgcagggtaaggttgagaactcactgagtaggactgggaaggagagatggagagatgaatgctgaat

SEQ ID NO: 203354 - DNA, 601 bp, Human
ctggggatgcagggcctgcatcgtcagggagttgaaccaccggcaccatcccccagaacagagtccaccaagggggcctccccaagcctggggctgcaggctcgcaggaagggagatggaagggccaatcttaccaggccgaggttcagagagttgttgtcatcttccggcatgggcaggtacacggccagggccacacaattggcaaagatggtgagcaagatgatcgtctcgaagggcctggagccagggttaaggagagccctcgagtgaggcaagggacttacagggttaaggggawgagggcgctgagggtcagtctggactgtgactctgatgccaggctgctggacaggctcatggacgctcgcccacgctgctccttccctgagcccctgcagggtacagtgaggaccaggttcctgccttgacctctggctccctctcctcaggaacaagtcactttcatgtagactccttggaatggcaaaggtctggtccctggctgagggctcctcagctttaaggcctagggggtcttcacaccgctccactctcagcgcctgtccatgcccttgcctgctcccaaggagccatgact

SEQ ID NO: 203355 - DNA, 601 bp, Human
tggctcactagctgaccttactaagcctcagtttccacatctgtcaaatggaaccactttatgagttggttgtgaggattaaatgaatttactctcatcaggtattagcacagtgcctgggaccaatgagtgcgtgcttagtgctggctgacagtatcagaatctggaataagcaggttgaccctggaaacccattgagccactcagccagccctgcaggtggctggggatgcagggcctgcatcgtcagggagttgaaccaccggcaccatcccccagaacagagtccaccaagggggcytccccaagcctggggctgcaggctcgcaggaagggagatggaagggccaatcttaccaggccgaggttcagagagttgttgtcatcttccggcatgggcaggtacacggccagggccacacaattggcaaagatggtgagcaagatgatcgtctcgaagggcctggagccagggttaaggagagccctcgagtgaggcaagggacttacagggttaaggggaagagggcgctgagggtcagtctggactgtgactctgatgccaggctgctggacaggctcatggacgctcgcccacgct

SEQ ID NO: 203356 - DNA, 601 bp, Human
cgaaggtggctgagcgaccttgggtatcaccgactttctctgggcttcacaattaaggggtcaggttaggagtcctcactgagcattcatttcccatagagctctgacatgccaggtggcatttgctgctttggaaacatttctgattaggtttccgacttgcagggaactcataatactgtctctatgaactctaggcctaacccaaggttttgcaactccagcccacaaactaaagaaaaacatacacaggaccacgtgaaacagttaagggagccaattttgtttcaggatggaagaygacataaccattaagatgtaattttttttttttttttttgagacagggtctcactgtgtcactcgggctggagtgcagtggcatgatcttggctcactgcagcctcgacctcccaggctcaagcaatcctcccacttcagcctcccgagtagatggaacaagaggcatgcaccaccaggccccgctaattcaatttttgtagagacgggagtctctctatgttgcccaggctggtcttgaactattggatgcaagatttcttcacgtctcagcctctcaaagtgctgggattacaggcat

SEQ ID NO: 203357 - DNA, 601 bp, Human
aaatgtgtctatttggttcacagtgatatccccagtatgtgccagggatgtgatagacactaaagatgcattcgttaaatgaatgagaaaggtcatgaataattaaaccttaggcctcctttcttgaaagctacgggttattctggatgactggaaagaccccaacccttctctgctacctacaaagcagccaatagggcaagagagagagtgcctactgcccttttctactctgactcctctcatctccctcttgctgggttttgtggacatgaacagtgaggacccctgagctcgaagstggctgagcgaccttgggtatcaccgactttctctgggcttcacaattaaggggtcaggttaggagtcctcactgagcattcatttcccatagagctctgacatgccaggtggcatttgctgctttggaaacatttctgattaggtttccgacttgcagggaactcataatactgtctctatgaactctaggcctaacccaaggttttgcaactccagcccacaaactaaagaaaaacatacacaggaccacgtgaaacagttaagggagccaattttgtttcaggatggaagatgacat

SEQ ID NO: 203358 - DNA, 601 bp, Human
ccagaatcggggagggccttggaggctcaacctcataggtcatttactgaatggactgcagcaatgtcagcccagggtagagacaaccagagccatgtccttccctgagacacggcccttcccattctcccactcaggcctctgccaagtggcccaggaccccagagggcaaaacatcaagctgagagcccctccttagaggcagggagatggcagaagtcaggaccttttgtgagccaaggttccaagcttgaggtgcatgtgccattgtcccaatggacttcacttacaaatcataaawtcaaagataaaattaattaaaatctcaatactttgaccacagagcattcaaccccaaatgtggggcccttctgagtgggagtcctctgggactgcataggtggcacttgtgtgagctgtccctgtcctcaacctttaggtctcaggttaaacatcccatacttggggaagccttcctgatctcaagactagcttaggttctctgtcaatatgctaccataatatccccaaatcttgaacctttcccatttcattttaactacctgtttaattggttttattatatttacttgtttaatcc

SEQ ID NO: 203359 - DNA, 601 bp, Human
tgggaaacagtaagtacccagaatcggggagggccttggaggctcaacctcataggtcatttactgaatggactgcagcaatgtcagcccagggtagagacaaccagagccatgtccttccctgagacacggcccttcccattctcccactcaggcctctgccaagtggcccaggaccccagagggcaaaacatcaagctgagagcccctccttagaggcagggagatggcagaagtcaggaccttttgtgagccaaggttccaagcttgaggtgcatgtgccattgtcccaatggacttsacttacaaatcataaattcaaagataaaattaattaaaatctcaatactttgaccacagagcattcaaccccaaatgtggggcccttctgagtgggagtcctctgggactgcataggtggcacttgtgtgagctgtccctgtcctcaacctttaggtctcaggttaaacatcccatacttggggaagccttcctgatctcaagactagcttaggttctctgtcaatatgctaccataatatccccaaatcttgaacctttcccatttcattttaactacctgtttaattggttttattat

SEQ ID NO: 203360 - DNA, 601 bp, Human
ggccagaggtggaggtgtggagccaggcatctccccttcactcagacccaccacctcaacccatagtggacatccggcacccaagggtgttgcaatctctgcttcctgggaaacagtaagtacccagaatcggggagggccttggaggctcaacctcataggtcatttactgaatggactgcagcaatgtcagcccagggtagagacaaccagagccatgtccttccctgagacacggcccttcccattctcccactcaggcctctgccaagtggcccaggaccccagagggcaaaacatyaagctgagagcccctccttagaggcagggagatggcagaagtcaggaccttttgtgagccaaggttccaagcttgaggtgcatgtgccattgtcccaatggacttcacttacaaatcataaattcaaagataaaattaattaaaatctcaatactttgaccacagagcattcaaccccaaatgtggggcccttctgagtgggagtcctctgggactgcataggtggcacttgtgtgagctgtccctgtcctcaacctttaggtctcaggttaaacatcccatacttggggaagccttcct

SEQ ID NO: 203361 - DNA, 601 bp, Human
ggaaactgagggaacagaaaggttacataacttgtctaagatcacacagctagtaggtgagtgggcctgggctcaaaagcagattctagctccagaacccatttttataaccaccatgccataatgggctgatttcagaggcccgtgccactgtgacatcccacagttggccaggatgtcagcatcctggatcctcctcttgccaccctctgatcagctgcatattcattcccaggactccttgctctctctgggcctcagtttcctcttctattcagggaagatcctgggatttcccacwgacacagagcaggcagagtcagaggtgtacctctagccccaggaaacccgggccccaagtctattaccctcagccagtgctggcagaagggatatggagggacactgccaagggagcctattcccacagacagcagtcacacccccggccctgctcgcacacacggcaactgagggaagcccttcttgcccacaaccatccccgcccctgccccacccagccagtttggcatgtgccaaagtgaggaaacctctgtcataaaatgcttggacctgcaaatccaattacccatcagtggac

SEQ ID NO: 203362 - DNA, 601 bp, Human
agggtgaagaggaattctttacctgaaataatcctttggcataactgttgggggttagaccctttgaatctagaacaacctgggggtctctgtgactataggctttttggctggtgagcctgctctgtggggcctgcatgatcaaagttccttctgttgatagataaagcactacaacttagaaggtcttcactcatccagttacctctctcaagtatacaatatcatccccattttataaaggaggaaactgagggaacagaaaggttacataacttgtctaagatcacacagctagtasgtgagtgggcctgggctcaaaagcagattctagctccagaacccatttttataaccaccatgccataatgggctgatttcagaggcccgtgccactgtgacatcccacagttggccaggatgtcagcatcctggatcctcctcttgccaccctctgatcagctgcatattcattcccaggactccttgctctctctgggcctcagtttcctcttctattcagggaagatcctgggatttcccacagacacagagcaggcagagtcagaggtgtacctctagccccaggaaacccgggccc

SEQ ID NO: 203363 - DNA, 601 bp, Human
actagatgctagtaggacacatctccgcccctgcccctccccctcacaattccagttgttgccaaatgtcctctggggcagaactacttcccctccccaatcccttgaaaaccactgacctaggagggaatgtaactttgtttagctctcactattctgtcctctagagatgcaaatgaattctgcctgataggaagataaccccaatggttagagttttattgccctgtaggacattaaccagcttggtatctaacctagcaatcctattccatcattctctctccggtgtcataacttytgctgctctaattccctttaactcagcttcacacgcctgcttgttctcttttgagttgaactaatctttgatatgtgttccttggatattttactcacagttgtgttttcactttttgaacatcatactttgacataggattgctttgagggtgaaatgagataatgtagcaaaagcaatcagtttatcatgtctgcccaacaattaggaagtctgataattgtttttgcttttccacattggtcccctcagcctggcctaggctggaatggtaaccctgcccaataaaggatgtaggcc

SEQ ID NO: 203364 - DNA, 601 bp, Human
gcagcccctgtgcctggtgtgaaggggcatgggttgggatgggcgggggagaatctaagtgccctgaaaggggacctgagttcttgcagtggtgggagggcaggctcccaggtgggtctaaaatccaggctttcattcatttccacagacccttttggagcaccatcacttctctgtacagtggcccaggctcaaaccaccctgtgctctgcaggtcctggatctctaaggggtgaggccagagctgcggtccttctgaggccccagcctccccagatggcgaggggaatgggctgctggycacaagagttggcgagcgcattccagaccctataaaaagacaaacgccctggctgccagaggcttaggctccagcctcgtggaggacgctgcagcaacttgaaccccaggaatgcgacaggggcctggtggagcctgctgatgcctgaggggtgggaagccaccctgcagcccaggaggggccaaatgggcagccatcttgcagagcttgccaggccctgccctgccctgccctgccctcgaggagagcaggcaccatctacttaagaaaaatctaaattatccagaacttggaaataaa

SEQ ID NO: 203365 - DNA, 601 bp, Human
ggaggtcagagaaggaagggaatgaacatttattgagcaactcttgtgtgccaggtcagacacgaggttgttgcactcatggatataacagtcctgaaaagaaagatattgtggaccagcctgaccaacatggtgaaaccctgtctctactaaaaacaaaaaaaaattagccaggtgtggtgacgtgtgcctgtagttccagctatgcgggaggctgagacaggagaattgcttgaacctgggaagtggaggttgtagtgaggtgaagtcgtgccactgcactccagtctgggtgacagatgagacttggtctcaaaaaaaaaaaaaaaagaaagaaagatattgtggtcctctgttcacagatgaggtaatggaggttcagagagtttaggaagctgccaaccagtctagattggaggcaggttggtttgacttgagaggccgtcctttcctgcgactccccagggagctagcaaagcttgggcaaaggctttcctccaaggctttcctccaaggcttctgttgttcagctattacagtgtctgcagcccctgtgcctggtgtgaaggggcatgggttgggatgggcgggggagaatcta

SEQ ID NO: 203366 - DNA, 601 bp, Human
agtgctgggaggtcagagaaggaagggaatgaacatttattgagcaactcttgtgtgccaggtcagacacgaggttgttgcactcatggatataacagtcctgaaaagaaagatattgtggaccagcctgaccaacatggtgaaaccctgtctctactaaaaacaaaaaaaaattagccaggtgtggtgacgtgtgcctgtagttccagctatgcgggaggctgagacaggagaattgcttgaacctgggaagtggaggttgtagtgaggtgaagtcgtgccactgcactccagtctgggygacagaggagacttggtctcaaaaaaaaaaaaaaaagaaagaaagatattgtggtcctctgttcacagatgaggtaatggaggttcagagagtttaggaagctgccaaccagtctagattggaggcaggttggtttgacttgagaggccgtcctttcctgcgactccccagggagctagcaaagcttgggcaaaggctttcctccaaggctttcctccaaggcttctgttgttcagctattacagtgtctgcagcccctgtgcctggtgtgaaggggcatgggttgggatgggcggggga

SEQ ID NO: 203367 - DNA, 601 bp, Human
cactgaggtttctgtggtgctggatacagcacagggtggcgtgacctgaagacaagaaagggggaggagggggtcctcctggagtccagtgcctggtgaagtgtggggcaggctccagactgggcagggaaaggcctcggatcccagtgtcacagcagaggccagacactcttccttggttcaaggtgaataggtcacaggaactgagacgggcttcccacatacaaccactgggagggcaaaggtagggaagggtacaggccggaaacaacgaggtgcccaaggtaagaggcaggccctygtcagcctcggatactgtctcctactcccaacccttgggcccaatagaggaaccagttgaaaaggaaggcccgacatatttccatcagcaagcaacaggaccaccaactcctccgtgttgcccagctcccactgagagtggacatacagtcatacccatacccaacacgcatcccagtctgtgcggagcagtccatcatcatcctccctagcttcggacgacagccgactaaggtaggtactcttatcccgttttacagatgaggaagccaaagcacagagggattaatttctccaggat

SEQ ID NO: 203368 - DNA, 601 bp, Human
ccagataactctactcaggcttttgacaaaaaacaaccctcaccctccataactagtcatcttccttgcccctccttctcacttccagggccttctgagatgtatctttcataaaatcaataatcagggaagaggaaaaaagagctaggatggaacaaaagtaaaacgtttagcaactttgacacaggggctcggcacctctacctgagctgcaggggtcccggctggggcagggccgggtggccctcctctactggcaatgcatctgctcccagatgcaggagagggtgagagagactcrcacctttcagggccgaggcacacacaccttctggtgtctgatgcccaaagtttgtgctggcatggaccaaccttgggagcatgcaggatgaacagggggatctgggcaggctgctgccttgtgtctcaggtcttggagccccatgggaggatggtgggtgtgaggtggccagccccgatggcccttgccatgacagctacattggtcctcaattcaagtgtcttcagaaagtgaagatgtaagctactctttgcaacattaactcctaacaagtccaaaaaaaaaaaagtacaagaagaa

SEQ ID NO: 203369 - DNA, 601 bp, Human
aatgaggataataatagctaagctttagtaagcacccgcttatgagcccggccctattctggccacatgcatacatttaatcctcactgaaactttataaggtaagtacttttttttttttgccttttcaagtttttatttgtatacatttttgtattaaaaagaaaaataatcatcacagattacaaagggctaacgcagtaatagaagaatgaatgaatctctttagcctagaaagcggatactctcaatagtattaatgtcataatacaagctcatccaagcgttttacatttctttwttttaatgtccttttaaatgtgatgtcctagcatgtagtaaagatcatgtactatgagtgtaagatggaaatttctccacaaagccagataagttttcctctctagtgagaaatgggctataataagttcttaaaaattcttatcttctctgccatgaatgaacatggctgaaggtggagaggctgcgggctggggaaaatccagggacctttccacacaggaggttctctggggttccatcccggagggtgtcacataacccagataactctactcaggcttttgacaaaaaacaaccc

SEQ ID NO: 203370 - DNA, 601 bp, Human
gacagagggacaatggggctgagggtcccagtagggctctgcatgctcagggtgaagggggctgggagagaaagggagaccagtgctgtcttgggtaatgaggataataatagctaagctttagtaagcacccgcttatgagcccggccctattctggccacatgcatacatttaatcctcactgaaactttataaggtaagtacttttttttttttgccttttcaagtttttatttgtatacatttttgtattaaaaagaaaaataatcatcacagattacaaagggctaacgcagtaayagaagaatgaatgaatctctttagcctagaaagcggatactctcaatagtattaatgtcataatacaagctcatccaagcgttttacatttctttattttaatgtccttttaaatgtgatgtcctagcatgtagtaaagatcatgtactatgagtgtaagatggaaatttctccacaaagccagataagttttcctctctagtgagaaatgggctataataagttcttaaaaattcttatcttctctgccatgaatgaacatggctgaaggtggagaggctgcgggctggggaaaatcca

SEQ ID NO: 203371 - DNA, 601 bp, Human
ctttcctcccggattccctcactttcttgttcccttaagctgacagctggactgggcccccttgcctcaggatgggtttgtggcagggccccaggcttttgtttttcaaagcctgagaatcactgcagctttgggaagtctcaggggtagagctcacagtttgaaggtgtggcaggatctgggaggaggccctgggacccccaagaaagcaggacccagcctcgattcctgccttaagaagggtgcagaggacctataaccctgtcacctgcacactgcctgagacccagggcctgggcamattccccaggcaggcgggataactgaaagcaccagaatagctgcagtgatccctctccatcccagagggatatgtgctcaggatccatggaaagttggttcacaggaaaaaataagtcatttcttgcacacctcagttgtggacggaggtttgctccggctgtgctgtttttcctgtttcacagaggttggaagtgagacttagaggggaatgaggtgtctgctaaaggcaaggaggcgttgcctgctgtgactgaagcaacagcgtttctggtaggccggcctgatgtgctggcctcta

SEQ ID NO: 203372 - DNA, 601 bp, Human
actgggctggcctgggaaggggctggcagaggcagcaaagtggctgcagttgaagggctccctgggaatgtgcactgccaccacatgactgcctgtcacctgggcctgaaaatctccttctttaggttcaaggcatggtgacctgctcaggcataaatctcactgggacagggaggcaatggactcatattcgttgttaactctttaaggcacgtgtgctgcatggaggcaaggtggatttggctgaggaggaggaagcccagggtgcttgcagggagctcaggctggggtggaggacagrcatcctcaaatgtcccctccctcttaggaaccttacaggaagctctccacacaggcttggcaggtgctactattagaagacagttttacaatattcctgattgctttcctcccggattccctcactttcttgttcccttaagctgacagctggactgggcccccttgcctcaggatgggtttgtggcagggccccaggcttttgtttttcaaagcctgagaatcactgcagctttgggaagtctcaggggtagagctcacagtttgaaggtgtggcaggatctgggaggaggccctggga

SEQ ID NO: 203373 - DNA, 601 bp, Human
acagtggcctggtcaggactccaggctcccaggctccccatgtgccccgctggagggttctgggatctacagagctcactgaaaggaccttactgggctggcctgggaaggggctggcagaggcagcaaagtggctgcagttgaagggctccctgggaatgtgcactgccaccacatgactgcctgtcacctgggcctgaaaatctccttctttaggttcaaggcatggtgacctgctcaggcataaatctcactgggacagggaggcaatggactcatattcgttgttaactctttaagrcacgtgtgctgcatggaggcaaggtggatttggctgaggaggaggaagcccagggtgcttgcagggagctcaggctggggtggaggacaggcatcctcaaatgtcccctccctcttaggaaccttacaggaagctctccacacaggcttggcaggtgctactattagaagacagttttacaatattcctgattgctttcctcccggattccctcactttcttgttcccttaagctgacagctggactgggcccccttgcctcaggatgggtttgtggcagggccccaggcttttgttttt

SEQ ID NO: 203374 - DNA, 601 bp, Human
atctctgagctcagaggaggacagtgagcccgtccaacttcgtgaggtgagagctcccttacctcagcccccaacaagggcctttattattaaatgtccccttcaaggaaattctcatccttccatagacaagcctctaactggtgctccctggggccaaacttagctggaggttggcgtggtgtgtgacccctgatgcacaggccttgcacctgctcccaggggcattggagccaggtacttccagagtcttgggttgaaaaaagcagggctgggaccgcacatcccctcaccctcccaytgcctctattttcaggctgagtctgctatttccaagggtcagccagtcctgaatacttctcctcccctggcccgcatggggctttgtgggaagatgatgagagctggttgggctttcctccaaagggatctgcccagctctagtctccctatctgggaccacagaggcagcagataccacaccttcttcccctgcaatcctacccctagcacagtggcctggtcaggactccaggctcccaggctccccatgtgccccgctggagggttctgggatctacagagctcactgaaaggacct

SEQ ID NO: 203375 - DNA, 601 bp, Human
acttccatgcatgtgggtggactatagaccattctgggtttgtcaaagtcacatggcaaatcccagctggcacacacacacgaagagaacagtgtcatcaatgcagtacacccatgcagtaggaccatgtatcaggccatgatggagtagaaattaaaaacgacgaactgtggtctttccctacagatcatctgagaagctctgctatagaatgcgtcatcctgcccagcacacaggaggctctcaggctatgtttgttgaataaatgaacaatggaaagtcacaatttctgctcaccttygaaccaggtgcagccttgggatctgcattcctaagaagagacactggacctcaggctctgaccccagagcaggagggcagtggctgtccctgaccccctgatctctgagctcagaggaggacagtgagcccgtccaacttcgtgaggtgagagctcccttacctcagcccccaacaagggcctttattattaaatgtccccttcaaggaaattctcatccttccatagacaagcctctaactggtgctccctggggccaaacttagctggaggttggcgtggtgtgtgacccctgatgca

SEQ ID NO: 203376 - DNA, 601 bp, Human
ctcctcttcgactgcccctgccattgattgctctcccctgcctgcagtggtccaccgccacccacgtctcctcccccgagcccttctccatacagacccggctactgccttgcttgcaagtctgcaatggctccacaacacctaccagaaaaatccaaatgcgtttccgtggcatgcaagatcctccataacatgacccttgctgacccctctggcctcgtcaccagcctgctggccaccccgtcaatcatgtggaatgactttcaggtcccctagctctctagctgccccagcctccacctttgctcatcccggcccctctgcccagagtgtccctgaggcccactgtccaagtagacctcttgcctcttacaaccctctgaccccccacagggagcaccagctctgtgtcctcactgtcccctataaccctgtgcttctctttgctgcctcctgacagaccgcagcttccttgaggccacgtcatcctcacatgtgtttctaactgtggggattctccatggcttctctgccccaagaacaggtgacattcccccatcagtaatagcatttgggcttgggggccagggtcactctccaa

SEQ ID NO: 203377 - DNA, 601 bp, Human
ccgtagcctgatcctctgggttaccctatccttggccccatcacctttccccctcttctgggcccaggtgagagctatttctaactgaggaagcaagtctctcttgtcaggactccaggctgaaactgctctccttgcagccatctgaaccctggcttggcagcttctaagagctctggcctccaggccttcccagattagcacagcctcccgagggggtgctgacccagcctgcagtctaggccagcctgcagcacggcacagctccaggaggtgtgtgtgtgtgtgtgtgtgtgtgtggatacatatatatacatatatatatatacacacatacatatgtacgtgtgtatatatatacacacacatacagatctatcctgattggtgctctctggagttacacaagggggtctgtacccccacaacccagcccccatcaccattagtctgcaacactcacacccatggaagcatctcctgggaccaggggcccaccccatcagcacactgcggaggcgtcattcatattcacagttccttaactgcggagccagactggggaactgggcactccattaatgatatggaagataattta

SEQ ID NO: 203378 - DNA, 601 bp, Human
ccgagactgctttggcttgaatcccagcactgccaccagctagctgtgtgaccttgggcaagttgcttgacttttctgttctttagcctccttatttataaaatgagggaaaacaggattgtggcaagaattaaatgagagggtacatgtaagcacatattaagtgcttgataaatgctattgttatcattacgtggtagttactcatggtaatgctatgggtagagatatgttccttctaaattcatatgctgaagccctaacccctagcacctcagaatgtggttgtatttggagacarggtctttaaagaggtggttaagatgaaacgaagttgttagggtgggccctcatccaatttgactggtgtccttataagaagaggaactctggacacacaaagagacaccaaggatgcacaggcacagaggagagactgtgtgaacccaaacctgccagcatcttgaccttgaatttccagactccagaactgtgagaaatagattcctgttgtttcagcttcccaatctgtggaatgttattatggcagccctagcaaactaatacaggttaataaatgtccgtttttgtgaacccaaat

SEQ ID NO: 203379 - DNA, 601 bp, Human
tgtgccacagggacagtccctggccctggggctgagtacccccaacacgggctggaggttacctgtacatagtcagtggtgacccagagaagaaactccacagcaagttctccctctgtgcttttcctcctggctgcactttttgataatgccctttattttctttcctactggcctcctcttcctctcttaatttactcaaatttccattatcctttgaagtctacctcaaattcctttgcctccaaatacttctaacggcagaactccctgggacacattgcgtatgaaacaacaatgsgctgtgaggtactgctttctgcactctattattctgtacgcatttgtcttggcttccaaccagggcagtttgtaaaaggcagaggcagattcacagaattcttctattttctctactgagccaaaagtagcactggatggttagcaggtaaccaacaccatccttacggaactgaaggacagcatactggttgagcatgcagcctctggagccgagactgctttggcttgaatcccagcactgccaccagctagctgtgtgaccttgggcaagttgcttgacttttctgttctttagcct

SEQ ID NO: 203380 - DNA, 601 bp, Human
ttgtgaggtctactttgggtgctgaacgggggtgaggtatgtgtgccacagggacagtccctggccctggggctgagtacccccaacacgggctggaggttacctgtacatagtcagtggtgacccagagaagaaactccacagcaagttctccctctgtgcttttcctcctggctgcactttttgataatgccctttattttctttcctactggcctcctcttcctctcttaatttactcaaatttccattatcctttgaagtctacctcaaattcctttgcctccaaatacttctaacrgcagaactccctgggacacattgcgtatgaaacaacaatgggctgtgaggtactgctttctgcactctattattctgtacgcatttgtcttggcttccaaccagggcagtttgtaaaaggcagaggcagattcacagaattcttctattttctctactgagccaaaagtagcactggatggttagcaggtaaccaacaccatccttacggaactgaaggacagcatactggttgagcatgcagcctctggagccgagactgctttggcttgaatcccagcactgccaccagctagctgtg

SEQ ID NO: 203381 - DNA, 601 bp, Human
cagtctccttttgtgttcagagattagattggctcatcagaactggaacaccctgccttacccatatttatctatttaccatgtaggctcaatgctctgaagatggaaaggagaggacattgatgggtctgtaggggccctgaccccatgaagtcagaagccccgatccgagaggggcttttgagcactgctgctcagcattcctcaagatctcatgagaacaccagtgagacctccaaatttgggttgaaggtgtgatcaaaggtcacctcctatccatcctgataatgcttatgatagsatgtagattgtggtggtgatgggaggaggctgaaatgggaggggtctaggaatataatccctgaaagctggaccagagtttactcttgtgagttgggtttaggactggtgttgactgtccctttgttgtcagcggtcatgaggaggtgagtagagtcttctgagacactgaaggcctagaacagttattctggtgagttcaatgccagggcttatggaggaggctaagtcccagtgagctgctggcagggtagagcagccagtctcagagtgggacccgagattctttcagagtgtcggc

SEQ ID NO: 203382 - DNA, 601 bp, Human
aaggacgtcagtccatccctccatggtaatgcactggtacacggtgagcatggagaagccgaagttgtcgaagtgggtgatgccatggttgggccctggccagccgccccggcactcactgccattgatggtgcaccggcgccctgagcccgtcctggcgcagggcgatggctcttcattctccaccgtggccacgatatctggaggcagaaggcaaagggaacatcagacaacagtagtaggtggacaacgacaggaggaaaggtgtataagagcaatttaagagaattgagcagtaagyctaaagacactctgctgaaaatgcaaaagacagcttcacatggagcagacggtgacagtgaagaggaatgccttgggctgaggatggctacaggcagcgggaattatgtcttgggcccctgggcctcatggcagggtcggcttctaggattaattgtcctaagcagtgcaacccatgaaagaggagtaatctgagtgtcatttgtccccacagaactttaaaaaagaaggcagctgcctggctggagcagggctggaggtggagggctcacatgttctgacttgagagttctgtctggga

SEQ ID NO: 203383 - DNA, 601 bp, Human
aatgtcggctgagggaggggacagaggatggcctacagtgctgtgctgttctacgccccacctgtccaagctaccttcagacaaactccaggcatgcgtagcctgaccaccccacttcctccagccacatgagagaagctcagggcatgagctagggagccagactgagtaaaatcctccatctttcacagaagagcgataatgacacaaacctccgaggcaatggaatgagaggatgcacgcaaaatgcttagcacaagtgcctggcaaggagcagacgctccgtgtggtttaattttarttaaagcaactctgagatgccacgttttgccccttatcaaaggccactcttcaacaaattaataatatctggggagggtgaggggaaatgagctttgacagtacaatctttttgggatgaattggcagcacttaccaaaatttaaagtctatatgctctgtttattaatgttttattatttatttatttagacaggtcttgctaggttgcccagactggacttgaactcttgtgctcaagtgaccctcccacctcagacttccgaggagctgggagtagctataccctttgacccagcaa

SEQ ID NO: 203384 - DNA, 601 bp, Human
atgtggaaatgtaattcccaatgctggagctggggcctggtgggggttgtttggattgtggggacagattcctcatgaatggcttgggccatttctttggtgttaagtcagctcactctgagttcaccacaaaacctgtcatttaaaagtgtgtggcacctcccctcccactctttctctctcttgctcctgctttcgccatgtgacatgcctgccctccctttgccttccatcatgattgtaggctttccaagacctcctcagaagctgagcagatgccagcccatgttttctgtaaagsctgcagaactgtgagccaaccaaacctcttttctttataaattacccagtctcaggtgcattttttttttttttttttttgagacagagtctcgctctgtcaccaggctggagtgcagtggtgcaatctcggctcactgcaatctccaccttccaggttcaagcgattctcctgcctcagcctcctgagtagctgggactatgggtgcatgccaccacgcccagctaatttttgtatttttagtagagatggggtttcaccatgttggccaggatggtctcgatctcttgactttgtgat

SEQ ID NO: 203385 - DNA, 601 bp, Human
agtccaacactttattcacatataaggcctgatatcgtttggatagacagccctgcccaaatctcatgtggaaatgtaattcccaatgctggagctggggcctggtgggggttgtttggattgtggggacagattcctcatgaatggcttgggccatttctttggtgttaagtcagctcactctgagttcaccacaaaacctgtcatttaaaagtgtgtggcacctcccctcccactctttctctctcttgctcctgctttcgccatgtgacatgcctgccctccctttgccttccatcaygattgtaggctttccaagacctcctcagaagctgagcagatgccagcccatgttttctgtaaaggctgcagaactgtgagccaaccaaacctcttttctttataaattacccagtctcaggtgcattttttttttttttttttttgagacagagtctcgctctgtcaccaggctggagtgcagtggtgcaatctcggctcactgcaatctccaccttccaggttcaagcgattctcctgcctcagcctcctgagtagctgggactatgggtgcatgccaccacgcccagctaatttttgt

SEQ ID NO: 203386 - DNA, 601 bp, Human
actggtcagtcttttctcgtatcctactcgtctcacggtccagagcttcacacccaggtgaacatctaccatgtggacgaggccgactcactgaccttccaccaagactgatctttccaagactcaagtctgatcacattatattcttgcttttaacttctcactggctttccattgcctaaagtgtaaagtccaacactttattcacatataaggcctgatatcgtttggatagacagccctgcccaaatctcatgtggaaatgtaattcccaatgctggagctggggcctggtgggggktgtttggattgtggggacagattcctcatgaatggcttgggccatttctttggtgttaagtcagctcactctgagttcaccacaaaacctgtcatttaaaagtgtgtggcacctcccctcccactctttctctctcttgctcctgctttcgccatgtgacatgcctgccctccctttgccttccatcatgattgtaggctttccaagacctcctcagaagctgagcagatgccagcccatgttttctgtaaaggctgcagaactgtgagccaaccaaacctcttttctttataaattacc

SEQ ID NO: 203387 - DNA, 601 bp, Human
gagacatttttcctttctcccagggcctctagcaggaataaacttccaagctcatttcctggcccagtgagattttggcttcccttccatgggggcagcctttccagggccctggctctatgtaggtatgacagtgccagttcccaccttatgcaggcccagagccctgtctccagccctgcacaggccttaggaacccagctgctacccattagggtttaggcctaggtctaaaatgtccttggaagtcagttcacaagctcgctgctctggctttgggtcacttctttgtttctgccaytaaaagacttccttttcattccaggaaacatcattcttatgccttatgcagcagtgttacttgtttgtagtggggagggcactgagtttgtccaccgtgttgttggaactggtcagtcttttctcgtatcctactcgtctcacggtccagagcttcacacccaggtgaacatctaccatgtggacgaggccgactcactgaccttccaccaagactgatctttccaagactcaagtctgatcacattatattcttgcttttaacttctcactggctttccattgcctaaagtgtaaagtc

SEQ ID NO: 203388 - DNA, 601 bp, Human
agtaccccagggattttacttgtttgcaacttgatttttatgttactatcttagtttagaatccttggaccatgagaggtagtgtatattggaccccatacctatataaggcactgataggattttgatttttcacttgagacatttttcctttctcccagggcctctagcaggaataaacttccaagctcatttcctggcccagtgagattttggcttcccttccatgggggcagcctttccagggccctggctctatgtaggtatgacagtgccagttcccaccttatgcaggcccagrgccctgtctccagccctgcacaggccttaggaacccagctgctacccattagggtttaggcctaggtctaaaatgtccttggaagtcagttcacaagctcgctgctctggctttgggtcacttctttgtttctgccactaaaagacttccttttcattccaggaaacatcattcttatgccttatgcagcagtgttacttgtttgtagtggggagggcactgagtttgtccaccgtgttgttggaactggtcagtcttttctcgtatcctactcgtctcacggtccagagcttcacaccc

SEQ ID NO: 203389 - DNA, 601 bp, Human
aacgattggcacattcacggtgctctcgagaagattggttgagatgaatgaatgaatgaattcatctgacctgtagctagtaatttaaaactagctttgtttcctatttcattcccatagaaaaagataatcttgttttctatttattttccttcttttacctctttcatcattttaaacagtctcctttgtactgttctatcatctcaggtttttggggctgccagcttccattgattgtacctgatgactctttctcagggtggctctgttccttatttggtttgcaggttttttttggttgttgtttgtttgtttgtttttttaattgtgatctcatcttcaggaaacacttttcccttcagaaattctatatgccttagattaagaagcatccttaaagaatggtttatgtttgcttctgttgagtaccccagggattttacttgtttgcaacttgatttttatgttactatcttagtttagaatccttggaccatgagaggtagtgtatattggaccccatacctatataaggcactgataggattttgatttttcacttgagacatttttcctttctcccagggcctctagcagg

SEQ ID NO: 203390 - DNA, 601 bp, Human
gtgttttgacaacgattggcacattcacggtgctctcgagaagattggttgagatgaatgaatgaatgaattcatctgacctgtagctagtaatttaaaactagctttgtttcctatttcattcccatagaaaaagataatcttgttttctatttattttccttcttttacctctttcatcattttaaacagtctcctttgtactgttctatcatctcaggtttttggggctgccagcttccattgattgtacctgatgactctttctcagggtggctctgttccttatttggtttgcagkttttttttggttgttgtttgtttgtttgtttttttaattgtgatctcatcttcaggaaacacttttcccttcagaaattctatatgccttagattaagaagcatccttaaagaatggtttatgtttgcttctgttgagtaccccagggattttacttgtttgcaacttgatttttatgttactatcttagtttagaatccttggaccatgagaggtagtgtatattggaccccatacctatataaggcactgataggattttgatttttcacttgagacatttttcctttctcccagggc

SEQ ID NO: 203391 - DNA, 601 bp, Human
cacacctgtaatcccagcactttgggaggtcgaggcgggtggatcacaaggtcaagagatcgagaccagcctgaccaacatggtaaaaccccctctctactaaaaatacaaaaagtagctgggtgtggtggcatgagcctgtagtcccagctactcgggaggctgaggcaagagaatcgcttgaacctgggaggcggaggttgcagtgagccgagatcaagccactgcactctggcctggtgacagagtgagactccatctcaaaaaaaaaaaaaaaaaaaaaacccaagactctcccatkttccctctatcttctatcctagctctctcctccctgtcaccgtcaaactcccgaaagttgtctatattgctctcttcacttcttcaccccctgccctgccacatttgctcttcacctcatccctacctggatgcaccctcactacttcaccaacactactctctccaggggcatcgatctgccacatccaatgctaatctaaccctcctgctcctgacctcccagcagcactgggcactgttgaccattctcttgctttttcaagcattctgtccttggtttctgtggtgccacatcctt

SEQ ID NO: 203392 - DNA, 601 bp, Human
aaagtctaggccgagcgcagtgactcacacctgtaatcccagcactttgggaggtcgaggcgggtggatcacaaggtcaagagatcgagaccagcctgaccaacatggtaaaaccccctctctactaaaaatacaaaaagtagctgggtgtggtggcatgagcctgtagtcccagctactcgggaggctgaggcaagagaatcgcttgaacctgggaggcggaggttgcagtgagccgagatcaagccactgcactctggcctggtgacagagtgagactccatctcaaaaaaaaaaaaamaaaaaaaacccaagactctcccatgttccctctatcttctatcctagctctctcctccctgtcaccgtcaaactcccgaaagttgtctatattgctctcttcacttcttcaccccctgccctgccacatttgctcttcacctcatccctacctggatgcaccctcactacttcaccaacactactctctccaggggcatcgatctgccacatccaatgctaatctaaccctcctgctcctgacctcccagcagcactgggcactgttgaccattctcttgctttttcaagcattctgtcc

SEQ ID NO: 203393 - DNA, 601 bp, Human
gcttcaaaaaaaaaaaaaaaaaaaaaacccggtaaattttgcccattgatttcttgcaagctaactcatatcatatttaacaggaagaggattttattactcttaattctactgaagttcattaagtctgctactctctcattcctatacacctccctcctggtagagaagggtcctgccacctacctgaagccaatccatcctcccacgctttgccccctcccccttttcgggaagctccctgtccgtgattctttttctttcctatatatttaacttctttctttcaaatggaccctcmctttgccattcttaaagccaaagtctaggccgagcgcagtgactcacacctgtaatcccagcactttgggaggtcgaggcgggtggatcacaaggtcaagagatcgagaccagcctgaccaacatggtaaaaccccctctctactaaaaatacaaaaagtagctgggtgtggtggcatgagcctgtagtcccagctactcgggaggctgaggcaagagaatcgcttgaacctgggaggcggaggttgcagtgagccgagatcaagccactgcactctggcctggtgacagagtgagactc

SEQ ID NO: 203394 - DNA, 601 bp, Human
atctagaagcttattgctgctctctatggacaagaaattggactgtgggctcaccatttccctgttctcttcctaacccccgggcttcactgtgcttcacccacccaggcctcctgttattctggccttagaagtcctgtgaaatgtcgagtctcttgaaaggccggaggcctgaccagccagtggggctaatggaagaaagagaggatcgacggacgatcacacactgcctttctcactggtacaaaagggaggtgtcactcatgaaatatgggccactccagagaggaatgtttccatrtctacactaagaaaactcctccaggaggccagggaccctgaaagcttctcactgggccacagccatgctcccttgggtggctgatagtgaatcggctgtgccgcccctgcagagtgagaaatggtttgcgtttctctggggctttctcagccttcgggagaaaaagctccccttatctgactttgccctgagacctgagtggcacatgaaagcacgcatccggactcccaggccatccctaacccagtcatattatcctgcagtaggccagcactgtgctgggcaccagaaacaaagact

SEQ ID NO: 203395 - DNA, 601 bp, Human
gatctagaagcttattgctgctctctatggacaagaaattggactgtgggctcaccatttccctgttctcttcctaacccccgggcttcactgtgcttcacccacccaggcctcctgttattctggccttagaagtcctgtgaaatgtcgagtctcttgaaaggccggaggcctgaccagccagtggggctaatggaagaaagagaggatcgacggacgatcacacactgcctttctcactggtacaaaagggaggtgtcactcatgaaatatgggccactccagagaggaatgtttccaygtctacactaagaaaactcctccaggaggccagggaccctgaaagcttctcactgggccacagccatgctcccttgggtggctgatagtgaatcggctgtgccgcccctgcagagtgagaaatggtttgcgtttctctggggctttctcagccttcgggagaaaaagctccccttatctgactttgccctgagacctgagtggcacatgaaagcacgcatccggactcccaggccatccctaacccagtcatattatcctgcagtaggccagcactgtgctgggcaccagaaacaaagac

SEQ ID NO: 203396 - DNA, 601 bp, Human
gtgacagagcgagactccatctcgaaaaacaaaacaaaacccctatcccagtgatctagaagcttattgctgctctctatggacaagaaattggactgtgggctcaccatttccctgttctcttcctaacccccgggcttcactgtgcttcacccacccaggcctcctgttattctggccttagaagtcctgtgaaatgtcgagtctcttgaaaggccggaggcctgaccagccagtggggctaatggaagaaagagaggatcgacggacgatcacacactgcctttctcactggtacaaragggaggtgtcactcatgaaatatgggccactccagagaggaatgtttccatgtctacactaagaaaactcctccaggaggccagggaccctgaaagcttctcactgggccacagccatgctcccttgggtggctgatagtgaatcggctgtgccgcccctgcagagtgagaaatggtttgcgtttctctggggctttctcagccttcgggagaaaaagctccccttatctgactttgccctgagacctgagtggcacatgaaagcacgcatccggactcccaggccatccctaacccag

SEQ ID NO: 203397 - DNA, 601 bp, Human
tgcgaggcacacatgagttggggaacaacggtgcccttcctccccactccccacagtatcacattccaaggtgcaggcaccaggacggctcaggcactgccagtaactctccggccccatccaccttaccctcatatctgctcctctcatctctcagcctgttctggctccgtccttctggtcccagcgctcagactgatcatcccggccacagggtcctggtggctccctgcctgcctctgaacctttggagaaggctgtcccaccatcttcatgttcctcagcaaagctctgtccttcytccccactgctctaggctcactgaccttactgggcttttaattcctcccagctgtagccaaacaaccctgtgagtctctaatctttttggcacaaagaattatcctacagctgtacctgcatttgctatgtcctaccccctaccgcatgggcctgggagctcccctccagccagagggcctggctacctagaaactggacacccttgacccccattttaagccctttcccccaccccctccctaagctcttttctgcaccctgctcccgagaggatacagttgccacagacgaaaaggat

SEQ ID NO: 203398 - DNA, 601 bp, Human
cctgcagggcaggagttctgtctgcctgcatgtgggcaggacctaaccccactcccagagctacccatgggaaggtgtggatccagggacatagtggaaggccctcagggaagcctgcctgctgagagtacccaggaaggagcctgaatcctgtggccttgaatcccatccgtttcctgtccagactggtcccagctcccacactgagctgcgtggagagccagtgaggcaaaacaagtgagacccatgcgaggcacacatgagttggggaacaacggtgcccttcctccccactccccayagtatcacattccaaggtgcaggcaccaggacggctcaggcactgccagtaactctccggccccatccaccttaccctcatatctgctcctctcatctctcagcctgttctggctccgtccttctggtcccagcgctcagactgatcatcccggccacagggtcctggtggctccctgcctgcctctgaacctttggagaaggctgtcccaccatcttcatgttcctcagcaaagctctgtccttcctccccactgctctaggctcactgaccttactgggcttttaattcctcccagct

SEQ ID NO: 203399 - DNA, 601 bp, Human
catgtttaacgttggttgatagtgaatgggtggagtgtggctttgtactgggtttatacgagattcatagagtggaagcatggtttgcccaagatggctccaactctttagaaatgtctgaactccattgctggtccctctttttccatcttgcctccacaggaatgggtgtcccattcctgtaggcatgggcattggaagaagcagaactctgtctagaacctaggtacttgaagcataatcctccaaccagcagcatgggcaccaccggggagcctgttcgatgtagaactccaacccygccagaggcatagcgactcagtgacagggttgggaggggaattcccaggatccctccgcaggggagccctgcccaactggccaggctctgaggctctggcattctacatcctgaggcctgtctgtccagaaggccaacttgtctctgttcttgcccccagggaaggatctcagccacccccatgtgcaggttacagaagtttgcccactgaggtgggtgtcaccatgtcagggaccctgatcattgggttacagggaggccctgtccagagctggaaggccatggccacgactgagcact

SEQ ID NO: 203400 - DNA, 601 bp, Human
ctgctccagtccagtctccagcatcctcacctgggaagtcggctgaggggtagggatccttcacctcattgacattagattcaaactcatcgattttcagctgtaggaaggaacacaatgactataacaatgaaaaagaagttgcggtttcccctcaatgagcatatactggagagcctgttagcgttcagctcacttaatcatccctacagcctaaggaacagggaatattatgatcatccccattttacaaatgagaggccaggcccagcaaggccagacaacttgcaaaagctcccayggggcaaggcctgagcccgccctagcctgtctgactctatcttcacatacccactgcttggttctccagaagggagttgagcttccccaggccaggacctcgagcctctctgggcccagttccctgactttttgaactccacttcctcagttttcaggaatggtgagcagagccagatgggaatgagcagggcagggctagcaatggtggaagccggtctgggcctctcagtggaacagcgggtgtcagggagaggaaatacctccttggtctggagtgggaagctgctacgctggagaa

SEQ ID NO: 203401 - DNA, 601 bp, Human
caaaagtccccctggagcttagagtcactggggcaaacagatgctaatcagctgattccataagtagacatacaagtagctgatcagctgatgggacaagtagatctaaaattgccccactgacccggtgatccaaaggacccaggacccagagagttcttgggccccagggctctgccaggtggcctggtaagattaattcagcctggttctgcttgtcctcttcttggtccagataaatgggatttctgcagcagtcactggctatttgcatttatgagatgtttgtggtttatccacrgttgtttcttatccatgctccccctaccccaccattgtttcctcctcttggactttcccacattgcctgccatggttctatccatccctgtatccttccggcccccagccctaccggacactggatagtgagtaatctgcctcatcacgacatatatgggcgtgtcctcatttatgatccattctgcatgactggcagggaagacttgtatacccacgtgtccctgtgcttcttgaaaactgagtccttggcagtgaggcacatagctggcactcaataaatacttgctgagttacatga

SEQ ID NO: 203402 - DNA, 601 bp, Human
taaaacacaaatattcattgctggtagatatttgaagaaatttcattattcttatttgtaccagctccattctccccatacttcactttgcaaaattctttcatgcattcattcattcaatttattgagtgcctcctctgagccaaacactgtgctgtgtggaacacaaaagtccccctggagcttagagtcactggggcaaacagatgctaatcagctgattccataagtagacatacaagtagctgatcagctgatgggacaagtagatctaaaattgccccactgacccggtgatccraaggacccaggacccagagagttcttgggccccagggctctgccaggtggcctggtaagattaattcagcctggttctgcttgtcctcttcttggtccagataaatgggatttctgcagcagtcactggctatttgcatttatgagatgtttgtggtttatccacagttgtttcttatccatgctccccctaccccaccattgtttcctcctcttggactttcccacattgcctgccatggttctatccatccctgtatccttccggcccccagccctaccggacactggatagtgagta

SEQ ID NO: 203403 - DNA, 601 bp, Human
atgcccatggcttctgtgctcagagccctcctaggagcccctgcagccagtaagcaagggaccaccaggctgacttgggaccctagggctttggcagagtccagcccgggcatctccttctcttcacagtgagcagatttgagcgtcaagggtaggtaagggaagcccacaaccttccagaagtggggcaaggagcaagcccaagtaactttgtggctgcatgttgtgtctcaaggctcgatccacacagcctcaaatatccataggctgggggatggagtgggaaacgctgcttcagaakaagagacctgggtcctagtcccaggtctgcgtctaacttgctgtgcagtgctgggaaggtctgtgcccttccttagcgtcagtttccaatttgtgaaaccgacaaggggcaggagggttgttgaaataaaaggaccctgtgatcctctcctgggctaggattttaaaaatagtaacttcacagagaagcttcttccagcatggaaaaaagcaatcagaatttcttgagcttcacccagtccccaggatgcaggcaggggataggggatgaagagacggacattccaagcacattcactgg

SEQ ID NO: 203404 - DNA, 601 bp, Human
cagcagcagcataaagcaggcagtcagagccattctgtgccccagcctgtgccgttcagaaggagtggagtgggcagtcctatccctgaggaactgaactctaagaaactctgatgcttgtagccacatagaggatacagctgaaccctgggcaccagactgaggctggagggggcaggggtgctgagtggcagagagggtgaagcccgtcacctgatttctcatggaatcagcccggatggggtcttccgcagccagtgcagcgctgctgagcaggatgaagagcaggatgaagttggtraaccaggtggcattgacgatgcggtgacacaggacacggatcctggtggggcgaggtagggagggcaggggagctgtgagctgctggaggctcaggcctcatcagcctccatcctgcggacgaacatggaatacacctcctgctcctccctggccaggagagaagtgcagccctgcacctgcagggtcctctggctggacacacagggggccctgacctctcactctgtttctaaagccttagttcctcctcccagccaagcccctcccaccacctgccccttcctgcaattatggcacc

SEQ ID NO: 203405 - DNA, 601 bp, Human
cagcccaaaggggccactttatcctctctggcaatgtccccagatctccttataatgcacttgctactgtctgtcctaggccgccctagctatctctacccagtgaaggcctgtccaacttcaagttctggctctcgtgccccaaactccacaaacttcttgacctcgaggaagccaccatctccctctactcaattccttcaatagttgaggccccgaaataaggtactgtcctgatttcacaccacagcctgctctgagcctgttcctggggctcggctagcttctcctctcttagttygtgaatgtgcacgcgggggctactgggtttcagttatagatgggttctccttctgcccccagagcccaccacccccaggatggctggaaccccgtgcatctgtgttgggaatgggtgagcagtgacgtgctgtggataaggtgtggaaaaggcgtgatagggcagagctgccaggaacccagctcagggcagcagtcacttctctggggactcttggaggaaaaggcctttccagtcactgttaacagaggtctagggatgacaaatcacacagctccccggctctgctctttttttttt

SEQ ID NO: 203406 - DNA, 601 bp, Human
tacaatggcaacagtggtcagcagtcaaccaagaggcccgggatggatgtcactgaggaaactggatctggacttgccacatattagccttaaaactctgtgcattcagttgaagcaaattcactttgagtctcaataatgtgttgtgttgcttgtgtatttaatttttaaaagagcttaagatagttgctgtcaggttttcattttagcttattagatctcttaaagctattaaccatcattgaaagatggctgtctcttaaaagtttgatttaggagagttgtatttatagattgaagyttcatagtcatatttaaaagatggacatcaaactaaccgttttcttgttttgtttgatagaattctaagtgcatgacaatagctttaagagatggggcttgaattgtatttaaatttcaactcagtagacacatgaccctctgctaccatttcagtagtgttagaagcccattgactgtttctgagattatcattgggctgcttttgtggaactcaaggtgctatttaaatgtaacgatgtcttactggctttctgcaaacttatgtgtttggtgtggtgaagacctatttttcaaaata

SEQ ID NO: 203407 - DNA, 601 bp, Human
tgtgagatgatgaactcccagccttagaggctcctggtagatgtggatgatgccagacataccagccaggaagatgggctgccgcagcccagctgcactgacggaggcggagtgtggggctgggatagggcgtatgcttggcacaggcctggcaggatgggaggaagcgggcaagggtgggaagggagaagaatggctgtggggccctgggaggaggggcctccctccccaaggaaaagccacgtggggtagggagagagcagatacaatggcaacagtggtcagcagtcaaccaagaggyccgggatggatgtcactgaggaaactggatctggacttgccacatattagccttaaaactctgtgcattcagttgaagcaaattcactttgagtctcaataatgtgttgtgttgcttgtgtatttaatttttaaaagagcttaagatagttgctgtcaggttttcattttagcttattagatctcttaaagctattaaccatcattgaaagatggctgtctcttaaaagtttgatttaggagagttgtatttatagattgaagtttcatagtcatatttaaaagatggacatcaaactaa

SEQ ID NO: 203408 - DNA, 601 bp, Human
catgcaggaagtatcaagggtgttggtgtatacttaggaatcaatttctctgtcctgcaaatgatctgagagccagagacatctggaaatcagggtttgtgtgagggacatctttgtagggctaattcctagagaggaactgaatagctgtgttctcctaggaaaatgagaaaagtataaggttggctccggatgtgagatgatgaactcccagccttagaggctcctggtagatgtggatgatgccagacataccagccaggaagatgggctgccgcagcccagctgcactgacggaggsggagtgtggggctgggatagggcgtatgcttggcacaggcctggcaggatgggaggaagcgggcaagggtgggaagggagaagaatggctgtggggccctgggaggaggggcctccctccccaaggaaaagccacgtggggtagggagagagcagatacaatggcaacagtggtcagcagtcaaccaagaggcccgggatggatgtcactgaggaaactggatctggacttgccacatattagccttaaaactctgtgcattcagttgaagcaaattcactttgagtctcaataatgtgt

SEQ ID NO: 203409 - DNA, 601 bp, Human
ttttgtttgctcactctgtcgcttaggcaagagtacagtggtgtgatctcggctcactgcaatctccgcctccccggttcaagcaactctctggcctcagcctcctgagtacctaggattacaggtatgtgccatcatgcccagctaatttttgtatttttagtgagaaggggtttcaccatgttggtcaggctggttttgaactcccaacctcaagtgatccgcccgcctcggcttcccaaattgccgggattacaggcatgagccaccgcgtccagcaggatggctaggtcttaaagakgctaaatcaggcttgagatccacggattctggtgcagttccttcaaagacccagatagggaaactgcctcggccaaggacacagcactagttgaagacacagctggcccttgccccccgctgcccctgccacacagatctgtgctgttcctatcacatgccctttttatggttgctggagcagaaggtgaaggtgaggcgggtggtactgggggtaagcagagagtggatagagctgccactgggcagggtctgggcacttaacaccaaatgcccagtttactatggaaagcaaagcttg

SEQ ID NO: 203410 - DNA, 601 bp, Human
ctttggccagagcagttaatccttttttttttttttcaaggctttgcagattatttattatagaattttttttaaattatactttaagttttagggtacatgtgcacattgtggcagttactccttttatctgtgtctcagattgggtccctgagcaacatgtttgaaggaaagtagtggatggctaggtcttttttttttttgtttgctcactctgtcgcttaggcaagagtacagtggtgtgatctcggctcactgcaatctccgcctccccggttcaagcaactctctggcctcagcytcctgagtacctaggattacaggtatgtgccatcatgcccagctaatttttgtatttttagtgagaaggggtttcaccatgttggtcaggctggttttgaactcccaacctcaagtgatccgcccgcctcggcttcccaaattgccgggattacaggcatgagccaccgcgtccagcaggatggctaggtcttaaagaggctaaatcaggcttgagatccacggattctggtgcagttccttcaaagacccagatagggaaactgcctcggccaaggacacagcactagttgaagacaca

SEQ ID NO: 203411 - DNA, 601 bp, Human
cagagtcaagcggggtcccatgtcccagcccaaggcccaggtaggggggctctgtgctcctctgcactgactttggccagagcagttaatccttttttttttttttcaaggctttgcagattatttattatagaattttttttaaattatactttaagttttagggtacatgtgcacattgtggcagttactccttttatctgtgtctcagattgggtccctgagcaacatgtttgaaggaaagtagtggatggctaggtcttttttttttttgtttgctcactctgtcgcttaggcaagwgtacagtggtgtgatctcggctcactgcaatctccgcctccccggttcaagcaactctctggcctcagcctcctgagtacctaggattacaggtatgtgccatcatgcccagctaatttttgtatttttagtgagaaggggtttcaccatgttggtcaggctggttttgaactcccaacctcaagtgatccgcccgcctcggcttcccaaattgccgggattacaggcatgagccaccgcgtccagcaggatggctaggtcttaaagaggctaaatcaggcttgagatccacggattctg

SEQ ID NO: 203412 - DNA, 601 bp, Human
ttggcccctgcccctccctcggggagctgagcctctgagccccttacctcccgcactgctgcaggaggccttctgtggtctcccattatggaacaaggaggaggggctgcccacctcccacctccatcctcctgccagtggggcgggagcagcagagttggagcccagctgggctctgatgactcaacttgtctcagagtcaagcggggtcccatgtcccagcccaaggcccaggtaggggggctctgtgctcctctgcactgactttggccagagcagttaatccttttttttttttttcaaggctttgcagattatttattatagaattttttttaaattatactttaagttttagggtacatgtgcacattgtggcagttactccttttatctgtgtctcagattgggtccctgagcaacatgtttgaaggaaagtagtggatggctaggtcttttttttttttgtttgctcactctgtcgcttaggcaagagtacagtggtgtgatctcggctcactgcaatctccgcctccccggttcaagcaactctctggcctcagcctcctgagtacctaggattacaggtatgtgccatcat

SEQ ID NO: 203413 - DNA, 601 bp, Human
ggaaggggggagggaaggcaggcatctgaaaaaaggagcccaagcccatctcttcctctcagaggcgtgaactcgcccttggggcagggccccagagcagcctcctttcttcaccatcgttcattcccacagctcccccagggcttccccacccagcctagatgctgccaagaccgagaaggcagtgcctcagaggggcatttactgagtgccccctgatgggctgaggggatggacatgagtgcagcttggcccctgcccctccctcggggagctgagcctctgagccccttacctcccscactgctgcaggaggccttctgtggtctcccattatggaacaaggaggaggggctgcccacctcccacctccatcctcctgccagtggggcgggagcagcagagttggagcccagctgggctctgatgactcaacttgtctcagagtcaagcggggtcccatgtcccagcccaaggcccaggtaggggggctctgtgctcctctgcactgactttggccagagcagttaatccttttttttttttttcaaggctttgcagattatttattatagaattttttttaaattatactttaagt

SEQ ID NO: 203414 - DNA, 601 bp, Human
acaggtcagcaccaagaggcccctccctccctctccacacccacatccatgggattgacgggcaagtcaggagcagctgtggccaggggctgtggctgaggactgtgaactgtttaggggaataatcctgttgggctttgggttccccttgagttatcacagcccattcccatgggtgctatagactagactgtgggtctgaagggcttcctttctctgggcatcatgaggttccacaagaagacccactctaccaacttgtattgcttcagtttggagatagggtagggtgcatggaggmtagggcttggcatcaaatgcaggttctggggtcacccttaggcctctcttccctggctgaacctagggcttgggccagcaggaggcctgctggagctctgccctccacctctggcaggcagcccaggcacctggttcttgtccagctcacagttcttgtactcagtctctccctgctcctggaaggtgacaatgacgaagcccacaaagatgttcatcatgaagaaggcaatgaggatgatgtagatgatgaagaagatggccatctccacacggttgttgtagatgggacccacgtcct

SEQ ID NO: 203415 - DNA, 601 bp, Human
cacccccagtgattatgaggcatgatggtgaggcccctgtcacctaccactatgaccctccttaaatctacttccttgtaagttttcccagggatctcttacccttttattagaaagtggatgaaattctacctcttccacaaaaccttccaggtagtttgggaggatctgatggctgcctccaccctgccctgccttggcaggactgcccaattctgctgcctgactcagccccaaacacaagccagtgctgatgatcctctgcgacctgggcctcctggctcagtgattgtctttccayatcaccatgacctagcagtgtgtgttcttatcattgggtgtgtcttgggcttctaggagcagggagcctagttacaccatcctatttatacagggcttaaggaatcagatgcttaatcgaggcttgataacgatgctgctaattatgatattgtctataaagggtgctcaactcccaagagagacatctgttttgcaaatactaaacccatttttcttgggaccagagccaagattccagccaactcaaccatccagatttgcaacagcagaagaaaaacagagaaagcactttctactt

SEQ ID NO: 203416 - DNA, 601 bp, Human
aaccagtgacaccctcctggcctccaccaccaaagacactgttttgatatatccaggcttccgctacacagacctcagattttaagaagtaactatttttagtttgggctgtttattttggctgtttagatttctctgttctggctgtgctggtgagaagtgctgctgtcaaaccatggaggcttttgggatactatttcccagcaaaaactgagtgtggatggaaatacacaacacacacacacagacagacagacagacagacacacacacacacacacacacacacacacacacacaatggttttgctcagagcccaccctgcccctcgctagctcagcgcccccaggggatctgagcagatggggttgtctgtcaccgtctgttctgtgcatggagggtgaacagggttcccaccctggccctcccctagcacatcagacagacgatgtgacagccaagtccctactccctgccagagctcagcctcagctgagggctccttcctcagagactccagacttttcctcagccattcctctcacccacaccccacctcaggcatccccagtgctgatccttccacccctatacccaact

SEQ ID NO: 203417 - DNA, 601 bp, Human
ttcacgtgactttaagcaaacactactggtaagggacatctgctaaaaatcaaataaaaaccagtgacaccctcctggcctccaccaccaaagacactgttttgatatatccaggcttccgctacacagacctcagattttaagaagtaactatttttagtttgggctgtttattttggctgtttagatttctctgttctggctgtgctggtgagaagtgctgctgtcaaaccatggaggcttttgggatactatttcccagcaaaaactgagtgtggatggaaatacacaacacacacasacagacagacagacagacagacacacacacacacacacacacacacacacacacacactggttttgctcagagcccaccctgcccctcgctagctcagcgcccccaggggatctgagcagatggggttgtctgtcaccgtctgttctgtgcatggagggtgaacagggttcccaccctggccctcccctagcacatcagacagacgatgtgacagccaagtccctactccctgccagagctcagcctcagctgagggctccttcctcagagactccagacttttcctcagccattcctct

SEQ ID NO: 203418 - DNA, 601 bp, Human
atggtagccattagccacatgtgactatttgaattacaatgaaaattgaataaaaccagaaatttggttcctcagttcctctagccacctttccagtgacaagtagacatgtgtggctagtggctactctattggacagggcagaccatttctgtccttgcagaaagttctaaccaatgtgctcccctagtcctttccctggtttgtacatcaggtatgtaaatcaatcttcacgtgactttaagcaaacactactggtaagggacatctgctaaaaatcaaataaaaaccagtgacaccytcctggcctccaccaccaaagacactgttttgatatatccaggcttccgctacacagacctcagattttaagaagtaactatttttagtttgggctgtttattttggctgtttagatttctctgttctggctgtgctggtgagaagtgctgctgtcaaaccatggaggcttttgggatactatttcccagcaaaaactgagtgtggatggaaatacacaacacacacacacagacagacagacagacagacacacacacacacacacacacacacacacacacacactggttttgctcag

SEQ ID NO: 203419 - DNA, 601 bp, Human
tgaagagacgtgtcagaaaggacagacacacagaagagttaaagagaaaaagaggcaggggctaaagaccccacatggctgccaatcaggggcggggtgggtgggagtgaggactgaagctctgtgggaactgtgaggcaagaggtgggggacaaggaaataagaaggggagggaaggctggacacagacagatcccttctcattttggagatgcagctacgggtggcaagggtttgggtttttcttatgtgtttgggttatgtgatgctggggacgtccctaatgaaggcgcattggaaratgcctgctcattgtaaatggattcacatccatagtgccctgaggccagggtccgggcccctgtggaagtcccatctcccaggggcacagctcctctgggggagtctgaaatccccacagcagatgtttctctgtccaggactggacctgggaccaaggcttctatctcagtattcgggctcttgaagagcaggtgggtaggtgtgtgggagcaatttcttcctgtttactcccttgggccacacttcatgagaagcccttgttctgcagccctgggtcaaaagaagtcattgttttatc

SEQ ID NO: 203420 - DNA, 601 bp, Human
tgtgttttggggagatgtttgtggcatggaggaactccagccccgcctctggcccctgctgtccactagttcgggaccatccttgggcacagggctctggggctgttcagctgggaggcagggaagaggacgtggggcaccaggcagcgtggtgaagcccacacttgggagcagtggcagggatttgccctggggtgtggctgcacccaggcccactgcctgccctctgggacctgctgcacatctcacaatctcctcaagctgccactgagtcgaggaccctggtggccctcctagggcycctcccctggcgtcctcccagtgcaaagatttcccaaagcttggctgctctattgccacaaactcaatgtggctactccccatcactcccaccctgcacacggctgttctaagccaggcaagcctctaatcttgtgccagccttagatacacgaaatactctggaaggggagagctgcccctgctctgcttcctgtgtcctcaaaggccttgtgcccaatgaactgtcactaaggtcctttgccagcgatcacagttctctctggactgtgtttccatctgcatagagggtgccagagag

SEQ ID NO: 203421 - DNA, 601 bp, Human
cggggagggaggtgcactgtgtgttttggggagatgtttgtggcatggaggaactccagccccgcctctggcccctgctgtccactagttcgggaccatccttgggcacagggctctggggctgttcagctgggaggcagggaagaggacgtggggcaccaggcagcgtggtgaagcccacacttgggagcagtggcagggatttgccctggggtgtggctgcacccaggcccactgcctgccctctgggacctgctgcacatctcacaatctcctcaagctgccactgagtcgaggaccytggtggccctcctagggctcctcccctggcgtcctcccagtgcaaagatttcccaaagcttggctgctctattgccacaaactcaatgtggctactccccatcactcccaccctgcacacggctgttctaagccaggcaagcctctaatcttgtgccagccttagatacacgaaatactctggaaggggagagctgcccctgctctgcttcctgtgtcctcaaaggccttgtgcccaatgaactgtcactaaggtcctttgccagcgatcacagttctctctggactgtgtttccatctg

SEQ ID NO: 203422 - DNA, 601 bp, Human
agaggtcagtctgggggcagaacctcagaggggtaaggggcagggcggggagggaggtgcactgtgtgttttggggagatgtttgtggcatggaggaactccagccccgcctctggcccctgctgtccactagttcgggaccatccttgggcacagggctctggggctgttcagctgggaggcagggaagaggacgtggggcaccaggcagcgtggtgaagcccacacttgggagcagtggcagggatttgccctggggtgtggctgcacccaggcccactgcctgccctctgggacctgstgcacatctcacaatctcctcaagctgccactgagtcgaggaccctggtggccctcctagggctcctcccctggcgtcctcccagtgcaaagatttcccaaagcttggctgctctattgccacaaactcaatgtggctactccccatcactcccaccctgcacacggctgttctaagccaggcaagcctctaatcttgtgccagccttagatacacgaaatactctggaaggggagagctgcccctgctctgcttcctgtgtcctcaaaggccttgtgcccaatgaactgtcactaaggt

SEQ ID NO: 203423 - DNA, 601 bp, Human
ctgaccaaagcaaggcagggtcagatgtcacagaggcctcaaagagattaactgactccactctctgaggtaaccccacagttgaacccaactggctgaattcaactgccacccactctggctgagtcacaaaagcagcccttagatttcacaccttgtggatgtgtcgctgttgaatgaagaatctcaatgcatccgaggtgcatatgcatgacatgtttgcatttttccagtaactgctacaacctgctctgtagataacctccctccacctctccagctgggaagaagtgtctcctcyagtcacattcagccagactacataacttcccactcctttgtgtctaataactgtctcatttcagctagctcccttccttcctagagcaggcagtgcagggtggcctcgggtttggagttgaggtgcagagctggggcgaggtgggaatctctgcctgcacacggtgaggtgccggtctccttttcacaggccataagggctgcaggctgctgtgacctcatggagcctttgacacgctgtgccaagaaggggccctgggtgtgggtgtccctaggccttgtctggtctcagtagagcatt

SEQ ID NO: 203424 - DNA, 601 bp, Human
gtgtgagctgggcctcagtttcccctctgtgctgcagccctcatggggtgttacaagcaggagctaaactttagagaagagggcaaaatcaatctgattcaagttactagagggatgcactgttctgaccaaagcaaggcagggtcagatgtcacagaggcctcaaagagattaactgactccactctctgaggtaaccccacagttgaacccaactggctgaattcaactgccacccactctggctgagtcacaaaagcagcccttagatttcacaccttgtggatgtgtcgctgttgartgaagaatctcaatgcatccgaggtgcatatgcatgacatgtttgcatttttccagtaactgctacaacctgctctgtagataacctccctccacctctccagctgggaagaagtgtctcctctagtcacattcagccagactacataacttcccactcctttgtgtctaataactgtctcatttcagctagctcccttccttcctagagcaggcagtgcagggtggcctcgggtttggagttgaggtgcagagctggggcgaggtgggaatctctgcctgcacacggtgaggtgccggt

SEQ ID NO: 203425 - DNA, 601 bp, Human
agaggacagaagaggctcctgtcacctatctgctcctgcctggcccctcagaaggctggcagtcaggtggcagcagggtgtggacagatgagcaaactggggctgttgtccaatggtaaggaggtcagatcttcatgttcactgtgtagctcagtgtgagctgggcctcagtttcccctctgtgctgcagccctcatggggtgttacaagcaggagctaaactttagagaagagggcaaaatcaatctgattcaagttactagagggatgcactgttctgaccaaagcaaggcagggtcakatgtcacagaggcctcaaagagattaactgactccactctctgaggtaaccccacagttgaacccaactggctgaattcaactgccacccactctggctgagtcacaaaagcagcccttagatttcacaccttgtggatgtgtcgctgttgaatgaagaatctcaatgcatccgaggtgcatatgcatgacatgtttgcatttttccagtaactgctacaacctgctctgtagataacctccctccacctctccagctgggaagaagtgtctcctctagtcacattcagccagactacat

SEQ ID NO: 203426 - DNA, 601 bp, Human
gtcatgtctctgtgctcttgcacagacagtgctctctggccttgctaaattccttttgatgagtgctaaccaaaacaaaaaaaaaaagtaagaacttttggcagcctctctggagtatgaaaaagcacccaggaaacaaagccacactcaggatgaccagaatgggggacaacctaactagagcctcctgcgtccccgagatgaatcccaggagaggtggaaactggccaggaaggggcaggcaggctcccccatgcctcagcttatcaaagccctctccctgccccgcaggccctcagcrtctcaccaggaaggcacagagcatgtagaagctgatgaagtagtagtatgcaaagttggtgccacatgtgtactcctcccctggggcatagtccgactctgggtcacacagcttcccatagctgcaggccagtaggatctcctgccaggcctcacctgttgcacacctagaggacagaagaggctcctgtcacctatctgctcctgcctggcccctcagaaggctggcagtcaggtggcagcagggtgtggacagatgagcaaactggggctgttgtccaatggtaaggaggtcagatct

SEQ ID NO: 203427 - DNA, 601 bp, Human
aaagtcctactggcttcctcttttctttgatgggcaggctgcgaaaaagagatgaaacattccccgcctgtctccagagggctgaatgaggacctgtgggtggctggtagaggcaagtaggtttggctcctgctgatggaggcactttaaagcacggttgctataggcaccaaacagacctgcactgtatcttggcaccatctcttaccagttacatggactggggcaacttacttaacctctctgaacctcagtttcctcatctgagactgagaccatcgggagatgcctatttcctatygggaaggaaagtaagagagccgtgctctccaagctttaaatgcatacgaatgtcccaaggctcaggttcagagcaatgcaagagttagattcagtcagcctgggaggggcctgcgactctgcattttaatcaagctcagcttctgctggtcagaggaccgcactttgatttggggtctagagtgtctggtgaggtatatagcttcctactcctaggagtgttcaagcaggagctggatgacaatttctcaataaagtcaagggtgtttccaccccggaaagctgtaggattccctccaac

SEQ ID NO: 203428 - DNA, 601 bp, Human
ctgagaacctcctctgctcctgctcacagccaaactgcagggcacccctgacccctgtgccagcactggcccttctctggcccccagacacagctgaggagtgtgggaacagacccttgatgatctttgccctgcagaaaaccctcaggctccctctgagccctgaggggcatgaggactttgtgcccatggcctggggtcctccctctacttcttcccacagttcttaagagcaatcttgagctctgagaatctggcagaatctgtgccagaaacagcctctgggagaaaggagggggctcacattggaaggcactctcaccttccgtcttgatcttgagtgccgtgcggaccagggcaaagagtgtggcattgaaggtgactgtgccgtcgctgttcaggggcatgttcatgcccaccagccgctgtacagggagacgcagtggcctgccgctgagctgggaccaggccaagcttggcaagtcatcctcacccggtctgtggaccgggaggggacgggacacgagggctgggggtgtcagctgaccaggacatcctttgtgaggggacagaatgatgagttgggtgacattgctgagac

SEQ ID NO: 203429 - DNA, 601 bp, Human
actaatttttgtatttttggtagagatggggtttcgccgtgttggccaggctggtcttgaactcctgacctcaagtaacctgccaaccttggcctcccatagtgctgggattataggtgtgagccactgcgcctggcctagagaccactgttcttatctaacttgtctctcccttgaacaaatcctattttctttggtcctatcatccagagatgaagcgccctggttctttttttgaggttgaaacatcttcaatcatggactacccagaactgtcttgacattttttcactcttctggscttcctttttccctctatgtctccatcattggcccctcaaggacatggaaggataactagagtctggagacctggctcagtgggggagccccttggaacatacctggattgggcttacctggatctgtacaatgtccttcttgggccgatagccataatactcctcttggcgtttcatgaacttccggaagtgctcctggatgaggaatgtggcgtagaacttccccactgtcacctcatcatctgcagaggagccaacaagagatgccctgaaggctagtgggaatctgacactggatt

SEQ ID NO: 203430 - DNA, 601 bp, Human
aattttagtagagatggggttctaccatcttgcccaggctggtctcaaactcctgacctcaagtgatccgcccttcttggcctcccaaagcgctgggattacaggtgtgagccaccgcacctggacccatacccagtggaacattttaagagcccttcatggatcacctttctttagagagaactgttcttttttttttttcttttgagacacagtctcactctgtcgcccaggctgaggttcagtgtctcaatctcggttcactgcaacctccgcttccagggtcaagtgattctcacgsctcagcctcctgagtagctgggcacatgccgccacacctgactaatttttgtatttttggtagagatggggtttcgccgtgttggccaggctggtcttgaactcctgacctcaagtaacctgccaaccttggcctcccatagtgctgggattataggtgtgagccactgcgcctggcctagagaccactgttcttatctaacttgtctctcccttgaacaaatcctattttctttggtcctatcatccagagatgaagcgccctggttctttttttgaggttgaaacatcttcaatcatg

SEQ ID NO: 203431 - DNA, 601 bp, Human
ccagtctggccagcatagcgaaaccccatctctactaaaaatacaaaaagtagcctggcatggtggtgtgtgcctgtgatcccagctactcaggaagctgaggcatgagaatggcttgaacccgggaggcagaggtcgcagtgagccaagatcatgcctctgcactccagcctgggcgacagcgagactcttgtctccaaaaaaaaaaaaaaaaaaaaaaagcatcagtgttaatttcctgattttgtggttatgttgtggttacatagaagaattatgcaggataacgcccttgtaatayacattttgccttgaatacacacaatgccttgaaatatgcattaaagtgtttttggatgatggaacatcattttggagttactctcaaatggttcagaaaaaaaggttttatattatacttgcaactttttaaaagtatgagattatttcaaaataaaaatagccattgaaataaatttttgagcacagctcaaatgcatgtgtatttgggggttttataaattatgtgcattacagtgaacccaaaaatagaaataaaaccagataagataaaacaaaaagttctaaagttttcttttca

SEQ ID NO: 203432 - DNA, 601 bp, Human
ttctttttttgagacagagtctcactctgttgcccaggctggagtgcagtggcacaatctgagctcactgtaacctctgcttcccgggttcaagtgattctcctgcctcagcctcctgagtagctgggattataggcatgtgccaccactccctgctaatgcttgtatttttagtagagatggggtttcaccatgttggctaggctggtctcaaactcctgaccttgtgatccacccacttggcctcccaaagtgctgggattacaggcatgagccaccgtgcctggctagaaccgcttcstatggcttacttgtttcttatcactgtacccagggctctcccaaagccccagcctaggccccactctccctcttgggttattgaatatctcaggtacctgagaggccaccaggtcctgctctggcctctgggatagcccacaccttaattgttccaattgagtcatctcttgaccccatgggtggaaatttcatgcccttcccaggcttccaggttgagaagtgttcttactcagtacagtcttctagattggtgatctttattgattggatatgtcatatatatatagttgagcaaagt

SEQ ID NO: 203433 - DNA, 601 bp, Human
tgtgactggaaggggtgcaggcagccctggccatgaaaaggggctggctgctgccttgttctgcttattcctgaggcctggggctaagcctttccaggccgaagaggcctccaatcagctgacctcctgtctagaacagaagctttgcctgagcctagcccctaagttatgattgctgagaagttctccccctcatcctgctgttttttatgacacttacgtaatcacagattatatttagtctacagcccaaggttggtgagatgggaaccacccagcacagcgggatctccttggaacytaaatccagtgatggaatcttattgtccacagtcttttgtggtatgtgctaccaccgaagatcctctcctaacctatcatgtgttcaatacgtctcagctcctagacttgctgaagccgacggaataaaagaacctctcaacactggggccaatactgacatgatgtgaggcttccccctgctggccaaagaagcctctgccatcgaggtcggcctcttacattaaggttcaggatggattggggcacaaaggcaagcaaaagacaccctacaaatttggggtaccctcttccaatccaa

SEQ ID NO: 203434 - DNA, 601 bp, Human
caaagtgctgggattacaggcatgagccaccactcctggcctctgtgattatttggtcccaatcatatcacataacatatcacccaacaagacgacaacccccttcagggcagggcccagggctgatgcttctgtatttccacgttaccttgcaccatggtgacccaaaaaggtacatgcacccttcaaggcttgtgggctgaatttaaggggtctctgtgactggaaggggtgcaggcagccctggccatgaaaaggggctggctgctgccttgttctgcttattcctgaggcctggggmtaagcctttccaggccgaagaggcctccaatcagctgacctcctgtctagaacagaagctttgcctgagcctagcccctaagttatgattgctgagaagttctccccctcatcctgctgttttttatgacacttacgtaatcacagattatatttagtctacagcccaaggttggtgagatgggaaccacccagcacagcgggatctccttggaacctaaatccagtgatggaatcttattgtccacagtcttttgtggtatgtgctaccaccgaagatcctctcctaacctatcatgtg

SEQ ID NO: 203435 - DNA, 601 bp, Human
ccaaagtgctgggattacaggcatgagccaccactcctggcctctgtgattatttggtcccaatcatatcacataacatatcacccaacaagacgacaacccccttcagggcagggcccagggctgatgcttctgtatttccacgttaccttgcaccatggtgacccaaaaaggtacatgcacccttcaaggcttgtgggctgaatttaaggggtctctgtgactggaaggggtgcaggcagccctggccatgaaaaggggctggctgctgccttgttctgcttattcctgaggcctgggrctaagcctttccaggccgaagaggcctccaatcagctgacctcctgtctagaacagaagctttgcctgagcctagcccctaagttatgattgctgagaagttctccccctcatcctgctgttttttatgacacttacgtaatcacagattatatttagtctacagcccaaggttggtgagatgggaaccacccagcacagcgggatctccttggaacctaaatccagtgatggaatcttattgtccacagtcttttgtggtatgtgctaccaccgaagatcctctcctaacctatcatgt

SEQ ID NO: 203436 - DNA, 601 bp, Human
tgtgtttttagtagagacacggtttctccatgttggccaggcaggtctcgaactcctgacctcaagtgatccacctgcctaggcctcccaaagtgctgggattacaggcatgagccaccactcctggcctctgtgattatttggtcccaatcatatcacataacatatcacccaacaagacgacaacccccttcagggcagggcccagggctgatgcttctgtatttccacgttaccttgcaccatggtgacccaaaaaggtacatgcacccttcaaggcttgtgggctgaatttaagggktctctgtgactggaaggggtgcaggcagccctggccatgaaaaggggctggctgctgccttgttctgcttattcctgaggcctggggctaagcctttccaggccgaagaggcctccaatcagctgacctcctgtctagaacagaagctttgcctgagcctagcccctaagttatgattgctgagaagttctccccctcatcctgctgttttttatgacacttacgtaatcacagattatatttagtctacagcccaaggttggtgagatgggaaccacccagcacagcgggatctccttg

SEQ ID NO: 203437 - DNA, 601 bp, Human
aggtctttccagcccatggtgatccataccccctctgcactctcaggacactaaatatctgttattatttggtgttttttgtttatttgttttgttttgttttgtttttttgagacggagtcttgttctctcacccaggctggagtgcagtggcacaatcagctcactgcaacctccacttcttgagttcaagagattcttctgcctcagcctcccgagtagctgagatttcaggcatgcgccaccacacctgactaattttttgtgtgtttttagtagagacacggtttctccatgttgkccaggcaggtctcgaactcctgacctcaagtgatccacctgcctaggcctcccaaagtgctgggattacaggcatgagccaccactcctggcctctgtgattatttggtcccaatcatatcacataacatatcacccaacaagacgacaacccccttcagggcagggcccagggctgatgcttctgtatttccacgttaccttgcaccatggtgacccaaaaaggtacatgcacccttcaaggcttgtgggctgaatttaaggggtctctgtgactggaaggggtgcaggcagccctggc

SEQ ID NO: 203438 - DNA, 601 bp, Human
aaaagagtggggcttcccggactcctctgggagaagactcaagcttcttagatgcacagaagggactgacccaggaccctgcagggttggccaagggctcgtcctctggtagcaggcgtctctgtctcttctgggaactccctttcatagtggacactgaaatggaagcaaggctgggtgaaccagagaaggctgctagctctctcggcatccctgcctctctggccccaaacatccttttccctcagagcctgtacaaggccaacctagtgtagcagccgtgactctagggctgacgttyccaccactgtgccccagccagccctgactctctaggaggaaggagtccagagcattcctgactccactcctttgctcagttgctccctctaccctttctacattctgttcatcttccaaggcccagctgcagcctcccagcctttggaaccctgcttctccatcttggccacacataggatcacctgaggagctcaaaggtgagtggtggctgagtcccacacccagcatctgtggtgaggcccaggcattgggatttgcagaagctccctggattatctaatgcacagccaaggctgag

SEQ ID NO: 203439 - DNA, 601 bp, Human
catttggggacctgcctctgttggccctaccctctctccacgccaggccatcacagggccaccactcaatgcagccactgctgtgacccagcccctggctcaccttttggatcagcagggctgtagctggtgctgagcacctggaagtattctccctggtgctcctgctgtggggtgtctcctcatgaagagaccctggtgtggagctctttctgtcctcaggcatggaggactccaccctggggcactgttccaaaggtacaaaagcaaagaccccgacaggggtgctggagcccaccartgagcaaaattccagatcatctgagggcaactcaaccaagatccacagaaaggggaggatggagggatcccgtcccttctgtactgttggacacattgctgccacagccttcccctgccatgatcccactccaagtatcaggccaggcagggtctctgtatggagtttgctcccaggcctctgccactgttacctggcagggggcaggaggtgcctggcctctgggcattgccctctgggtcagcagtcccttcagcatctccacacagggtttgctgtggggtcctgtatgcaagaagg

SEQ ID NO: 203440 - DNA, 601 bp, Human
gagtttcaccatgttggccaggctggtcttgaaactgctgacctcaagtggtccacccacttcagcctcccaaagtgctgggattacaggtgtgagccaccgtgcccggccgctagttagtggttttgagtaatggatttcaaatccatttaaatccagtttaaagtgtcctaaaggaattctgagatttttctaagtgtaattatagtgttacccttgtttaagcgaccctttcccgcagtttaaatatatatagttgtgcattagtagaatatgcttgtggggaacagagccagcatcygcaataacaaactcctggttagaaaagcatgacgtattgtttacttgagcatgaattgattgttgaatccaaaccaaacgggtgtatttattgtaaggatgtactttacattcatattgaatagcgtatgttatttgtttcttgaggttgagtttaagagacttgtaaaaataaaacgtatacatttcacctcccgttatggagaggattccagggtattcaagaaagatgggcatttgatactaggtttctaaagaaactgcagtgtctagatcactctgccgagcacagcattaggca

SEQ ID NO: 203441 - DNA, 601 bp, Human
taatttggagagcatatacagtgagtccatgcctttttcctgccatcagcattataccaaaattctgccatggtttttaaactttgattctgagaaagtttctcaccctaataacataactatatttgtgtttgtcttcatagttaaatatgcattatgatatcagcttgcatacattttttaaatgacttgaatatctgactttaaaaattattctagaatttctgtgcttcaatattaatgccagaagacttggaattgtttatttgtaggtaactgcctttaaggaaacttgaccaartattaactaagttatgtatttccttttggcaacagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggtaagagtcactactgccatgtgtgtgtgtttgtgtgtgtgtgtgtgtgtgtgagagaaacagacaga

SEQ ID NO: 203442 - DNA, 601 bp, Human
aaccataactttcttttcccagatctagtcttgtttatcacagacatcaacagcctggcatgtttagcctcacttgggctaggtgcaccccatcgtctcttgtacaagttctctttctttcttttttttttttttttttctggagacagagtctcactctgttgcctaggctggagtgcagtggcgcaatctcggcccactgcaacctccgtctcctgggttcaagagtttcctacctcagcctcccgagtagcttgggattataggcacacgccacgttgcctggctatatatatatatwttttttttgagacggagttttgctcttttggcccaggctggagtgcaatggcgcaatctcagctcactgcaaccgccacctcccgggttcaggtgattctccttcctcagcctctaaagtagctgggattacaggtgcacaccaccaagcccagctaattttttatttctagtagagatggggtttcaccatgttggccaagctggtcttgaactgctgacctccagtaatccacccacctccccctaccaaagtgctgggattataggcgtgagccactgtgcccagccgcccagctaa

SEQ ID NO: 203443 - DNA, 601 bp, Human
atgttggccaagctggtcttgaactgctgacctccagtaatccacccacctccccctaccaaagtgctgggattataggcgtgagccactgtgcccagccgcccagctaatttttgtatttttagtagagacggggtttcaccatgttggccaggctggtctccaacttctgacctcaggtgatctgcccatttcggcctcccaagagtctccagtctagtacgttgtcgtactcggtgttgtaaaatccaaacaagggtcagtttcccaggtaactgggaaattcccagaatcacactcyttcgtcatagtgctcatcctacaaaaaaggattgggggcattttgtctaaaattaaatgtaaatggtgatctgacatacaggtggaaagagaattgggaagttttgttctctcttctaccaacttgccacataatcttggccaagcaaagtaacttgttttttcttttaatctttttaaaagaaatagagacacagttttgccatgttgcccaagctggtctcaaactcctgcctgagctcaagcagtctgcccacttcggcctcccaaagtgctgagactacaggcataagccaccatg

SEQ ID NO: 203444 - DNA, 601 bp, Human
tgaaacactgtctctactaaaaatacaaaaataagctgaaatcccagctactcgtgaagctgaggcagagaattgcttaaacctggtaggcggaggttgcagtgagccgagatcgcgccactgcactccagcctggggaacggagtgagacttcatctcaaaaataaataaataaataaataaataaaataaaataataaataaagtaaaaagatctctcattgaaccagatgatatatgaagtctcttttaggaccaatttcgagatttaaaaaatttggcagaattactttttttttttgcagcggagtccagctttatcacccaggctggagtggaatggcacaatctcagctcactgcaacctctgcctcctgggttcaagcgattctcctgcctctgcctcccaagtagctgtgattataggcgcccaccaccaggcccagctgatttttgtatttttcagtagagttgaggtttcaccacgttgtccaggctggtctcaaactcctgaccttaagtgatccgtccaccttggcctcccaaagtgctgggattaggtgtgagccactgggctggcccagaatgacttttaaaaaga

SEQ ID NO: 203445 - DNA, 601 bp, Human
aaaaataagctgaaatcccagctactcgtgaagctgaggcagagaattgcttaaacctggtaggcggaggttgcagtgagccgagatcgcgccactgcactccagcctggggaacggagtgagacttcatctcaaaaataaataaataaataaataaataaaataaaataataaataaagtaaaaagatctctcattgaaccagatgatatatgaagtctcttttaggaccaatttcgagatttaaaaaatttggcagaattactttttttttttgcagcggagtccagctttatcacccwggctggagtggaatggcacaatctcagctcactgcaacctctgcctcctgggttcaagcgattctcctgcctctgcctcccaagtagctgtgattataggcgcccaccaccaggcccagctgatttttgtatttttcagtagagttgaggtttcaccacgttgtccaggctggtctcaaactcctgaccttaagtgatccgtccaccttggcctcccaaagtgctgggattaggtgtgagccactgggctggcccagaatgacttttaaaaagagatcagtaaggccaggcgtggtggct

SEQ ID NO: 203446 - DNA, 601 bp, Human
aaaccttgaaatacaaccttggctcaaacgttaatggtcatggataaagtgaattaaaacttgttaggggccaggtgtggtggttaatgcctataatcccagcactttaggaagctgaggcagttggatgtcctgaggacaggagttcaagaccagcctggccaacacagtgaaaccctgtttctataaaaaatacaaaaattagctgggcgtggtggcacacacctgtagtcccaaccacttgggaggctgaggcatgagaattgcttgaacttgggaggcagagggacttgggaggcasagggtgtagtgagccaagatcgcaccactgcattccagccagggtgacagagcaagaagactgtcaacaacaacaaaaaatgttatagaagtgaaaaaaattgattaatttagaacaagcttgtccagtctgtggcccaggatggcgtttaaatcagcccaacacaaatttgtaaactttcttaaaacattttgtgatttgttgttgttgtttagctcatcagctatcattagcattagtgtattttatgtgtggcctaagacaattcttccagtgtggcccagggaagctgaaagatca

SEQ ID NO: 203447 - DNA, 601 bp, Human
caaataatccgggagatccgtgatatgtgaatgtgctaggcctgagatgagacagccaattgtggaagagcaaacactagaaccagtataagttgcttactgctttcttatgctattaatgagcatatcgcctcctgatatttatgatatatggtcatgccaacagctttgtcataaatagaactcccatggcagcaatcacttaatcttgtagttagaggtggggtctcaccatgttgccgagctggccttgaacttctgggctcagcgattttctccacaggcacctgctactgtgctyggtgcagcactttgtgtttttgaacataacctcaagatgttattgtcttcatagtaaaacaaaagatgaggcttagaactggatcactttgcctgtctcttcttacctcctcccagttcaaaatgcttgcatctcttaatagctagcattcccttggattttgcacatgagctcaaactcaagcctcagcacaatcttttttatagttttagtcttttagccagagtcgacttaccccccatacccactctgcttccttcataatgctgctttccctgggcagagaatccttgcccttct

SEQ ID NO: 203448 - DNA, 601 bp, Human
atgagatttaatcttttataccaatatgtgtagctcatgatagctatataacctagaagatgaatttatgtaatatgatttgcaaaatgagtattcatttgtgatttttttttttttaaggtgaaagtacattttttgttgaattaagtgaaactgccagcatactcatgcatgcaacagcacattctctggtgcttgtggatgaattaggtaagacattaaacttctcatttgaagactatctatcttaaaaacatttgtacaaataactatttttatagaagattatctgaagtacatytaaacaatatgaatgtttttagagcacgcactcaccattgtggcacagaccgatagttggagataaaaggtgatattgtgaaaggtttttgattacccattaattattaggccttacactgtttagttgtaataaaacatttgttatactacggggatgagaacactaataggaggactcaggaagtttatgaccttgagcgatactgtattttctttaaaagaaacctcactccccatgggctgctaagcagactcgtgtagctaaacaaggcctatttatagaatgcttttagacgtg

SEQ ID NO: 203449 - DNA, 601 bp, Human
tgctcaacatcaataatcatcagaaagatgcaaaccaaaaccacaatgagatatcatttcacctgttaaaatggcttttatcaaaaaggcaataatggatactggtgaggatatggagaaaatgaaatcttcatacacaattggtaggaatgtaaattagtacagccactattggccaggggtggtggttcacacctataatcccagcactttgagaggccaaggagggaggatcgcttgagcccaggagttcaagaatcccatctctacaaaaaatgaaacaaattcgccaggcatgggkgtgggtgcttatggtcccagctacatgggaggctgagatgggaggaccacttgagcccaagagattgaggctacactgagctatggtcatgccactacactctaccttgggcaacagagtgaggccttgtctcaaaaagaaagaaaagaaaactgtggtacatatgcacaatagaatataactcagtcacaaaaaaatgtaatcctgtcatttgcaacaacatggatggaactgggggacattatattaagtgaaatgaacaaagcatagaaagacaaatattgcataatctcattcaca

SEQ ID NO: 203450 - DNA, 601 bp, Human
accgagatcgtgccactgcactccagcctgggcaacaagagcaaaactctgtctcaaaaaaaaaaaaaaaaaaaaaaaagagtatgcacagtatgagctcattttcacaaagtattaatatgtgtaactctatatgttgaaaaattctacagcagcactgtccaatatggtagtaaccagccacctatagctacttaaatttgaatttgttaaaactaaataaaatcataaattcagttcctcagtctcactagccacatttcaagtgctcaatttccacatgtagtggtactgtattagmcagtacagatacagaatatttccatcatcacaaaaagttcaaatggacagtgctgactgaaggacataaacattaaactactatcagtgatgtgtatgcactgtggtacaaactatggggaatgtttacattttatgttatatatttctgaaatgtttacttctttgataatgtacatgtattgcttttgtaatgagaaaataggtaaataaaataaacatttaaaaaagagagagaaaaagaagtaacatagtatgttagagaacagcaagaggtccactacagccaagctggggcgac

SEQ ID NO: 203451 - DNA, 601 bp, Human
ctcaggcagaaacctttgagttttattggactttttctcccatctcctggtgagttctacttcctgaatacccttgtatctatatcattgcttctgtctttttttcaggccctcatcaattctggtagcctactaattcagccccttgccaccaatttcaatcttctacatgctgtcagagggatatttgtaaaatatagatctgaacatcatgtcactgccttgttcaaagtcctccaatatagctttactatgtacacaaaacactcaaatctttcagcttaaaaaaaaaaaaaaaaamaaaaaaacagggctctgaatgatcttctcctcactggctcggcttccctggcctcatttcctctattctccctacacaccctttgacccagccacactgaattgcttgcagctcctcaaacacgtaatcctgtttaatgcctttatggtttcaaacacatcagggctagaatgctttctccctttctaaataacatctactcatactttaaatctcagttaaaatgtcacctattacaggaagccttctttgccccagaatggataaacgtcctttgtttatgttttcctctgtcttaag

SEQ ID NO: 203452 - DNA, 601 bp, Human
ccagctacctcaggcagaaacctttgagttttattggactttttctcccatctcctggtgagttctacttcctgaatacccttgtatctatatcattgcttctgtctttttttcaggccctcatcaattctggtagcctactaattcagccccttgccaccaatttcaatcttctacatgctgtcagagggatatttgtaaaatatagatctgaacatcatgtcactgccttgttcaaagtcctccaatatagctttactatgtacacaaaacactcaaatctttcagcttaaaaaaaaamaaaaaaaaaaaaaaacagggctctgaatgatcttctcctcactggctcggcttccctggcctcatttcctctattctccctacacaccctttgacccagccacactgaattgcttgcagctcctcaaacacgtaatcctgtttaatgcctttatggtttcaaacacatcagggctagaatgctttctccctttctaaataacatctactcatactttaaatctcagttaaaatgtcacctattacaggaagccttctttgccccagaatggataaacgtcctttgtttatgttttcctct

SEQ ID NO: 203453 - DNA, 601 bp, Human
ttgtttactgcatagtgcctggcacaaaataggtattaaagaaacatttattaagtacatgaatgaaacctcatcccagaactgtttaatatttcctccccacaatgttttctttaccaaccctatcatcgactgaaacactattccactggaaatgaacacggcactctcagtttctacactgaatgttctctaccttctgatataattacaacctggctcacaacgataccacctttccttggggtcaaataaaaatggagaatgctgatcattccactttccacataccataattctraaacaaagcagaggtgggtttagctttctccttgcacctactgctgcttctgctgcttccaagctactattcttttcatgcccttaagaacacttcctttatgggtcatgctatttagcttatttaccttctccttccacaatgctgtcttctagaatctctgtgtcacttccctacattctctgaataatctgatggtcttaagcttttgtgttgatgtagatgacttacactagctcaacagattccttaactaacgcaaatcaaattaccttcactgatctttacctctactccagc

SEQ ID NO: 203454 - DNA, 601 bp, Human
gttttaacgcgtaggtaaacaaagacagaatgaatatcttaaaagaatttggggagaaagtgacaaaggtctagttgtaaagacagagagagagaaacatgcatggcatcaagagagaaactaccaagtaagtacaaatgttgaaacagaaagactcattattgttctctatgttgacaggaaaaccaaatcacagagaagtaacttcatcttgctatgctataaaggggcctgagggttgggctaactactaactcagccaacagctgtgaaataggagtgagttgtgaaacagctactwtcctatttctttttctctgtctctaacataatgaaaatactgttcacaggagctctaccttgtcaattttgaaaagtacttatgtctcatatattgccaagctgttagtttaagtgaggggtgcaaactcaactgcctactagaactaggcagataacattagaaatgggctaagaataaactatagagaatggtaagaactgcagtcaacaagagtgagtttgcctcatccaaatggaacagctactattcagctctagctgtttattatcatgagaaaatagtctagtattgccagag

SEQ ID NO: 203455 - DNA, 601 bp, Human
gaacacttaaaggccattgcatggttattagttggcctaatttcaatattgttgtgtcttgaatccagaagactgaaaagatggagcaattatcttcatttctttccatattctgcattctagttctgtgatttcagccatcttagcctggttaagaacccttgttgaagaactagtactgtcatttggaggaaagaagacactctggcttttcaagctgtcatagttcttgcactcatttttatcagctgatgtttcttcaatctttgaagtcactgtcctttggatgtttttaaatttyattctatttgaggaccttggggtttgattgtggcaaaaggtgggttcagttgactgggttcatttctggaagattttaggaggccaagcctcagctcaggactccggaactccatgtgctaactctggatgactgctatcaagcctctgctttgttctttggctccttgaaattatgaacctgctgtgctagaagggccgaggtgctcacagaccgctggtcactacactctaatgagtggtaacagctaaagtgtttcatagggtgatggtagtgggattcatctttgtttgcatgtgt

SEQ ID NO: 203456 - DNA, 601 bp, Human
tccttcccccaatggatacactgatttaattgcaacacaaggatcaattccctttatgagaaatccagcaactcatggagaggcttctgcaccctggataagtatgaaaccaaccagattgtaaacaaaacatctgtagaaaaagcagaaacatccactcatcataatcccaactcccagcacagtgccataggatcaggaggaaacccccattcccagcttctatctcagaatggaagaagttggactgcacacctaacatcccaacttctccaggtgccacctgaaagactggcttctktctcacctgtttcaaagagttgaaagggtctggcatgtgatagtatcctgagggctacagagaagaaagtggcagtttcaactagcatgtaggcatgtaccacagctcctgtacctggctcaacacagggtagggggaaaatcccagttcccagcttctccctgggaagggaaaagagttggaacatgcacacagcattctaaattctccaggagctaccaagggaatggcttttgtgccacctgtctaggaacactgatgaaactggacatactctggatgcctgggggacactaataa

SEQ ID NO: 203457 - DNA, 601 bp, Human
acacctgcatcaatgaggttcttggcctgggcagcagtgaccactatggtgaaggaaaggaaaatgctcatgtgaaggttaaggtgggagcccagcttacccactcccaccacacatccttcagggcacaatcttgccttaccattgcctccaatgacttggagattagggtatttgtctttgatgtacttgatcatattgatctggaagatggaatttccctgggaagagtcctaggacaagaagtaagtctcagactgtgatgtggcagctgcccctattgccccaacccacctgtgtrgcagctcaccaaaaccactacatccacaccagcctgggcgagcaagtccagcctatacttgtcatcctcatgagtgccaatggctgccccacacagcagctgtttcttggcatctttggaggctagtgggtagtcccgattcttcttcaggtctgtccgggcaatgatggccacaagctcatcatcttcatttacaatgggcaactttcctgtggtcagggcaggacatgaatcaggaccctaggcattagttccaggccctttcccagctctaggacttacccttcttgctgcgctgca

SEQ ID NO: 203458 - DNA, 601 bp, Human
cttatttatttagtatttatttttcaatgaatgaatgaaactgtgatttgatagattttttttttttaagagaagctaagacaactggggctgggggagaaattggccatgcagaaggggaaaatccccttcctaagatcagcagccgattgtgcaccagctggtcggaggagagggtggaccacgcccctaggagctccgatgggatgggaaagacagccgggtattacctgttggaaaccaggtcttttctcttatccccttcccttgcttctttcctgggattgtcagtgaccagagrcaggctaacatcctggataataagtatggtgactcattttcatcaggaagagggacacatccaagattagcaagaatcagagcccctccttccctcccccactgcccaggttttacagccatttccaattgctcgcttatttcttgaaagacattttagaaacttgattggggtgagagtgggaaggaatgacgagtgtggtattccgcagcaaccgaccatgccatggcagtctccaaaagaagctttcaaacatttgttggaatgcatttgagtgattttggcaaaggttaaagagaa

SEQ ID NO: 203459 - DNA, 601 bp, Human
gtggtttaaaattccgacctctctgcctttccttgcagtgttgggaaggtgtggaaggatgctgccttgctgcttggtgcaggcgattcttcctagtgataaattggattcctcccaaatctctctgagccacacccagtgtcactcagggacttagtgaattaattaagctgagccattttacttaatataattgaagcttctcgttcttttttttttttttaatagtgattttcaccacaggtttccaaatttaaacagaaaaaatatttgaagggcattttctttcttttttctttcttttttttttttttgccaaattatctggacttgcagagaaccttagaaaattcatggtgagtctagaaagtgttcatttctggtgactctataattccttctaacccatgccagggcgcatacacaatgagccctgatctctcctgctgacagagtctgtgtaactctcttccccaccccctcccctaccaacccatgctgaggcaactggaataagaaaatgcagagttaattttctttcttgctgagctggcaaaactacagaaacctcctttgatgtttcaagctaaagggcagtact

SEQ ID NO: 203460 - DNA, 601 bp, Human
gatctctcctgctgacagagtctgtgtaactctcttccccaccccctcccctaccaacccatgctgaggcaactggaataagaaaatgcagagttaattttctttcttgctgagctggcaaaactacagaaacctcctttgatgtttcaagctaaagggcagtactcctgttcaccgagagggagagtggcttggggtctcctttgcctctgtcatagtgaaattgccagtgttattcctggggctgaattaatccacagacttcagaattttacctggccccataaggaagggtactggkgttctttcaggcaagaatagagcatatatattaaccaatcgtattgataaagtaagacaagtcttcctctattaatagttcaaagaatgcacataaccaggtcatctcaagagaaggtatagcagcatttaactattcacttccctattagtattaataaaggcattagggcaaccaagcagtggctgttgcaaaccaaagaagtgatttcatacaggaattctcccttttcaatttgtgaagtgtggtcaggtggcttttgtacctttgtaattaaatcttcataacattttcagaagt

SEQ ID NO: 203461 - DNA, 601 bp, Human
ctccctttagaacaaagttccaagtactctccaccctcattttctcctcttcttcactccccattcactattccatctagtttaatttggctttgattttcataatttcactgaaaaacatattctgaaagggtgtcacatccagtgacccttcattttacatcttatttgatgtctctttggcattttgtgttgttgtcaatccctgttcctgaaactgtccccttactgggtctgcatgatattaatagctctccttattctccctctcagataagaccctgctcagtctccttatagkcttctcttgctctcttcacccacctccccaaatctatgatctcctggatcataatcttcattcattccactcttctcgtttgactcactaatcctaggtgatctcatcaggtcatccacatccaaatctttagccacctgtgtgatttccagatctgtagatcagatgtctgtttttagcttctgatccatagttatcttggtctaagtgcttcatttcagagacaagtttgttaggtacaaaacccaactcagtgtcttctgttgtgtatcacacttgatcttcctcactacaattatt

SEQ ID NO: 203462 - DNA, 601 bp, Human
tattctgaaagggtgtcacatccagtgacccttcattttacatcttatttgatgtctctttggcattttgtgttgttgtcaatccctgttcctgaaactgtccccttactgggtctgcatgatattaatagctctccttattctccctctcagataagaccctgctcagtctccttatagtcttctcttgctctcttcacccacctccccaaatctatgatctcctggatcataatcttcattcattccactcttctcgtttgactcactaatcctaggtgatctcatcaggtcatccacrtccaaatctttagccacctgtgtgatttccagatctgtagatcagatgtctgtttttagcttctgatccatagttatcttggtctaagtgcttcatttcagagacaagtttgttaggtacaaaacccaactcagtgtcttctgttgtgtatcacacttgatcttcctcactacaattattgctctgatactgtccatccagcctcagagctctaggaacctgagagtaatcctgaatgtattttatttcaactcccatatccagtttctaaatcctttgattccttgattcttgtttaaa

SEQ ID NO: 203463 - DNA, 601 bp, Human
attccttgattcttgtttaaaagattgaataaatcctctgcttttctaccctgtttatataaataacctggcacagacttttcatgactactcatctggacaaaagcagtaactttctatgtggagttctaccaccacattgttctttagtttaccttgcaaataacaccacagctatctttacaaaatgcaaatcgggttttgttattttctttgttaaaatataaactcttcagcatcaatgacacaatctagttttgcctgcttttctagtgccaaattccaacagcccccctgctcttttttttttttttacctgatgacaccatgccaagatttcaggccttggtgccttcgcttgtactccactctctgcccatgttacccttccctctcagcctgaaatattcccactttccctgcaagagttagctctttgaagccattcttaaccttcctaattaagttttcttctaccttctttttgcccatgctgtattttgtactatctctattatcacttattgcactatttgacatttattttttcacattctggtgtctaccctgtgagcttcttggggaaaaggatgaaaacata

SEQ ID NO: 203464 - DNA, 601 bp, Human
gttagtgtttagtgggtgaggctatggaaggagaactttaagaaaaagtgtgtttcttcaaactttctaaaaagtacttatagacaaaacaggtattttaagctatgtctggcacatcttagattctcaataaatatttgttgaagtaataaatgtaggaagggagggagcatcatgatgggtcattaggggagatgttctgggacagacgaccatttctgattacttattcagcgtgggctttgtgtaaatgcaagctcagctctattggtccccctcacaaggtggatgtagtcaaagytcaattccctctcctgtctgcttagatcagagagacacacttgcagtcatttcattcaggtttagcacgggaatgtgatcttccagatttcctatccttaattatttacagatcttattttcttagatgttgtttgtttaatgtcctgtttcatgtctttgtagtggaataaatcctttccctgggttctagacctggttctgccaattgcttgtcatgtgatgttgggtaagtaatttaacctttctgagcctagtatattcatctgtgtagtgggtacataaaaagaacctccaaatc

SEQ ID NO: 203465 - DNA, 601 bp, Human
attggatttatattacagaaatgctactccttgacattagtcatctcattttgaatgttcttgaattaattccagcaataataaccacatttatctatttttagcaaattggcactttgtaaaatatttgctctaaatgtagaatattggtaattagccttacatccattatttataattccagttccaataactattcaaaaatgttattttaaaatgaaagttgggaagaccctaatatcctttcattaatgactagataaaagagctagatgaggcaaagaaaaaaaataaacaaaaygatctccaaaggttaagcaaactcagaaatcggttgcttttattaagtggctgcagaacttcttagtcagcataactaggcttgactggaacctgtgaggatgcatatcctcttcctattcttactttgctttgattccggaaccaatttatctgcttggaatataagctgagaattaaattcctcttaatggccaaactagttcctataacagctgtttccaagggatttattctacaggtctacacaaattttaatagaggcaattgtctcattatttacctaaaaaggaaagaaaga

SEQ ID NO: 203466 - DNA, 601 bp, Human
atgaggaaggatctcttcagcctaggaggtataggctgcagtgagctctgatcacaccactgcactccagcctgggtgacagagcgagactctgtctcaaaataaataaataaataaataaataataaaaattccccagtttctaaataattaacttgcagttagatttatttgtccatgttgtactgagggtagcccactttggttgtccagactcttactaacattccagtggggaaaggaataagcattgagttatattttgcatggacattgcatttcggtctttaaatcaattttraaaagtattattttatttgagagatgggaaggaataagagacttcataagggagaatgatattgtcttacttaaaaaacaccaattctttctttagtaaaatccaaactgggagtttgatctattcaaacgtcatttttttttcctgaaatgcaacatctgcaatatttccttaactctcaaggacttgtttatcctaataaaagagaaggaaattgttttctctatcacctgggaaagttactctggagaactcaggttggtattaaatattcatttgaaaaagtctttcacgataatc

SEQ ID NO: 203467 - DNA, 601 bp, Human
acattctcagtttcccagctcataacagaaataattgattactctccttctgttataaaagtcatactatcagttaccaaattctttttgtaatgtatttcacatatgctcttttcatcttctgccagtctttcttaaccagcattccagaagagagccaaacccaacccttaaagccctaaggccctaatgtccatatgtatgtaatgagttaatccctctcttgtgcatctagatgggtaccagttatataccatccttggaagaagagaaaatagtcactcattttcatgttctgtgkttcagatgagaaactccaggtgaaaaaaggctggacagttaccaaaattctctacatattgcctgctggctaatcttacgtttaatcccccctttccccaaatttcaatggtttctctttgtttacaaggttaattctaatttatttacttatggttgtgtttcaaggctccttaggatctattaccaatttcctattcttgtcttatctcctagtggctctggcattgactaggcttgtgaatttaaataaatttagtctctctcagttgtcatttccttttacgtaaaacgaaagtat

SEQ ID NO: 203468 - DNA, 601 bp, Human
aaacgaaagtattgaatgaaatcatctctaaggctttccaacttttaacaaacatgttctatagcaaaatgcctcttttacttggatattctgtcccacccagacttagtataaatttaagtattaattttcctataattttgttcattgttaccgccactacttgaaaagtccccttttgggcctagctcaatcttgcctaaactccgggccctgaatcaagacttatctcatttgtgagggctttcctgactaacacagttctccatgacctgttttgcctcttagatcttttgcagcwcatactacctgtcctttgctttggcattcatcaagcagagccttaaccatccatttgcgtttttatgtacctgattctgccaagtagtttgcaaactctttaagggtaagatatccagtacagtgcatgactcaagaaacacatattgtatctactctgtgataagctctgtattagactctaagggaatgtacaagccaaataatttctcagaaagacaggtggaaccatcttgcattacctctctgggacatttgacatcatgaaacataccttgcctcttgaatctctttattttct

SEQ ID NO: 203469 - DNA, 601 bp, Human
taaaaatctttgatagcatcccattccacgtagaatcaaaaccaaacttaatacaaggcctaagaaatcctacattatccaggctttgcctccttttctagtttctgcttaacaaccatgcgcctcttggtcaccaagtctgttggcctctttttagtttttaaaacacataaaacatgttcacacttcaaggcctttgcatgtgttgctccctgtgcacagaatactctttctctggctctttacttgagaagcctttccatctgagtggtgtccaagtcactctctaacacatcacacttttttttttttttatctttttgggatgctctcaatctgattttttttaaaaagtatttacttttcaatattctggtcactgcctatctcttcaagctttaaaacccacccctcttcacatcccagactctattgcaattgtgttatttcatggaatggtccatattatttcatcctttctctctttctaaacactgttccttttgtctgtaatgtcttccttcctctccttttctacatgacacatttcctgtttatttccgtgataataaacaggaaatatgtggctgcagttattttc

SEQ ID NO: 203470 - DNA, 601 bp, Human
gtttcttcttgtatagatgtgactatcaacaagccttggaggtttgggggataaattttgtaaataacagaacatccatagatctaaagacttaagtaccacaactccaaaagatttttaagaattaaatgttaatatttataactatgcctgccacatagtaagcacttaacattagttattacttgttattgttgatgctgttgttgataatgatattttatctacattaagtgagtcatatacctaaatagctttttgtggtgattcttaaaggactagtttctggattttaggggtmtatgtgtgtgtttgtgtgaatgtatgcatacacatctgaagttcaatgaaaatacaattgattaactgagaaatgagttatgaatgccactgacttaaactttgcatgtcctatgctctcaacactctttaatgctaatatacattgtttcttgcagtcttggaactcagaggtgtaattagccttatcttacagatgtggctaataaaggttgaataaaaatttcaggctgcctctacttagaaaccagagaggctcatcatttgcaaggagctgaaatgtagacatctcaatacctag

SEQ ID NO: 203471 - DNA, 601 bp, Human
gaatgaaaacttaactcagtttagttttgtttgcatacacaaatcaagcattggaataaatcttaagagttaaaatgaaataactatatttgtaaaatgcttagaaatatccccagaaaaatatttcttaaggctcttcatcattggctgtggcaagatggaaggcatttcaaggtctcacaaaataaaaagtaaagtagcatgcaaacatatgcagacacaaaactcttaactccggaattttagggattttttagatttctagtttgggtttaagataatggtcaattgtcacttattrgaactttgatttagtaataattttaaaaaattaagtgttggactaagttttaaaatttaaaatatactcctataactaaaccatattggattatgcctcttgccaagattattcttaaaccatgatctaagaatctcctattattctttcactgtcaggatccagaaactcagtgccaagggtaagtcagccttagataaacagattgtctggcctaggccaccaatctgtccaacatttgtgacctataaagatttttttttcctgcaagcaactctgcctatgccaactgtttatatg

SEQ ID NO: 203472 - DNA, 601 bp, Human
ttgcagactttttgaagaaaaatgggtcattttcagtgcctatgacacatgaagaaaagtctctgccaatacatgtggtccatgatcctttcaatttggctaaccagttgttttgtagtctaggctgtatgacagtgtgacaaggctcgtcatggaagtagtccttcttttacgcaatactgtgggcccttctgcagatctacttgcattccatttttatttccctaattcttggactgctggctgtatacctcaaccttcttttctgcttctgactccttcaggtagaccctatctgatrtgctgtcctcgcctctgagactgggactcctctgtccactgggctctttgtcctgctctgttctctagctttggacaccatcttcagcattgaactccattgtcctatttcaaacccactgcaccctataagccaggagaatccccctaacttgccctatgatgtgtggagaaataaatatgattataagatttctagcttagatttactggaatggatgggctattggcagaactgataaaaggaagaactgatttggtgaggaagacaatgatttttatttccagcatggccagcatg

SEQ ID NO: 203473 - DNA, 601 bp, Human
ggagaaataaatatgattataagatttctagcttagatttactggaatggatgggctattggcagaactgataaaaggaagaactgatttggtgaggaagacaatgatttttatttccagcatggccagcatgaggaaaacatccagaaagaaatcactaattgaaggtccagaagtggaggcagagggtacagggggcacatgactcaaaggctgattgagagcttattcatcttcgtggcattagttgaggaagggttagaaagaaaagagctaagagaagggcttactcacccttcartggcagaagatacttcattcagagaaaaagaaagagcagttagtaaaagcatatgggatcagggaagccaacaaaaagaaagctctaaaataaatggtcagtactattaaatcagagtgattaagaaggatgacaatggagaatagaccattgaatataggaataaagagaccattgataatctctgagtgggtagtttagttgagtagtgaggatgaaagccagagtttaaaggcttagaagaaggttgaagtagaagaaatacagataactggcatagaccacaaatctagaaatttg

SEQ ID NO: 203474 - DNA, 601 bp, Human
aaataaatggtcagtactattaaatcagagtgattaagaaggatgacaatggagaatagaccattgaatataggaataaagagaccattgataatctctgagtgggtagtttagttgagtagtgaggatgaaagccagagtttaaaggcttagaagaaggttgaagtagaagaaatacagataactggcatagaccacaaatctagaaatttggtattcctctcagtcaattcctgctactacaaaaaaaaatcacagattggttattagtaacagaaatttatttctcacagttctgtaygctgatccaggcaccaacaggtttggtgtctagtaaaggcctggtctctgtctccaagatggtgctttactgttgcatcctcacatggcagaagggcaacaaggaataaattcactttctcaagcctttttatgaggacatttgctgagacctcttgacctaatcacctccgaaaggccccacctcttaatactattgcattagggattaagtttcaacttgaattttgaaaagacacaaacattcaaaccataacagtgtcgaatggagaaagagaaatgagattgtaataaaaagatg

SEQ ID NO: 203475 - DNA, 601 bp, Human
aaatcaatgtgacagtaaagaagggataagttcaaatgtttagatctcagcagagttccttatggagaaatgatacagctttgaaacagaaaggaaaaagaagaggacaagaaatgtattgaaatgggatggtttatattcaggggatcctgtcaaaatcctgaattttgatgctgcatgtgatgattcccacctttaatcccagctactcagtagggtgaagcaggagaattgcttgaggccaggagttcaagaccagtctgagcaatatagtgagaccctgtctctaaaaaaaaaaaagaagaaagaaagaaagaaaaagaaaagaaaagaaaatcctgaaaccctgaaaccctcccctcttttttccctcagtgaagaactttggctggctgttcagaggaaaaatgggaaagaaaaaccttcaggggagtttactaactgacaggaatgaattagacagcactttcccaagtgttctatggatcacctgacatagtgtcacctggagaaggtttttaaaatgatctctggaggagacacttcattcacaagctcctcagatgattatgatgcttgcaaacgtccaggagtgagtgcc

SEQ ID NO: 203476 - DNA, 601 bp, Human
tccttccaaacatttaccattgaaactgagtccatcacctttccccaaaatccatctttccctttgaattctccacaaataaactgtaccgctcatttaattctgaagatattatcttttttattatttatttaattctttcatttgttgttaccatatttaaacagtaattattttgagggaaagaatcgtattttctacatctctatattcctgtattcctgatgattcttatccagcattctttttttttttttttttttttttttttttgtgatagagtcttgctctgttgagtctygctctgttgtccaggcttaagtgcagtggtggcaccatcataactcaccacaccctcaacttctgggatcaagcaattctcccacttcagcttcccgagtgactgagactacaggcatgtgccaccatgcccagctaatttttaaaaacttttttgtagagacaggttctcgctcttgcccaggctggtctcaaactcctaagttcaagtgatcctcccaccccagcctcacaaagcactgggactacaggcatgagcctctgcacccagcctcctatgcagtgttcaataaatgatttt

SEQ ID NO: 203477 - DNA, 601 bp, Human
accatatttaaacagtaattattttgagggaaagaatcgtattttctacatctctatattcctgtattcctgatgattcttatccagcattctttttttttttttttttttttttttttttgtgatagagtcttgctctgttgagtcttgctctgttgtccaggcttaagtgcagtggtggcaccatcataactcaccacaccctcaacttctgggatcaagcaattctcccacttcagcttcccgagtgactgagactacaggcatgtgccaccatgcccagctaatttttaaaaacttytttgtagagacaggttctcgctcttgcccaggctggtctcaaactcctaagttcaagtgatcctcccaccccagcctcacaaagcactgggactacaggcatgagcctctgcacccagcctcctatgcagtgttcaataaatgatttttattaagacgtttcacctaagttcctaatattttgcatatacttctcactgtggtaatttttgaaagggttgacagattttgatgaaaatgaatagatatgaagtgtaattttggttcagaccaccgtcttgagacaaaatagtagctacta

SEQ ID NO: 203478 - DNA, 601 bp, Human
attttgagggaaagaatcgtattttctacatctctatattcctgtattcctgatgattcttatccagcattctttttttttttttttttttttttttttttgtgatagagtcttgctctgttgagtcttgctctgttgtccaggcttaagtgcagtggtggcaccatcataactcaccacaccctcaacttctgggatcaagcaattctcccacttcagcttcccgagtgactgagactacaggcatgtgccaccatgcccagctaatttttaaaaacttttttgtagagacaggttctcrctcttgcccaggctggtctcaaactcctaagttcaagtgatcctcccaccccagcctcacaaagcactgggactacaggcatgagcctctgcacccagcctcctatgcagtgttcaataaatgatttttattaagacgtttcacctaagttcctaatattttgcatatacttctcactgtggtaatttttgaaagggttgacagattttgatgaaaatgaatagatatgaagtgtaattttggttcagaccaccgtcttgagacaaaatagtagctactaaatgtactgacaggagaatt

SEQ ID NO: 203479 - DNA, 601 bp, Human
gatgattcttatccagcattctttttttttttttttttttttttttttttgtgatagagtcttgctctgttgagtcttgctctgttgtccaggcttaagtgcagtggtggcaccatcataactcaccacaccctcaacttctgggatcaagcaattctcccacttcagcttcccgagtgactgagactacaggcatgtgccaccatgcccagctaatttttaaaaacttttttgtagagacaggttctcgctcttgcccaggctggtctcaaactcctaagttcaagtgatcctcccaccscagcctcacaaagcactgggactacaggcatgagcctctgcacccagcctcctatgcagtgttcaataaatgatttttattaagacgtttcacctaagttcctaatattttgcatatacttctcactgtggtaatttttgaaagggttgacagattttgatgaaaatgaatagatatgaagtgtaattttggttcagaccaccgtcttgagacaaaatagtagctactaaatgtactgacaggagaatttctgtaacttattaacagtggattccgtacaattttatatacctctgcaac

SEQ ID NO: 203480 - DNA, 601 bp, Human
taagcagacactcaaatgagagggaaggcagagctaaaacttcaagactgggtttctctacctcatctgggagaatactgacaacagggcatataaatttttgtctttttgcccaaaatatgaggtactgggctaggtgcggtggctcatacctgtaatcccagcactttgggaggctgaggggggcagataacttgaagtcaggagttcaagaccagctttgccaacatggtgaaaccctgtctctactaaaattacaaaaaaattagctgggtgtggtggcgcgtgcctgtaatcccasctacttgggaggctgaagcacaagaatcacttgaacctaggaggcggagggtgcagtgagttgagatcttgccactgcactccagcctgggcgacagagtgagactctgtcttaaaaacaaaataaaataaataaaaaggtaatttttccaatgtcaaaggagactagaaaaagtttttgaagaatggtgtctgcccctactttgtgtggcggggtgaaataccactatttcaccaagggtaacctgcgcctcctaaaacttttatttctcccaagactaagtttacagattcttagaat

SEQ ID NO: 203481 - DNA, 601 bp, Human
aagcagacactcaaatgagagggaaggcagagctaaaacttcaagactgggtttctctacctcatctgggagaatactgacaacagggcatataaatttttgtctttttgcccaaaatatgaggtactgggctaggtgcggtggctcatacctgtaatcccagcactttgggaggctgaggggggcagataacttgaagtcaggagttcaagaccagctttgccaacatggtgaaaccctgtctctactaaaattacaaaaaaattagctgggtgtggtggcgcgtgcctgtaatcccacytacttgggaggctgaagcacaagaatcacttgaacctaggaggcggagggtgcagtgagttgagatcttgccactgcactccagcctgggcgacagagtgagactctgtcttaaaaacaaaataaaataaataaaaaggtaatttttccaatgtcaaaggagactagaaaaagtttttgaagaatggtgtctgcccctactttgtgtggcggggtgaaataccactatttcaccaagggtaacctgcgcctcctaaaacttttatttctcccaagactaagtttacagattcttagaatt

SEQ ID NO: 203482 - DNA, 601 bp, Human
acttgtccacttatccagtagatgaaaccgcaaaggaggagagtttatctgaaaagttcttctctggagaaagatacttagaaaatacaaatggtccttactaaagaccccagctcatcccaggaagatctgaggaaaagatgagcagacccaatgctacttcagctcacctttcttagcagtcttttttttaaaagctctgttttaattgaacactatgttcctgagtcagaagagtgcttcagtaaatctgccttcctggggcacaacgaatcacacacagtcacactttcagaaaggygaatcctgccaaacgttggctggacaaaagatggctttttttctcctccagcaaaaattactcaaattgcttgagaaagaaacacagtatgtttatccctgtttacagatatttagctagtgccccttcagagggtcatgttcctataaacagcatcatgataattatatccactgctgcaaagaacagatgtgtaaattggtggtttcttgggggaaaataataccaagtccattttccagaaatgtacacagtacagtgcagctgtaacattctgtgcagaggtctcattagtgtcta

SEQ ID NO: 203483 - DNA, 601 bp, Human
actcaaattgcttgagaaagaaacacagtatgtttatccctgtttacagatatttagctagtgccccttcagagggtcatgttcctataaacagcatcatgataattatatccactgctgcaaagaacagatgtgtaaattggtggtttcttgggggaaaataataccaagtccattttccagaaatgtacacagtacagtgcagctgtaacattctgtgcagaggtctcattagtgtctattactgagtgaggtgatttttaaagaatatggaaattcacggggggcatctagcagggargtccagagacacctaggaaatgattcagatggtttggtatatttaaaaatttctagtgatactgggcaaatctccacatctaaagaaagtagtaataaatctttgattataaagttttccaggcaagaaatatgtatgagtagagggtaggattaggaaacttctcatgccccacacacctctgagatctgtgtaacttaggtatagactaaactttagtgaggccaggttgcatcaaggtggtcaaattttcgatctgtgaacaccagaatatttctaaactcattgctgaagggtctg

SEQ ID NO: 203484 - DNA, 601 bp, Human
ttcattgaatactataatattcaatgacattatgcaaaactggggcattttgcttctgggacagaaaagtataaactatttcttttaagctatgcttctataattccacacgaactacccaggaggatcaaagcatgttagaatgactgaaatacaacaggaacagtctagtctgttaatctggatttttcaggcctgggatggaaggataataaattgaggcctgccacatgccttaggccaaagcatgcctttgacactaatgatctaattcagttatctactttgtccaaaattcagycttctcatactctgtgccctggggacataaacaaaaacacagggggtgatgaggtagccccagctctatctggggctctactgactcactctcttggtctcagtttcaagggctatgaaatgtcatggtgtgatggtctcttctaggccttgtgtcttatgttcagtgggtctatgcatgctggaatttagaatagtgattcttggtcatttgtgtgggatagcggctgctgggtatccacttgacttgaaagtaaagaggtaatggggtagaaatagaaaattctgaattgtttaatat

SEQ ID NO: 203485 - DNA, 601 bp, Human
atccaaaatgtaactgaaattctatatgtttgcaatggaaacatagaagaaaataatgttactgggcttcggagtgtaatagaaccatttcctcatatataatttcattaaaaatgcaaaaatataaaaaactatatacacacgtacttgcgtataatttcccttttctagtctacaagtattatggtagcccaccctcaacagtactgagaatgaaaattatagcaaaactcttttgtattagttacttctgtgtcataatgagagtctcaagataaatgaaaggagggatggataaaaygatttcttatgatgggcaaaggttggaagaaacatcatgtggggagagggcaaagagaaaacagataaaaagagaataaaagaggaaatgagtggcttatgtgagcaagcgatgagctaaagtggaagtgtaggagaggtgagttgcttaggtctaaggagaaagactgcttaggtgtgtgttcacccccaggacgaagaaaggaacactgggtgagattttgttcaactacccatagttaccaccagatggtgaaactgatcccgggcctcttgggtattgatcagtttatggggagat

SEQ ID NO: 203486 - DNA, 601 bp, Human
cacacgtacttgcgtataatttcccttttctagtctacaagtattatggtagcccaccctcaacagtactgagaatgaaaattatagcaaaactcttttgtattagttacttctgtgtcataatgagagtctcaagataaatgaaaggagggatggataaaatgatttcttatgatgggcaaaggttggaagaaacatcatgtggggagagggcaaagagaaaacagataaaaagagaataaaagaggaaatgagtggcttatgtgagcaagcgatgagctaaagtggaagtgtaggagargtgagttgcttaggtctaaggagaaagactgcttaggtgtgtgttcacccccaggacgaagaaaggaacactgggtgagattttgttcaactacccatagttaccaccagatggtgaaactgatcccgggcctcttgggtattgatcagtttatggggagatggggagaagactatctttcacttgttaattcattaatttctttcgcaaatattttttcagtacctgctaagtcccacggactatgctaggagctgctgttaaaatgacaaaccagataaggtcactgcccttaatcaa

SEQ ID NO: 203487 - DNA, 601 bp, Human
tattagttacttctgtgtcataatgagagtctcaagataaatgaaaggagggatggataaaatgatttcttatgatgggcaaaggttggaagaaacatcatgtggggagagggcaaagagaaaacagataaaaagagaataaaagaggaaatgagtggcttatgtgagcaagcgatgagctaaagtggaagtgtaggagaggtgagttgcttaggtctaaggagaaagactgcttaggtgtgtgttcacccccaggacgaagaaaggaacactgggtgagattttgttcaactacccatasttaccaccagatggtgaaactgatcccgggcctcttgggtattgatcagtttatggggagatggggagaagactatctttcacttgttaattcattaatttctttcgcaaatattttttcagtacctgctaagtcccacggactatgctaggagctgctgttaaaatgacaaaccagataaggtcactgcccttaatcaacttacagttgggtgagaagctatcaggtacaagtatggccctagaacaaattagtcttttctagttaataatcttatgtgatgagatttggccttgctcc

SEQ ID NO: 203488 - DNA, 601 bp, Human
taaaagaggaaatgagtggcttatgtgagcaagcgatgagctaaagtggaagtgtaggagaggtgagttgcttaggtctaaggagaaagactgcttaggtgtgtgttcacccccaggacgaagaaaggaacactgggtgagattttgttcaactacccatagttaccaccagatggtgaaactgatcccgggcctcttgggtattgatcagtttatggggagatggggagaagactatctttcacttgttaattcattaatttctttcgcaaatattttttcagtacctgctaagtcccayggactatgctaggagctgctgttaaaatgacaaaccagataaggtcactgcccttaatcaacttacagttgggtgagaagctatcaggtacaagtatggccctagaacaaattagtcttttctagttaataatcttatgtgatgagatttggccttgctcctttggtgacttgcctcaaggagccccaggcaaaaccaatgtaacatatattaataatatatgaaataatatattttgtagacacaattgccttatgttgtccaggctagcctcgaactcctgagctcaagcaatcctcc

SEQ ID NO: 203489 - DNA, 601 bp, Human
gactgcttaggtgtgtgttcacccccaggacgaagaaaggaacactgggtgagattttgttcaactacccatagttaccaccagatggtgaaactgatcccgggcctcttgggtattgatcagtttatggggagatggggagaagactatctttcacttgttaattcattaatttctttcgcaaatattttttcagtacctgctaagtcccacggactatgctaggagctgctgttaaaatgacaaaccagataaggtcactgcccttaatcaacttacagttgggtgagaagctatcagrtacaagtatggccctagaacaaattagtcttttctagttaataatcttatgtgatgagatttggccttgctcctttggtgacttgcctcaaggagccccaggcaaaaccaatgtaacatatattaataatatatgaaataatatattttgtagacacaattgccttatgttgtccaggctagcctcgaactcctgagctcaagcaatcctccccacctctgcctcccaaagttctgggattacagacgtgagccgccgtacccagccaaaaatgtttattttgattagatgactggtatt

SEQ ID NO: 203490 - DNA, 601 bp, Human
cttgctccccgaacacccgggagttcgctttcatttttaacgaatctccacaatctcttgtttgggagataattgcttctttcaggggcttggagaacaaaagcgtcagcccagggccccaggtctctccgcgggaggagggcacccaggggcgatgcgccgggctctctccttcgcccttcttggcccgctcgccttcagctcccacccgcagcagcaaccgcagcctgcttccggggactgagcagccctgggtcagccaaggttaagcagcgggtggggaagaggagagaaagctggrtcaattggaagtaaccttcttgtaccgcccactttttccttgcttggaggcggcaaaaagcactttagcattcttcgggctgtttgcgcctctttctctaacagggccaggggagtggaagagcggccggcaggaaggtttctttgtcagcaaaagcggacctttggaaactaaacagcaatgctctgtctttagaagacagcacaggaaggaacaaacagctgaggagtgaaggccagagaccccatttggaaaacaatggcctttcatgattattactatttttaaaaagttttctag

SEQ ID NO: 203491 - DNA, 601 bp, Human
tccccgaacacccgggagttcgctttcatttttaacgaatctccacaatctcttgtttgggagataattgcttctttcaggggcttggagaacaaaagcgtcagcccagggccccaggtctctccgcgggaggagggcacccaggggcgatgcgccgggctctctccttcgcccttcttggcccgctcgccttcagctcccacccgcagcagcaaccgcagcctgcttccggggactgagcagccctgggtcagccaaggttaagcagcgggtggggaagaggagagaaagctgggtcaaytggaagtaaccttcttgtaccgcccactttttccttgcttggaggcggcaaaaagcactttagcattcttcgggctgtttgcgcctctttctctaacagggccaggggagtggaagagcggccggcaggaaggtttctttgtcagcaaaagcggacctttggaaactaaacagcaatgctctgtctttagaagacagcacaggaaggaacaaacagctgaggagtgaaggccagagaccccatttggaaaacaatggcctttcatgattattactatttttaaaaagttttctaggcttt

SEQ ID NO: 203492 - DNA, 601 bp, Human
ttaagcagcgggtggggaagaggagagaaagctgggtcaattggaagtaaccttcttgtaccgcccactttttccttgcttggaggcggcaaaaagcactttagcattcttcgggctgtttgcgcctctttctctaacagggccaggggagtggaagagcggccggcaggaaggtttctttgtcagcaaaagcggacctttggaaactaaacagcaatgctctgtctttagaagacagcacaggaaggaacaaacagctgaggagtgaaggccagagaccccatttggaaaacaatggccyttcatgattattactatttttaaaaagttttctaggctttttcatttgaactttccatttctcactatgaaatgcaggttctatagacaattgcacacaagtttctttttcgggggggagggtaaacgaagcaggtggaaagaagtgagatgattgtagacgtggccaaatttagacttggtgtgagatttcctcttcgcttggaaacacatggcaccagcatgcatttgttcattcattcaataatgtgaatgaacattaaacactacgatgtgatgggctttgtcacaggctgtaagt

SEQ ID NO: 203493 - DNA, 601 bp, Human
aaaattaaaataaaatattagagagagagaaaagggaagaggggcaaggtgtcaggcagcaagcttcttagggtcagaatgggtccccatccctaaaagctgatgactgaagagacccacgagggtagacgagctgtagagagacaatactgcatctgccagtgatgagtgtaggaagctcatgagggttagaaccttccctctctgttttctgacctctttttctttttaaataggttgaagccaactgtggtagaggataacagtgattcgcgtatcttatttatttatttttagcagscccctcccccgcaactaggacagtgagttccattcagattttcaacacagctaaaaacttggctttaaaacttgtgaagggagacatttctttagaatctttcacttttttcatcgcagaggctttgggggaatgtttagctttttgctgaatcatgaagggtttgttactgcattctgagagggtaggaattagatgcctaaaggatggtgtctgctttcctgttgaggtggtttatttaacagttcatagaggcatgcaggtcaagtcatccttaactgtacagagtcaagggtattg

SEQ ID NO: 203494 - DNA, 601 bp, Human
acccaaagggtggtttgacttggctttgctttgtcaagcccaccgggctttgatatgactttgtttttgtttgtttgtttgtttgtttttgtttttttgagaggaatctcgctctgtcgcccaggctggagtgcagtggcgtgatctctgttcactgcaagctctgcctcccgggttcacgccgttctcctgtctcagcctcccgagtagccgggactacaggcacccgccaccaagcctggctaatttttcgtatttttagtagagatggggtttcactgtgttagccaggatggtctcratctcctgacctcgtgatccacccgcctcggcctcccaaagtgctgggattacaggtgtgagccaccgcacccagcaatatgactttgaatcgcaagtttggcttggggagaaactagggctttttttttttttttttttttttttacctgggagctgtcaaattgcaaaccacagggcatgctcacaagagaagtgggaagatagggaccatttcatgaatttctcaaatgccaaagcaatgcatattttcttagcttgataagcaatgggaatgtctaaagtttgtttttggtggggg

SEQ ID NO: 203495 - DNA, 601 bp, Human
aggctggagtgcagtggcgtgatctctgttcactgcaagctctgcctcccgggttcacgccgttctcctgtctcagcctcccgagtagccgggactacaggcacccgccaccaagcctggctaatttttcgtatttttagtagagatggggtttcactgtgttagccaggatggtctcgatctcctgacctcgtgatccacccgcctcggcctcccaaagtgctgggattacaggtgtgagccaccgcacccagcaatatgactttgaatcgcaagtttggcttggggagaaactagggctttttttttttttttttttttttttacctgggagctgtcaaattgcaaaccacagggcatgctcacaagagaagtgggaagatagggaccatttcatgaatttctcaaatgccaaagcaatgcatattttcttagcttgataagcaatgggaatgtctaaagtttgtttttggtgggggtcggggggaaggggaagggcatattgtaatgaaaccacaattctattttagcttactctgataaaatatgttgcacagagtggaagacagactaaggaagagagcttcttagattgaatgtt

SEQ ID NO: 203496 - DNA, 601 bp, Human
ctgggattacaggtgtgagccaccgcacccagcaatatgactttgaatcgcaagtttggcttggggagaaactagggctttttttttttttttttttttttttacctgggagctgtcaaattgcaaaccacagggcatgctcacaagagaagtgggaagatagggaccatttcatgaatttctcaaatgccaaagcaatgcatattttcttagcttgataagcaatgggaatgtctaaagtttgtttttggtgggggtcggggggaaggggaagggcatattgtaatgaaaccacaattckattttagcttactctgataaaatatgttgcacagagtggaagacagactaaggaagagagcttcttagattgaatgttatagtgttagcttttattgtcagttttaaaccttaaaatatgagaatagtacttctaggtagaatttctgacatttggtaaaaggagaatcttcgtctaggtcctccctgcatacccactgcactatcgccaccagctacttctgttattgccttgattctctgcagtgatttaaaccttctgttgtatgtttcttgggtgcttccatatcttccatatcat

SEQ ID NO: 203497 - DNA, 601 bp, Human
tttccaaactaaataaaagggaattttctttctttgatggctccaaagggttcggtgtttctccctgcagaaccacaaagtgggaggtgtgctgctgctttgtaccatgaactacacagtcatcaaacatatacattttctccacaacctatgctgcataaataatatgatactttctgagtatcattcgattcagagcaatttgtacggcatgcgtgaaacagttctagatggggtttccttatatacctcactacaattgtgaaaaaaaggaacacgaatagttggttcaagtaaaaarcaatgtttaattcaggaactcaggctgaatttaaatcctcacactcaggaataaatcgcagaaccttctctttaccacctgctcaatcccttccttctgataagaatgcataaggttgactctagtccattcatctgcttttctcatttattaaatagccatagttcctgacctgatgccctctccctccctcttctcccagtattgctttccctgctctctgatatttttctcttttgctttcagaattaaaagggaacctggtctctgggttgttttcaacatctcaagtgtgaattt

SEQ ID NO: 203498 - DNA, 601 bp, Human
cagtcctgaaaaaaggcattcagttatttttttctacatgtggaagaatacaacaacataccttctagaatcagggagaaatgtacttgctctttttatttttttttaatttctcaaatactgttctataaggataatcactcacctggtgattaatgtagaatgttaaggtgtgtacaaattactgctgataggtaacactgtccttgcaaaatcatcccatgtgcccccctcaaataaataagtatacttcaaaaagcagtgtgcttgctatacaagtgcagttttaagaaaaatcacycagctctctcttgcaaacatgttctttcccctaatgcctcctacacagagattctggagccacccccttcagaatatctgaaatatagaccaattttgctcgttaaaactacttcaagtagtcctagagctgatattaggattgctacttattcagtcatacttttcgagtgttcattgttgaattcttagattgaattttctattagtttccttaaaatataagaggttggagggctaagtttaagacccattctactaattgtgaggctttccacaatctgtgtttccttattttttt

SEQ ID NO: 203499 - DNA, 601 bp, Human
gaaatatagaccaattttgctcgttaaaactacttcaagtagtcctagagctgatattaggattgctacttattcagtcatacttttcgagtgttcattgttgaattcttagattgaattttctattagtttccttaaaatataagaggttggagggctaagtttaagacccattctactaattgtgaggctttccacaatctgtgtttccttatttttttaaaggggatggcacacttgcttagccttcttcattatcattctcagaggaatcattttaagttgaaagtacttcataacytataatgcataaatttaaaccactgtcatttccccccaccacagcccttggcaaatggggtcttaaattccttctcccaccaactagacttttagcatgcattctgacacgtattgtgtatccttactagatatgaggtatataatatttgggctttactaactatccagtgggggtgcattggatatacttggcttggcaatttcaaattataatgatcttcagtaccagatgctcttaagctagtcccctacaaatgtctggcagcttcatttgtaacttttatcaggcttgagtatt

SEQ ID NO: 203500 - DNA, 601 bp, Human
ccacccctttctgagtatgtacaaagtgtcagggactgtgctgggtgctttatgtgcattaactcatttgattctcatatcagcccaatgggatagtttttttattccctcatcctgcagatgaggagcctaaagctgacttgcccaaggtcaggatctaccaagtaactggcagagctggaattcaaacttacacatgtctaactccgcagcccatgctcttaagcaccagggaatattgacttttacaggaggaggactaagcaagggctttgtcattcagaagctggatgacgctggrctccttcctggttcctcatctgtgttgattataaaacaggcacagtgatgtgttcctcacatgatcatgatgaggattgaattgaaatactaaatatatatactgtgcacttataaatgtaagaagagagaggaaaatgactgctggagagtggcgtgatgaaggctccagcattagtgacctggagcgagaacacccagccagtgagctgagtgttcacacacagagagtttacacactctctgagcaccaacacagtatggcatgtggtcatgcaacaactaaaaataacattttttt

SEQ ID NO: 203501 - DNA, 601 bp, Human
gaagctggatgacgctgggctccttcctggttcctcatctgtgttgattataaaacaggcacagtgatgtgttcctcacatgatcatgatgaggattgaattgaaatactaaatatatatactgtgcacttataaatgtaagaagagagaggaaaatgactgctggagagtggcgtgatgaaggctccagcattagtgacctggagcgagaacacccagccagtgagctgagtgttcacacacagagagtttacacactctctgagcaccaacacagtatggcatgtggtcatgcaacaastaaaaataacatttttttttagtatcaactatgtgccagcactattttagccactgaagcttagaagattgtaaaaaaacagataaagttctgttctcagattgtttatagcccaagcgaagttcagttagtaataaaataaaaacatacagcagatgatcataagaactaagaggggaaagacagagaagtggaccaagagtgacaacatttgaagaagggtgtgtggtagagtgggtgagaaaagtctctgactcatttattcattgaacaaaatgtctcaagtacctgctgactcag

SEQ ID NO: 203502 - DNA, 601 bp, Human
acttatgaagggggtttaattaagaaaaaatagatgaacaatcattatttgttatagtaggaagactgtagtaatttaagaaaatacttatcttattgcatctcacatttttgagtatccaacaaaagacacttcgcagtgtcttacctggaaggaagattgttttatgctaagttccctgggctctggggccctcttcctgctggtgagctctgaccatcttcaggagcttggcatgtgctttgctcttggggcctctcagctgggaaagatttgcctctggtggtagtacaggggtttktctgctggtaaactgcttttctgtctttttcttgatgcattggcttcctgcagctcttcttctgtcttcagttgctagcagaagaggcctcacagtccctctcatggactggtctgtgatagcctttttagctgagtgatggggagttccacccttttgttcctagctcacagtggctgctaaaggcatagcaacctctctgagagcagagtctagtgtccccctcactttgccagcccttctgtcctttgagcatgtcatttcttgagggaatcaacatgtgcttctgtaatgggcagt

SEQ ID NO: 203503 - DNA, 601 bp, Human
tacaggggtttgtctgctggtaaactgcttttctgtctttttcttgatgcattggcttcctgcagctcttcttctgtcttcagttgctagcagaagaggcctcacagtccctctcatggactggtctgtgatagcctttttagctgagtgatggggagttccacccttttgttcctagctcacagtggctgctaaaggcatagcaacctctctgagagcagagtctagtgtccccctcactttgccagcccttctgtcctttgagcatgtcatttcttgagggaatcaacatgtgcttctrtaatgggcagtgttcatcagagggtttgctcccattgctcaagagtagagatgcttcctcccagggctgacttcccataggtattttcctgagtctcagtgattttgacccttgattcagttaggtaacttatacctatgtctgctatatccaaaagttttctagaggagtttagtcaagtgattctgtctggcttgtgccttggtacatgaccagcatgattaacgtgcctcatcgcaacactgggctcttccaacccctgtttagggaaggagacttccttccttgaataactaaggg

SEQ ID NO: 203504 - DNA, 601 bp, Human
atggggagttccacccttttgttcctagctcacagtggctgctaaaggcatagcaacctctctgagagcagagtctagtgtccccctcactttgccagcccttctgtcctttgagcatgtcatttcttgagggaatcaacatgtgcttctgtaatgggcagtgttcatcagagggtttgctcccattgctcaagagtagagatgcttcctcccagggctgacttcccataggtattttcctgagtctcagtgattttgacccttgattcagttaggtaacttatacctatgtctgctatayccaaaagttttctagaggagtttagtcaagtgattctgtctggcttgtgccttggtacatgaccagcatgattaacgtgcctcatcgcaacactgggctcttccaacccctgtttagggaaggagacttccttccttgaataactaagggactagttattcccagcctactccccttaagctttggagagcaatacacagattaaatataaatagtagggagcagagattctccagcaatctcccatgaatattttcaccacttttatttatttatttgagacggagtttcgctcttgtt

SEQ ID NO: 203505 - DNA, 569 bp, Human
agtccaggagtttgagaccagcctgggtaatatggtgaaatgttgtccatctctacaaaaaatataaaaattagctgggcatggtggcacatagctgtagccccagctatttgagagactgaagtggaaggattgcttgagcttgggaggtcaaggctgcagcagtcatctgagatagtgccactgcgctccagcctgggtgacagagagtgaccctgtctaaaaaaaaaaaaagaaagaaaaagtacacacacacacacacacacaccgaaaaataattttattgatatgactctaacgagtcaatagataaatataaatcagttgtctttatcttagatgtattattattttcaagtgcttgtttattattatgatcaatggcgtttctatagctttgctatttcttttcttgttaaacctctgcttactaatttctataattggggaatcatatacctgttgtagttagatgctcttgaattccaccactgagaagtgaaggattttaacaaaaattgacaaaatcgaatccagatttcttcacctgtcatcatctttctgaaata

SEQ ID NO: 203506 - DNA, 601 bp, Human
taaatctttttaaaggacacttttttccttacccctgcacccaaaccggaatagacattccctctatagaactggaggaggctggaccactgtattctctctcctacctaaagggcattttactgtatttttgatctttgtctaggtttaaagaaagtacagaagctccactgtgaactactttaatacttgcacattttccctaaagtcaattgccatggtatcaatgatgcttaaaaatagagtgaaattttgttatgtgactttcacctcaataaattattaataaaaaataaagtgrgccataagtaggtacttcccagattttatttatatttatcaacactttattctggttcctttacaggctgtagaagattctgataggcatgaaaactacaacatatttaaaaaaacattgcttaggatatctccggcctttcaagtttgttctcaaaaataactttgcttgatcaaatgaactatattttggtttactaaagatgttctcagaaagaagaatatgtgtacatcaatgatttgtaatgcatttaaaattcaatactattttttaaaaatttaagtattataatggtactat

SEQ ID NO: 203507 - DNA, 601 bp, Human
gagtgaaattttgttatgtgactttcacctcaataaattattaataaaaaataaagtgggccataagtaggtacttcccagattttatttatatttatcaacactttattctggttcctttacaggctgtagaagattctgataggcatgaaaactacaacatatttaaaaaaacattgcttaggatatctccggcctttcaagtttgttctcaaaaataactttgcttgatcaaatgaactatattttggtttactaaagatgttctcagaaagaagaatatgtgtacatcaatgatttrtaatgcatttaaaattcaatactattttttaaaaatttaagtattataatggtactatttatagctagcagaagtagatatagggccaagttttaatttgcttggaaggttgaggcattcctatgataactgggaaaagtgaaatgcattgaggtatcccagatgaatggatgatgttatttttagttctgaaagttagccattcatggatttttgcctagagctcttttgtaacatattgaatgcaaatgtttggacattttagaataaatcttaagttgtccattcctcctttcccca

SEQ ID NO: 203508 - DNA, 601 bp, Human
gtatagtcacttatttgggtacctggctcttataagactgtcttcacctctctctcctaactcttgtttttcatggttctccccgtttctgctcactcctgcttcccttgaatttcttatacttctgggttgtttaagtgaggtttgtctcacaatcttggcaccctagtctagtcttagcctttctaaaaagtcattctaacatagatgctgtgttcagaagcttaaattctgattttttagaaaattgaagttgcagatgctttaagaaattgagagagagagaaagagaaagaggagrgagagaaaattgagagccctttctttatccttgtagtttctttgtttatatcatgtagactctcagcttccttctctttgtgatttccagcttttcaggagtttcatccccctactccttatgttcataaagaaaagacagagctctaaaatgttagctttcttgagtcactagagagtcttttgtggacacctgctccttctgaaacaattgacttgtctactttcacaaacagcagtatttgtattaaagaaccagttggcatcaatgcccaagtgcaggtgtcctaatatataagat

SEQ ID NO: 203509 - DNA, 601 bp, Human
tttcttgagtcactagagagtcttttgtggacacctgctccttctgaaacaattgacttgtctactttcacaaacagcagtatttgtattaaagaaccagttggcatcaatgcccaagtgcaggtgtcctaatatataagatggtgcttcattcagaaaactcaaggtagagtaaaataaattatcaacatcttggctccatgctccattcacaactgttaattttacagggttatgcttccatctctgagcagagaactcctggcagggacagctgctcctgtgtctcacattgggctgwgctcatcccagtaggagtcatcaagagcagcaggttagcgagaaggtgatagtacatcagagaactgagcagtggaggagggagaaggatgggcctctccaaagtgcttttcatttactcctttaatctttgtgtgtatatacatgcatggttaactaaggaaaaaggaaaagttgacttgaatttgactgagaaaattatcaaacctgcttttacttgtacatgtagctcattttcaaaaatacttttgtgtatccactggtatgttgatggtcctatgcagcaataggtctgtacgct

SEQ ID NO: 203510 - DNA, 601 bp, Human
tccattcacaactgttaattttacagggttatgcttccatctctgagcagagaactcctggcagggacagctgctcctgtgtctcacattgggctgagctcatcccagtaggagtcatcaagagcagcaggttagcgagaaggtgatagtacatcagagaactgagcagtggaggagggagaaggatgggcctctccaaagtgcttttcatttactcctttaatctttgtgtgtatatacatgcatggttaactaaggaaaaaggaaaagttgacttgaatttgactgagaaaattatcaracctgcttttacttgtacatgtagctcattttcaaaaatacttttgtgtatccactggtatgttgatggtcctatgcagcaataggtctgtacgcttgtccaaagaatgtctaacagccccacatcatgattagcaggagctgggtcactggggcagagctggtttgacaggtggaaaacttgtcctgagtagttctgtattagcttacctcctaaactggagcaaaggtcaaggccaatccaagattgagaacaggcgccgaacatgttacatggtaaacactcttttattagtggtct

SEQ ID NO: 203511 - DNA, 601 bp, Human
aaggaaaaaggaaaagttgacttgaatttgactgagaaaattatcaaacctgcttttacttgtacatgtagctcattttcaaaaatacttttgtgtatccactggtatgttgatggtcctatgcagcaataggtctgtacgcttgtccaaagaatgtctaacagccccacatcatgattagcaggagctgggtcactggggcagagctggtttgacaggtggaaaacttgtcctgagtagttctgtattagcttacctcctaaactggagcaaaggtcaaggccaatccaagattgagaasaggcgccgaacatgttacatggtaaacactcttttattagtggtcttttgagggaaagttgctgtgttgttctttgctgttatttctgctagaacagtgttcacaaaagtgaacaaaagttcaatgctcaagttaaagaaatctaagaatggagactatcagtagccatgttggggcaccatggtaaacaatggaactggataaaattttatgtagttgcctacacaattctttctatgaccatacctgctgttcctatcctctgaattaattttcatgtggaaaatagtcatttgcagc

SEQ ID NO: 203512 - DNA, 601 bp, Human
actgcagcctcgacctcgcaggctcaagtaagcctccttcctcagcctcctgagtagccaggaccactggtgcatgccactacacccatctaattttaaaattttctgtagagatggggtctcactatgttgccagggatggtctcgaactcctatgctcaagtgcctcctgccttcacttctcaaggtgcttgaattacaagtgtgaaccactgcacccagcttgtaaatgtgatttgagttgtcaaagtacttctaaaaaaaaggctggtttaagtttgacatggagcaacattgagcyggggaaagaaaatacgtagaaaataatgccagtggccagatgcggtggctcacgcctgtaattccagcactttgggaggtggaggtgggcggatcactgaggtcaggagtttgagaccagcctgaacaacatgatgaaaccccgtctctacaaaatacaaaacttagtcgagtgtagtggcacatgcctgtaatcccagctatttgggaggtcaaggcaggagaattgcttgaacctgggaggcggaggttgccgtgagctgagaccacgccattgtactccagcctgggtgacagactg

SEQ ID NO: 203513 - DNA, 601 bp, Human
gtttaagtttgacatggagcaacattgagccggggaaagaaaatacgtagaaaataatgccagtggccagatgcggtggctcacgcctgtaattccagcactttgggaggtggaggtgggcggatcactgaggtcaggagtttgagaccagcctgaacaacatgatgaaaccccgtctctacaaaatacaaaacttagtcgagtgtagtggcacatgcctgtaatcccagctatttgggaggtcaaggcaggagaattgcttgaacctgggaggcggaggttgccgtgagctgagaccacsccattgtactccagcctgggtgacagactgagactctatctcaaaaaaaaaaaaaaaaaaaaaaaaaaaaatggccagtgattctggaaggtccgaaagacattacttttcccatacaatactgtgggagaaagatgaggcttgatttgaacttccagggtactgttgaattcttaactccaaaaacagtgcctggcacaaaataaatcacttaataaatacttgttgaatgctgagatttaaaggagaagaatgtcattgaagccctctcttttcccttcttttctcgacaaaggttga

SEQ ID NO: 203514 - DNA, 601 bp, Human
cacctggctaagttttgtattttttgtagagatggcgtttggccatgttgctcagactggtcttgaactcctgagctcaagtgatccacccacctcagcctgaatcatacttaaaaacaattttttttggccgggtgcagtggctcacacctgtattcccagcactttgggagaccaaggcgggcagatcatgaggtcaggagattgagaccatcctggctaacacagtgaaaccctgtctctactaaaaatacaaaaagttagccaggcgtcatggcgggcgcctgtagtcccagctacttaggaggctgaggcaggagaatgacgtgaacccggcaggcggagcttgcagtgcgctgagatcgtgccactgcactccatcctgggtgacagagcgagactccgtctcaaaaaaaaaaaatttttttttaagagttggaatattgctacatcacccaggctagagtgcagtcacttttcacaggcttgatcacagaacactatagccttgaaaccctgagctcaagtggtccttctgcctctcaagtagctggggctacaggtgtgtcccagtgtgcttggctgaattacactttgttat

SEQ ID NO: 203515 - DNA, 601 bp, Human
cctggttaacttttggttaggtagattacagtggtctgttgacacaactatatccatgtcggtagctgcaaacagctctggaggacagtcatgtgaataataggggacagttatcagtccaagatcggtattaaattttttagttttatgagtcatgaaaattcaatatatatatcatttcatatagcattttatagcttgcacagatggcttctgtatgttatataatttgatccctgtaaccttatataaatgtcattttccccattttataatcaaaggcactaagcttaagtggttrtgatttcctcaagcccatacagcctctactttatagagcaggggcttcaatccagatcttttgttctcagataatttgtttttttcttagacatttgaaactgcaattaattctgtaaaaaataacaaactcattccttttataatattgcatataaattaatattttataaattgaattaattggttacctgttttttagacttatcctttcatcttctccacaaagcaagaaatctgccttttaagtttaagatttgatagtaataggaaaattgccttccctctacttagttgataa

SEQ ID NO: 203516 - DNA, 601 bp, Human
agcataagtgttttaatttcatcaggattcaactgtttcttgaatatttataaatgaaacatgggaaatattatggttgctgaaatgaatatttgccaacgcttatatttgctatacctagccctagtatatagaagtcattcttatatgtttaattataattataattggtatatctttacttgaccagagcatatgatccttaagaataaaatgaacttgtctcatgtcagagagaaaattattaaaatacatagacgttcaggatagcttacggaaatattacagtaataatttttayaagtagaaaatgtaacttttcaatagctgttgtggtgtttctttatttttttcccctctattgttcccttcaaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggtaggta

SEQ ID NO: 203517 - DNA, 601 bp, Human
ccgtggagccggtggcgcgcagactgcgggggctggagttgggggcggtcacgtggtgaagcctgtctcctttcagccagggtcgggggatccagagggtccgctcctccgtccccgccccgtttaactcgcggatgctagacccaagtcctggaggcctcctggctgccagcttcctttcggcccctgcttttgtgctccctccgctcccaaactgtacctgtcacagaccaggaaaaatgtttgctgtgctgcgtctgttggcgagtcccctcctcacccggttcccttcctctgcatyctttcctcagcttgagaaacacctctttgccccgtcatgccaaagaggaaagtgaccttccaaggcgtgggagatgaggaggatgaggatgaaatcattgtccccaagaagaaggtgagggggccagactgctttgtgtgggggaaagaggagctagaagcctgaagaggaagaaagctggcgggagaggggcggggcgggcaggcagagaaaagcctagttttttcaggttctctgaggaatgggttgggagcgtctttagtgtggctcctgaaatatttggggaagtagtcgagatcc

SEQ ID NO: 203518 - DNA, 601 bp, Human
aagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactggggccttggctgtgctgatggccagaagccaggggccttctccacagtccctttggacttgtcttggtccctgagtactcccatgaagatcctycttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgg

SEQ ID NO: 203519 - DNA, 601 bp, Human
actaaaaatacagaaatcagccaggcgcagtggctcatgcctgtaatcccagcactttgggaggccaaggtgggtggatcacaaggtcaagagatcgagaccatcctggccaacatggtgaaaacctgtctctactaaaaatacaaaattagctgggcgtggtggcgcatgcctgtagtcccagctactcgggaggctgaggcaggagaatcacttgaacccgggaggtggaggttgctgtgagccaagatcgtgccactgcactccagcctggtgacagagcgagactccgtctctaagaaaaaaaaaatcatccaggtatggtggcacatgcccataatcccagctactcaggaggctgaggcaggagaattgcttgaacccaggaggcagaggttgcagtgagtcgagattgtgccactgcgctccagcctgggtgacagagcgagactctgtctcaaaaaaataaaataaataaaataaagcatatttgccgggcacggtggctcacgcctgtaatcccagcactttgggaggccgaggtgggtggatcacaaggtcaagagattgagaccatcctggccaacatggtgaaaccctg

SEQ ID NO: 203520 - DNA, 601 bp, Human
gtgtttgaactttgagagacaacatctgccaggtcaggcagcctgggtgcagtctggccttgaaggcggagtggggcagctggcctgcagttcacattcaaggggcaggtgggaagaggtggggcagttatggctttttttttttttttttttgtcaagcggagggatgccccttcccctgacagaactggcttcccaaaaggcactttcctttctgctgttcttctccactccctctgctccctttccccaccccacccccaggaattccagctgtcccaggagcctacctctctgcccrgaaaggaaaagatttgagggctgtagggagaagtttgcctgggctgtcaggagacctgcgtgctaggggctggcttctgctcaccctaggatctcgctgattgctcacaacaagcagaacacacgttttctccccattttagcatctctgcagagctatccttcatagctgtgggccccaaatggggaaattggggcccagagctttgaagccacttgccccaggacaccagggagttaatggccaagggccagtctggggccctagtagctgtcttgagattaagccaaggctacagct

SEQ ID NO: 203521 - DNA, 601 bp, Human
gtgaccctctcagggctcaaatgggtgtgactcatttctgtgtccccagcatcacccagcacacagttgataatcagtatatgaagtggtcctggcagtaaggtctcagggtgagtacttcaaccagtactcgggcagggcagaattgaggcaggtggcatcccaggctgtggtctgaagtcaagccgagcctcttggcctcactggcctgtaatgtaagcagcatttctgaaggagcagactagctgagaagtaggtttctaggactgagatgaaaggtatctgcctggggctggaaacytgtgggggaagtttctgaggggcaaagagcagcaggaccacatcagcccctaattccaccccagggaccgctatccacgcattggagacatcctgcagaaactggcccccttcctcaagatgtatggtgagtatgtgaagaactttgaccgggccgtggagctggtcaacacctggacagagcgctccacccagtttaaagtcatcatccatgaggtgcaggtaagtggtcaagctggaaggagcagacttggggaggagaggtctgcagggatgtggtggggcatctgcagccagatct

SEQ ID NO: 203522 - DNA, 601 bp, Human
ggcatggaggtaagcatccaagaggtgggaaatgggaacttggagtggggcattggtgttgggaggaacaaagatgctggctttgaccccgagtctgtgtgtgtatgtgtgcagagggctagggccctgtggagttcagtggcctcaccatgcccctttctgcctccattcagctaaaggagagctccaacctcaatctgcctcgaaccttcctggtgtcaggaaagcagcgctccctcgagctccaggccaggtacttatccttgcctatgcctttcctccagcgcctacctcccttttsttcagatatgctgaggcattccaggcccagagattgttccagagaaaggatgggcacctttccccaaagatgcaggcttgctcttcagcggtgggggtgatccctaagggttagacaccatttagattcagggtgagtacttcacgatatggggaaaggtggcactcctgccagggaaaccttttggaaaatgaataagctctccctaattaaaccaagaatttcttctggtggattttgttagaggagagagaagaatgggatgtgaaacccaacatgaataataccaccacaaatagt

SEQ ID NO: 203523 - DNA, 601 bp, Human
atcatggctcccttcagcctcgaactcctgggttcaagtgatcctcctgcctcagcctcccaagtagctgggaatacaagcatatgccaccatgcccagctaattttcgtattttttgtagagatgaggtctcactatgttgcccaggctggtcttaaactcctggcctcaagcaatcctcccgcttcagcctcccaaagtgctgagatgacaggtatgagccaccactccgtctattgtggctcttaaaaataaaaagcaacacttgttcacttctaagaaattataaattagaaaatayagataaataaaatatttcttttttttgagtcgcagtttctctcttgttgcccaggctggagtggcagcaatggctccatctcggctcactgcaagctccgcctcccaggttcaagcgattctcctgcctcagcctcacaagtagctgggattataggctcccgccaccacgcccggccaatttttgtattttcagtagagacggggtttcaccatgttggctaggctgacctcaggtgatccagccgcctcggcctcccaaagtgctgggattacaggcatgagccgctgcacctggcca

SEQ ID NO: 203524 - DNA, 601 bp, Human
tccaaggctctgtggtagggggctagaagagtattaacaggtctcctaggggttgatagattctccctcaaaactcacagctaaccagaatggtcctggacaactgtctttcagcaaactttactatccccattttacagataagcaaactgaggtgcagaggttgagcagaaactcacaaactcttcttttaggaagctggtttctctgagggtgtataaggtgagggtgtcaagctctgtaaaatcttaagcccagaaggtggccaggaaagccacctgaggtttttcagccaccactycccctcccccattttacacttgtaacactgagacctggatttgggaggggatttgttcaaagtcatccacctaccagtgacagaactgggtttgaaacccagcttttctaacttcaggctagggtatacgaaggtgaggcgagggtagaaatgggtagtttgtggggtgatctgacttctcatttcttacacctcctccccaggccatcaactccaccctcctgaagcatgaacagacgctggagactttcaaactgttgaactcaacaaacagggaagatgaagacaccccacccaact

SEQ ID NO: 203525 - DNA, 601 bp, Human
ttaagcccagaaggtggccaggaaagccacctgaggtttttcagccaccactccccctcccccattttacacttgtaacactgagacctggatttgggaggggatttgttcaaagtcatccacctaccagtgacagaactgggtttgaaacccagcttttctaacttcaggctagggtatacgaaggtgaggcgagggtagaaatgggtagtttgtggggtgatctgacttctcatttcttacacctcctccccaggccatcaactccaccctcctgaagcatgaacagacgctggagacyttcaaactgttgaactcaacaaacagggaagatgaagacaccccacccaactctccagtaagagtccccgccctctttcccctgcactgggaccccttccagacttccaaatgcccacctgacctttagatgatcctctccctttcctagacggtaatgaccagagaggcaatgcatgacttcagaagcagtcttccattggtagggccacagagaaatcattggggaaactgaggcccagaaagtataatagaagtgacttgtcttcagtagcacagctaggagcagagccaggactta

SEQ ID NO: 203526 - DNA, 601 bp, Human
caccactccccctcccccattttacacttgtaacactgagacctggatttgggaggggatttgttcaaagtcatccacctaccagtgacagaactgggtttgaaacccagcttttctaacttcaggctagggtatacgaaggtgaggcgagggtagaaatgggtagtttgtggggtgatctgacttctcatttcttacacctcctccccaggccatcaactccaccctcctgaagcatgaacagacgctggagactttcaaactgttgaactcaacaaacagggaagatgaagacaccccrcccaactctccagtaagagtccccgccctctttcccctgcactgggaccccttccagacttccaaatgcccacctgacctttagatgatcctctccctttcctagacggtaatgaccagagaggcaatgcatgacttcagaagcagtcttccattggtagggccacagagaaatcattggggaaactgaggcccagaaagtataatagaagtgacttgtcttcagtagcacagctaggagcagagccaggacttaaaggcaggtcttctgaatgtggctgctccccctacccccagccca

SEQ ID NO: 203527 - DNA, 601 bp, Human
cattgatcaactggcactggatgcccaaacaagtgagatggcccttgaacccaaacagcaatgagagtcccacctgcagggcaggggggcactggagagcgagaccctcagcactgcagcctacgggggcccacctgggagagggcagattaacaagggcctgtcacgtgacggcgcaatgacggctagtgggcgctgatgctggggacagaaggccagagatgggggagaaggatgcagggcctctccagagacgggggagatggaaccaggccgggggacccagggcctccccagagaygggggagatggacccaagccgggggacccagggcctccccagagacgggggagatggacccaggccgggggacccagggcctccccagagacgggggagatggacccaggccgggggacccagggcctccccagagacgggggagatggatccaggccgggggacccagggcctccccagagacgggggagatggacccaggccgggggacccagggcctccccagagacgggggagatggatccaggccgggggacccagggcataaagacgggatttaagacgtgggtctctgaacca

SEQ ID NO: 203528 - DNA, 601 bp, Human
ggcatcctggaccctcctacctgccaggcaaggctgccctccaccatccacctggcctaaagcctcactcagggccgtggctgtgggagagatcaggtccgtgcccaggcagggaagccggggctggagcccactgagctgaagggcggcagcagaggcacgggagctcctgccaggccacagttccccgagagcaggcctgagacccactctcactcccaagccttatcctgtcccattttccggaaaccctcatcgtgagggtgactggaggaacagcctcggggcctcagacacagcmcggctgcctctgggtggcctgttcagccgccctggtgccccgcaccctggtttcagacatctcagagacgtaattgggaagcgtgtgtgctgaagaatgggctgccaggcccacgtcactgtcgggcactttgaggcaccaagtacacagcggcttcttgaggggaggggcccggcccagcccctgtgcttcctcccctgagaggcacctttcctttgacggggggcgccgtgctccccgcgctgaaggctgccgtacgatctgcagcgggtgcagactattttggcatctcacagattt

SEQ ID NO: 203529 - DNA, 601 bp, Human
tctccacagacccagccgcgggggaggcagaccctgctctgcaggaggccagagcccctggaaaagcctagaagccaccaaggcgcgagcagagtccaccatggcagtgcttgcaggtcactcatggtgccagcagagacctgccctccgaggtgcaaaggcagcgctagcgggtgggagaggggtaagcccccggttggtgaccagcggccacgtgctgtggccactctgcccagcaggccttgcaggctcatagttctgctccgagcccaagagccttgagtgagcaggcggcgcagcytagcaagtgcatggggccatcctggctgaggcagcctcctgcctctggggctactccacacggaggtctcctacacaaggagctcagacttcactctctcttcctcaacgcctcggcttgtggctgccccagacccaactaggtcatcggaccccaggctcaggcctgcccaagtccccacacagccctgtcgctgctgtctgcccagagactcctggcacatggggtcccacggttccccacatgcaccatctgggctgagtgcccaggcctgtggagccctgctgcatagggaagggt

SEQ ID NO: 203530 - DNA, 601 bp, Human
gggtcacgcgtcggcggagcatgagaatgtgttgtgtcacgtgtcatgtgccatgtcacagggagtatgccgcgtgtcatgtgttgtatgtcacatgtcatgtgtcaggagctgcaggctgcatgtcctcaggtttctggagcccagctgacagcactggatcctgttgtgggcatctggctctgtgatgaggcactggccttctccatgctccacctcccagggcaggcagccatgaagccgtgcagacctgactcgggacagtgctggggaggaggccctggtgagtgccaggcaaggytgccgcctgccaagtgggttgttctcctgatccggcccttgctgtgggcctgcgtgcagaggtctcctctgcaggggacggtgggtgtgcatcagccacggcgctcagcacagaatacccatggctgtgcagcagctggaccagggcatgttgaatgaatggactgccatgggagctgctcgctgagaaggaacactggataacctgggcacggtcatccttcaaaagcctcagcttagacagcagcgcctccagacccgcgtccgtggatgcaccccacagggacctcatggccagcac

SEQ ID NO: 203531 - DNA, 601 bp, Human
cactgccctagttttaggcttaaaggaatcagagtcaaaaaaataaatgtgcaccaatatggatcaccacttctggtcctctctgtgcatttacttcaataagaatttaaaaggtagatatcagaggactctacgtttgaaacaacacacttgtcccttctccatcttcccccagttctgactgcctcacctctctccctgaactctgtaatggtccccactgactacctaatcacattcaaatttctttacctgatactcaaaggacagtcaagattctaggctcttctctcaccgtgartggcatccagacagcctctgctcagacaccagagcctctgctcagacaccagagccactcccacctgttgctgacacaggtgcctcaccgcaccagatcacaaactggcacaccaccttcttgtcagtgctacctcctcctgcaggtcttgtttgatgtcaccatcaacagaaggagtctcttcctcctaagaagtttcctggaattttgttttttaaaagctagtaacacacacacacacgagttctgcaaggcacactatgaaaacagtagctcctgtccacttcagtcttctagttc

SEQ ID NO: 203532 - DNA, 601 bp, Human
ccctgaacctctctgtgcctcaacatctctatctgtgacacggggaagacaaataacagtacccacttcatagggctgctctgatccctgcatgggtggcacatgtaaggcacatgaaacagtatcaggaagctcatgtgccaacggctattccaggaggtgttggtgctgcttcctgtcagcaccttcccatgctggaggagccgcagaatacggccccaacacatccttggctgatgatgggatcaacaggcatggcaggaagggctgtgccagccaagaaggttgtgtccttccaaarcaaggaggtagataccgaagcagaaagggtggagtcagaagcagggagggcggagtccagagcagggagggccgagtccgaagcagggagggcggagtccgaagcagggagggcggagtccagagcagggagggcggagtccgaagcagggagggcggagtccgaagcagggagggcggagtccgaagcagggagggcacaagcctcgccgcagcccacgtttgaactctccactcctaagtcatctgtgcctcccttgggcccaggggaggccacggctccaggggccccagttgccca

SEQ ID NO: 203533 - DNA, 601 bp, Human
cagagcccaagacggcagcgtggtgaggggggccatgacagaggagccccagtggggaggttcagctctgcacccaggcagcatccacaggacctccaagaccaatgtgagctgggatgggctctggagagacagcgtccagccatggacctgcagaggctgaaacagcttcagacacctcagggaggcatcaaaggtgactgaacctaggtctacagttcaggacaggtgcctgggtgatggtgggggtcaccatgtgaatacctgtgggtctacagttcaggacaggtgcctgggtgayggtgggggtcaccatgtgaatacctgtgggtctacagttcaggacaggtgcctgggtgacggtgggggtcaccatgtgaatacctgtgggtctgcagttgaggacagatgcctgggtgacggtgggggtcaccatgtggatgggcctcaaagctggggaagactcagcttgccaaggaggagctggagccagagaaaagggcagggtcaagcactggactgaggctactactgtggagagacaggagcaggtgagagccagcagtcagtggggcaaggagccacgggggaaacaggaggg

SEQ ID NO: 203534 - DNA, 601 bp, Human
actgaaatggaacgagatggcctgtaaaacagcctgcggcaggcttctccaaagggggtacatctgagggcggcaaggtgaccagcagtcctggcttctcgcctgctaccagcactgggctctctgtcacactgcgggggcaaagtcattggccggtctaaggacacccacccttgctgagagaattcagtcaccactcacattccacaaatatgcacccggcactttctccttcctctgtgccacatatgttctcagacatgtgagatacatgagtgaccagatggccagagcccaagayggcagcgtggtgaggggggccatgacagaggagccccagtggggaggttcagctctgcacccaggcagcatccacaggacctccaagaccaatgtgagctgggatgggctctggagagacagcgtccagccatggacctgcagaggctgaaacagcttcagacacctcagggaggcatcaaaggtgactgaacctaggtctacagttcaggacaggtgcctgggtgatggtgggggtcaccatgtgaatacctgtgggtctacagttcaggacaggtgcctgggtgatggtgggggtcac

SEQ ID NO: 203535 - DNA, 601 bp, Human
cagctgacttatttacaaagcactgactttccaatttcagctcctggggccaaacgggatgacggcaccaaggtgtccccctgtctggcctcctgccgagcccctctcccggctggctgctggcgggagagatgcacacgtaatctcattctgcctcctgttcgacagctgacgctagaggttaattaaattggttgtccattgtattcatccactttacaaagctaatgatattctgttcctgaattaaagagcattttataaagcgtgccccgtggaagccggcattctgcacgcgggktgctgaaccctgtcacggctcttggatgtagtgtccccaattaggagcccaggaaggaccgggccttcatctgccagggtggaacaccagtcatgctgacacgagggtaaacacgccacataccagccgcttaatcgccctcgctggccacgataaattccaccagacgagtgcgcccgttaacatttccgattaccacggtgaggagcaactgaaatggaacgagatggcctgtaaaacagcctgcggcaggcttctccaaagggggtacatctgagggcggcaaggtgaccagcagtc

SEQ ID NO: 203536 - DNA, 601 bp, Human
tattgttttaatttgcatcttcattatactagcatagttgggcacctcttcatcgaactgtgtggctgtggtaaaatgcacacagcataaacttgaccatcgtacccaccttcaggtgagcaggtcagtggcacgcagtccgcgcctaacgaacgtctgcacccgtcacaccatccatctccaggacactgtccaccttcccagctgagactgttcccgaccagcaacagctcccatcacaacatccatctccaggacgctgtccaccttcccatctccaggacgctgtccaccttcccayctccaggacgctgtccaccttcccacctccaggacgctgtccaccttcccacctccaggacgctgtccaccttcccagctgaaactgttcctgtccagcagcagctcccttcccgctctccccttcccgctcttcccttcccgctctccccagcccctggcaaccaggcactgtactttctgtctccatgactttgactaatccgagtacctcatgtaagtggaatcataccatgttcgtgtttctgtgacaggcttgacttggcataatgtcctccaagttcctccaccatgttgtagt

SEQ ID NO: 203537 - DNA, 601 bp, Human
gtgcgtacatatgtatataatacacagatggccttgctgggtcacaggagacgtgccctccacataggataacacacacgtgtacacgtggattaaatgtgcgtacatatgtatataatacacagcattgctgggtcatggcagacacgtgcccgccacataggatcacacacatgtgtacacacagattaaacgtgcgtgcatatgtatataatacacagatggccttactgggtcacggcagacatgtgtcctccacataggatcacacacgtgtacacgtagattaaacatgagtgcrtatgtatataatacacagcattgctgggtcatggcagacacgtgccttccacataggataacacacagtttacacgctgattaaacatgcgtgcatatgtatataatacacagatggccttgctgggtcaccacagacacatgccctcccaggcaccaccacgttgcccctcctgttgccatgacgatcccccagtggtctcatcagggcagtgcccacgttccacatccttgccatggcccagtgccagcctctagtttttgccaactggataggtgtgaaattagaccttattgtttt

SEQ ID NO: 203538 - DNA, 601 bp, Human
cagacacgcaccctccacatagggtaatacacacatgtacacgtgaattaaacatgcgtgcatatatatataacagccttgctgtgtcaccgcagacacgtgccctccacataggataatacacatgtgtacacgcagattaaacgtgtgtgcatatgtatataatacacagatggccttgctgggtcacggcagacacgtgccctccacataggataacacacacgtgtgcacgtggattaaacgtgtgtgcatatgtatataatacaacacatggccttgctgggtcacggcagacacrtgccctccacataggataatacgtgtacacgtggattaaacgtgcatacatatgtatataatacaacacatggccttgctgggtcacggcagacacgtgccctccacataggataacacacacgtgtgcacgtggattaaatgtgcgtacatatgtatataatacacagatggccttgctgggtcacaggagacgtgccctccacataggataacacacacgtgtacacgtggattaaatgtgcgtacatatgtatataatacacagcattgctgggtcatggcagacacgtgcccgcca

SEQ ID NO: 203539 - DNA, 601 bp, Human
cttcccctgtgctggttccaaccgcgtcgcgggcgtgaccacaggtgccagctcccagtgcgccccagggggatctctgtggagcctgccactgcattctgccactgggaagggaaaaagtgttgagggaggaggccacggcccgcggcccaggggagccctgactaaggccgaccgtgcttatcaacagtgactcagaaaaaagagtggcagcatttggtgactcccatctcactctgagacagcatgacattttgttatttctacagataaagcgttttcacctccagttttttttttwaataaaataaatctaggagcagaaagaaaaacttcataagatattgttggtaactaatcttcaagtctgcaacaaaatagagaacttcatttgttttaaatgagagtcgagagattactaaacatgactcccctcatacgcagcccactccttccccagctgcatgctgtgaggacacaggacccccaaatgaaggacgcggcctcacgcaggagcccaggggcacgaaaccatgctcacctgggctctgacacaccctgtgagggccagtggcaaacatctgtgctctctgagaacaaa

SEQ ID NO: 203540 - DNA, 601 bp, Human
aggacattgggccaggagcgtgtccggggcctgccgacaggaagtccccagctcgcccaggtctctgaccacagtacttgtcaagagtatgtctgtcacatctgagaataatgactcctcgcctcttgctaaaaacaaaatactttttacgtattgataaacaagactgtcaagagtgctcattaattctgcattagtgaaatgcagccattagctgtgatgcttctgcgaggactgcagacacgggcaggagtcctccagcccccggaggccacggcacagccgggaagcggcctccacyggacaaagccaagcccctggggcaccgaaaagtcgatccggtgcgggccacacaggagatccagaccccggctaacctgggccctggctggggctgcactggtgggaccctggtctctgaaggcagcctgggagctaatgggcaactgaagctcccagtcaccaccatcaggcttccacaccaactggcgaccagggcgcaacgaaccctgcgtaccatgggggctcagtgcctctcacaggggcggctagtgaagatggagtatttacaaatgctattaaaacaacctctcaacttcaa

SEQ ID NO: 203541 - DNA, 601 bp, Human
cacttgcacacacactcatgcacacgcacgcacttgctcacactcacacacttgcacacacgcactcatgcactcttgctttgttttgggcagaaccatgaccccacaaccctgcagttctgagtgccccagtgtggacctcctgctgagatgctgccctacggggctgcagagctattgtctctctaagaaagtcaaaggcaatgcctgaacatcacctaattccatggcccaagctaaacgtcccacacacttcaggctctgcagttcccagggaactgctgctccctccctgacgacyggtcactggggtggctgtcctgggggcagggctgcaagaaggtgcaccacactggggcgtcaggaggctgctgctccctcagaggcgcagggcggcaggcacagtgcatggtgaggggacttatgttctgggcctgctgagggccaatcgtgccagtaactctggcctggtccctgtctgcagccccctgggcccctgggtcagctctctggggcctgttaggccgtctctggtttgatgccgactccacaacatgggaagctccctggaggctgtgcagctcctgctcctagggcgtgt

SEQ ID NO: 203542 - DNA, 601 bp, Human
gggcacttcacatggatgtcatctgctccggaggccgcgtggggttctgagaactcacacacagcaggaaacgatagcgtcagacgggaagtcatcgcacaaacacccccaggccgtgtggagcacgcacggaagccccacacccggcctagctcacgcacctgcccccgacaaagaaatgaacaggaggggacagcttgtgtcagcggagcgtctcagggcaagtcttttccgtgaagacacacagcacatgaccatcaaacggggatgctgttcacggcagggaggaccgtccctgccygttcttatttctgaaacatgcaaccctctcattcggcttttcattttctcacactggatgggaacacagatacaaactattccttcctcttaactcaactctaggaaagccaggtccccaccagagccttgccagggagccagtgtgggacagccaaggggcctcgagtccaggtccaggaggcccctggagtgacctctggacagtggctcaagacacccagcccacagtggccactcacagagacagggcaggagaggtctggggaagccagacaccaggaggggtgagtgccgagac

SEQ ID NO: 203543 - DNA, 601 bp, Human
atttcctgttttcaattctgttgctttctgttccaattttcattatttcttttcttctgcttactttggaattttcttttcttctcctagcttcctaaggtagaagcttagataattgattttagctctttcttcctttcttcttagcacttttttctttttagctctttcttatatgcatttgatgctataaatttacctctaaacattacttttgctaatatcccatgaatgttaagctgtatttacgttttcatttggttcaaaatatttttaaatttctcttgagacttctttgackcatatgttatttagatatgtgttgtttaatgttcaagtatttggggattttccagctacttttctggtgctgatttctggtttaattccattgtaatctatgagcatgctgtatatggtttctgttcttttaaatttgtaaaggtgtgttttatggcccagaatgtgatgtctcagtgaatgttccaggcgagcttgacaaaaacgtagattctgctgttactggatgaggtatcctataagtgtcaattagatcaatttgtttgatggtgctgttgagttaaactatgtctttcctgat

SEQ ID NO: 203544 - DNA, 601 bp, Human
gggccctggcctctcaggacacacctcggcccccacccccaagagctatggggctccctatgggctctcctaccccatccggagtggacaggacccagtgaataagtggacacctggtggggaggggacagcccagcagcacctggtccggccacggccctggacagcaatgcagccacatgggtcctgagacgaggtgccgggtcaacagcctctgcctggaccagcccagccacccacagctgctctcctcatgccatcaggtggcagcgcctggccctgcccagcccagcccccccccaccccagcacccacgcttcccacaaagggccctgagtcggtctctggtcactctgagatgagagccttgcccgggttcaagagaggccagagttcagctcgcaggctctccaggggaaccacagcccccaccctgcccttccgacgggcctgcaccacagcccccgccctgcccttccgatgggcctgcaccacaggtggccccttcagggaggctgtcatgacccagggacgcaactactgtgcgtggagaagaccatggagctttcttgcatgtcctttccaactgctggacatccgg

SEQ ID NO: 203545 - DNA, 601 bp, Human
agggcctcaaggcagtgggtaagacaggactgccaggctgccaggttcaagtcccagctgtggggcctcgggtacaaggaggggaggacagagcccatgttgccggcgggctgcgaggggtggctctgcgcaccagcagccgccgcgggctggcgtccaacacacaggcacacacccaaccctcgggccgaccagaaagggaaactgaggctcacaggttaagaactgcacctatggtcccttggtggctttaggccacagtcactgggcccaaggctgggttctcacccatgggggctgycatgggagaaggctggacgtgtgactggtgacaaatctacagtaactgggtgaggcccctctactagtgacagtgggaggcaggcgtctttccaggagaaaaggtaccgtccctgcaggccaaggcgcctcaatacacgactcccctagagcaccagcagctcatcttccgtgcctcgacacctcctgtctggggggactggggggcctgacatgctttgggaaccagatgctgcagcagagatcaggccaagccttcagaacccatgcgggtgaagctgcgtgtgtgtgggggtgaagc

SEQ ID NO: 203546 - DNA, 601 bp, Human
ggtggcagggctcccctcgagatggcatggaggccctcctgccctcccacctcccaccatggtaggttcctctgctgggccacccagtacagcagtggccagccaccggggccaccgagcgtgcaaagtgtatgactgaagaactgaattttagattccattttatcttcattaattttaatttaaacagccatgcagaacagggtagcttcacagcctaggcctcttgggaaacccttgaaaaccacagaaggcactgggaagaggctgacagagtcaagtccaaggtccacaaagcaaagcgcttcaggcagtggcgggggaacggcagccaacagggcagggcaccgcccattccgttcccagcagcagccatatgcctggcgccatcgggggcggaggtggacaggggctgctgttcttggtgctcatgggctggcagagaaggaaagcaggacagggaagaccctgtctcctccaccacaccctaaggtctgctgaggagatgaaagcagatgggaatctggagttaactgtggacgaaacacccgtgaagaaagggtccagcgtggcgtgctccctctatctaacacggagagcg

SEQ ID NO: 203547 - DNA, 601 bp, Human
gctggaccacagggaagacttgagcagccgtgcccagccaggcgtcctggacagtgggtgacctgcccaccccaacagtgtgtgtggtctctcactgatccccaccacccaccgatgcctctcacccaccgatgccgttcacccaccgatgcctctcacccaccgatgcctctcactgatccccaccacctagcagagccaccgaacgtagagcctgagctctggtctaaaagtacccccaaaattcaagtgaaacagtcaacagcatgagattccaaagaggggtgttctttaagaggtrgcagggctcccctcgagatggcatggaggccctcctgccctcccacctcccaccatggtaggttcctctgctgggccacccagtacagcagtggccagccaccggggccaccgagcgtgcaaagtgtatgactgaagaactgaattttagattccattttatcttcattaattttaatttaaacagccatgcagaacagggtagcttcacagcctaggcctcttgggaaacccttgaaaaccacagaaggcactgggaagaggctgacagagtcaagtccaaggtccacaaagcaaagcg

SEQ ID NO: 203548 - DNA, 601 bp, Human
tgcactgaaaaataaacacgtcacacaaatgagccagagtaagtgagcaagagcaacacgtgggtcccacacacctaaaggacacaggagatgctttccaaacaaaaaacagcagggctcttccggcactgatgccgccccactaaagagaaccgagctgtgcacctatcctcaagtggggcttcgcacagagatgcctgcaggggctgctgatgcccagcctggggtggggtggggggaagatatgaagaaacgtgccagcctgccgcctgtgagccccatgcccccatgtgagagcagstgcagggaaaccactgtcaccacagatgctgatcagggagctcgagacacacggccgccctcggctggaccacagggaagacttgagcagccgtgcccagccaggcgtcctggacagtgggtgacctgcccaccccaacagtgtgtgtggtctctcactgatccccaccacccaccgatgcctctcacccaccgatgccgttcacccaccgatgcctctcacccaccgatgcctctcactgatccccaccacctagcagagccaccgaacgtagagcctgagctctggtctaaaagtacc

SEQ ID NO: 203549 - DNA, 601 bp, Human
tcaagcagccaagttttggaaaatccatgaaaagaaaatgaaaacagtattcaaatgagatgtgatggctggagggacacgttggggagccacctggaagccaccttaggaaagcagataacaggtttctgtttcttatgatgcagaaaaggtggggcggcgctatcgagaacatgttcactgcagaaaggccaggccagaggatatgtggatgagacgcaggctccgctacgtctgtgctcagtctgctgatggaccaggctgccaggcagcgcttacgccgtctcactgggcagccacrgggccccagtactagggggcctccctgctgacttctctgtgcagcgggctctggccagcggaactctccagctgcggggagggactggggccgtcactgtgtctccattggcactgggcacccagatgtctgacttacagggaacagtgacaatgctccgaatgcatcgccgtgaaccaaaagggtcagagtggcaggtgggggtcaggcagctgggggtcctcatgcaaaatcagtagagcctccaatgaggtgtgtggaacatgccgctggtgcaagatataaaagggtaagaaacgt

SEQ ID NO: 203550 - DNA, 601 bp, Human
gagagcacagtccccaggctcagaccgatccctgcctcggtgtcagtgccagctccagagatatccgggaggccggacaggtcccctgcagagggtgtggccgtgcacagggctgagggccggcctcagtgtgtggccacgagcacagcagcacccaggcctcgcagttgccaccctccccgggaccaggctagtggcaggggaccagggctccatcactctggagacggaggtcaggggcggtcagaggggataaggggccacgcctcagggccctcagcaagggccagatgcagaggasagccaaggccatatacccgctaataacagcacagggatgggagcccagcccagactccttgtgcagagccctgtggggaacccgggaggatcgtgaaggcggcaggcaaggagccacgcaggccacactcaccacagcagcagacggagccagcattcaggaggggccccatcagctccaactccccctggagccacacctactggagaatgcagccttccaccccttcctcaggatgcacagtgctgagctatgacaggtacacacttatgtgcacatgcacccacacctgtacaccta

SEQ ID NO: 203551 - DNA, 601 bp, Human
ctctcaaactctgcttggacaccgccataaaccacaaaaactggtgcggcacagaagtgcctcaacctccaggaccccccactcctctccagctagcagaaaacacaactggctgagatgccagtggtgacgctggggttcagggtgtggaaaggaccagcgggagtggagacacacggcccccatggcccagcacaggcatcgtcctgtctgccaccaaagggccgggaaccacccaaacgctctccagacagccggcagcgagtcccatgaccgagcaccgtggctggagctcgtggaracgtccggcagactccgttcacaggatgctggacatgttggtcacaggcgatgacatgtgtaaagacataaaccacacacaggcgtcacagcaacgtcacgtcgacgcttgcctccagctggcacataataaaagtacagaaacatccgtgcctgtgtcacaagaggccagaaagctgcaaaggagcgacaggtgctgaattcaggctgatgctgggggccaggatggggttcaggatggaggacggggcacctgcgggcccacatggtttgtttcttaaggaaaggaaacatgcggaga

SEQ ID NO: 203552 - DNA, 601 bp, Human
cagatctcaaactgagaactaaggtcggctgcaaagccccgccacagagttgtgttgcggtgggcggggctgagatggcctctggacctcagccttggggctgggggcatcctgggccccagcagtatgtgccttctcagtgtctggcaccttttaaagcccacactcccttcgatgagtccatccccacatcaagtgctctcgggcagagtcgtgcggggagccccgtgcagggcggcaggagggctgtgcagggctctccttcggcagccgccgctctcatgctctccacacggagcaycgccattttacttttgtttttctcactctgagacccaccctctcaaactctgcttggacaccgccataaaccacaaaaactggtgcggcacagaagtgcctcaacctccaggaccccccactcctctccagctagcagaaaacacaactggctgagatgccagtggtgacgctggggttcagggtgtggaaaggaccagcgggagtggagacacacggcccccatggcccagcacaggcatcgtcctgtctgccaccaaagggccgggaaccacccaaacgctctccagacagccggcag

SEQ ID NO: 203553 - DNA, 601 bp, Human
gcgcttgctgtgtcccgtgagcacagaaagctcggagggtgcatggaggaagacagagggccctgtgctccgagaccccaggagagcggcagcccggggcacagaggctcccgagggagggcggcaacgcccgccggccagcgggcaggatgcagccagccaagcccaggtgtaggcgagaccacaagataccaaagccatccccacatggccaatccccacacggccaatccccacacagccaatccccacatggccaatccccacaaaaccaatccccacacggccaatccccacatgrccaatccccacacggccaatccccacacggccaatccccacatggccaatccccacatggccaatccccacacggccaatccccacacggccaatccccacatggccaatccccacacggccaatccccacatggccaagcatctgtgtgcggtgtcgcaggaacagacgcggccgtcagttggctaaacaaacagcagaaccctgacggaacaaactctaatgagttccccagtgcggagagagaggaaatgcggcctcccggctggccctcactccactgaccgagtttcctctctca

SEQ ID NO: 203554 - DNA, 601 bp, Human
catggaaaaccacggctgccccgagaacgggaaagggccggacaaggatgcctgaataatccaccacaaaccaaataatccaccgcagagctcaggaaaggcgggagggagacagacgggaggagggaccgacagcgggagggagatggacggggaggcgcgtgcaggtgaaccggcaggaaccggagcccccgctctctcctcccagacagggatgtcccctcagacctgttttgaaggtttacatatgatctccactcggacgtttcaaagtgagagggtaacagtggctgcatacgtktgtgtatgtttttagccaggtacagctgtactcaagaaaaattcttcctcatattttcaatcaatcacaatcagtttcctaaaggtttttccactgcggcttcccttacagatataagcctgtaaaaagatctcagaaaccgccaactcactcaaaccccaaatctcccctcagcggctccagtcagtaacgccgtgaactgcttgcttttgaggagggcaaggcactcaacccttctggtgtgaaagcaacacgagaacccttgcaacgtggcattggccaccaaaaccatcagtggaa

SEQ ID NO: 203555 - DNA, 601 bp, Human
ccccgctgtgggctgtcagctcatgcccagcacctggaggggccaccagggaggctgagggtgagggcagcagggccagggcgggtgggcaacaggtgctccaccatttcccacacccccctcttcacagctgcccgggaagtggaatcccaagtcatgaaaactgggagggaggacccacagccagcgtggactggaccacagagaaacatcggcccttgcactgagcctagaggcccacttcctgtcggtggcacctcggcgcccaagctgctggtccccggccagcccgaaagcacamccaggagcaccctggacccctgagttcccacacccaggagcacccgggacccctgagttcccaggcgggggtgacgactcgttaactcacggaataatgactttgcagacagaaaagcacaatgtttaaaacgggctctgacagtttctacgtgttatgacaaaaaatcgctgagatcaagttggacagtgtgaaggagctgacactctgcagaggctgcagctctgtgggcatcgagggggtggcgctgtgacggcactccagcagctccttgtgtgccgacggcggaagccacagggc

SEQ ID NO: 203556 - DNA, 601 bp, Human
ctggggagcagctgagcccaagctggctggacagcaagtccacgggaatgttcctcccccgtggtagcccctgcactggttgaaagtcacctggtctgtactgtcccatggaatagccacgcggctctatcagatctgaattatcagatctgaattaaaatgaaatgaagtgaaaaatcgggttcctgggctgccctcggtgcttgttagcctcatgtcctggcagccgctgcaggggcagaggggaggcagcttgcggtcaggctcacagcaggacacgccaacgcggctgggacttcargacgccacctgggtcagccaggcccgcaggagctctgccacgttcctgcttactgttcctttgagaaatccacttggggcatgcagaggaggttccaggaagaccgcagttttctttcccttcctgacttatagtcacctctgacgcttcgatggccaggcaagccccacacccgctgtcttaacaagctgcacgcaggagctgctcttcctacacccaggacacctctccacagagctgagtgggtggggctgcagagcggccgaggagcctgcagacagggcgtgagggacagacgtg

SEQ ID NO: 203557 - DNA, 601 bp, Human
acgtctgccaggcagcgtggagaccccacccagggcccacctcagggctgtggttccgagaacagggatgcactggggagcagctgagcccaagctggctggacagcaagtccacgggaatgttcctcccccgtggtagcccctgcactggttgaaagtcacctggtctgtactgtcccatggaatagccacgcggctctatcagatctgaattatcagatctgaattaaaatgaaatgaagtgaaaaatcgggttcctgggctgccctcggtgcttgttagcctcatgtcctggcagccrctgcaggggcagaggggaggcagcttgcggtcaggctcacagcaggacacgccaacgcggctgggacttcaggacgccacctgggtcagccaggcccgcaggagctctgccacgttcctgcttactgttcctttgagaaatccacttggggcatgcagaggaggttccaggaagaccgcagttttctttcccttcctgacttatagtcacctctgacgcttcgatggccaggcaagccccacacccgctgtcttaacaagctgcacgcaggagctgctcttcctacacccaggacacctc

SEQ ID NO: 203558 - DNA, 601 bp, Human
agaccagctccctcccaagctgatcgcggggctggagagcccccactcccagcagatgcaacggaggctcagccaccacctcctgcgtgcccttccttggtcccctcctcatgtctgacaccaacaaacggcaccagcgaagaaaacctgctgctgaaaacacctgcgtctgatacgaggcaggggtgcggtcactcccagggtcgtctgatacgcaggagggatgcggtcactcccagggccgcctgatatggggcagggacgcggtcactcccaggggcgtctgatacgcaggagggaygcagtcacttccaggggcgtctgatacagggcagggacgcagtgactcccaggggcatctgatatgcaggaggcacgcagtcactcccagggatgcctggtaagtgggagggggcgcctgatgcgcaggagggacacctgatacgcaggaggggtgcctgatatgcgggaggggtgcggtcacctccagggccgccttctctgttctctgacctctcaccggggggaacccaggcctgactcttccctgggattgtgcagggctgaccacgccatcccatgtgaatgaccgccacgtctg

SEQ ID NO: 203559 - DNA, 601 bp, Human
tttccactaggctcgctttacttacatagtaaactgtgtgcaaaatgtaacgaaagacttgtcaaatgaacagctatgtatccacagtcttaaagagccacgtgggcaggaaaaccctccaaacactaatgcaaggatcttagacacttgctgagtaaacaatccagtttaaaactattcatttttcttcccattcctttgcaaatggcagacaaacagcgcagaacagtaagacccacgtctgtccagcatgagggcattataagccagggcctggtaactgcatgggcagctgctgtcrcgggcagcatcctagagcccagagaccagggtggccgggcgtgtgaatgagccgtggtgggtggaggcctccctgctcccaggaatctgcattgccactgcctggggtgccgggggctcccctgggtggcatctacgtctgttggggacatggtgtccaattctggtgccatttagacaggggctcccctgggtggcatctacgtctgttgaagacatggtgtccaattctggtgccatttagaagggacctttgcagacagaacctggatttcccacgaacgccctgggcatgcctcgg

SEQ ID NO: 203560 - DNA, 601 bp, Human
aaaggccacatgaggatggaggcgcagacggaggtgatgcggccatgagccagggccatctgggccacctgtggctgggtgaggcaaggaggggtcccccctggagcctccaggagcagcgtggcgctaggacaccttgattttggatgtccaggttccaggactgtgagagaataaacttctgctgtgtaagccacccagcctgtggtcctctgagccactgccgcaggaatctccccacacggagacaggagactctgcgcgggagggatccacctggcacgcacattccacgtcaacrgatgagcaaacagaagacaggccgtgaccctccggagagcctgcacgtgtctgcggcccacaggaagcgacatggccacgtggaggtgccacgcagcactgaggggccgcaggtgaccctggggataccgcccctgccctgggcctcagggtcctccccgtggtcggttccagggtcctgtgactcctcacggcccccagccctcaggaaatccctgcggccatgggatccaggtgctcagcttcgggccagtccctgcaccaagcacttagcttcagtgagctgtggaatttgacacac

SEQ ID NO: 203561 - DNA, 601 bp, Human
cacaggcctgtgtgaaaaagaacctgctcagctgagcagctggaaacgctgcgaatccgcactctgcccaggccatgctgagctgctgcacgctccaattcctcctgatacttcccagctgcaaagacactggaggctggaccacagtgcgaaaaatgaaagctgtacgaggaaaatgaggccctggaccacagggattcctcgtccacttttcatctgaggaaggagaagcgcacagcctcagggagcaccgagatcagtgggcagtgacggtggccactgccgggtgtggtcctgccakgacagtccagcccagaggtgatgcttctgcgtcacacgagagcatagctggcatctcaggtgcgcctgcagcgatgcatccctggaggctgcacgggcatggcactgcgggtggcgtggaccgagcctgaatcccgaccagaggtacctgcgcagccccggttcaccagctgcactgagcctggtgccaggcagacgtgaggagacgctgcctgggccctgggcctgactcacaggatctgtgtgctgaggagctcccaggagactcgcaggtccgggagagcccaggatgtgtgtgcta

SEQ ID NO: 203562 - DNA, 601 bp, Human
ccctcctgccaccaaaaatcacaagcaggtctccacctcggggtctgagagcctccagggccaccaagctggtcgtcctcccagacaccctgcccctgaactctcggcagggcaaacaaccctgtatttaatctgctgctgccagcccggctctgcccggcctcccattgctgtggagatggatttaattaacctctgatgagtctttccagcaagcctgccactgagggcaccaaggaggcgctgtgagcaggcagaggaacgcggtcggcagtgagagcaagaggatgaccccaccagyccaggaccgagggggcaaggatgggctgctgtgggtgggagctcagcagtgaaaccaaagccaggccagccgtggtttctgaaagaccattacactcacgtgtcccttcgtaccaacaccgccccagggcgcccgtgccaccgggcaccgcctgcccccagcctccagcattcccagaacactccatcaggcaagacgctctgcactgtgataaacacggcttcctgatgcgctctggctatgcacgactgtgtcactgtccacaaaccttcagaaccgcgtatgcttactctgatcctg

SEQ ID NO: 203563 - DNA, 601 bp, Human
cctgtcagtgattggtaactggttgttaaaaatggccaccagcctccaaagacgcatccatcaccgtcactgtcagacgtgatggacggcaggtgtggtgtgcggtcgggccgcgtggagacgggtgcgcctggcactgctgtcactctttgtcaccacggccagctgagcgccccagctgccagttgccaccgcgcgaggcaggaaacacaccctctgaacatcccagcagcagctggagccgcaggctgcatcactgactcgtgtgaggacgcacggccctctcagatggcacacgacyggcgtgtttcatgtggtgggttgtaattacagcttccgtggtgccagatctgactccagtatcttttcagttctgctctgtgagcaagtctgcattaatctgcatctgaaacacaggaggctgcgcattcctgggggacagtctcttcgctttgcacacagagcctctttcacagactggtgtggggcagggcaggactcccggatccaatccctacaaccctcctgccaccaaaaatcacaagcaggtctccacctcggggtctgagagcctccagggccaccaagctggtcgtcctcc

SEQ ID NO: 203564 - DNA, 601 bp, Human
cttctggatgtcaacgcccccaacggccattcccctgcaggcccagctggcacctgagcatgtacctgtcagtgattggtaactggttgttaaaaatggccaccagcctccaaagacgcatccatcaccgtcactgtcagacgtgatggacggcaggtgtggtgtgcggtcgggccgcgtggagacgggtgcgcctggcactgctgtcactctttgtcaccacggccagctgagcgccccagctgccagttgccaccgcgcgaggcaggaaacacaccctctgaacatcccagcagcagcyggagccgcaggctgcatcactgactcgtgtgaggacgcacggccctctcagatggcacacgactggcgtgtttcatgtggtgggttgtaattacagcttccgtggtgccagatctgactccagtatcttttcagttctgctctgtgagcaagtctgcattaatctgcatctgaaacacaggaggctgcgcattcctgggggacagtctcttcgctttgcacacagagcctctttcacagactggtgtggggcagggcaggactcccggatccaatccctacaaccctcctgccaccaaaa

SEQ ID NO: 203565 - DNA, 601 bp, Human
gctgcgctaacattaacccacggcggcaggaggatggggctgtgtgcatctttccatccatgctgctctggagacggtgctgaggctctacaggagtgtcactctgagccaggctttctggggtctgtgggagttagaagggaccgtccctgccacctgccctctggacacacactgtgcccatgttgccacatcgagtccgctcatggctgtgggatgggccaaatcctgaatggtgcagggctttggagggctgcgccgactgcagccgatgcaggaacatcgtcagactgaggagtcrgccgccatgctctcagtttttaggagctcaggcctgcccatacacagggctagcgacagctgcacagtcatccctgtctgtcacgcctgatgggagctgccagtggacacagggacctggcctctcctgcccacagcctcacggcgcccactgtgcccacggctgagggatcagggggcagaggggctcaacaaggcagccggtaaccagatgaggtcacaacttcacctggagcctggctggggccggagcagccagcgggtctcaggagtctgtggggctgtggggggccatgaccag

SEQ ID NO: 203566 - DNA, 601 bp, Human
aggtaagatgagaacttgacgatgactaacattagtccacggcagtaggaggacagggctgcgctaacattaacccacggcagcagaggacggggctgcgctaacattaacccacggcggcaggaggatggggctgtgtgcatctttccatccatgctgctctggagacggtgctgaggctctacaggagtgtcactctgagccaggctttctggggtctgtgggagttagaagggaccgtccctgccacctgccctctggacacacactgtgcccatgttgccacatcgagtccgctcayggctgtgggatgggccaaatcctgaatggtgcagggctttggagggctgcgccgactgcagccgatgcaggaacatcgtcagactgaggagtcggccgccatgctctcagtttttaggagctcaggcctgcccatacacagggctagcgacagctgcacagtcatccctgtctgtcacgcctgatgggagctgccagtggacacagggacctggcctctcctgcccacagcctcacggcgcccactgtgcccacggctgagggatcagggggcagaggggctcaacaaggcagccggtaa

SEQ ID NO: 203567 - DNA, 601 bp, Human
tctgcaggccctcaccgccctgacctccaccctcagggaagggcgtccctgtggctgaggagctggcagggagggcagagaggctgccactggcctgcctcaccatccagagcacgctgggcacgtggcgagggcagtgccccactgggtctgcacaaggtctgtctacacactgggtccccaggtaagatgagaacttgacgatgactaacattagtccacggcagtaggaggacagggctgcgctaacattaacccacggcagcagaggacggggctgcgctaacattaacccacggcrgcaggaggatggggctgtgtgcatctttccatccatgctgctctggagacggtgctgaggctctacaggagtgtcactctgagccaggctttctggggtctgtgggagttagaagggaccgtccctgccacctgccctctggacacacactgtgcccatgttgccacatcgagtccgctcatggctgtgggatgggccaaatcctgaatggtgcagggctttggagggctgcgccgactgcagccgatgcaggaacatcgtcagactgaggagtcggccgccatgctctcagtttttagg

SEQ ID NO: 203568 - DNA, 601 bp, Human
ggctccacaggactggccctgcccggcggcagaagcacctgctgtgcctctgggtggctcctcccggacatccccagccttccactggcacggctggacgtggggagggggatgtggcaaagggagggggacgcaggacacagagctcagccctcgtcccagggtcccctgtatgcttgtcagagccactgattgctagtaagggagccgggtgcgatgtgtgaaggaggaggacgaatgaggctacacagtgtccggggtctccagcaaccccctgccttggcacgagagacctgctctrtgccctacctttcccatgggtttcttttaaaccaagggcagtcagaggaatttttaaataaagtatgagctcataaaaaatatagaaaagtgcattaaagattagtgaacacactacggattatgaatcatttaggagtgagtccaaaaaacagttcctcgaacagagtcccagcatagaccagagaaaatgccaagcgtcttttgttttttgtcttctttttctataaaatgagaagattcttggcatcaatataccagttgaaaatattgggtaatatttgcaaagtgaacttcctag

SEQ ID NO: 203569 - DNA, 601 bp, Human
ggcactatagccaccacccccaagtatgctggtggctactaggacctattagcacacaggcccacagggcaacagctgtgccctccaggctcgacaggctgggggtgtagcaggtgcagggtaaggatgagtaaaccaccttcccgctgccttctgtcggcacgcccccaccacgggcctcacacaggcttctccaggggctgggcctgagcttggcagagggaccccggccagacttggcgtgggaaatgtgtggtgaggccgggaggccagggtggcaggcaccaaggacccttcctcaggggcacgtgcccatgctcagcccccagtgaagccaggaacggcgttctgtaaagtgtgccatggtgccaatttcctagctttttaggaccagagtgggcaccgaacacagagaatgaccatcccagatggaatctgaggagctgagagcctggcttgctgggagggctgtggggcagggtttgctgggagggctgcggggcgggccctcagacacttcgccggcctcccttactttgacttcccaagagaaagcccttctggttagctccatcttctcaacggtcttcctggtgaaccc

SEQ ID NO: 203570 - DNA, 601 bp, Human
actacacccaagcctgacgatctttgatggaaacagcacacgtcatctcaaattaactcccggaggctccagactcctttcctatggcacacacgtgagcagcttcttggaagcgagagtgcgactcacccggctcccagggcaaggagggcagcaaaggccagagagcgctgcgtccccctctgggagtggctgagatcagggggctggcactatagccaccacccccaagtatgctggtggctactaggacctattagcacacaggcccacagggcaacagctgtgccctccaggctcracaggctgggggtgtagcaggtgcagggtaaggatgagtaaaccaccttcccgctgccttctgtcggcacgcccccaccacgggcctcacacaggcttctccaggggctgggcctgagcttggcagagggaccccggccagacttggcgtgggaaatgtgtggtgaggccgggaggccagggtggcaggcaccaaggacccttcctcgggggcacgtgcccatgctcagcccccagtgaagccaggaacggcgttctgtaaagtgtgccatggtgccaatttcctagctttttaggacca

SEQ ID NO: 203571 - DNA, 601 bp, Human
gaaagtgccaaggaagcctcacctctggagtcctctggcatcccgttggggtggacacaggcggcacccccgaacgtcagtgctcatcaaacatacacgggccaacggacacacagggtggagacaaggtcctcagaccctagaagacgcctctgctgaggcccctgggtcctggcagggggcatggcgagggcctcacaagcactacacccaagcctgacgatctttgatggaaacagcacacgtcatctcaaattaactcccggaggctccagactcctttcctatggcacacacgtgwgcagcttcttggaagcgagagtgcgactcacccggctcccagggcaaggagggcagcaaaggccagagagcgctgcgtccccctctgggagtggctgagatcagggggctggcactatagccaccacccccaagtatgctggtggctactaggacctattagcacacaggcccacagggcaacagctgtgccctccaggctcgacaggctgggggtgtagcaggtgcagggtaaggatgagtaaaccaccttcccgctgccttctgtcggcacgcccccaccacgggcctcacacaggct

SEQ ID NO: 203572 - DNA, 601 bp, Human
cctggagaagcattactggtcccgtggggttagccattccttggtaactcacattatggacgctggtgcagatcttagacattgccgtggagtgggaaaggaggacaaccagccaatcgcttcacaggcggccccaacgtgcaagtcctgtctttaaaacctgcttcgtcctggggaggccacggaaagtgccaaggaagcctcacctctggagtcctctggcatcccgttggggtggacacaggcggcacccccgaacgtcagtgctcatcaaacatacacgggccaacggacacacagkgtggagacaaggtcctcagaccctagaagacgcctctgctgaggcccctgggtcctggcagggggcatggcgagggcctcacaagcactacacccaagcctgacgatctttgatggaaacagcacacgtcatctcaaattaactcccggaggctccagactcctttcctatggcacacacgtgagcagcttcttggaagcgagagtgcgactcacccggctcccagggcaaggagggcagcaaaggccagagagcgctgcgtccccctctgggagtggctgagatcagggggctggcact

SEQ ID NO: 203573 - DNA, 601 bp, Human
cttcagtttttgaatgactctagaaaacagaactgactccaggggataaacattttctatgctacaaataattcttctagtcatggtgaacgtgaatataaatctgtgctcccggatgccgcgccactacaccaacgtaatgctttcgctgtgaaaggagaattcactaagaggctcccaccgctcctgccctgaacgtgcctgagggtccggaccactgctcagaatcgagggggtaattccgttacagttcagaaaactatggagcctactgacaaaccagcacgcaaagttccaggtytactattaggtcactgcaaacaggcagagataattcaaacgctaagttctgacaaacgccccagtcctctggatatccacctggagaagcattactggtcccgtggggttagccattccttggtaactcacattatggacgctggtgcagatcttagacattgccgtggagtgggaaaggaggacaaccagccaatcgcttcacaggcggccccaacgtgcaagtcctgtctttaaaacctgcttcgtcctggggaggccacggaaagtgccaaggaagcctcacctctggagtcctctg

SEQ ID NO: 203574 - DNA, 601 bp, Human
ttttccttaaaacgagttaataggaaatcattacggcttcagtttttgaatgactctagaaaacagaactgactccaggggataaacattttctatgctacaaataattcttctagtcatggtgaacgtgaatataaatctgtgctcccggatgccgcgccactacaccaacgtaatgctttcgctgtgaaaggagaattcactaagaggctcccaccgctcctgccctgaacgtgcctgagggtccggaccactgctcagaatcgagggggtaattccgttacagttcagaaaactatgragcctactgacaaaccagcacgcaaagttccaggtttactattaggtcactgcaaacaggcagagataattcaaacgctaagttctgacaaacgccccagtcctctggatatccacctggagaagcattactggtcccgtggggttagccattccttggtaactcacattatggacgctggtgcagatcttagacattgccgtggagtgggaaaggaggacaaccagccaatcgcttcacaggcggccccaacgtgcaagtcctgtctttaaaacctgcttcgtcctggggaggccacgg

SEQ ID NO: 203575 - DNA, 601 bp, Human
ataaagaagggttatacacagaagttccacgtagccactctctagcagcagggatgaaaggaggaagtagaaaaggatttctaaaatatggttcacaacaaaaggcccgagtactttacatgggttttccttaaaacgagttaataggaaatcattacggcttcagtttttgaatgactctagaaaacagaactgactccaggggataaacattttctatgctacaaataattcttctagtcatggtgaacgtgaatataaatctgtgctcccggatgccgcgccactacaccaacgtaaygctttcgctgtgaaaggagaattcactaagaggctcccaccgctcctgccctgaacgtgcctgagggtccggaccactgctcagaatcgagggggtaattccgttacagttcagaaaactatggagcctactgacaaaccagcacgcaaagttccaggtttactattaggtcactgcaaacaggcagagataattcaaacgctaagttctgacaaacgccccagtcctctggatatccacctggagaagcattactggtcccgtggggttagccattccttggtaactcacattatggac

SEQ ID NO: 203576 - DNA, 601 bp, Human
aggcggtgtccctttttttatttatctctatttttaggtttttgagacagggtcctcctctgttggccaggatggagtgcagtgatgtgatcatggctggctcactgcagcctcgacctccgggctcaagcaatcctcccgcctcaacctcctgagtatctgggactacaggcgtgccccacaatgcctggctaattttactttcttattttctgtagagacggggactccctatgttgcccaggctggtcttgaattcctgggctcaatgatcctcctgcctcagcctcccacagtgctkggaaggcaggtgtgaggcactgtccctggccttcccctttctttgtaggtgaactcttagggtttctctcctcctcctccaggaaatcactgtgacgtcagagaagcctgacccttgggtggtgaatgctgggggtgaacgatgtggaccctgcgagtggctctcactgggaaaactgaccaaaggcacggcaggaagaaacttgccaagtcccatccttctttattatcctgtagtttttggttaaattttaaccagaaacatgtctagaaataaagaagggttatacacagaagttcc

SEQ ID NO: 203577 - DNA, 601 bp, Human
cacagatgccgagaagttcccgtggtgtgaacctgcagtgtttgtccagcaggaaccagactgagaccaaccacttgtgacccacagacacggagctgcccactgttaggctgcggagatctggccagcccatctcatgctgtcaacccaagacaggcggtgtccctttttttatttatctctatttttaggtttttgagacagggtcctcctctgttggccaggatggagtgcagtgatgtgatcatggctggctcactgcagcctcgacctccgggctcaagcaatcctcccgcctcarcctcctgagtatctgggactacaggcgtgccccacaatgcctggctaattttactttcttattttctgtagagacggggactccctatgttgcccaggctggtcttgaattcctgggctcaatgatcctcctgcctcagcctcccacagtgcttggaaggcaggtgtgaggcactgtccctggccttcccctttctttgtaggtgaactcttagggtttctctcctcctcctccaggaaatcactgtgacgtcagagaagcctgacccttgggtggtgaatgctgggggtgaacgatgtg

SEQ ID NO: 203578 - DNA, 601 bp, Human
ggatgaggaagctctaactttcctggcacagatgccgagaagttcccgtggtgtgaacctgcagtgtttgtccagcaggaaccagactgagaccaaccacttgtgacccacagacacggagctgcccactgttaggctgcggagatctggccagcccatctcatgctgtcaacccaagacaggcggtgtccctttttttatttatctctatttttaggtttttgagacagggtcctcctctgttggccaggatggagtgcagtgatgtgatcatggctggctcactgcagcctcgacctcygggctcaagcaatcctcccgcctcaacctcctgagtatctgggactacaggcgtgccccacaatgcctggctaattttactttcttattttctgtagagacggggactccctatgttgcccaggctggtcttgaattcctgggctcaatgatcctcctgcctcagcctcccacagtgcttggaaggcaggtgtgaggcactgtccctggccttcccctttctttgtaggtgaactcttagggtttctctcctcctcctccaggaaatcactgtgacgtcagagaagcctgacccttgggt

SEQ ID NO: 203579 - DNA, 601 bp, Human
gctggtgccactgtgcgaaggcttcctcctgcagggcggggctgcgcgtgctggcccaggtcggggctgcatcaaggggaacacagagtgtgttcttggggtgggactctgagctctgtgttcacacgggactcacctggattcatccatcaggaacagaacaggctcctatgaggagcacttcgccatctctcctcggccctatctgatgcagcgtggctcatggcgcatgagctctatctggtagtaagttcacagagcaaccgcccctcagggctgtaggacccggtgctgattggcmtctgggagcaggctcctctccaggagactcgtgaggacacctcctgtcccacacagctctgacctggcctttgctctccctcaggagtgagcgccttctctgtaagtatgcatcctttctgcagaggacggccacatctcggaaagaagccattcgtgggtgctgcagccagctgcagtttatatcagctatggagtaaagcaagcagacgcggacgccaacgtccacctcagtttacgtcggctattgagtaaagcaagcggacgcggacactgacgtccacctcagtttacgtcggct

SEQ ID NO: 203580 - DNA, 601 bp, Human
tcaggacaaagctgggagcgcccctctctgctcaggacaaggcgtggtgtcgcctctgagagctggtgccactgtgcgaaggcttcctcctgcagggcggggctgcgcgtgctggcccaggtcggggctgcatcaaggggaacacagagtgtgttcttggggtgggactctgagctctgtgttcacacgggactcacctggattcatccatcaggaacagaacaggctcctatgaggagcacttcgccatctctcctcggccctatctgatgcagcgtggctcatggcgcatgagctctawctggtagtaagttcacagagcaaccgcccctcagggctgtaggacccggtgctgattggcctctgggagcaggctcctctccaggagactcgtgaggacacctcctgtcccacacagctctgacctggcctttgctctccctcaggagtgagcgccttctctgtaagtatgcatcctttctgcagaggacggccacatctcggaaagaagccattcgtgggtgctgcagccagctgcagtttatatcagctatggagtaaagcaagcagacgcggacgccaacgtccacctcagtttacg

SEQ ID NO: 203581 - DNA, 601 bp, Human
cgctggtgggtgggctgccctcactcccgggcccagtccctgctggggctgagtgcagcactggtgggtggccttgaagacacattttaccaatttttcatgccctcccctctcaacgtgaccctgctcctgagcttttatcctgctgacaacttcatgcagaaaaacacgcagacctctgatagcatgaaatcagaaacaatggccggggacaaagggggcgcggggcaggcgcaggccggctgggtcgaatttcagccacaaacagatgttcgtaggaacatctgaaaagaaactcttstaaaagaaatggtcttaaaaacaatgccttcagcggttaaataaagggccaaaggacgcaggatgcctgtcaatgataaatctcggcaaagagaaccaaaccggcatcatgaatttcaatgacaggtttcttgactaccaagggccccggttcaccagggattccagaccccgggaaggaagcatcggagctgggtgtccctcacggtccgaactcatcgggaggcactttttgtttcacggggctgtaatttatggaaagctgtgcccgtctccaagacttccctgaagaacagcaatg

SEQ ID NO: 203582 - DNA, 601 bp, Human
gtttccctggtggtgtctggcagcttggccagagccggccactcctccacctctgtgggggcccgtccagcctggcccttaagtgtcgcaagacacagacctgcaggtgcaaatccgctgtggctggagttctttctcataacaaaaacttcctctgttccaaggatggaattcgggaccacacgctcagccatggtctgtctgcgccagagtgaatgcactaaaaccaggaggctcagatgtggccccagcctgcctgtctgagccccggggccggccttggagggtgtcctcagcacaygtgtgcaccccagtcctcatcacaggtttcctgggagggtaacgtctgcgctccagtgaggctgcccgtcagcaagcttagctagggtgtgaccgctgtgggctggctggggtggtgtgaactcagccactgacttcagtgattcagaagtttcctccccacacgtgacgaggagtgagtccagtcttgaagaaagtgctgattcggaagcaaactgcctctggcactttgcagacatccaattgatacccacgggacaaatgaatgaatggagggaggggcagagcccacagccccagg

SEQ ID NO: 203583 - DNA, 601 bp, Human
caccaggtgtccagagcgccctgcctgggccaagtggacacacagcctcgggggcccactcagggctccgaagaagccatctgggcacacgtgcaggcaacgccgaggccctaccccaggcttggcttctaggtcctgccaaggcgtctcagggtaggcagggtaggcgaggctgggtgggcagcatgtgttgctcttgtggctgagctgggagctctcacgcacccgcctgttctccaggacacactcctcctcgggggccaccacacccgggcccaccacacccgaggccaccatggcygggcccaccatgcccaggcccaccatacccagggccaccacacccgaggccaccacgccagaagcccaccatgcccgggcccaccatacccaaggccaccacagctgaggcccaccacgcccgaagcccaccacgcctgggcccaccacacccgaggccaccatgcctgaagcccaccatgcccagggccaccacacccgaggccaccacgcccgaggcccaccacacccagggtctgacacactgtgggcccaccacacccgaggcccgggctggggccagtgccagccgtgacatgcc

SEQ ID NO: 203584 - DNA, 601 bp, Human
aacaaataccctaaatgctatgtttaaaaagccatctaagatgtatttcattattagcagccgcaaggagaggctctggaaagagtggtccggtgtgccgtcttatccacacttagaatttaacgggaacgctgtgtgccagggtcatccacacgcgtgtggatcacgaagttcctgcatttcttcttactgtttggataaccaaggaggcatgctgcctggacagggcgtccacaggcccagggcacaggtgtcagcccaggagaaaggctgttttctgtgcaaggaaataacgcagtcwttcggatgtgcacggagctgcatggcaggcagagtcgccccaatgtgcacctgtgcagttggtctcacgttgggagctgaatctgtcccatcaccccctcaactgtcccggacactctgccacaaaatccaaaactctactaaaggcaaacacatcctctcagaccctgtcagcccaagtttttaaatgcaaccttcaagagctggtttataaaaacaaaaagttgttctgtactctctgaaatgaatcctcgctggctgtagcctccaggcaccgcacgcacagccagcaggcgcctgg

SEQ ID NO: 203585 - DNA, 601 bp, Human
gagaaacaaataccctaaatgctatgtttaaaaagccatctaagatgtatttcattattagcagccgcaaggagaggctctggaaagagtggtccggtgtgccgtcttatccacacttagaatttaacgggaacgctgtgtgccagggtcatccacacgcgtgtggatcacgaagttcctgcatttcttcttactgtttggataaccaaggaggcatgctgcctggacagggcgtccacaggcccagggcacaggtgtcagcccaggagaaaggctgttttctgtgcaaggaaataacgcrgtcattcggatgtgcacggagctgcatggcaggcagagtcgccccaatgtgcacctgtgcagttggtctcacgttgggagctgaatctgtcccatcaccccctcaactgtcccggacactctgccacaaaatccaaaactctactaaaggcaaacacatcctctcagaccctgtcagcccaagtttttaaatgcaaccttcaagagctggtttataaaaacaaaaagttgttctgtactctctgaaatgaatcctcgctggctgtagcctccaggcaccgcacgcacagccagcaggcgc

SEQ ID NO: 203586 - DNA, 601 bp, Human
ccagggcaggccattgacattccgagcacagaccggctgatggggtcaagccccccaaagtggcttttggactcatgtgtcacaaatcagtctggagccttcaaacagcgtgaggattagaacaagcacccaaacagccacacagcggggccaccctgcccacccctgtgtcccaaggaggtccggccccatccagatgctaatgggcttaagtggcttaagctgctttccctgaatgggagaaggcttggcaggcagacggccattgtagccatcccaggacgcggctcaggaaattcayggctctgtctcccaaaaggcatctgcgggaaactgtttaaaaactgctttatctcagcacttcaggcaggctcccaaaggacaaacatctgatggaccccagagcccaggaaggggccggccaccccaaacccctccccagagctgcctcattcacaggctgtaaaggagtgatcaggccaggctgaaggggccaaagctggcctgttccctttgcctttcaatccagcaaagtcgtggccactcatgcggaaagcggccaggctgggcctttccggctcgcctactttgggaagggatt

SEQ ID NO: 203587 - DNA, 601 bp, Human
tctggtgcctgtggatgctcactggcctgaccagctacgggaaggggcagtcatctgggcagcagaggagagggaggctgagtgagtgccgatctctctcccacactgcatggctgagctgctccaggaggcacggtcctggctggcggacagccggcacagatcaccgcgaaggattacattgaggcctgttttgaaaattcttctcgtcttaacctcagtacaatgcagggaatggtcactgagggtcagtccctaaaggtaagagagctggagacccctacctgggtggactggccayggggagcccctggccccgacacaggggccttgtgggcactgagctctccgagcttggcagaagtcatgaaaacaagaatgcctagaacctcaccgaacaagggaagtgtgagacccacatctgagagaaatcaaagctctgtgtggacagcgagggcccgtgctcatggcgggcagaggcaccggcgtttctgcatcgctggtgtgggtggaggagggcacagctgctgccttacacaaaaggccacagactgtagattccatttacacaaaatacccagacatggcgaagtcggagaga

SEQ ID NO: 203588 - DNA, 601 bp, Human
gagacaaggggctttcctccccaccccacagcaccagcgtctcccctcgcacacggggggatctctgaagctgatgggtcgagtgtcatgctgcccgtggacaggacagtgatacggagcctccacccaacctggcccggggtgccggacgcacccaatatgtgtccccagcagtctgacttgcactggctcagaactgagtcctggaggtggcagggacaaggcagggtggtcccaggtaagcagaggtaatgggaaggcctgggggcgtggatgtcccaggacgggggagctgccacaytggaccacaaactcaccgcggtgccgttgttgtctcggaaaacctcctggttgaagtagtcgaagagtttcttttctaactggagcataacctgtgaagtcagagtggcccatgagcacctgagctcccccagccttgtgcgtgtcccctagcccccaccgaaccgggcaggcagggcggctctgaaggaagctgcagagtcctgcgcaggccccgtgcgtcacctgcccagtcacaggccccactcaccttccggtcgttgtccgactcacgaaatatgagcttcaccacttcattggt

SEQ ID NO: 203589 - DNA, 601 bp, Human
ccgaggccgcatatggggcccagccagctgctgcgtggttcctggttctttgcgctgataaacatttgtaaatacattaaaaatgggacaaaagtagaccacaataaaaaataaaaattgtaaagagagtgtgtaggccgcccctcagcgctcgcctacactgatcccttgaagggaagactcacgatttcaaaaccaacagcaggtccagcagccggggctgtctctcactggcaggggccacctctccgtggaccgacctgagccgcacattcccattgacacgcacttgtttacacaygtgctcatggacatacagcggcacacccaccccacagaggcagatacgcactcacgtgcacatgtgcacacgcatgcactagagcacacacacgtgctcacacacagacccacacacagcaagtctagcgacaggagtgtgaggaacctgctcccttcagtctcccacttcagagtgaggcccgaggcccggccggttcactctgagacaaggggctttcctccccaccccacagcaccagcgtctcccctcgcacacggggggatctctgaagctgatgggtcgagtgtcatgctgccc

SEQ ID NO: 203590 - DNA, 601 bp, Human
gcccaggatgctaggatgtgaacgcggctgcagtgtcctgggtctacccgcctgtgctccctcacctctcccccggccactccccagacagcttcctgaggacaggggccacctgccctgacgcagcgccaagggaaccatagctggctcgggagcgccctaggaactgatgccgaggtttccagatcttggatgctggctcgttgcacacggcatcacgtgtggcttggaatcgccacagtgggcgtgtttacagaaatcggccgaggccgcatatggggcccagccagctgctgcgtgrttcctggttctttgcgctgataaacatttgtaaatacattaaaaatgggacaaaagtagaccacaataaaaaataaaaattgtaaagagagtgtgtaggccgcccctcagcgctcgcctacactgatcccttgaagggaagactcacgatttcaaaaccaacagcaggtccagcagccggggctgtctctcactggcaggggccacctctccgtggaccgacctgagccgcacattcccattgacacgcacttgtttacacacgtgctcatggacatacagcggcacacccaccccacag

SEQ ID NO: 203591 - DNA, 601 bp, Human
gggcacaggaggcccaggcaccacggaggtgtgggcgtcacgggagcctcgggctctgggttgatgaggggcaggaggcagaagtgacttcccaagaagacaggagcgtggggtctgggggccgttggggaggcagcgaatgccatcctggagtggaggttctgggcctgggactcggggctggcagcgtccgctgggctgggcgtgcccctctgtctggcactgagagaccccagctcttcctaagcactttgcatgcactcacccataagcccccaaaccccacgaggggaaactgacrcacagacacctggctggcccaggatgctaggatgtgaacgcggctgcagtgtcctgggtctacccgcctgtgctccctcacctctcccccggccactccccagacagcttcctgaggacaggggccacctgccctgacgcagcgccaagggaaccatagctggctcgggagcgccctaggaactgatgccgaggtttccagatcttggatgctggctcgttgcacacggcatcacgtgtggcttggaatcgccacagtgggcgtgtttacagaaatcggccgaggccgcatatggggccc

SEQ ID NO: 203592 - DNA, 601 bp, Human
gaaaccttaggcttgcccaggctgatggggccatgtggggacaggacaccaaggcctgacccgaccccagtgggggaaaggaccatgggctcctgcagcaggtgacagggacgggcacaggaggcccaggcaccacggaggtgtgggcgtcacgggagcctcgggctctgggttgatgaggggcaggaggcagaagtgacttcccaagaagacaggagcgtggggtctgggggccgttggggaggcagcgaatgccatcctggagtggaggttctgggcctgggactcggggctggcagcrtccgctgggctgggcgtgcccctctgtctggcactgagagaccccagctcttcctaagcactttgcatgcactcacccataagcccccaaaccccacgaggggaaactgacacacagacacctggctggcccaggatgctaggatgtgaacgcggctgcagtgtcctgggtctacccgcctgtgctccctcacctctcccccggccactccccagacagcttcctgaggacaggggccacctgccctgacgcagcgccaagggaaccatagctggctcgggagcgccctaggaactgatg

SEQ ID NO: 203593 - DNA, 601 bp, Human
ggagggtgcctcccacacatggcgcaggaggaaacccagcctgcctggatggagagaagcggaggaaaccttaggcttgcccaggctgatggggccatgtggggacaggacaccaaggcctgacccgaccccagtgggggaaaggaccatgggctcctgcagcaggtgacagggacgggcacaggaggcccaggcaccacggaggtgtgggcgtcacgggagcctcgggctctgggttgatgaggggcaggaggcagaagtgacttcccaagaagacaggagcgtggggtctgggggccgytggggaggcagcgaatgccatcctggagtggaggttctgggcctgggactcggggctggcagcgtccgctgggctgggcgtgcccctctgtctggcactgagagaccccagctcttcctaagcactttgcatgcactcacccataagcccccaaaccccacgaggggaaactgacacacagacacctggctggcccaggatgctaggatgtgaacgcggctgcagtgtcctgggtctacccgcctgtgctccctcacctctcccccggccactccccagacagcttcctgaggacagggg

SEQ ID NO: 203594 - DNA, 601 bp, Human
tcctgggcacctgcctccacccagacatctgtgctccccaggctctccctgctccccactgacgaggccgggatgcgccacccgggagtgtcctgtagctggaagcatcctggagcccagagtcccgcaggcagagccagagaggggcagcgggagccacagacaggcggccccaccaggccctggaggcttgagaaggagaggggagggtgcctcccacacatggcgcaggaggaaacccagcctgcctggatggagagaagcggaggaaaccttaggcttgcccaggctgatggggccrtgtggggacaggacaccaaggcctgacccgaccccagtgggggaaaggaccatgggctcctgcagcaggtgacagggacgggcacaggaggcccaggcaccacggaggtgtgggcgtcacgggagcctcgggctctgggttgatgaggggcaggaggcagaagtgacttcccaagaagacaggagcgtggggtctgggggccgttggggaggcagcgaatgccatcctggagtggaggttctgggcctgggactcggggctggcagcgtccgctgggctgggcgtgcccctctgtctggc

SEQ ID NO: 203595 - DNA, 601 bp, Human
cccgcctctacccagacacgtcctgtgcaccccctttcacgcagacgcctcctgggcacccgcctccacccagacacctcctgggcacccgcctccatccagagacctcctgggcacccgcctccacgaaggcacttcctgggcacctgcctccacccagacacctcctgggcacctgcctccatccagacacctcctgggcactcgcctccacgaagacacctcctgggcacctgcctgcacccagacacctcctgggcacctgcctccacccagacacctcctgggcactcgcctccaygaagacacctcctgggcacctgcctccacgaagacacctcctgggcacctgcctccacccagacatctgtgctccccaggctctccctgctccccactgacgaggccgggatgcgccacccgggagtgtcctgtagctggaagcatcctggagcccagagtcccgcaggcagagccagagaggggcagcgggagccacagacaggcggccccaccaggccctggaggcttgagaaggagaggggagggtgcctcccacacatggcgcaggaggaaacccagcctgcctggatggagagaa

SEQ ID NO: 203596 - DNA, 601 bp, Human
agcacctcctccaaacgacggcagccctgtctccctcctgggcacctgcctccacccagacgcctcctgggcacccgcctccacccagacacctcctgggcacccgcctccacccagacacctcctgggcacccgcctccacccagacgcctcctgggcaccccccttcacgcagacgcttcctgggcacctgcctctacccagacgcctcctgggcacccgcctctacccagacacgtcctgtgcaccccctttcacgcagacgcctcctgggcacccgcctccacccagacacctcctrggcacccgcctccatccagagacctcctgggcacccgcctccacgaaggcacttcctgggcacctgcctccacccagacacctcctgggcacctgcctccatccagacacctcctgggcactcgcctccacgaagacacctcctgggcacctgcctgcacccagacacctcctgggcacctgcctccacccagacacctcctgggcactcgcctccatgaagacacctcctgggcacctgcctccacgaagacacctcctgggcacctgcctccacccagacatctgtgctccccaggct

SEQ ID NO: 203597 - DNA, 601 bp, Human
tggcactgaggagccagctctgctagggaccctgaaagcacctcctccaaacgacggcagccctgtctccctcctgggcacctgcctccacccagacgcctcctgggcacccgcctccacccagacacctcctgggcacccgcctccacccagacacctcctgggcacccgcctccacccagacgcctcctgggcaccccccttcacgcagacgcttcctgggcacctgcctctacccagacgcctcctgggcacccgcctctacccagacacgtcctgtgcaccccctttcacgcagacrcctcctgggcacccgcctccacccagacacctcctgggcacccgcctccatccagagacctcctgggcacccgcctccacgaaggcacttcctgggcacctgcctccacccagacacctcctgggcacctgcctccatccagacacctcctgggcactcgcctccacgaagacacctcctgggcacctgcctgcacccagacacctcctgggcacctgcctccacccagacacctcctgggcactcgcctccatgaagacacctcctgggcacctgcctccacgaagacacctcctgggc

SEQ ID NO: 203598 - DNA, 601 bp, Human
ctcccctggcactgaggagccagctctgctagggaccctgaaagcacctcctccaaacgacggcagccctgtctccctcctgggcacctgcctccacccagacgcctcctgggcacccgcctccacccagacacctcctgggcacccgcctccacccagacacctcctgggcacccgcctccacccagacgcctcctgggcaccccccttcacgcagacgcttcctgggcacctgcctctacccagacgcctcctgggcacccgcctctacccagacacgtcctgtgcaccccctttcacscagacgcctcctgggcacccgcctccacccagacacctcctgggcacccgcctccatccagagacctcctgggcacccgcctccacgaaggcacttcctgggcacctgcctccacccagacacctcctgggcacctgcctccatccagacacctcctgggcactcgcctccacgaagacacctcctgggcacctgcctgcacccagacacctcctgggcacctgcctccacccagacacctcctgggcactcgcctccatgaagacacctcctgggcacctgcctccacgaagacacctc

SEQ ID NO: 203599 - DNA, 601 bp, Human
ctttgctcccctggcactgaggagccagctctgctagggaccctgaaagcacctcctccaaacgacggcagccctgtctccctcctgggcacctgcctccacccagacgcctcctgggcacccgcctccacccagacacctcctgggcacccgcctccacccagacacctcctgggcacccgcctccacccagacgcctcctgggcaccccccttcacgcagacgcttcctgggcacctgcctctacccagacgcctcctgggcacccgcctctacccagacacgtcctgtgcaccccctytcacgcagacgcctcctgggcacccgcctccacccagacacctcctgggcacccgcctccatccagagacctcctgggcacccgcctccacgaaggcacttcctgggcacctgcctccacccagacacctcctgggcacctgcctccatccagacacctcctgggcactcgcctccacgaagacacctcctgggcacctgcctgcacccagacacctcctgggcacctgcctccacccagacacctcctgggcactcgcctccatgaagacacctcctgggcacctgcctccacgaagac

SEQ ID NO: 203600 - DNA, 601 bp, Human
agactttgctcccctggcactgaggagccagctctgctagggaccctgaaagcacctcctccaaacgacggcagccctgtctccctcctgggcacctgcctccacccagacgcctcctgggcacccgcctccacccagacacctcctgggcacccgcctccacccagacacctcctgggcacccgcctccacccagacgcctcctgggcaccccccttcacgcagacgcttcctgggcacctgcctctacccagacgcctcctgggcacccgcctctacccagacacgtcctgtgcacccgctttcacgcagacgcctcctgggcacccgcctccacccagacacctcctgggcacccgcctccatccagagacctcctgggcacccgcctccacgaaggcacttcctgggcacctgcctccacccagacacctcctgggcacctgcctccatccagacacctcctgggcactcgcctccacgaagacacctcctgggcacctgcctgcacccagacacctcctgggcacctgcctccacccagacacctcctgggcactcgcctccatgaagacacctcctgggcacctgcctccacgaa

SEQ ID NO: 203601 - DNA, 601 bp, Human
ggctgggaactgtcccctgccaccaccctacctgtggctgagggagcctccctcttccctgtctcctagctccttccaaaacattccatctccctgggcttccctggcatcctcctccaagggaccctccactttttcatgccctgtgcaaggtccccggagactttgctcccctggcactgaggagccagctctgctagggaccctgaaagcacctcctccaaacgacggcagccctgtctccctcctgggcacctgcctccacccagacgcctcctgggcacccgcctccacccagacrcctcctgggcacccgcctccacccagacacctcctgggcacccgcctccacccagacgcctcctgggcaccccccttcacgcagacgcttcctgggcacctgcctctacccagacgcctcctgggcacccgcctctacccagacacgtcctgtgcaccccctttcacgcagacgcctcctgggcacccgcctccacccagacacctcctgggcacccgcctccatccagagacctcctgggcacccgcctccacgaaggcacttcctgggcacctgcctccacccagacacctcctgggc

SEQ ID NO: 203602 - DNA, 601 bp, Human
ccactccacgcagccccggctgggaactgtcccctgccaccaccctacctgtggctgagggagcctccctcttccctgtctcctagctccttccaaaacattccatctccctgggcttccctggcatcctcctccaagggaccctccactttttcatgccctgtgcaaggtccccggagactttgctcccctggcactgaggagccagctctgctagggaccctgaaagcacctcctccaaacgacggcagccctgtctccctcctgggcacctgcctccacccagacgcctcctgggcasccgcctccacccagacacctcctgggcacccgcctccacccagacacctcctgggcacccgcctccacccagacgcctcctgggcaccccccttcacgcagacgcttcctgggcacctgcctctacccagacgcctcctgggcacccgcctctacccagacacgtcctgtgcaccccctttcacgcagacgcctcctgggcacccgcctccacccagacacctcctgggcacccgcctccatccagagacctcctgggcacccgcctccacgaaggcacttcctgggcacctgcctccac

SEQ ID NO: 203603 - DNA, 601 bp, Human
cacacatgctcacacacgctcatatgcatatgcttgctcacacatgctgacacacctgctcacacgccagctcacacacttgcctgctcacatgcatatgcacatatgatcacacacacgcatatgatcacacacatgcatacgatcacacacacgcatactcacacaggctcacatgcatatgcctgctcacacacgtccgcacacatgcctgcttatacacacacttgcccattcacatgcatatgcacgcacactcatgcatactcctacaggctcacatgcatatgcctgctcacamacatatccacgcacacacgctgacacacactccaataggaacaaccccaaggcaagttgtggggaagctggaaaactccaggaagaaggagcaggctggggctgcccaaggttttcggtggctgggggccccctccttcccatggggactgaatgggattcctcggccggcatcctgcctgggtggtggtgtttcaggactgctcagtggaccaaggccactttcccaccctgtcttctgagttagaaggcccccagttttggcagtgcaaagtaaaaataaaaggaaattcgtgtgtgg

SEQ ID NO: 203604 - DNA, 601 bp, Human
tcatatgcatatgcctgctcacacacactcgctcacacctgctctcacgcacactcccactcatatgcatgtctgctcacacacacgctcacacagctcacacactcgcccactcaaatgcatatgcatacacgctcacacacacgctcatgaaggctcacatgcacacacctgctcacacctgctcatgcatgtacacgcctgctcacacatgcacacacccgctcatgtgcatatgcctgctctcacacatgctcacacacgctcatatgcatatgcttgctcacacatgctgacacacctgctcacacgccagctcacacacttgcctgctcacatgcatatgcacatatgatcacacacacgcatatgatcacacacatgcatacgatcacacacacgcatactcacacaggctcacatgcatatgcctgctcacacacgtccgcacacatgcctgcttatacacacacttgcccattcacatgcatatgcacgcacactcatgcatactcctacaggctcacatgcatatgcctgctcacacacatatccacgcacacacgctgacacacactccaataggaacaaccccaaggca

SEQ ID NO: 203605 - DNA, 601 bp, Human
gcacacacccactcatatgcatatgcctgctcacacacactcgctcacacctgctctcacgcacactcccactcatatgcatgtctgctcacacacacgctcacacagctcacacactcgcccactcaaatgcatatgcatacacgctcacacacacgctcatgaaggctcacatgcacacacctgctcacacctgctcatgcatgtacacgcctgctcacacatgcacacacccgctcatgtgcatatgcctgctctcacacatgctcacacacgctcatatgcatatgcttgctcacayatgctgacacacctgctcacacgccagctcacacacttgcctgctcacatgcatatgcacatatgatcacacacacgcatatgatcacacacatgcatacgatcacacacacgcatactcacacaggctcacatgcatatgcctgctcacacacgtccgcacacatgcctgcttatacacacacttgcccattcacatgcatatgcacgcacactcatgcatactcctacaggctcacatgcatatgcctgctcacacacatatccacgcacacacgctgacacacactccaataggaac

SEQ ID NO: 203606 - DNA, 601 bp, Human
tcatgcacacacccactcatatgcgtatgcctgctcacacacactcgctcacacctgctctcatgcacacacccactcatatgcatatgcctgctcacacacactcgctcacacctgctctcacgcacactcccactcatatgcatgtctgctcacacacacgctcacacagctcacacactcgcccactcaaatgcatatgcatacacgctcacacacacgctcatgaaggctcacatgcacacacctgctcacacctgctcatgcatgtacacgcctgctcacacatgcacacacccgytcatgtgcatatgcctgctctcacacatgctcacacacgctcatatgcatatgcttgctcacacatgctgacacacctgctcacacgccagctcacacacttgcctgctcacatgcatatgcacatatgatcacacacacgcatatgatcacacacatgcatacgatcacacacacgcatactcacacaggctcacatgcatatgcctgctcacacacgtccgcacacatgcctgcttatacacacacttgcccattcacatgcatatgcacgcacactcatgcatactcctacaggctc

SEQ ID NO: 203607 - DNA, 601 bp, Human
ggatacgtgtatggctggactgcaggggatggcttcactgtcaccactgaacactccccagtcttcctcagtctccaagagagacctgcagagccgtgtcaggcccctggagcctcctctggggtcagcacctgctcctgggtggccaggacctccctcaggcctcagcggctgccgctagggtctgcctaaactttctaactaaaaagcaaaccaccccccacacacacccactcacatgcacacacctgctcacgctcatgcatgcacacgcctgctcacacacacacacacacccactcactcatatgcatatgcctgctcacacacactcgctcacacctgctctcatgcacacacccactcatatgcatatgcctgctcacacactcgctcacacctgctctcatgcacacacccactcatatgcgtatgcctgctcacacacactcgctcacacctgctctcatgcacacacccactcatatgcatatgcctgctcacacacactcgctcacacctgctctcacgcacactcccactcatatgcatgtctgctcacacacacgctcacacagctcacacactcgcccactcaaat

SEQ ID NO: 203608 - DNA, 601 bp, Human
ttacagtaatggtaagaagtgtgggagaagaaacgcagacaccagtaacacagttgtttgttgttgctctgaagtacgacacgctgcgcatccctgagtgtgccagactctcccacagcaggcggcgcagcggctccttcacaccagtgccgccacgctgtgatgtcacaacagttacatcacacagcgagaggaagctttcagtcctatcgtcagattatcaaaccttagtcacatatgtagtctgttgactgaaacgacattatgtgacgtgactgtatacacacacgcacacacacargtgcatacaagtacacgcacacatacacacacacgagtgcacacgtgtacacacacatgcatacaccacacacgagtgcacacatgcatacacacatacaccacacacactagtgcacatgcacacgcatgcgtacacaccacacacgtgagtgcacacatgtacacgcatacatacaccacacaaagtgcacacatgtacacgcacacacatatgtgtacacacacacactccccccccacacttgcttttctcttcaattcctgaccgggccgaggaattccaggccaggcggattct

SEQ ID NO: 203609 - DNA, 601 bp, Human
gagtgcattacagtaatggtaagaagtgtgggagaagaaacgcagacaccagtaacacagttgtttgttgttgctctgaagtacgacacgctgcgcatccctgagtgtgccagactctcccacagcaggcggcgcagcggctccttcacaccagtgccgccacgctgtgatgtcacaacagttacatcacacagcgagaggaagctttcagtcctatcgtcagattatcaaaccttagtcacatatgtagtctgttgactgaaacgacattatgtgacgtgactgtatacacacacgcacrcacacaggtgcatacaagtacacgcacacatacacacacacgagtgcacacgtgtacacacacatgcatacaccacacacgagtgcacacatgcatacacacatacaccacacacactagtgcacatgcacacgcatgcgtacacaccacacacgtgagtgcacacatgtacacgcatacatacaccacacaaagtgcacacatgtacacgcacacacatatgtgtacacacacacactccccccccacacttgcttttctcttcaattcctgaccgggccgaggaattccaggccaggc

SEQ ID NO: 203610 - DNA, 601 bp, Human
ggacctgcctgaggctgtttacaggtacctttttttattaagtagaaggagtgcattacagtaatggtaagaagtgtgggagaagaaacgcagacaccagtaacacagttgtttgttgttgctctgaagtacgacacgctgcgcatccctgagtgtgccagactctcccacagcaggcggcgcagcggctccttcacaccagtgccgccacgctgtgatgtcacaacagttacatcacacagcgagaggaagctttcagtcctatcgtcagattatcaaaccttagtcacatatgtagtctgttgactgaaacgacattatgtgacgtgactgtatacacacacgcacacacacaggtgcatacaagtacacgcacacatacacacacacgagtgcacacgtgtacacacacatgcatacaccacacacgagtgcacacatgcatacacacatacaccacacacactagtgcacatgcacacgcatgcgtacacaccacacacgtgagtgcacacatgtacacgcatacatacaccacacaaagtgcacacatgtacacgcacacacatatgtgtacacacacacactccccccccacact

SEQ ID NO: 203611 - DNA, 601 bp, Human
gagggaacagtaaaaacaaggtctaaagaagaaaaagcgtgcgcctctgcggagccccgctcgcgaagggagctggcagggctgggacgggctcggggtgagctggtgagcgggcgggggtgagcgggaaggcctgggatcaactgtgcactgcagactttagaaatgcccagcgctgagagtaacagaatgtcagactttataaatacggaacgctgagacgctaagagtaacataatgtactgaaatgtattttctcgtaataagttaaccttaacttattgtaacttttttactttayaaactttaacatttttcaactttttcactcttttgtcaaatagtacttggcttaaaacacattgtatagctgtataaaatattgtttatatattctataaactttttgcctattctttatatttaatatttcaaaatcttaaaacattttttgataacaatgaagacaacgacacagacatgagcctaggcccgcacagggtcaggatcatcgacgttcctctctgccgcctctgcgtcccacggaaaggccctcaggggcaaccacccgcatgcagcctcatctcctgtgataacggcg

SEQ ID NO: 203612 - DNA, 601 bp, Human
aatcagaactccgccttcggggagaaaagtctctgcaactcctcgccctaaatgtaaacagagttcaatatcactgttggctgaaccaatgatttgcattgacagggaaacgtgatggcagaaaaattaaaaacccagctttccgatccttttcaggaggaacgcgggtctgaatccaactgacgaaacccgacgctcaggagacagggccgccggacaccgtgggagagtcccacagccacaggagaccccacgtgggccacatccacagatggcagctcccagccttgtgctcctcatragaggagacaaaggacggtctaaggcttttcagcagctctgggggtccttcctcagcacctgcccatagataagacagtccatgacaataggaaaacagccgagctggggtcagctggggacccattccatggtgctgtgctgtcgggtcagctggggacccacatcatcgcactggcccatggggtcagctggggacccaacgacattgcactggcccatagggtcagctggggactcaggtcatggcactgggctgtggggtcggccgggcacccacgccatggtgctgggctgtggg

SEQ ID NO: 203613 - DNA, 601 bp, Human
ttccttcttcatcccaccctgctccagaagctcagctactcctggttctctgtgggacctgctggtggggctgtgtctctccatcgccaggtactgtctttatggtggccagtgttctgaaggctgacttggctgctgagagaactctaagtgtgtgggtggggttttccaccagctctttgactgaacgcctccacttctcctggtgtgtatttttgtggttgttctggaaacccgccgccacttgcattcttatgtaataggacatttttcccacaatgcttcaaaaatattctcttcrtctttgatgttccgctgtttcactctgacatgtctgtgtgtggatttacttccattcctcctgctcaggactcaccatgcttcctgaggtttatgtcttggataattctggaaaacgcccagccattgactctccagtgtgcccctcgtggaccctcactgcgcaagcgctgggctcttccctcctctcccagccccgaccctcctgtcccatcctgccacgtttctgtgctgcattctgggccattccccaggcctgccatcccattcctcaatcccttctccagctgtgtctactccg

SEQ ID NO: 203614 - DNA, 601 bp, Human
tcaggtgtggaggtgaggaggcagcagggaggctgccagcgctaggtgccatgcggttcttggctctgcaggcaccagctatgagactaggagcccagatttccctaaggcctgcccaggagcatctatgagatctgctgagactcagaaaggagccactgccatcctgtggctttcaccaaaatgctgatggcaggttccctgaatctctatgatacaacatgtttcgagatttcaggaaggcactggcaggaggggatcagatctcccctgcaccaccaaaccctctcattcctcccartgtaactcagacctttcaagaatcccaagtatggtttttaagttatttatttatttattgaaacagagtctccctctgtcacccaggctggagtgcagtgatgtgatctcggctcactgcaacctctgcctcctgggctcaagtgattctcctgcctcagcctcccgagcagatggaattacaggcgtgtgccaccactcctgctaagtctttattttttgtagagacggggtcttgccacattgccctggcttgtctgagactactggcctcaagcaatcctcctgcctcggcctcccc

SEQ ID NO: 203615 - DNA, 601 bp, Human
catgtgtgtctttgcatgcaggcatttactcagatacattcacacacaggcctataaacacgcatcatctctaggtcattctggagcttgagtttgaggcttccccacatcagagatgcagcagggtccccagtccagcgtgggccctgctggcttctcaggtgtggaggtgaggaggcagcagggaggctgccagcgctaggtgccatgcggttcttggctctgcaggcaccagctatgagactaggagcccagatttccctaaggcctgcccaggagcatctatgagatctgctgagastcagaaaggagccactgccatcctgtggctttcaccaaaatgctgatggcaggttccctgaatctctatgatacaacatgtttcgagatttcaggaaggcactggcaggaggggatcagatctcccctgcaccaccaaaccctctcattcctcccaatgtaactcagacctttcaagaatcccaagtatggtttttaagttatttatttatttattgaaacagagtctccctctgtcacccaggctggagtgcagtgatgtgatctcggctcactgcaacctctgcctcctgggctcaag

SEQ ID NO: 203616 - DNA, 601 bp, Human
tcatacagtctgtccttaaagacagacaactccttgtcaaactccaagagctaaagaaaagaaagagcagaaaataaagtcacattggttttcctcgctgggggcacgtgtgtctgtgtgcagctgggacgctcaaatgctcggtgtgacatctgctcttcccagagccgccacatctgtcaccagaaagctctgtggtgccagcaggctctggtgttcgcctgcctctgctgcagacagtgggacctgccctgcccgttatagatgtgctctgcccacccataaagctttctctgttggkgacgccagagaagcactcatggcctcgggcactgccgtggcagccccagtagcagcccctctcggcctctcctccctagtgctggctcccccagcagagggaacacagctcctgtcctgcccagagtgtcaagtaacctgcagagtgagcaatgtcagctttgtgagaacaggtcagggaaaatggccccaaggtgcacactggtgagattctggcagcagttcgggggcaaaatgttcattctcacatgcacgggaggcagcaaatggccttgccccctgagactcttccaaaacaagc

SEQ ID NO: 203617 - DNA, 601 bp, Human
gggaacgagatgtccagttcatacagtctgtccttaaagacagacaactccttgtcaaactccaagagctaaagaaaagaaagagcagaaaataaagtcacattggttttcctcgctgggggcacgtgtgtctgtgtgcagctgggacgctcaaatgctcggtgtgacatctgctcttcccagagccgccacatctgtcaccagaaagctctgtggtgccagcaggctctggtgttcgcctgcctctgctgcagacagtgggacctgccctgcccgttatagatgtgctctgcccacccakaaagctttctctgttggtgacgccagagaagcactcatggcctcgggcactgccgtggcagccccagtagcagcccctctcggcctctcctccctagtgctggctcccccagcagagggaacacagctcctgtcctgcccagagtgtcaagtaacctgcagagtgagcaatgtcagctttgtgagaacaggtcagggaaaatggccccaaggtgcacactggtgagattctggcagcagttcgggggcaaaatgttcattctcacatgcacgggaggcagcaaatggccttgccccctga

SEQ ID NO: 203618 - DNA, 601 bp, Human
tccacacccacatagacacactgcatttggaggccccgatattgccagaaagatccataacacacagtccccgtaggtccctcgtgagcaagtctgataagaaagtattttgcatattggaaaaaaccttttttggaaaaagataacagaattacttattactctcagctgcttttttcatgtcatgaaaagggcaggagaaggtgcagtttgcacacaagtgcaggacacacagatacatgtgcacacacaaaaacactatgcacacaagaacacacacgtgcacacacagatgcacacktgcacacacagatgcacaggtgcacacacagatgcactcgtgcacacacactcgtgcacatgtgcacacacacagacgcatacgttcacacacagacgcacctgtgcacacagatgcacaacacacacgtgtacacacaggtatggtacacacactctggatgcacacagaatgcacacactcatgcccagcacaaactggcacacacagacacgcagatgcaccagagactgggagggtggagacgccaccttcccggccgggttcatccagcaaacagcatgttccatacctgggagg

SEQ ID NO: 203619 - DNA, 601 bp, Human
gtgggcaccctgggaacgctgagggtcggggtccacggatctttctggaatgccactgggcgcgtgggcaccctgggaacgctgagggtcggggtccacagatctttctggaatgccactgggcacatgggcaccctgggaacgctgagggtcagggatccatggatctttctggaatgccaatgggcacgtgggcaccctgggaatgccgagggtcggggtccatggatctttctggaatgccattgggtgcgtgggcaccctgggaacgctgagggtcagggtccacggatctttctgraatgccactgggcacgtgggcaccctgggaacactgagggtcagggatccatggatctttctggaatgccactgggcgcgtgggcaccctgggaatgccgagggttggggtccatggatctttctggaatgccattgggtgcgtgggcaccctgggaatgctgagggttggggtccacggatctttctggaatgccactgggccagcgtgggcaccctgggaacgttgagggtcggggtccacagatctttctggaatgccactgggcgcgtgggcaccctgggaatgcagagggtcggg

SEQ ID NO: 203620 - DNA, 601 bp, Human
tttctggaatgccactgggcgcgtgagcacctgggaacgctgagggtcggggtccatggatctttctggaatgcaactgggcgcgtgggcaccctgggaacgctgagggtcggggtccacggatctttctggaatgccactgggcgcgtgggcaccctgggaacgctgagggtcggggtccacagatctttctggaatgccactgggcacatgggcaccctgggaacgctgagggtcagggatccatggatctttctggaatgccaatgggcacgtgggcaccctgggaatgccgagggtyggggtccatggatctttctggaatgccattgggtgcgtgggcaccctgggaacgctgagggtcagggtccacggatctttctggaatgccactgggcacgtgggcaccctgggaacactgagggtcagggatccatggatctttctggaatgccactgggcgcgtgggcaccctgggaatgccgagggttggggtccatggatctttctggaatgccattgggtgcgtgggcaccctgggaatgctgagggttggggtccacggatctttctggaatgccactgggccagcgtgggcacc

SEQ ID NO: 203621 - DNA, 601 bp, Human
ccacaatcctgccctgagggccttggcgtctggggagccgggcagaccaatgctgggtgaagaaagcccatcgccgcctctgctcaccactaagggctgacgccacctgaccccgcatccactcatagccgcctggtttccagagaccagagtgggcaagactcatccctgccaccatgggtccctcatcccccagtaactctaagcacacgtgtagagctttaacacgtcacacccgatggaaatagcacatggcatgaaaggccttcgggaggctgtatcctgggtgctgtcctggccygaaggcaccatcttacagctcagggtcccgcccgggagagttccttatgcagaggcagaggcagcccaaggtctggccagcctccttcccgcctgctcactctcctgctcctgaccgcctcaaacaggtcacttttgtggctgtccctaaagaaggcgctaggaagaaccgtgcttttagttaaggacaaaaattgagggttgtataaatgtctgaaatattagcaccttttctggcaaaatgacagacagcattcagttacaattcattcagagcagagttctattcatccatgggatc

SEQ ID NO: 203622 - DNA, 601 bp, Human
gactctggttccagaggcgccgccctcgccagccctgttctacatggggtttcgtgagaaatgctaacgcctagaaatgtcgggctgtcacaccagtggagcggccaccgaggagccatcttaaatctctttatcttagagttaatggcggttaattctcaaagttaaactaaaaattagaaattcacttctagctaggatgcgcaaaaaggcagcagctccatgctaccactggggtgtccaaatcgccgccacctgagcctgggctgtaccgggagccacacgtatcaggaacttcggsgtggggggagctacggggtgggggctgcagggctgctgttgaggcgcacaccacaatcctgccctgagggccttggcgtctggggagccgggcagaccaatgctgggtgaagaaagcccatcgccgcctctgctcaccactaagggctgacgccacctgaccccgcatccactcatagccgcctggtttccagagaccagagtgggcaagactcatccctgccaccatgggtccctcatcccccagtaactctaagcacacgtgtagagctttaacacgtcacacccgatggaaatagca

SEQ ID NO: 203623 - DNA, 601 bp, Human
gcccccaggcaatggacgtgacagttcccatcctccatacgctcagcgtccacacagacaaagagggagagccaaaccccggctgactatgcacagcaccacggcctccgcgaggaaacgcagtgccccccacattccggaagctgcaacaggagccacccgatggccggcgacactgcggtgacttgggagcgttcggctctctggctgcggagaggctgacctgggggtgggtaccgtcgggcaggcctgggcctgaaggctcagcctgcccagaggagacgatagcatcctgaggggsacgctgaggccacgaggggtgagcaatgtgcccaactctgcagtgtcagggcagaggtgggactctggttccagaggcgccgccctcgccagccctgttctacatggggtttcgtgagaaatgctaacgcctagaaatgtcgggctgtcacaccagtggagcggccaccgaggagccatcttaaatctctttatcttagagttaatggcggttaattctcaaagttaaactaaaaattagaaattcacttctagctaggatgcgcaaaaaggcagcagctccatgctaccactggggtgt

SEQ ID NO: 203624 - DNA, 601 bp, Human
ctgggcagggtctctcccagggtcaatccctcagcactaaacaaaaagctaccttcacttacgagggaagcaggagaaatgattccttgtgttgaaccccaggcctgggagatggggtcttgggctgggtgggatgagatgaggcctccagggagtcctctgcccagagggatgacatggccctcatctctcaggggagcgtgcctgcatctgagtcgtcagctaaagcagctgctcgttttcacggacaccatattttgccagaaagattgacagacagactgtggtaacttagacctcrgtggctaacaggcattttctccagaagggcggacgagcctgcctcttccagcagcagcggatgctatttgttgccaatgacaaaatttaagctttcaaggagacccgagggtgttggaaaacgtattcctcccagaggctggcggcgtccccaccacagagacccctcccttgagctctgccatattctgaggaaggtgctgctcgcactgggtgccagacgtgccgcgtcgagactcccacaccctgggtggctgggatttcccgggacctgtgtgtgcggctcccagatcacgccctg

SEQ ID NO: 203625 - DNA, 601 bp, Human
gggcatgggggctcacgcctgtcatcccagcattttgagaagctgaggcgggaggatcacttgagcccaggagtttaagaccagcctggacaacatagtaagacccctgtctctatacaaaataaaaaagttagccaggtgtggtggtgcacacctgtagtcccagctacttgggaggctgaggggggaaaatcgcttgagcccagaagatggggctgcagtgaggcgagatcaccactgcactccagcccgggcaacagagcaggaggctgtcctgggtgctcccctcgcccgtatctcsagggacaaaagctctccgggtgaccagaacccttggcaggcctcttctgtgggacgggttccctcactgtcctccccctcggcacaggtcccacagtctgtatgagccacaggcacccagggttcctgaccaccaggcggacgggcggcctcgctccctcctgagcacccagctcgcaggcagtagagttcattttgctagataattattacactataaatacacatctaaagacaggagaacataaattatggcccacggaaagtttgaaaggggcctcctaatccctaatttaaaaat

SEQ ID NO: 203626 - DNA, 601 bp, Human
cagctgtggcaatgctgaagctaccgagcgggagaaggaagcggcacagacttccaagagggtctggggggctgggcatgggggctcacgcctgtcatcccagcattttgagaagctgaggcgggaggatcacttgagcccaggagtttaagaccagcctggacaacatagtaagacccctgtctctatacaaaataaaaaagttagccaggtgtggtggtgcacacctgtagtcccagctacttgggaggctgaggggggaaaatcgcttgagcccagaagatggggctgcagtgaggcragatcaccactgcactccagcccgggcaacagagcaggaggctgtcctgggtgctcccctcgcccgtatctccagggacaaaagctctccgggtgaccagaacccttggcaggcctcttctgtgggacgggttccctcactgtcctccccctcggcacaggtcccacagtctgtatgagccacaggcacccagggttcctgaccaccaggcggacgggcggcctcgctccctcctgagcacccagctcgcaggcagtagagttcattttgctagataattattacactataaatacacat

SEQ ID NO: 203627 - DNA, 601 bp, Human
ctcacttctccaggtgggcgtcagggtgaaagcccctcctctgactcccgcctggttaaaatattaaccaattaccacgccgctcttgtgtacacggagcaggagggtgcagcacactacagagaaaacggttctgacacacccccgtcacaagcaggacctcatcaaagctctgccttcccgtgcagcctgcaggcaccaccggcaatgctggcttcagacacccgcttccaaacacaccagctgccactggaattcctgaaaaggagaaggccctaaaaccaaagagaaagaactaaaygattacagctgtggcaatgctgaagctaccgagcgggagaaggaagcggcacagacttccaagagggtctggggggctgggcatgggggctcacgcctgtcatcccagcattttgagaagctgaggcgggaggatcacttgagcccaggagtttaagaccagcctggacaacatagtaagacccctgtctctatacaaaataaaaaagttagccaggtgtggtggtgcacacctgtagtcccagctacttgggaggctgaggggggaaaatcgcttgagcccagaagatggggctgcagt

SEQ ID NO: 203628 - DNA, 446 bp, Human
ctcctccctgtccctctctcctccctgcccctcctccctgcccgtctctccctacccctctctcctccctgcccctcctccctgcccctctctcctccctgcccctctctcctccctgcccctctctccctgcccgtctctccctrcccctctctcctccgtgcccctctctcctccctgcccctctctcctccctgtaggatgcgggcagcagcccctgtgtaggctgcacggcagattgtttgctgtggccaggctgactggccctgctgacaaggcccagctttagaacctgagcaggctgggctgggtaggtagggtcgccacgggcccgagaagcagacaacaagcttaaaagcccggctatgtcgaggtcttggggcagggctgacggcacaggagagaccaacgggcctgggaggaccccagaaggcaggctgggtggg

SEQ ID NO: 203629 - DNA, 601 bp, Human
atgcaccccatggagcttggagagcccgtgccacctggcgtcccctgggggcacggagagaagccagggcgtggcaggaagcacagccgccctctgtccatgggacagggtctgatgggcattgctgctcagacagactgggctctggggatgagcaagagagaacagggatgccagagtggcagcggcttcctcagcccatctgctccaggaagggcttccctgggagtgttcacagacgactcaacaggaggaagaagcctgggtgagagaggtgtcctggccaggctgttgggggcamcacccttaatccacagccaggggtgctccctgtggcccccaacacccagggagaaatgcaggaggggctggttccagctgggtctggggaaggccagtgtggactgcacacaaccgctgtacccacaggtgggaggtgctggcggggccacgctgcagagcagcaggacgcggggcctggacgctgcccagcagtgactgacgtgggagtgccaggcatgtgggcttatctgaaagcatacctgctgggtggggggggaggcacacaggacaggggcgcacctgcgcctacagcgtggga

SEQ ID NO: 203630 - DNA, 601 bp, Human
tgagctttggtttttgttggttttttgaacatggtctaaagtatgatgaaaacctccatggaaacaaaatggcagccagtgtcatctggtcccaggacgttcctccacctggtgacctggcccggatcagctcgaaacgcctgtaagtgcaggcagctctggggtgtggcacacgtggtctccgctttgaccaacgccgctcccacctcggggagcatccaggtgctcaggctgtggccccgggtcactgctgcagtggagggtgactgtccccgactcactgcttcctgggcctgcccaygccctctgcgggtctgggaatggggctggccacatggcggtgccagtagccctgagggcggagcccttcacccacacagtgagcgcatcccacactgcctggggtctgctggttgcgtctccaccacccaccgccggccagggcacagctcatctgggctcctccgcggccttgctgtgtctctgagccattggcccccgccctcacacagcagagcagtccacgcacacacggactgatcactcccccaccagcctggagcctcatggccatggcccccactacccgccgagtctggaa

SEQ ID NO: 203631 - DNA, 601 bp, Human
tcacaatttaagttctatatcaaactgtttttatgtgagactaaattttagctatagcacagtatcttcacatcagtccttcctttactgcatgaaattgtctgttgagctttggtttttgttggttttttgaacatggtctaaagtatgatgaaaacctccatggaaacaaaatggcagccagtgtcatctggtcccaggacgttcctccacctggtgacctggcccggatcagctcgaaacgcctgtaagtgcaggcagctctggggtgtggcacacgtggtctccgctttgaccaacrccgctcccacctcggggagcatccaggtgctcaggctgtggccccgggtcactgctgcagtggagggtgactgtccccgactcactgcttcctgggcctgcccacgccctctgcgggtctgggaatggggctggccacatggcggtgccagtagccctgagggcggagcccttcacccacacagtgagcgcatcccacactgcctggggtctgctggttgcgtctccaccacccaccgccggccagggcacagctcatctgggctcctccgcggccttgctgtgtctctgagccattggc

SEQ ID NO: 203632 - DNA, 601 bp, Human
ctcaatgatgggcacaggccctgcccacaggccagaggtggggctgcggaggagccaggctggctgcagaccccagggacttctggccaaggggccccgcctccagcccaggcccccaccaggcaggctcctcacagcacagccagggacggagggcaggctgcacccagggtgctccaggatgtaggaaggaacagtaaggaacccggcccggcagacagagccacatggcagaggccagcagggtgcatctcagggaccagggctgcagaggtccccgccctgctgagggcacacctgyacccaggtgtttgctgtgcctggggtctggtgccgtctggcacagacacagatgggcagtgagggacaactggagcctcacacagctggtgttgaagtcggggttagtagggggctcctgtccctgctctgggcctgggacagtggagagggggcagagcccaccaggctggcagtggaaccaccagagtctccagcctccttccgattgcacacccacgttatgttcagaggccccggctctgggtgttgggcacagctgcagttcccacgcacacccgcaagctttcattactatctg

SEQ ID NO: 203633 - DNA, 601 bp, Human
tacatgttaggaaggggcaacaggataaacaaaaaggctgccattcagaaggtgcaggtgcccaactgctatggtttggagtggtaggcaacagagagctaatgaaagagttctgatgcggatggtggaggtggtggttgcatgattacgaatgtatgttagaacacttcaggggcaacagtctaggagtggcaaagatacattccattccagagcctactatactaaaagtgaataaaacatagttatttgaggccgggtgtggcggctcacgcctataatcccagcactttgggaggcygaggcgggcagatcacgaggtaaggagttagagactagcctggccaacacagtgaaacccgagtctactaaaaatacaaaaattagccaggcatggtgcaacgcgcctttagtcacagctactcaggaggctgaggcaggagaatcgcttgaacccgggaggcggaggttgtggtgagccgagatctcgccactgcactccagcctgggcaacagagtgagactccgtctcaaaaacaaacaaaaaaaccatagttatcagttgaatactgccattagcttggaaagaaaggggcacatt

SEQ ID NO: 203634 - DNA, 601 bp, Human
aacagcactcaccttttgaactcatttctcttagatgagctgcatgtgattttctctacatatcctgtgggaccacactcaggggtagttttctgccaggagaaaaggagcaaagtacatgttaggaaggggcaacaggataaacaaaaaggctgccattcagaaggtgcaggtgcccaactgctatggtttggagtggtaggcaacagagagctaatgaaagagttctgatgcggatggtggaggtggtggttgcatgattacgaatgtatgttagaacacttcaggggcaacagtctargagtggcaaagatacattccattccagagcctactatactaaaagtgaataaaacatagttatttgaggccgggtgtggcggctcacgcctataatcccagcactttgggaggccgaggcgggcagatcacgaggtaaggagttagagactagcctggccaacacagtgaaacccgagtctactaaaaatacaaaaattagccaggcatggtgcaacgcgcctttagtcacagctactcaggaggctgaggcaggagaatcgcttgaacccgggaggcggaggttgtggtgagccgagat

SEQ ID NO: 203635 - DNA, 601 bp, Human
accatccatctaaagtcataggagcaaaggaggtgatctcagagaagagaaacagcactcaccttttgaactcatttctcttagatgagctgcatgtgattttctctacatatcctgtgggaccacactcaggggtagttttctgccaggagaaaaggagcaaagtacatgttaggaaggggcaacaggataaacaaaaaggctgccattcagaaggtgcaggtgcccaactgctatggtttggagtggtaggcaacagagagctaatgaaagagttctgatgcggatggtggaggtggtrgttgcatgattacgaatgtatgttagaacacttcaggggcaacagtctaggagtggcaaagatacattccattccagagcctactatactaaaagtgaataaaacatagttatttgaggccgggtgtggcggctcacgcctataatcccagcactttgggaggccgaggcgggcagatcacgaggtaaggagttagagactagcctggccaacacagtgaaacccgagtctactaaaaatacaaaaattagccaggcatggtgcaacgcgcctttagtcacagctactcaggaggctgag

SEQ ID NO: 203636 - DNA, 601 bp, Human
cttctttcttattatttttgagatggtgtctcgctctgtcacccagactggagtgcagtggcgtgaccttggctcactgcaacctccacctcccgggtttaagcagttttctgcttcagcctcccaagtagctgggattacaggtgcccgccatcatgcccagctaatttttgtatctttaagagagatgaggtttcaccatcttggccaggctggtcttgaactcctaacctcgtgatccacccgcctcggcctcccaaagtgctgggattacaggcgtgagccacccctcccagcctcttttttttttttttttttttgacacacagtctcgctccattgcccaggctggagtgcagtggcatgatcttggctcactctaacctctgcctcctgggttcaagtgattctccctgcctcagcctcccaagtagctgggattatgggcacccaccacaccagctaatttttgtatttttagtagagatggggtttcaccacgttggccaggctgatctcgaactcctgacctcaggtgatctgttagcctcagcctccctaagtactgggattataggtgtgagcccggccccctcttctt

SEQ ID NO: 203637 - DNA, 601 bp, Human; identical to SEQ ID NO: 25158

SEQ ID NO: 203638 - DNA, 601 bp, Human; identical to SEQ ID NO: 25159

SEQ ID NO: 203639 - DNA, 601 bp, Human; identical to SEQ ID NO: 25160

SEQ ID NO: 203640 - DNA, 601 bp, Human; identical to SEQ ID NO: 25161

SEQ ID NO: 203641 - DNA, 601 bp, Human
cggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggaggtggccgcacccaagcaggggtcgaaagcccgggtggatgcggaacaaggatatgataggccttaagggtggrggatacctctgggctcgaaatcggcgggcggtgcaaaactcgaggtccagttctcggagcccatagagccaaaaaagcctcagcttgtccggggcgggttcttgaaagccggaaagcggctgagtaccacgcggcttgcatttttctcttgggacgctcgagaggtgggctccgtgagggcagctgctgcctgcagattatagggagccctttgcgcatttattaagaagctactggtgtatctcgggctgcgctaggcacggcgcatgcaaagatgaagcaggcagcatcccagccctt

SEQ ID NO: 203642 - DNA, 601 bp, Human
catagagccaaaaaagcctcagcttgtccggggcgggttcttgaaagccggaaagcggctgagtaccacgcggcttgcatttttctcttgggacgctcgagaggtgggctccgtgagggcagctgctgcctgcagattatagggagccctttgcgcatttattaagaagctactggtgtatctcgggctgcgctaggcacggcgcatgcaaagatgaagcaggcagcatcccagcccttccgcacctcagacggtcagttgagtaggatccgccggtaccaactcctccttttaacaaatrgggagaccgaaagctaggagacagtcagggatctctaagttcccagtgagtaggaggcagaggtgaggtgtagaactcgtttttgcatgtctctcgcctctagacgcacccttccctcatcccatgccctcccacctccgcccctacattaaaggtagcattggatcccggggccgttcagtgaagctagcaggtgtccgcaggaactcccttccccctgccaggctagaaaccttacaaggctgtctagaaatagcagtgatttgtaaggagagacccggctccagcttggtgactctg

SEQ ID NO: 203643 - DNA, 601 bp, Human
ggatctctaagttcccagtgagtaggaggcagaggtgaggtgtagaactcgtttttgcatgtctctcgcctctagacgcacccttccctcatcccatgccctcccacctccgcccctacattaaaggtagcattggatcccggggccgttcagtgaagctagcaggtgtccgcaggaactcccttccccctgccaggctagaaaccttacaaggctgtctagaaatagcagtgatttgtaaggagagacccggctccagcttggtgactctgggctgactgcctgcctagaggtcctctckgatttttgccctttggagtggtgtcaaaactagacgtgatactttggggatgcagcctgtgatatttcctccagcgaatgcagtgcagggttggattaacaaggtggaaagaattcgagggttccaccaagtagctattaactctagggctgcaggcctcaggccttctgcagctatttctacactccctgtactgaaactatttcttcatactgggcctgacaggcctttgcaacaaggatcacggccgaagccacaccgtgcgcctccctcccggttggttaacaggccctggtttct

SEQ ID NO: 203644 - DNA, 601 bp, Human; identical to SEQ ID NO: 117781

SEQ ID NO: 203645 - DNA, 601 bp, Human; identical to SEQ ID NO: 117782

SEQ ID NO: 203646 - DNA, 601 bp, Human; identical to SEQ ID NO: 117783

SEQ ID NO: 203647 - DNA, 601 bp, Human; identical to SEQ ID NO: 117784

SEQ ID NO: 203648 - DNA, 601 bp, Human; identical to SEQ ID NO: 117785

SEQ ID NO: 203649 - DNA, 601 bp, Human; identical to SEQ ID NO: 117786

SEQ ID NO: 203650 - DNA, 601 bp, Human; identical to SEQ ID NO: 117787

SEQ ID NO: 203651 - DNA, 601 bp, Human; identical to SEQ ID NO: 117788

SEQ ID NO: 203652 - DNA, 601 bp, Human; identical to SEQ ID NO: 117789

SEQ ID NO: 203653 - DNA, 601 bp, Human; identical to SEQ ID NO: 117790

SEQ ID NO: 203654 - DNA, 601 bp, Human; identical to SEQ ID NO: 117791

SEQ ID NO: 203655 - DNA, 601 bp, Human; identical to SEQ ID NO: 117792

SEQ ID NO: 203656 - DNA, 601 bp, Human; identical to SEQ ID NO: 117793

SEQ ID NO: 203657 - DNA, 601 bp, Human; identical to SEQ ID NO: 117794

SEQ ID NO: 203658 - DNA, 601 bp, Human; identical to SEQ ID NO: 117795

SEQ ID NO: 203659 - DNA, 601 bp, Human; identical to SEQ ID NO: 117796

SEQ ID NO: 203660 - DNA, 601 bp, Human; identical to SEQ ID NO: 117797

SEQ ID NO: 203661 - DNA, 601 bp, Human; identical to SEQ ID NO: 117798

SEQ ID NO: 203662 - DNA, 601 bp, Human; identical to SEQ ID NO: 117799

SEQ ID NO: 203663 - DNA, 601 bp, Human; identical to SEQ ID NO: 117800

SEQ ID NO: 203664 - DNA, 601 bp, Human
ttggtgagaacccgttttctccttccttccccagcctgtcttgtcccatccctgcccctccacagagtgctagagatgaccccctccccagacttcttcctccctcaattagaaaaattgcagcaggtcatcagacccatgggcagcatcacctgtcctggtctggtcccctgagccctctctgagttctcacctcctcttcccagaccagggcagcccctttgcccaggagctgctggacgacggtcagcaagccagcccctaccaccccggcagctgtggcgcaggagccccctccccyggcagctctgacgtctccaccgcaggtgagagctctctctgggccacaacctcccttccccgaagtgtcccttgttccctctggctcccagcaccataactcaggccttctggcaggaacaggaacaggctgggaagtgtgtcctgagagccagcagcgtggttgagcagagggtgggccggcaggggacttactctgaccccgccccccagggactggtgcttctcggagctcccactcctcagactccggtggaagtgacgtggacctggatcccactgatggcaagctcttccccag

SEQ ID NO: 203665 - DNA, 601 bp, Human; identical to SEQ ID NO: 30207

SEQ ID NO: 203666 - DNA, 601 bp, Human; identical to SEQ ID NO: 30208

SEQ ID NO: 203667 - DNA, 601 bp, Human; identical to SEQ ID NO: 30209

SEQ ID NO: 203668 - DNA, 601 bp, Human; identical to SEQ ID NO: 30210

SEQ ID NO: 203669 - DNA, 601 bp, Human; identical to SEQ ID NO: 30211

SEQ ID NO: 203670 - DNA, 601 bp, Human; identical to SEQ ID NO: 30212

SEQ ID NO: 203671 - DNA, 601 bp, Human; identical to SEQ ID NO: 30213

SEQ ID NO: 203672 - DNA, 601 bp, Human; identical to SEQ ID NO: 30214

SEQ ID NO: 203673 - DNA, 601 bp, Human; identical to SEQ ID NO: 30215

SEQ ID NO: 203674 - DNA, 601 bp, Human; identical to SEQ ID NO: 30216

SEQ ID NO: 203675 - DNA, 601 bp, Human; identical to SEQ ID NO: 30217

SEQ ID NO: 203676 - DNA, 601 bp, Human; identical to SEQ ID NO: 30218

SEQ ID NO: 203677 - DNA, 601 bp, Human; identical to SEQ ID NO: 30219

SEQ ID NO: 203678 - DNA, 601 bp, Human; identical to SEQ ID NO: 30220

SEQ ID NO: 203679 - DNA, 601 bp, Human; identical to SEQ ID NO: 30221

SEQ ID NO: 203680 - DNA, 601 bp, Human; identical to SEQ ID NO: 30222

SEQ ID NO: 203681 - DNA, 601 bp, Human; identical to SEQ ID NO: 30223

SEQ ID NO: 203682 - DNA, 601 bp, Human; identical to SEQ ID NO: 30224

SEQ ID NO: 203683 - DNA, 601 bp, Human; identical to SEQ ID NO: 30225

SEQ ID NO: 203684 - DNA, 601 bp, Human; identical to SEQ ID NO: 30226

SEQ ID NO: 203685 - DNA, 601 bp, Human; identical to SEQ ID NO: 30227

SEQ ID NO: 203686 - DNA, 601 bp, Human; identical to SEQ ID NO: 30228

SEQ ID NO: 203687 - DNA, 601 bp, Human; identical to SEQ ID NO: 30229

SEQ ID NO: 203688 - DNA, 601 bp, Human; identical to SEQ ID NO: 30230

SEQ ID NO: 203689 - DNA, 601 bp, Human; identical to SEQ ID NO: 82067

SEQ ID NO: 203690 - DNA, 601 bp, Human; identical to SEQ ID NO: 82068

SEQ ID NO: 203691 - DNA, 601 bp, Human; identical to SEQ ID NO: 82069

SEQ ID NO: 203692 - DNA, 601 bp, Human; identical to SEQ ID NO: 82070

SEQ ID NO: 203693 - DNA, 601 bp, Human; identical to SEQ ID NO: 82071

SEQ ID NO: 203694 - DNA, 601 bp, Human; identical to SEQ ID NO: 82072

SEQ ID NO: 203695 - DNA, 601 bp, Human; identical to SEQ ID NO: 82073

SEQ ID NO: 203696 - DNA, 601 bp, Human; identical to SEQ ID NO: 82074

SEQ ID NO: 203697 - DNA, 601 bp, Human; identical to SEQ ID NO: 82075

SEQ ID NO: 203698 - DNA, 601 bp, Human; identical to SEQ ID NO: 82076

SEQ ID NO: 203699 - DNA, 601 bp, Human; identical to SEQ ID NO: 82077

SEQ ID NO: 203700 - DNA, 601 bp, Human; identical to SEQ ID NO: 82078

SEQ ID NO: 203701 - DNA, 601 bp, Human; identical to SEQ ID NO: 82079

SEQ ID NO: 203702 - DNA, 601 bp, Human; identical to SEQ ID NO: 82080

SEQ ID NO: 203703 - DNA, 601 bp, Human; identical to SEQ ID NO: 82081

SEQ ID NO: 203704 - DNA, 601 bp, Human; identical to SEQ ID NO: 82082

SEQ ID NO: 203705 - DNA, 601 bp, Human; identical to SEQ ID NO: 82083

SEQ ID NO: 203706 - DNA, 601 bp, Human; identical to SEQ ID NO: 82084

SEQ ID NO: 203707 - DNA, 601 bp, Human; identical to SEQ ID NO: 82085

SEQ ID NO: 203708 - DNA, 601 bp, Human; identical to SEQ ID NO: 82086

SEQ ID NO: 203709 - DNA, 601 bp, Human; identical to SEQ ID NO: 82087

SEQ ID NO: 203710 - DNA, 601 bp, Human; identical to SEQ ID NO: 82088

SEQ ID NO: 203711 - DNA, 601 bp, Human; identical to SEQ ID NO: 30231

SEQ ID NO: 203712 - DNA, 601 bp, Human; identical to SEQ ID NO: 30232

SEQ ID NO: 203713 - DNA, 601 bp, Human; identical to SEQ ID NO: 30233

SEQ ID NO: 203714 - DNA, 601 bp, Human; identical to SEQ ID NO: 30234

SEQ ID NO: 203715 - DNA, 601 bp, Human; identical to SEQ ID NO: 30235

SEQ ID NO: 203716 - DNA, 601 bp, Human; identical to SEQ ID NO: 30236

SEQ ID NO: 203717 - DNA, 601 bp, Human; identical to SEQ ID NO: 30237

SEQ ID NO: 203718 - DNA, 601 bp, Human; identical to SEQ ID NO: 30238

SEQ ID NO: 203719 - DNA, 601 bp, Human; identical to SEQ ID NO: 30239

SEQ ID NO: 203720 - DNA, 601 bp, Human; identical to SEQ ID NO: 30240

SEQ ID NO: 203721 - DNA, 601 bp, Human; identical to SEQ ID NO: 30241

SEQ ID NO: 203722 - DNA, 601 bp, Human; identical to SEQ ID NO: 30242

SEQ ID NO: 203723 - DNA, 601 bp, Human; identical to SEQ ID NO: 30243

SEQ ID NO: 203724 - DNA, 601 bp, Human; identical to SEQ ID NO: 30244

SEQ ID NO: 203725 - DNA, 601 bp, Human; identical to SEQ ID NO: 30245

SEQ ID NO: 203726 - DNA, 601 bp, Human; identical to SEQ ID NO: 30246

SEQ ID NO: 203727 - DNA, 601 bp, Human; identical to SEQ ID NO: 30247

SEQ ID NO: 203728 - DNA, 601 bp, Human; identical to SEQ ID NO: 30248

SEQ ID NO: 203729 - DNA, 601 bp, Human; identical to SEQ ID NO: 30249

SEQ ID NO: 203730 - DNA, 601 bp, Human; identical to SEQ ID NO: 30250

SEQ ID NO: 203731 - DNA, 601 bp, Human; identical to SEQ ID NO: 30251

SEQ ID NO: 203732 - DNA, 601 bp, Human; identical to SEQ ID NO: 30252

SEQ ID NO: 203733 - DNA, 601 bp, Human; identical to SEQ ID NO: 30253

SEQ ID NO: 203734 - DNA, 601 bp, Human; identical to SEQ ID NO: 30254

SEQ ID NO: 203735 - DNA, 601 bp, Human; identical to SEQ ID NO: 30255

SEQ ID NO: 203736 - DNA, 601 bp, Human; identical to SEQ ID NO: 30256

SEQ ID NO: 203737 - DNA, 601 bp, Human; identical to SEQ ID NO: 30257

SEQ ID NO: 203738 - DNA, 601 bp, Human; identical to SEQ ID NO: 30258

SEQ ID NO: 203739 - DNA, 601 bp, Human; identical to SEQ ID NO: 30259

SEQ ID NO: 203740 - DNA, 601 bp, Human; identical to SEQ ID NO: 30260

SEQ ID NO: 203741 - DNA, 601 bp, Human; identical to SEQ ID NO: 30261

SEQ ID NO: 203742 - DNA, 601 bp, Human; identical to SEQ ID NO: 30262

SEQ ID NO: 203743 - DNA, 601 bp, Human; identical to SEQ ID NO: 30263

SEQ ID NO: 203744 - DNA, 601 bp, Human; identical to SEQ ID NO: 30264

SEQ ID NO: 203745 - DNA, 601 bp, Human; identical to SEQ ID NO: 30265

SEQ ID NO: 203746 - DNA, 601 bp, Human; identical to SEQ ID NO: 30266

SEQ ID NO: 203747 - DNA, 601 bp, Human; identical to SEQ ID NO: 30267

SEQ ID NO: 203748 - DNA, 601 bp, Human; identical to SEQ ID NO: 30268

SEQ ID NO: 203749 - DNA, 601 bp, Human; identical to SEQ ID NO: 30269

SEQ ID NO: 203750 - DNA, 601 bp, Human; identical to SEQ ID NO: 30270

SEQ ID NO: 203751 - DNA, 601 bp, Human; identical to SEQ ID NO: 30271

SEQ ID NO: 203752 - DNA, 601 bp, Human
tctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtamtagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaa

SEQ ID NO: 203753 - DNA, 601 bp, Human
gagaaacagcaggattgcttttgaccttttagaagattggtctccagtaaaggtggacatttttgagatttttataataaagaatttaattgctctgcatttgtcaagtacagttcgcttgaaagcctgcctgactgtggaaaagatggagctcaagaatggagttgatggcccagcgtggtggctcatgcctgtaatcccagcactttgggaggctgaggcggtcggatcacgacattaggggatcgagaccatcctggctaacacggtgaaaccccgtctctactaaaaaaaaaaaaaattagccaggcgtggtggcgggtgcctgtagttccagctactcgggaggctgaggcaggagaatggcttaaacccgggaggcggagcttgcagtgagctcagatcgcgccactgcactccagtctgggcaacagagcgagactccatctcaaaaaaaggaaaaaattgtaaaaaaaaaaaaaaaaaaatttcccccagcagtttttgttttctaaagttatcagtttatatattcaggtcttaagaaaggcaaaagctgtcttcaggtgattggcttgggggcagaacagtacttctgctc

SEQ ID NO: 203754 - DNA, 601 bp, Human
gcgatcatccttgggcaccaaatgcccacacaggctgtgggcaggcacaggccctggacgctgcacaatcagttccaactctgcccattgctcagggacctgggaaaacgggatgatggaggagatgctcccacacccagaggttcagctccagattagataacagggtctaacctggggctctaagcgcagcagcaggtcatagtccatagccttcggcacagaggccaccaggaactccagggtctgaccttcctgtagccgcacgaagcctgagccagtccaggatggagtttccccrggggtcaccaggcgctccaccacatcgagcacctgggagataatgcagccagggatggaggctcaggtgaggctttgcctcttctgccacagccagccccaaaccccatttctcctgccaaagctagatatcacccctatcccctcaacaaggtactgcccataaccccacctctccagtcatagacgtgtccacccacatccagccctctgcttagggggaggccccacacctgccctcgggtgtcctcagcctcccaaattaggtggtccaggaagggccggaagtagccaggttgca

SEQ ID NO: 203755 - DNA, 601 bp, Human
tccacctgtgcagactcactggaaatactcataaagcctggaaatcccaagaacttgccaattctcctcaacaaccacctcacgcttcctctgaccccgacctacaacctacaatggctgctcctcttcatcaacactatgtcgccccctctctctttgtctccaaggctttcctttcccattgtgctgcaaactcatacttgggttcttttatcccatcccaaaaattgttcttcaatccctcatcttttttctttttattttctgatttatttatttatttgtttatttgagatgcggkctctgttgcccaggatggatggagtacagtgcgtgaccttggctcactgcagccttgacctcctgggttcaagatatcctcccacctcagcctcccaagcagctggaaccacaagcacacaccaccatgcttagctaattattttattttttgtagagacagggtctcgccatgttgcctaggctggtcttgaattcctgggctcaagtgatcctcctgcctcagtgtcccaaagtgctgggattacaggcatgagccaccatgcctggtctagaggaattttttttctaaacacaagtc

SEQ ID NO: 203756 - DNA, 601 bp, Human
cagggatctgcaggagggtcccatacctcgttgcaggtggggcctctggcccggcttgggtggcaggcacaaggctggcaaccatggccactggtgaggttccagaagttgggggcacagcggtcacagctagggccctggacattggggaggcatgggcactgcccactgcttggatcacagtggcactggtcaggagatgggcactgctgcggatttgtgcccagcaggttgcatgtgcagcctgtgccaaccaagatgagcacagtagtcaagaggaggccaagaagcagaaccccaattcagccatgccctcccacactcatactcacggtgacagctctgtcgggcagcctgcccatggaagccaggcttgcagtgggcacagtgtggaccctctgtgtggtgtaaacagcgcaggcattgccccgtgtgggggtcacaggcatcaggatccattgggtcaatgttcccactgcactcacacagttggcaccggccacctggccttgatgggtccccaaagtgcccaggggcacaagcttcacatcgcagccctgcccacggttaagaggaagctgtgagtgctcagcccagccaa

SEQ ID NO: 203757 - DNA, 601 bp, Human
caggtctgcctcgagctgagtcaggtgctcagtggcctccccaatttcacgcctgcaatgatggagaggggggtgtttagagaggcttcagccctggtccactgggcctctgccccatcccaccatgtattcttaggcccttccgcaccgcagctcctctgtggcctccacaagctgtgcagtggaggcggctgaggtgttgcgggcacctacgatgccctgcacaatgcccagcttctcctgcatgtgccagaagctgctctcaaaggcacccagcacacccgtctgttgcaactcctgygcccgctgctctaggcgctgtgtacgggctgccaagtcctgcaccactcggtcccaatccccgaagcatgcatggcagggatggcaggcaggaaagattcctgagaagccacgggcacactggtcacagcgcacaccagacacccctgggcggcagctgcagtgacctgtgaagcggtgacactgaggtgtatctattccacgagagtcacaatcacaggctgcaagaaagagcagagcacagagttagggtcactgtggggcattctgggaagtcctccatctaccctggccccgctgg

SEQ ID NO: 203758 - DNA, 601 bp, Human
tgaccacatagcctggggtcttgtagttctcacctgccaggaccagaataagcctaaggaccaggctgcagccaaagcctctgaccccaggggcctgactataggagctgctgccaagatccagccctccccagggttttgacatgcccactaaccaggcttgtggaacttaagggcctccccccggagctgctccatcagagacagggtctggtcagcagtctcgcctgtggggaacaaaacaaggaaaacttgtcctctagatacatttaccatatcctacagccagaacagaactgartagacccctattccctcaattccagagacaagatatctagagccagacatctgaggcctctcatgccagtctctgggcaaagggaacaaaagaaacaccaggaatcccagtcttgagacagaagtcagggtactgagtaagccaagggcctgaggagcctgtaaggactcttctgaggaggttcagaagtcagggagctgaatgctgtgacaggagtctcaagcttctcaccattctccaccacatcctttgccgtcctccggtctgtttcttctagccgagcttttgccacctgaaaga

SEQ ID NO: 203759 - DNA, 601 bp, Human
agtaggatcttcagggttcttgtgctggaatctgcagccaaagtgaaggtcatacccccagctgggcagccatagcaggcaatgtgcatcttgtacctgcccccaccccagctctgttcactcacagtcgctcatagaggcgaacctcacacatcaaaggctgtgacacccagtgaataaaggcctttggcttctctccagcatctgcccgtctgcaggtcacctccagactctctacacaaccactggggccctggaagtggggggaggggagcagcaattagacccgggaaccacaacsaggactgcaggctatactcacatcttggccccagcaggcactgcagtaggaaggctgcagctggctctcaccttgacaacatgctgcagctcaatgacgtagcctgtatgcctcaggcccacaggctggccccaagccaggcgcttaaatcctggctctggctcctagagataggaagtggggtagacacatgaggctgcaagggtcaaacaagtggggaagcttccctacccccgtgtctggcaaagattggttcatctgaagcaggaagtagatggactgacagagatgaggagatga

SEQ ID NO: 203760 - DNA, 601 bp, Human
tggggtcccaggaattgcgtgggatcttgcgcagaaagttggccaggcaaatccttcgcaatgagggggaaataaaccgaaaatagatgccggcagatgcgattatgtcggcagtttggcccggagacaccgaggcccaggcgctgggagcgcggtcccaggcagcagtctccggacccggccgagctcttcctcgcaggcgcctccctcggcggtcctggccgcgtccccgctccgagggccggggtccggcgcacagcccggggaggggagcggagggcagagggctggcgggcggagytgttttctgcttttctcgccgacgcttcggagcgcgcggactcccaccccagcccgcccgtcagggacagtcccgagggtcccggctccccgccggcccccagggacgccgcggggccgcgcctgggcccgactgagggcgcagaggaacccgtctcggcggccgggtagcaccgtccccgccaaggtcacttacgctgcggtggccccgggtccccagcactcacccagcgctgcagccgagagcctgcagcccagcctgcgcgcagcggagcggttggcgttgccggagcggttgccg

SEQ ID NO: 203761 - DNA, 601 bp, Human
ccgagatcgcaccactgcactccagcctgagcgatagagggagtgtgtctcaaaaaaaaaaaaaaaagaaagaaaaagaaattaagaaagaaaagaaaatcactgacagacatcccaaggcacccctgaaacgtgacctcccttcaattcacttcccaatccaaccaagagcaacagaaaatatctgttacccctaaaatgggtgcaacttctcttccaactcccaggtccagcagctggggaaagaaaagaacctgcctacaaaaagagcctccccagtctgctaaatcagcaccacatrggcagtttcaacctggaaccaaagggccaccacccctcaccgcctaaccagttggaaacagggctgtcctgagccaacacccaggagagctgtgccagggccgtgtctggcctgcgttgccacctggggagcaagggacctgtgcctttccaccagggggtacccccagctagaggacaaatgaccaaagacgaagggaagcctctgttctccaggagacgtttgactctgtctttgggaaagctacacagggtgggcggcccagcccctttctccaggagctggcgggttctaagtcac

SEQ ID NO: 203762 - DNA, 601 bp, Human
aagaatcggcatacctgtaactcctccctctcaatgtttcagtccatatctcgaaaggacggtatgttactctacacaaccacaactcattaccagatttaagaaaattacccctccaccgcgcggtggctcatgcctgtaatcctaccactttgggaggctgaggcggatcacttgagatcaggagttcgaaaaccagcctggctaacatggtgaaagcccgtctctactaaaaatacaaaaaaaaaaaaaaaagccaggtgtggtgatgggcactggcaatcccagctacttgggaggsaggctgagacaggagaattgcttcaacatgagaggcggaggtggcagtgaaccgagatcgcaccactgcactccagcctgagcgatagagggagtgtgtctcaaaaaaaaaaaaaaaagaaagaaaaagaaattaagaaagaaaagaaaatcactgacagacatcccaaggcacccctgaaacgtgacctcccttcaattcacttcccaatccaaccaagagcaacagaaaatatctgttacccctaaaatgggtgcaacttctcttccaactcccaggtccagcagctggggaaagaaa

SEQ ID NO: 203763 - DNA, 601 bp, Human
aaacatagtgacatcccgtctctactaaaaatacaaaaattagctgggcgtggtggcacacgcctgtaatcccagctactcagggggctgaggcaggagaatcacttgaacccgggaggcggaggttacagtgagccgagattacaccactgcactccagcctggcgacacagtgagactccgtttcaaaaaaaaaacaaaaaaaaccagcaaatatgccatcactgaccaacaataaaaacaggaaaagtgtcactcaacccatttatgccagaggttgcaattttttaaatttttgcaygagtaaaaacatcagaccttggcgatgaccttgagcagtatgatgtaaaaactcccacatgcttagcgttctaataatggaacactaggcataagtgggttactgttgtcctacagcaaagattaaatttgaatttctggtcatgaaattaaaacaggggtaccacttcaaacccatcagattggcaaaaatcaaagtctggtactatctagtgttggtaaatgtgaggaacaggaactctgcacactgctgggcgagtaaattgatgcaaccacactggagaaccctttgccagcatct

SEQ ID NO: 203764 - DNA, 601 bp, Human
tgtgtgcacattctgccagagtccaggtcagcacgtcagagggtcatgagacagcccggccctccgggctcttagggcagaatatctagatgtcttctacagggctctctactggtcccgttaccatcttggccacattgggcccatccttctccatgcatgcttgctggtgatgctagattatcttgatgaccagaccaaagaagttactggcctggtaaagacagataacacagtcaagactgccagccacacatccttctcagcacccagcatttagaaaacatcagttctgggctgrgcacagtggctcacatctataattctgacacttcgggaggccaaggtgggaagattgactgaacccaggagattaagaccagcctgggcaggatagtgacctcgtctctatatagaaaattaaaatttaaaataaaaaataaataggctagcggtggctcaggcctgtaatctcagcacttagggaagccaagacaggcagatcatgagctcaggagttcaacaccagcccgacaaacatagtgacatcccgtctctactaaaaatacaaaaattagctgggcgtggtggcacacgcctg

SEQ ID NO: 203765 - DNA, 601 bp, Human
ttatacataggacagccaacgtttgcatcccagagtcatcatttctattttcagaagtatcctaatttggatgaaaaataatggaaattgtactatcagtgacaaggccttaaaagttgatttgttctgctgtcttgactgccaaagcaaagcatgtcccaaacaccaggaaggctgagtgggttgggaatgggtggcaggtggcccccagcactctgatgtggtttgatgatacgcttccaaccctcgaatgggaaaagcctgtggctggcaccgccctcctgggacttgcgcaagccasgaagctgtgtgactgtgtgtgtgcacattctgccagagtccaggtcagcacgtcagagggtcatgagacagcccggccctccgggctcttagggcagaatatctagatgtcttctacagggctctctactggtcccgttaccatcttggccacattgggcccatccttctccatgcatgcttgctggtgatgctagattatcttgatgaccagaccaaagaagttactggcctggtaaagacagataacacagtcaagactgccagccacacatccttctcagcacccagcatttagaaa

SEQ ID NO: 203766 - DNA, 601 bp, Human
gacttgctcagatgctgacagagccaatgcattcaccacgtctgcatcggataccaaaggaccttgggcctgctttataaaagcttttagagatcctttgagattgcaatgagattagtgttctgctcattagtgttctgcctctccagcttgcagaacacggcggttccctaattcaaccgcaggcgagattacaccagggtagttgaggctgacgcgaaggccagccacagaaaggcctagctctgggccgggcatgctggctcacgcctgtaatcccagtactttgggaggctgaggygggcgaatcacgaggtcaggagatcgagaccatcctggataacacggtgaaaccccgtttctactaaaaatacaaaaaaatagccaggcatggtggcaggcgcctgtagtcccagctactcgggaggctgaggcaggagaatggcgtgaacccgggaggcggagtttgcagtgagccgagatcacgccactgcactccagcctgggcgacagagtcagactccatctcaaaaaaaaaaaaaaaaagaaaggcctagctcttggatccagctaggtcctgttttcctcccttggggccctg

SEQ ID NO: 203767 - DNA, 601 bp, Human
agaaggctttctggccaggcacagtggctcatgcctgtaatcccagcgctttgggaggtcaaggcaggcggatcacctgaggtcaggagttcgagaccagcctgtctctactaaacaaggtgaaactcctgtctctactaaaaatacaaaaattagccaggcacggtggtgggtgcctgtaatcccacctacttgggaggctgaggcaggagaatcacttgaatccaggaagcggaggttgcagtaagctgaggtcacaccactgcactccagcctgggcaacagagcgagactctgtctaaaaaaaaaaaaaaaaaaaaaaaaaaggccggacacaatggctcacgcatgtaatcccagcactttgggaggctgaggcaggcggatcacgaggtcaggagttcaagaccagcctggccaacatggtgaaaccctgtctctactaaaaatacaaaactcagccgggcatggtggtgctgcctgtagtcccagctactcaggaagctgaggcaggaaaattgcttgaacccaggaggcagaggttgcagtgagccaagatcacaccactgcactccagcctgggcgacagagcaacactctg

SEQ ID NO: 203768 - DNA, 601 bp, Human
tgctgagaactcaaaaagtgtcaagccaaacacagaggtcctgacagcagtggcaatctcactccattgtgcaacaggcgcctttctctccacaacaacgcaaatctcaatcactctggacaaatgcagatggtgaaagtgacaagctgagctgttaacagctttccagggtctttgcatgggacagcaacccattttcacttccctttatataggcacccacttcccttttatttcttaattctgtgctttctgctctgcttcttacaagagatgatgaacacaaagtccttatttcacsagggaaggatgtgaactcttgtgtgccacaagacccctttccaggatgcgggctggtggaagaacagctgcgagcagatgtcatctctagaccttggtctgctgtgctgcttaggcagacctgagttccagtgcacccctctgccccttttccaagctaatctttgggttaaaaaaaacagaaaagggtgctcctcatatcctctctctccaaacctgcagagcacttatgagaaagcacgctccaccccggctctgtagaacgttgttatgtgccaaaaagagtgtgcggccaggcgac

SEQ ID NO: 203769 - DNA, 601 bp, Human
ccagctacttgggaggctgaggcagtagaatcacttgaacccaggaggcagaggctgcactccagcctggacgacagattgagacttcatctaaaaataataataataaaataaaagtaaaaaaccaactagttgaagtgaattctattgtattaacagagtaaaaatgccccaagtcccaatgttaagtggggaaaaagcaagctgtgggtgactgaggaccataagcatctgaccctctcagcaatctacacatgtaggaacactcctgccactacatgcaaaatgccaaggaagatgyacggcagtcggtcactacggtggggagactttttttcacaacatacccttacttttaagaaaaaaaaaaaagtgagtatgttcctattatttcagttttgtttcttctaggaaaaatagttggcagtattactaaaggccctgagccaccaaactgataaaaggacatttgttttaatgattcctcagagcatttccaatttggtcttccttcccaccaatgaggcttcctccctagtgactttgagatgggagtctcgctctgtggcacatgctggagtacagtggcgcaatcttggct

SEQ ID NO: 203770 - DNA, 601 bp, Human
aagtaaaataagttcaacctcagggaggtgcagataaaatcaaggaggtattcagcatgtatcagattggcaagggctggacagtttggcacttcttgcagggcttaggaagtggggaaacggaaggcatgataatgagtgcctggggtgggtgggcacaaccaccgagacatcaaccagcaacgcccaccagtttctaaatctgcatgtcctggaaatgaatcaagtatccaataacagagtaactgttaaattacggtaagtggttaaatagaatatgaagcaaccattaaaaaagcarttagttggtggggcacggtggcgcatgcctgtagccgaggcggttggatcacctgaggtcaggagttagagaccagcctgactaaggtggtgaaaccctgtatctactaaatacaaaaaattagccaggcgtggtggcgcatgcctgtaatcccagctacttgggaggctgaggcagtagaatcacttgaacccaggaggcagaggctgcactccagcctggacgacagattgagacttcatctaaaaataataataataaaataaaagtaaaaaaccaactagttgaagtgaattctat

SEQ ID NO: 203771 - DNA, 601 bp, Human
gtcgtaaaatgctgggtgatgctcatcagcacagcacccaacggaccactcagaagcacatcctccgtggaggaatcagcgttacctaggtgaggccagagaggcaacaggacagtgcttgtacaagtggctgcctgaagtctgaatcttcacactggactcctcacacacaaaaagtaccacatgcaacacagaattgttttgtttttttgagacggagtcttactctgtcccccaggctggagtgcaatggcatgatctcggctcactgcaacctctgcctcctgggttcaagctattytcctacctcagcttcccgagcagcgggattacaggcatgtgccatcatgcccagctaattttcatatttttagtaaagacagggtttcaccattttggccaggctggtctcgaacgcctgacctcgtgatccacctgactcagcctcccaaagtgctgcgatgacaggcgtgaggcaccgcaccaggcccacagatcttaatttaaaaagttttatgaaaaaaatcaatgccctttgaaaaacaggctgggtgcggtggctgatgcctataatcccagtactttgggaggccaaggcaag

SEQ ID NO: 203772 - DNA, 601 bp, Human
ccacacgcacctaatttctgtatttttagtagagatggggttttaccatgttagccaggctggtctcgaactcctgacctcaggtgatccactggcctcagcctcccaaagtgctgggattacaggtgtgagccaccgcacccagccagtggaaaagagctctgacgggagcccagccctctggggcagcacatgtgtcgtaaaatgctgggtgatgctcatcagcacagcacccaacggaccactcagaagcacatcctccgtggaggaatcagcgttacctaggtgaggccagagaggmaacaggacagtgcttgtacaagtggctgcctgaagtctgaatcttcacactggactcctcacacacaaaaagtaccacatgcaacacagaattgttttgtttttttgagacggagtcttactctgtcccccaggctggagtgcaatggcatgatctcggctcactgcaacctctgcctcctgggttcaagctattttcctacctcagcttcccgagcagcgggattacaggcatgtgccatcatgcccagctaattttcatatttttagtaaagacagggtttcaccattttggccaggc

SEQ ID NO: 203773 - DNA, 601 bp, Human
cgtgtgggtccccgggggccaggcggccagagcccagagagagagccaaggggctgtgctggacgagaccgagtccagggccttcgctgctatttttaaacggcctttgcatggatttgtagaacagcttgagacactttcccaagtgagtgatatgaaacagttaagagcctgtctgtgtgattacaccctaagtggaggacccaggggacagggaaatgtaagaaaagttacaatccaggagtcctagtttcgacaggacacagacaaacaagctcggtgtgggctggtggaggttgasgctgagaggtggggctgggctggccatccacccactcccggggcctctctggtttttccagtcagccaagggctctgcttccggctgcggagatgaggcttctgagaaggaaaactctcacctcgatgccccagccgtttgatcttgcactggctcatgagtcacaagccagtgctttccagcttgaactctgagtcaccctcctaagtgagcagctcaacaaaagcaatacatgtctcctgggcgcctgcatccagggctggggagagccgcggcgcggggagctgggtgaggcagggg

SEQ ID NO: 203774 - DNA, 601 bp, Human
tttgttgacatagttgaccagctcatccgacaggggatggaaagagggcctgctccgggcattggccaacaccagcaggcagcagagggaggcccagagctgccacatgttggaagccggatcctagatccacctggagaggacagagggcatcaggacacctctctgttatgtgggtcgagggctcacacacacaggggcaccgtctcgggcatcagtggggacccccatgctcgtcctggcccaggcggagaactctaaggagctgaggtgtctatgggatccccgccccactgcccgmagcacgccatgacctcgtgtgggtccccgggggccaggcggccagagcccagagagagagccaaggggctgtgctggacgagaccgagtccagggccttcgctgctatttttaaacggcctttgcatggatttgtagaacagcttgagacactttcccaagtgagtgatatgaaacagttaagagcctgtctgtgtgattacaccctaagtggaggacccaggggacagggaaatgtaagaaaagttacaatccaggagtcctagtttcgacaggacacagacaaacaagctcggtgtgg

SEQ ID NO: 203775 - DNA, 601 bp, Human
gtattccgtttgttgacatagttgaccagctcatccgacaggggatggaaagagggcctgctccgggcattggccaacaccagcaggcagcagagggaggcccagagctgccacatgttggaagccggatcctagatccacctggagaggacagagggcatcaggacacctctctgttatgtgggtcgagggctcacacacacaggggcaccgtctcgggcatcagtggggacccccatgctcgtcctggcccaggcggagaactctaaggagctgaggtgtctatgggatccccgccccmctgcccgcagcacgccatgacctcgtgtgggtccccgggggccaggcggccagagcccagagagagagccaaggggctgtgctggacgagaccgagtccagggccttcgctgctatttttaaacggcctttgcatggatttgtagaacagcttgagacactttcccaagtgagtgatatgaaacagttaagagcctgtctgtgtgattacaccctaagtggaggacccaggggacagggaaatgtaagaaaagttacaatccaggagtcctagtttcgacaggacacagacaaacaagct

SEQ ID NO: 203776 - DNA, 601 bp, Human
ataggacgcagccccacagcctacctgccacgtggtattccgtttgttgacatagttgaccagctcatccgacaggggatggaaagagggcctgctccgggcattggccaacaccagcaggcagcagagggaggcccagagctgccacatgttggaagccggatcctagatccacctggagaggacagagggcatcaggacacctctctgttatgtgggtcgagggctcacacacacaggggcaccgtctcgggcatcagtggggacccccatgctcgtcctggcccaggcggagaactctaaggagctgaggtgtctatgggatccccgccccactgcccgcagcacgccatgacctcgtgtgggtccccgggggccaggcggccagagcccagagagagagccaaggggctgtgctggacgagaccgagtccagggccttcgctgctatttttaaacggcctttgcatggatttgtagaacagcttgagacactttcccaagtgagtgatatgaaacagttaagagcctgtctgtgtgattacaccctaagtggaggacccaggggacagggaaatgtaagaaaagttacaatccagga

SEQ ID NO: 203777 - DNA, 601 bp, Human; identical to SEQ ID NO: 23586

SEQ ID NO: 203778 - DNA, 601 bp, Human; identical to SEQ ID NO: 23587

SEQ ID NO: 203779 - DNA, 601 bp, Human; identical to SEQ ID NO: 23588

SEQ ID NO: 203780 - DNA, 601 bp, Human; identical to SEQ ID NO: 23589

SEQ ID NO: 203781 - DNA, 601 bp, Human; identical to SEQ ID NO: 23590

SEQ ID NO: 203782 - DNA, 601 bp, Human; identical to SEQ ID NO: 23591

SEQ ID NO: 203783 - DNA, 601 bp, Human; identical to SEQ ID NO: 23592

SEQ ID NO: 203784 - DNA, 601 bp, Human; identical to SEQ ID NO: 23593

SEQ ID NO: 203785 - DNA, 601 bp, Human; identical to SEQ ID NO: 23594

SEQ ID NO: 203786 - DNA, 601 bp, Human; identical to SEQ ID NO: 23595

SEQ ID NO: 203787 - DNA, 601 bp, Human; identical to SEQ ID NO: 23596

SEQ ID NO: 203788 - DNA, 601 bp, Human; identical to SEQ ID NO: 23597

SEQ ID NO: 203789 - DNA, 601 bp, Human; identical to SEQ ID NO: 23598

SEQ ID NO: 203790 - DNA, 601 bp, Human; identical to SEQ ID NO: 23599

SEQ ID NO: 203791 - DNA, 601 bp, Human; identical to SEQ ID NO: 23600

SEQ ID NO: 203792 - DNA, 601 bp, Human; identical to SEQ ID NO: 23601

SEQ ID NO: 203793 - DNA, 601 bp, Human; identical to SEQ ID NO: 23602

SEQ ID NO: 203794 - DNA, 601 bp, Human; identical to SEQ ID NO: 23603

SEQ ID NO: 203795 - DNA, 601 bp, Human; identical to SEQ ID NO: 23604

SEQ ID NO: 203796 - DNA, 601 bp, Human; identical to SEQ ID NO: 23605

SEQ ID NO: 203797 - DNA, 601 bp, Human; identical to SEQ ID NO: 23606

SEQ ID NO: 203798 - DNA, 601 bp, Human; identical to SEQ ID NO: 23607

SEQ ID NO: 203799 - DNA, 601 bp, Human; identical to SEQ ID NO: 23608

SEQ ID NO: 203800 - DNA, 601 bp, Human; identical to SEQ ID NO: 23609

SEQ ID NO: 203801 - DNA, 601 bp, Human; identical to SEQ ID NO: 23610

SEQ ID NO: 203802 - DNA, 601 bp, Human; identical to SEQ ID NO: 23611

SEQ ID NO: 203803 - DNA, 601 bp, Human; identical to SEQ ID NO: 23612

SEQ ID NO: 203804 - DNA, 601 bp, Human; identical to SEQ ID NO: 23613

SEQ ID NO: 203805 - DNA, 601 bp, Human; identical to SEQ ID NO: 23614

SEQ ID NO: 203806 - DNA, 601 bp, Human; identical to SEQ ID NO: 23615

SEQ ID NO: 203807 - DNA, 601 bp, Human; identical to SEQ ID NO: 23616

SEQ ID NO: 203808 - DNA, 601 bp, Human
tcatgcccatctccaactctggtccacaacattcatcacaggacttatcaactgaccagaggaatctaagtgagattccatagaggtagcaaagaattgtaaatttcccctaaatgatttcttccatagtcaaaaagaaaaaaaaaactcatctaagagttgaactctagttttgagttccctttcactctgccttctaaaagcagtaatttcttcaaatctctggtctgcaaaatctcaacaaactttcaagaagtctcaatcctagcaacagatagtttcccagaacttttcacatctyccaagagtatacatcatttagttttgaatcatgcaatactcaggggttccagcctgtatttgttatacccatctttcattccctgatattgtgggggagttgcttgtttactcagccttctttttttttctacttatacttgtcaacattttatccagattatcagtctttaaaaacaagtctggatgcttgtgatcaagtttacattttgtgtaccattttattagtgtctttatctttattaattcactgcgatatttgaaagggagggtaggaggtttggaagtaagtgtattcatt

SEQ ID NO: 203809 - DNA, 601 bp, Human
cttctttctttctttctttctttctttctttctttctttctttctttctttctttctttctttctttctctctctctctttctatgaaatttcactctgtcacccaggctggagtgcagtggcacagtctcagctcactgcaacctctgcctctcgggttcaagcaattctcctgcctcagcctcctgagtagctgggattacaggtgcccaccaccacgcctggctaatttttgtatttttagtagaaacagggtttcactttgttggccaggttggtctcaaactcctgacctcaagtsatccactcgcctcggcctcccaaagtgctgggattacaggcgtgagccactgcaccaggcatgtcttacccatgtctatagatttttaacatattatgttctcattgtcattcagttataataatttatgattttttctatgctttctggtgtacctaagacttaaaagaagtatgtaaatttctaattttattgtattatgaacggtgttcaaggccatacgtagggtagcaacttttttgtagcctattttgagttcaatttggaggaaggttttatgtgtgttttgaaaagattata

SEQ ID NO: 203810 - DNA, 601 bp, Human
ttacagtggtcactctgcctgttatcctttggccttttcctgctctttgcttctacttctccaagcatggacaagattggtgaagctgctatcctacctggcagtttacatcttcaatctcattgtacctacttcgcagcttacacagatcattcacaatttcttgtaactgagagttgctctcttgtttttctactctgctactattctttaaagattgaacaaacatatttgaacctatatatttctctggcatcacgtaggaatgtaaataaatgttttcttttttgcattttctctytcttttctatatttgacattgaatatacattttatttataatcaggaaaaagtgtatgtgtgttacaatctttaaatataaatgttcttttatgattccatagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacc

SEQ ID NO: 203811 - DNA, 601 bp, Human
cagatcattcacaatttcttgtaactgagagttgctctcttgtttttctactctgctactattctttaaagattgaacaaacatatttgaacctatatatttctctggcatcacgtaggaatgtaaataaatgttttcttttttgcattttctctttcttttctatatttgacattgaatatacattttatttataatcaggaaaaagtgtatgtgtgttacaatctttaaatataaatgttcttttatgattccatagtgcaagtggtgacccaggatgaaagagagcagctgtacacamctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatggtgagaatctctgag

SEQ ID NO: 203812 - DNA, 601 bp, Human
ggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatggtgagaatctctgagaatcattgtctgtgtctggaaatactatttgcaagaatgtttggaatatagccgtagtgcccagtttttcaggattttaaccacagaaagggtcatgagaagatagcctttcwtgtctactatagctgtgtttatgattatttggagagttcatggggctacactgagttctttggctggagctatcttttctctgagggatcctgctgtcaacaggagaaatttgaggacaatggtgagggcaacaagttctccataagcagtgatatgattcagacctggctttgccactagcaatcatgcgaccctagaagggtcctatccactctccactggagtttcattgtctggacaataagtgtgaaatagatcatttctagggtcacttacaacttcaactttttggatctaag

SEQ ID NO: 203813 - DNA, 601 bp, Human
aagtgaatacaaagctgcagtttatgttttgtgtaatggaaatttgctagggtgaaggggtgatgtgggagtttcctccatttcagatgactgaaggataggggtcaggaaagaaaaatagttggctttgatagctattttagactttgattaaaaatctcactcattttttcctttcattttatgttttatagaaatgtttccttttagttttatgtttatatttttatgtttttgttcatgtttcaagtttttgaccactttattttgcataatcctccagattaattcttgtgaattyataaaacacacaaaaagccttcagtgtcagtggcccttttgcaaaagtaggtaaaggtatttgttctgtccaggagagaagattacaaatcagttaatcttactacacataattataagcctgtggaactcataagtgctccacagaataaaatcaaagacagaagtctgtttgattctactttatccagaaatttttcttttccaattaggaaactgaagcccagagaggaaagctgacttccttccataagtttatacagcttcttaagagcaggctaggactaaaccccggtgccct

SEQ ID NO: 203814 - DNA, 601 bp, Human
aaagctgcagtttatgttttgtgtaatggaaatttgctagggtgaaggggtgatgtgggagtttcctccatttcagatgactgaaggataggggtcaggaaagaaaaatagttggctttgatagctattttagactttgattaaaaatctcactcattttttcctttcattttatgttttatagaaatgtttccttttagttttatgtttatatttttatgtttttgttcatgtttcaagtttttgaccactttattttgcataatcctccagattaattcttgtgaattcataaaacacmcaaaaagccttcagtgtcagtggcccttttgcaaaagtaggtaaaggtatttgttctgtccaggagagaagattacaaatcagttaatcttactacacataattataagcctgtggaactcataagtgctccacagaataaaatcaaagacagaagtctgtttgattctactttatccagaaatttttcttttccaattaggaaactgaagcccagagaggaaagctgacttccttccataagtttatacagcttcttaagagcaggctaggactaaaccccggtgccctgacctctgcc

SEQ ID NO: 203815 - DNA, 601 bp, Human
ctgttcacccctcctgaaataacaacctttgctttgctcagaaagcacttttgcttcccgtacaaaggctgtatgaatgggtagccctctgtccgggctgtatgaaataagaacctttgctttgctcaaaaagtacttatgcttccctgacagaggctggatgaatggcactacccaaccccaccccagtatcctcatagttccaggaggaagaaatgtgatgctttacatgagaaaagcgataaagaatcttcattgaactgcttagattagtattgctgggagaaatcttgaattccarggctatttttccgcaaaaattttacaaattttgggtgatttacctatcatgccaagatgacatacataatcttatcacaaaacccttagcaaacagattcttaatgcctggacattcttgcctggagctgttctttgctgttctctctaacatctaaacccacatgggcatagatgacccaaattttaagtttcagtctgtatgtggggaacatctctaggaatcaagacatctcagtctcctgcccaataattcaatgtgtgttcagtcctcaaatggcatactcattcccttggcttt

SEQ ID NO: 203816 - DNA, 601 bp, Human
gggctatttttccgcaaaaattttacaaattttgggtgatttacctatcatgccaagatgacatacataatcttatcacaaaacccttagcaaacagattcttaatgcctggacattcttgcctggagctgttctttgctgttctctctaacatctaaacccacatgggcatagatgacccaaattttaagtttcagtctgtatgtggggaacatctctaggaatcaagacatctcagtctcctgcccaataattcaatgtgtgttcagtcctcaaatggcatactcattcccttggcttyttggccatggggcttttcaaggagattagctgtcagtacctgttagactaattaatgaaaaacaaaaaggatgagaaaatctaccagctgaaaaatcctctaacatctctgctccttttgcattttagtttgcatatatcctttacctagtgtctattaccagtttgttttgtttggaaccgctgtgcatttcagtagtatagtcacacccatataataagcttgcctctaaacagatacaaggccctagcctctactaacaaaagaagccaactgtatgctatttaaactggaaaagat

SEQ ID NO: 203817 - DNA, 601 bp, Human
gcaattctgacttcctttgtcttcgtcataagcatcccgtaaacacaagttcacagggaactgtgaaagttcaaagtgggaaaattatatttatcactatgtgtggtgatagtaggcataaccaaattggtctttccccgcttatcataacgtattaaaccgggaatttctcagtccctaatacttgcagagtcatgttatgaggtcattatagattttaggagcctcaatgcttttcatatcattttcagaattcttcaaaattcccatttataggccctaattgatttcagcagcccakatgcagtagagcagttcttccactaacaatttttttaaagacagagctaaaaatatatatatttgatgaagtatattaagtagaaaaaaatgttagaaatatcagaaaaaaattaagaaataaaagtatgttcagtacaatttaatttgaataattttaatctctaaaaataaccatattgtaaaaaaatacaatttcttctagtaaataaagaacaaatgagattttgtactacaaacatgcaagacatgttttgcaaaaatcacaacttcaatgttaagttccgcatttcatgaggca

SEQ ID NO: 203818 - DNA, 601 bp, Human
atgttgttggaggacctgctatataagtcatttcagtagcagtcttgggagaaatttgtgggacccactggggagacagaatcagaaaatgtgcattctaaaaacgtgcgtatactgaaatgaacttgtgatgcctagatgaacttgtgatgccgaaaactgatttcctgctagtgcagttgtatctctttttgaagaagagaaactgttttgcttagacattttttttgtaggagtatgggaagaaaaattactcactgaagctagtgcgagtcaagggtagagggagggcagttcctgyaaggatgtgtataaatggatttccaggaaactaaactgccgcatgtcaggaagagcggctacctgaaggtgcttgtagatccaaagctgccctaggttccccatcagcactgattcatgagttttgcatctagtttctcctgtccttaccacaacttggctgttctgtcttctctgcactaaacaacttcttcactctctattccatatgttttaaacttatcttactatttttgttccctcataccttgcttcatagattacccaatccaacaagaaacaaaagagagaaagaaagaaa

SEQ ID NO: 203819 - DNA, 601 bp, Human
ttcaaggagagaataatccagccatggaggagacaagggaagagtggtttttagcaaattaattgcaaatgtgaaagctctaaggcagaaaagtcattaatattttacagggtgcggtggcacatgtctgtaatcccagcactttgggaggctgaggcaggcagatcacctgaggtcaggagttcaagaccagcctggccaacatagtgaaaccccatctctactgaaaatatgaaaattagccgggcatagtggcatgtgcctgtactcccagctactcaggaggctgaggcaggagaaycacttgaacctaggaggtggaggttacagggagcagagattgcgccactgcactctagcttggttgacacagtgagacttcatctaaaaaaaatatatatatatatgtatatattttagagcagtgttactcccaatatggtctgaggatggttgcccatccaagaagtgttctttactagtctgaagtaaaataagtacataactgagaaaaaatgcttacactctatgataagaatttgacagtaattttatatctgttaaatctgataatttaaaaatgaattatgttattttatgt

SEQ ID NO: 203820 - DNA, 601 bp, Human
ccagcctggccaacatagtgaaaccccatctctactgaaaatatgaaaattagccgggcatagtggcatgtgcctgtactcccagctactcaggaggctgaggcaggagaatcacttgaacctaggaggtggaggttacagggagcagagattgcgccactgcactctagcttggttgacacagtgagacttcatctaaaaaaaatatatatatatatgtatatattttagagcagtgttactcccaatatggtctgaggatggttgcccatccaagaagtgttctttactagtctgaagyaaaataagtacataactgagaaaaaatgcttacactctatgataagaatttgacagtaattttatatctgttaaatctgataatttaaaaatgaattatgttattttatgtcatttttctagtaattcgtttttactattgaaattgaaaaatattgagccatgttgggagaagatggtctttccatggtccattgatatctgatgttagaaatattgggcaggatctaaaatgtgcagaactttgcaggttctggtaaacaattacctaagattacacagagagtgagaggtggtgcca

SEQ ID NO: 203821 - DNA, 601 bp, Human
cttaattcaagggatgcctcaggatttccaaccaggatctctattctgggaccatcaactctgatccctctttatcccccagcctgggtatttctcagcccctgaaccagcccagtgacattcccgtttctgaggctcactagttcgaagacccccaaactatccttagtgggccttcattccctccccccagtccctctggttgcttcgagcttggaagagtagagactaagtggagggaagaggccccagggcgggcccttctggagtttgtgcaccacctgataggcagagaggaggyggaacgggcggaaagccagggtttgggagctggcctggaggaggtagatagcggtcctggactgaatcggccttatgaacccgcgctttccccagcctccagcgtagcatactgacacctacccccacccccacctgatcgccagacctcagggttttccggagctgaagaatgacacattcctgcgagcagcctggggagaggaaacagactacactcccgtttggtgcatgcgccaggcaggccgttacttaccaggtaagagtcagggtctggaaatctagataaaactccggaggg

SEQ ID NO: 203822 - DNA, 601 bp, Human
ggacagggcagggactcggggcgcggggagatcactctggaaggtctggggtagacaaaaggaagggtcagtctggcttctgtgacaccatctttctatccttctctagtggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggtgagtcctgagagagagagaaataggctkggatttggtctgtaaggaccagaagcaagagtgtcctaaacctgagagggcaggggtcttaatgccagggatgaaagaaccttggcctccagtgatctagctgagcagccaagcccatcctgacactgacagtggggcttaatgctctaagtattcagacaccaaagttagtgctgggatctgaggaaagtaaatttttttttttttaattactgggtttttagggtcaggcagtatcagggattgaagtcatttggggaaaattgaggtggattttgtatgtgggggaaacttcctctt

SEQ ID NO: 203823 - DNA, 601 bp, Human
gccttgaggttgaggtgggggtgttggctgggggagctgccatgtatgcagttaccagaacgtggcgctggctttgcttccagggagtgtgtggggaagacggtgacattgcagggcaacctggacccctgtgccttgtatgcatctgaggtaacagccagggcccctctgtgtgtctgttactgtgcactcctgtggctgtggttgtattattctgtgtgcacttgtttttaatgtctgtctgtccttttcttctactctgtacaacataagccctagaaagaccggactttttgttgcygttgttcatttgtgtttatgcttcatgcctgggtccatactagggatctgataaattttattgaatgactgaataacactgagtagaagcatgcctacatatgcgtttgtcactagtatatatagggaggacaaaggcttgctggtcctcctgtagccagtgccctgttggtcccccaggaggagatcgggcagttggtgaagcagatgctggatgactttggaccacatcgctacattgccaacctgggccatgggctttatcctgacatggacccagaacatgtgggcgcctttgtgg

SEQ ID NO: 203824 - DNA, 601 bp, Human
aaaagtcaagagtaaggttattcatgttacagttaataactgataattcttgggaacacacattttattccactggcaaaacacattactattatgaataataatgtacgaattaggtgaggctgttaactgacagcactaaatgaaaaccttaattttacaaagcaggataaatgcagatgtcccttgtgaacattaaagaatcagccagaaaagtaaattgaagctaatgatgaaaagtttcccagctgtagaattcataaagttgtatacttcccataatctcagtctttatcatgtraaaaaatttttaaacattgcccaaagatgaacacaccatctgaagaataatttcaatgaaaaatataactgaattatcttatttgtggttatgtttcatagctatagaaaaattttatgtgagggatatttttaaaaatacaatgcattttcaaatactgcatgtataagattcctctaaggggatcaaagaaatctctaagttgacatcatgcatcattggcatggtatattacactcaatggtaataaatatttgaagtctgaataaatgcttaatggtggatcacagtctttatttg

SEQ ID NO: 203825 - DNA, 601 bp, Human
tttttgtggaatctccaggttttaaaatgttgacaagtgaaatgagactttaaagacagacttaaagaaactttgttggcccaaaccatgagggccaaagaaaacatccatatgaggatgtattttatcatgatttaagatagaggctttggatacagaccacctggatttgaattcctgctaccctaggtgatagtgagaccgctggcaagttgcttatcctctctgttcttcctcagttttctcatttgtaaaatgaagattgtatcctcaggaaacagaatattgccgtcagttattrttattattattattattattattattattattattagctaaatccagttcatgatcatttttatacatatgagtgtatatatttatgtacatacctatttatacacacacacaaaaacacacacagacacatcagctatctcctgggagcatggcatcatatgaaagaaaactctaaagccaccaatctttaaggaacctgagtctgatggtagacatacatatacaaaaacccaattttgtaatattacacaataattttttgaacacctactaaatgccaagtaatgttctattactg

SEQ ID NO: 203826 - DNA, 601 bp, Human
attacattccaattgccaccaggatataattccttagatatatttgctaagaaaacttaaaaggaacactcacttcaatgttagcctagtcaacaatccaaccatgtattttgttatttatattttttaaaatctagtatgcaattgtcaaataaaagtattttcattttaaaaccaattattacctaacatttgcagcagaactgataatatcaaaataacaaatttactttcgtgtagtaaaatttgaagactgaaatggttattctaagactgtgctcttgctattgtattttttaayagataaaaaaatcacagttatttccatataaaaatattttcactcataaatgggagtcgaacagtgagaacacatggacacagggaggggaacatcacacactggggcctgtcgggggttgagggctaggggaggaatagcattaggagaaacacctactgtagatggtgggttgatgggtgcagcaaaccaccatggaacatgtatacctatgtaacaaacctgcaggttctgcacatgtattccagaacttaaagtttatatatatatataaaaaaacaaaataaaacccacatagga

SEQ ID NO: 203827 - DNA, 601 bp, Human
agttcattcacgctacagggaagagctagttactaatcatgagacccccttgttcaacatgtccatcacatatgtaatagggcggacacatcaaagtcagtcagtgttctcctaacctgactcatcatttatgcaaataagcccaggaaatttccctcctgtgatgttatatctttggaaaaaaatgtaggaagtatataaattgcttactctgttttaagtggctttaacttttagtggtttatccttctcactttaagggttgggaaagtcatctcaggtgatatgatggtaactgctgtcaggctttaatcccaaagatttcctctcctctctaacagttacaattttatggaagacagtgtaaacatatgcctgggtggaaatttctatttgatggcttgcagtggaggtggtggtgattagatacagacttgaaagggttgtatttttttttttaaagattctctttagggctcatcagattaatgtcacctgtttaatgtcagattgcctgtagaggaagcagtcgcagcatgtacttttttggatggatacccccccaaaatatttttgaggtgagaaaagtcggatttgataa

SEQ ID NO: 203828 - DNA, 601 bp, Human; identical to SEQ ID NO: 19588

SEQ ID NO: 203829 - DNA, 601 bp, Human; identical to SEQ ID NO: 19589

SEQ ID NO: 203830 - DNA, 601 bp, Human; identical to SEQ ID NO: 19590

SEQ ID NO: 203831 - DNA, 601 bp, Human; identical to SEQ ID NO: 19591

SEQ ID NO: 203832 - DNA, 601 bp, Human; identical to SEQ ID NO: 19592

SEQ ID NO: 203833 - DNA, 601 bp, Human; identical to SEQ ID NO: 19593

SEQ ID NO: 203834 - DNA, 601 bp, Human; identical to SEQ ID NO: 19594

SEQ ID NO: 203835 - DNA, 601 bp, Human; identical to SEQ ID NO: 19595

SEQ ID NO: 203836 - DNA, 601 bp, Human; identical to SEQ ID NO: 19596

SEQ ID NO: 203837 - DNA, 601 bp, Human; identical to SEQ ID NO: 19597

SEQ ID NO: 203838 - DNA, 601 bp, Human; identical to SEQ ID NO: 19598

SEQ ID NO: 203839 - DNA, 601 bp, Human
tatgtgttttctgccagttccacagggaacccactctgtggtgaactcaggacatgcaccaattggtagcccttggcctggaacccagttcagaagtcatataagcagtgggttgtttgtgctatctgacaacagcctctctaggcttccatgagcttgattttccctaggctgagagatttgctagctatttcttttctgcttccccattacaaaactgataaaagaacaatgcagaggtcattggtggataatatcaggtccaagtggttatcagagagatggtggtcacaaggcagargagcgactgtgttatcctctcaagtttggctttactctgttgtgtgtgtatcctcctgacatacacattcagtgtatgttttctgtgggccaggcactgtgctaaggcatcctagacataatctcatttatcattattcccagtttccagatgagaaaactgagcctcagagaattcttatgatctgcctaatattgcacagctgtacatgaggcatgaggatttgccacaggtctgttgaactccatagcagcactgtctggagggccagaccacagtactcccaacaacagctaccct

SEQ ID NO: 203840 - DNA, 601 bp, Human
ggggctattatctctatttggcagatgaggaaaccgaggttccaaaaggttaaaaaactggttcacggtcacagagcaagccctggactctagtccgagctgtgttgacccttctgctttggtttccttatctgtataatcttgttcagaattctagttccaagctatgctccaatccatttacccatgtgtagtatcagaatcccatttctattggccactcctggtactaaaaatcacaggtgcaacagggttgaggatggggctctggtaggaggatttttgtctctttcttcctccycccaactatattgaggtaaaaatcctgctaaccagaatgaaaaggaaagctattcagtgttggaaaccagtctaaagaacatgaagaggccgggtgcggtggctcatgtctgtaatcccagcactttgggaggccgaggcgggtggatcacaaggtcaggagattgagaccatcctggctaacatagtgaaacccgtctctattaaaaatacaaaaaattagccaggcgtggtggcgggtgcctgtagtcccagctactctggaggctgaggcaggagaatggcatgaacccgggaggtg

SEQ ID NO: 203841 - DNA, 601 bp, Human
tggtgaagatattcaaatatcacattcacaacttgtgagccccttactcacattaaaggtgtaagttgatgtgaaaagagtccagaggaaggctgttgttagaggcaggatttcttggagagagctgatggtgtagtgtactctgcatcctcccaacccccaggaggagaaagagggtggtaggaatgcttgcttctcaccttaagcctagagaggtgggctttaggggtccactctgcagagccataaactaaacagagcctagattttaaatctaagtcatcataggactttttgttaytgaagcataagcagcaaaagacacaaggtttctttctaattatattacttgactctggcttattcagcatattgctgaaaccttgaaacttccaaataacccttgttaaagtacttttaattgctcaaaaccacaagtacatctaatatcatctggagggacaggcaaggctggggctattatctctatttggcagatgaggaaaccgaggttccaaaaggttaaaaaactggttcacggtcacagagcaagccctggactctagtccgagctgtgttgacccttctgctttggtttcct

SEQ ID NO: 203842 - DNA, 601 bp, Human
cactcaccactacccaaaataaccttaaactatttgtttactttctgtctccccactagcatgtaaactctatgctggcagggaactcgtctcctcatttcccactatatctccaatgcctagagcacttcctgatttgtcataggtgctcgatacatttgttgaaaactgaatgcactaaaatgaagaaatgcatataaagctctagtgtgatgtgtatcatggtatgagaataatttgtgcttgtgctcacccatcatgctagactgcaggctcttaaatggtcaagatgagattttgyacaagacacatattcggggaatatttcctggcagagaccacttagatgggagctgtctgacttcagcctctcagggctctgccttcctagtggagctttcagagacccactagaactgtttgtgatagccactgcacttttaagtttgtgcatgtcaatttaagtgaaaaagatgttcttcatagaagataatcctcaccttcatttgtgaattaagaaaataatgggttttccccaaatagttacaatttatggaatgaaaatttcctaaaagaggtataaatttaacatctaattttt

SEQ ID NO: 203843 - DNA, 601 bp, Human
cctccccattcttagtctactgcatgcttactgggatggacattagagtggagctgatgccaacacatgcaaggggagacttgtacaaagggatgacacctatcattacctaggctttttccatccctcagcatttcccctttgaaagtcctaccaggtaccatatggttcaagtagagactttggcaacgtgtataccttcattgacttgtgagcaccatcaggaatccagattttatgaaacaaattcttaattggagcatcagacatctatctgtctgtctgtctgtctgtctgtctrtctatctatctatctatctatctatctatctatctatctatctacctactcattttcacccagggactctgagtgattctctttcagtgtttctgagggtcctgcctatttactttggatgcctccatttggacataccttgttcacagtgaagctctttcttccctacctccatgttttatacccctaccaagaacagtgctgaggaaagggctgtgggtgttagaagcagatagcctgggctcctgtcttaggctccatcatttcctaaccacacgtggccatggataagtctctcca

SEQ ID NO: 203844 - DNA, 601 bp, Human
tactcttctggattgaaaaatggcttggcctcttggccacccttcagtgtttgcacaacccagtaaatcatgttgcctctgctctgccccagggaaggtagccaaatgttctgttggtggactcatgatatttctaatcaaaagggtttaactgaggatgtagaacacacacacaaacacacacacacatgcacacacacacacacagattataaaaacacttcctcttcgtactttgcagagaaaattattttcctggtatggtattttaacaccagggttatcaagcatgttttatctscttttctggattaagggtatctctgagtctgatttatagccaggtgaaatgaatttctatctcagaaggaaaggtccaaaggcaagctatttctgaataatatatatggcttttagctgctgcagaaggaaaaaaaacaacacggacctgactttattaaaacatacttttcataactgcattttgaacaatacaagccataaaggtgaaatatgagtatgctactcaacattaaaatgctttgtaatgtgcttatgaaaaaagctaaagttgcaggcaaaaagggcaggtgctctttgt

SEQ ID NO: 203845 - DNA, 601 bp, Human
agctacccagttaggatagcactcctgacaatttctttacaaacgcattctgttgtcatttgcaactaacacctccgctccccagtaaaaagtattgcttgtccctggttgcatagaaaggtagatcacagttaaaaatacctattgctgacagaactggtttgtcctggaaacaccatccctagtcaatctttctgaccagtgccgggggaatcttattagaagactatgcaaatggaatcaagcatcactactcttctggattgaaaaatggcttggcctcttggccacccttcagtgyttgcacaacccagtaaatcatgttgcctctgctctgccccagggaaggtagccaaatgttctgttggtggactcatgatatttctaatcaaaagggtttaactgaggatgtagaacacacacacaaacacacacacacatgcacacacacacacacagattataaaaacacttcctcttcgtactttgcagagaaaattattttcctggtatggtattttaacaccagggttatcaagcatgttttatctccttttctggattaagggtatctctgagtctgatttatagccaggtgaaa

SEQ ID NO: 203846 - DNA, 601 bp, Human
ccctgtcactcttgtcccagctttccaaatctcataaggccgagccccagatttgcctcctcctactctttcttgcctccttccttacctgctatccaggccaaacagttttactgctcccctctgcctgccaacagtacttagcatttccccctgcatttttcatggagttggttattctttcctgcagtttcacctctatgaggacaaggacaatgacatcttcttgctctgtgttcttccccaccacaccatcatagaaccaggtcttgagctaggcaaatagtaggtactcaagaartactatggattagctaatggaggcagcaagggccaggacagtgattattaaagtgaggttcctgggctggcagcagcattagcacctgggaacgtgttagaaatgcaggttctgtgccacggcactccaggctgggtgacagagcaagaccctgtttctaaataaataaatataaataaaaataaaagaaatgcaaaatctggggcccaccctagacctataaagtaggagctctgttggccaggctctgcttgtccttacaagtcttccaagtgatcatgtgcatgctaaagcttagaa

SEQ ID NO: 203847 - DNA, 601 bp, Human
aaaatccactgagaaggttttaaaaaacctagaattgattctattaaaacccaaagataatattgacctcaagaataagaacagttcaaatttatcgagtgctatttctctgagaactgcagtaccatctttatgatatgtaagtgatgaaatttcatgttgtgcagtgtccggtacaggacaaacactatattgtggccatgaaagacagagcagcaggtagctcaggaagttcctgtcagtttggagattgacgactctgctgtcttcccatggtggccaagcatcacttcccttactstctccccatttcctttctgacccatttccttcaaaaatccttctttgggtctgggcctggtggctcacgcctgtaatcccagcactttgggaggcctaggtgggtggatcacctggggtcaggagttcaagaccagcctggccaacatggtgaaaccctgtctctacaaaaatacaaaaattattcgggcatgatggaggtgcctgtaatcctagctactcgggaggctgaggcgggagaatcacttgaacccgggaggcggaggttgcagtaagccaagattgtgccattgcactcctc

SEQ ID NO: 203848 - DNA, 601 bp, Human
atgggtgtgaaccatcatgcctggcccccaaggtagttttaaacgtattctggaaaataaatatttgttcagagatttcttctttttttttctttcttgagatggagtctcgctctgttgcccagactggagtgcagtggtgcaatcttggcccactataagctctgcctcccaggttcatgccattctcttgcctcagcctcccaagtagctgggactacaggtgcccaccaccatgtctggttaattttttgtatttttaatagagatcggttttcaccattttagccaggattgtttygatctcctgaccttgtgatctgcccacctcggcctcccaaaatgctgggattacaggcatgagccactgtgcccggcctcttctgttgtttttaagggataggttaataattgtttacatttttattatgaaaatgttgaaacaaaccaaaggagtgttgaatgtcctaagcgttgcatattacaagaagaagcaaacccctagttaagcataaaatgtggctcaactagagccatgccaaaaagttgttggcctgtggagtagatctagaaagagaggatagttctgaaaatacttgaa

SEQ ID NO: 203849 - DNA, 601 bp, Human
gaaggtgacagcacagataccttgggtcagagtactcagctctgtcctccctcagtttgggagataggacagaggttccagtggctgaattggcccagagggaaaggatgctttgaatattcatactgcccagccttgtataaaatgcatgggcatagacagtgaacagtcaattgcaaccatgaaaaatgacaagccaggaaccttcccaaatctcttggactgcatatccctggggttcgttacagtgggaaggtttggtggaatccttaaatacaactgagattggatttctcctatwcctgtttggtggggactgaccaggtgtaatttgatttggaaaatcaaaaacaggcacactgagcatgaatgtgagcaggagggctggttactgggttgggataccacacggtgatgctggggagagctgctgttacccttgccttcccagcacctctccacttctccctgctgcctctgccttatttacaaacagctcctgtgggcaagagcctgcttcttctgcaaactcaagtttttgggctttgagataactccctactcccctctcagagttgttttctgcctgctttcagggtcc

SEQ ID NO: 203850 - DNA, 601 bp, Human
aattgactctgtgatcaatgtggttgcattgcttctgctctgggctggcatagaactgggcactacagggcacaacatgcacctctcctccacactgccgagtggggagatttccagagggcttgtaagggtgaccaagtagttgagacatggagccctggaaaacaatagcatgaggagtaccacacacactctcacactcacacatcctcacactcccacacgtgtataggtgttcactcaggcatgccaccaagtgtgggtgacagaaattaatcacagaggccaggcatggtggctyacgcctgtaaccccagcagttttggaggccgaggcgggtggatcccttgagatcaggagttcacgaccagcctgaccaacatggtgaaaccctgtttctactatatatatatatgtgtgtgtgtgtgtgtgtgtgtgtgtgtgtgtgtgtgtgtattcatatttacatatatttatatataaatatatatatatatttagccaggcatggtggcgcacgcctgtaatcccagctacttgggaggctgaggcaggagaattgcttgaacctgggaggtggaggttgcaatgagcctaaatt

SEQ ID NO: 203851 - DNA, 601 bp, Human
ttctcttagaaatcagccaggataggaagttgggaatacatagaacccacaggaagtccttcctaaggggagtccctgactcctcagaggagaattgactctgtgatcaatgtggttgcattgcttctgctctgggctggcatagaactgggcactacagggcacaacatgcacctctcctccacactgccgagtggggagatttccagagggcttgtaagggtgaccaagtagttgagacatggagccctggaaaacaatagcatgaggagtaccacacacactctcacactcacacatsctcacactcccacacgtgtataggtgttcactcaggcatgccaccaagtgtgggtgacagaaattaatcacagaggccaggcatggtggcttacgcctgtaaccccagcagttttggaggccgaggcgggtggatcccttgagatcaggagttcacgaccagcctgaccaacatggtgaaaccctgtttctactatatatatatatgtgtgtgtgtgtgtgtgtgtgtgtgtgtgtgtgtgtgtgtattcatatttacatatatttatatataaatatatatatatatttagccaggcat

SEQ ID NO: 203852 - DNA, 601 bp, Human
taaagaaggagtacattccaagggcagatagctgtacacagaattgaagaaacctgggctcccaccatgctttccactatcacagtttccaaagctaacattgcttaaaacagccctttatgataaattagatacaggcactgtatcaatgttaaacttatagaagctgataaccatattgcagttttacaagagaataccttaattattaggaaatacatacggaagtatttagggctaaggcatctgattgttcagaaaaaaatatttgtatgttagagagaaagcatgtgcacatgayaaagcaaaggggcaaaatgtggtaactcttggtaaagagtgtacaggtgttttttgttatattcttgtaacttttctgtaagttggaattactcgccaacacttttttttttttaaaggaaaacaacagctctttaagagcattgaaggacagtattcacatgctcaaccctccttagcgcacttgccctcaattaagagttctttggttcgcctgcagggcccttcctctggcagcgcctgtctgccactcctcttctgggggctcccatcttcttctgccatcagaatggcattattg

SEQ ID NO: 203853 - DNA, 601 bp, Human
ttagccctggcatgtagtaggggcttagcaaattttatggaaggaaggaagaaggaaggagaaaaatgttagtgcatgggcctgtcctaatattttattttaataactcatactggacagcaagattaaaagttgttctgaccctaaagtaaattggttaccaataaattatgataatacttacaatattatagccttactcctatataaaaataagaagcagaaagaagagaatggttaaatgaactaaaatttctcaatttaatctgcttttagttggtgcccttcatccctgcattakaagagatttttaaaggaggctcaattgccttaaaagatcctcaggttgaggaaatggaaacaagtgaggaaagcccttctttctcagctaggggataaagaaggagtacattccaagggcagatagctgtacacagaattgaagaaacctgggctcccaccatgctttccactatcacagtttccaaagctaacattgcttaaaacagccctttatgataaattagatacaggcactgtatcaatgttaaacttatagaagctgataaccatattgcagttttacaagagaataccttaa

SEQ ID NO: 203854 - DNA, 601 bp, Human
acttagccctggcatgtagtaggggcttagcaaattttatggaaggaaggaagaaggaaggagaaaaatgttagtgcatgggcctgtcctaatattttattttaataactcatactggacagcaagattaaaagttgttctgaccctaaagtaaattggttaccaataaattatgataatacttacaatattatagccttactcctatataaaaataagaagcagaaagaagagaatggttaaatgaactaaaatttctcaatttaatctgcttttagttggtgcccttcatccctgcatyagaagagatttttaaaggaggctcaattgccttaaaagatcctcaggttgaggaaatggaaacaagtgaggaaagcccttctttctcagctaggggataaagaaggagtacattccaagggcagatagctgtacacagaattgaagaaacctgggctcccaccatgctttccactatcacagtttccaaagctaacattgcttaaaacagccctttatgataaattagatacaggcactgtatcaatgttaaacttatagaagctgataaccatattgcagttttacaagagaatacctt

SEQ ID NO: 203855 - DNA, 601 bp, Human
gttttcctctaaacagatgagaaaggactcatgtcttcaatttgggcaaggacggtgtcgtctgtcctcctcactcccagattgcctcacacatgatagatacctaacacgtgttggttgaattgatgcctgtctcccccagtagacagtaagctccatgaaagaagatgctgtatctgctgttcatttctgcaacaccagactcagcacagtgatcagcattgttgaatgaatctctatttgttgaaacataatcttgaagtaaatccatttgcttccttgccttagtttctatggtccyaccagagtgcacacacgtacatcaatatggtcattgttcatttacttgtctgccttccccaggaggcttgcaatgcctgaaggcaggagagggcgtctgattcatcattttatcactagctactgacttagccctggcatgtagtaggggcttagcaaattttatggaaggaaggaagaaggaaggagaaaaatgttagtgcatgggcctgtcctaatattttattttaataactcatactggacagcaagattaaaagttgttctgaccctaaagtaaattggttaccaataaattatg

SEQ ID NO: 203856 - DNA, 601 bp, Human
ctttaggaccatcctaaacctcacatctttaaaggtcttggagaagctatattcataggttgccttccttgctcttttgggaggaagatgtctggaataataatttgctctttcttatcatgagccttggactctgagttttcctctaaacagatgagaaaggactcatgtcttcaatttgggcaaggacggtgtcgtctgtcctcctcactcccagattgcctcacacatgatagatacctaacacgtgttggttgaattgatgcctgtctcccccagtagacagtaagctccatgaaakaagatgctgtatctgctgttcatttctgcaacaccagactcagcacagtgatcagcattgttgaatgaatctctatttgttgaaacataatcttgaagtaaatccatttgcttccttgccttagtttctatggtcctaccagagtgcacacacgtacatcaatatggtcattgttcatttacttgtctgccttccccaggaggcttgcaatgcctgaaggcaggagagggcgtctgattcatcattttatcactagctactgacttagccctggcatgtagtaggggcttagcaaatttt

SEQ ID NO: 203857 - DNA, 601 bp, Human
aataaaattctacatgttttctaaagaaaaaaaaggtctccttttcctttaggaccatcctaaacctcacatctttaaaggtcttggagaagctatattcataggttgccttccttgctcttttgggaggaagatgtctggaataataatttgctctttcttatcatgagccttggactctgagttttcctctaaacagatgagaaaggactcatgtcttcaatttgggcaaggacggtgtcgtctgtcctcctcactcccagattgcctcacacatgatagatacctaacacgtgttggytgaattgatgcctgtctcccccagtagacagtaagctccatgaaagaagatgctgtatctgctgttcatttctgcaacaccagactcagcacagtgatcagcattgttgaatgaatctctatttgttgaaacataatcttgaagtaaatccatttgcttccttgccttagtttctatggtcctaccagagtgcacacacgtacatcaatatggtcattgttcatttacttgtctgccttccccaggaggcttgcaatgcctgaaggcaggagagggcgtctgattcatcattttatcact

SEQ ID NO: 203858 - DNA, 601 bp, Human
agagaacttgtggctggggctaggatagaaagaaaatgttactttttactttttgattttttttaaccatctgcatgtattcatattcccaaagctaatttgaaaataaaattctacatgttttctaaagaaaaaaaaggtctccttttcctttaggaccatcctaaacctcacatctttaaaggtcttggagaagctatattcataggttgccttccttgctcttttgggaggaagatgtctggaataataatttgctctttcttatcatgagccttggactctgagttttcctctaaasagatgagaaaggactcatgtcttcaatttgggcaaggacggtgtcgtctgtcctcctcactcccagattgcctcacacatgatagatacctaacacgtgttggttgaattgatgcctgtctcccccagtagacagtaagctccatgaaagaagatgctgtatctgctgttcatttctgcaacaccagactcagcacagtgatcagcattgttgaatgaatctctatttgttgaaacataatcttgaagtaaatccatttgcttccttgccttagtttctatggtcctaccagagtgcaca

SEQ ID NO: 203859 - DNA, 601 bp, Human
cccttactagtgattgtccctgaggagagaacttgtggctggggctaggatagaaagaaaatgttactttttactttttgattttttttaaccatctgcatgtattcatattcccaaagctaatttgaaaataaaattctacatgttttctaaagaaaaaaaaggtctccttttcctttaggaccatcctaaacctcacatctttaaaggtcttggagaagctatattcataggttgccttccttgctcttttgggaggaagatgtctggaataataatttgctctttcttatcatgagcyttggactctgagttttcctctaaacagatgagaaaggactcatgtcttcaatttgggcaaggacggtgtcgtctgtcctcctcactcccagattgcctcacacatgatagatacctaacacgtgttggttgaattgatgcctgtctcccccagtagacagtaagctccatgaaagaagatgctgtatctgctgttcatttctgcaacaccagactcagcacagtgatcagcattgttgaatgaatctctatttgttgaaacataatcttgaagtaaatccatttgcttccttgccttagt

SEQ ID NO: 203860 - DNA, 601 bp, Human
aaggaagtaaaagaaacccttactagtgattgtccctgaggagagaacttgtggctggggctaggatagaaagaaaatgttactttttactttttgattttttttaaccatctgcatgtattcatattcccaaagctaatttgaaaataaaattctacatgttttctaaagaaaaaaaaggtctccttttcctttaggaccatcctaaacctcacatctttaaaggtcttggagaagctatattcataggttgccttccttgctcttttgggaggaagatgtctggaataataatttgctytttcttatcatgagccttggactctgagttttcctctaaacagatgagaaaggactcatgtcttcaatttgggcaaggacggtgtcgtctgtcctcctcactcccagattgcctcacacatgatagatacctaacacgtgttggttgaattgatgcctgtctcccccagtagacagtaagctccatgaaagaagatgctgtatctgctgttcatttctgcaacaccagactcagcacagtgatcagcattgttgaatgaatctctatttgttgaaacataatcttgaagtaaatccattt

SEQ ID NO: 203861 - DNA, 601 bp, Human
caatttataatactaagctaattaatgtctgttgagtttaactaaaagcagaggacctggagaaaagaccggtctaggtcactgccactggcccgcaagctccttttcacaaatgtcccgatgatgacatgtcatgagcagaagaccaggcaatttcaggccataggagagaaaggatgcagaggacaggacgagacttgtaatgccaaaaggggcccagaggccgcgcatcccacctatcgaagcctgggccgcggcgatgccgccaggtctccaggatgaaccgaagggaggccgatgrtggagaatagagcacgcaaggtccctcaccttcactacagctgtcccccggctgccctgccggccactgtctactcccgctccgagcttgtttacaaccagggtagccatcctcgcaggggaagcgccacagaaacagccttcagagtcctcaactgagaggcggggttgagccacctacccagaggcctctgcgcacgccaccggcgcacaggcgcagtaggacactgggcgccgcttagccgactcttactcctcctccccgcaatcgtcgggtggttagttgcacagcctcgcgcat

SEQ ID NO: 203862 - DNA, 601 bp, Human
gtttacctaaacctgggtttcctccctgtaaaatgggaattcacatctacttcataagtagatattaacgagctaaaacacctaacttagtacgtagttacgatgatgatgactcaatttataatactaagctaattaatgtctgttgagtttaactaaaagcagaggacctggagaaaagaccggtctaggtcactgccactggcccgcaagctccttttcacaaatgtcccgatgatgacatgtcatgagcagaagaccaggcaatttcaggccataggagagaaaggatgcagaggasaggacgagacttgtaatgccaaaaggggcccagaggccgcgcatcccacctatcgaagcctgggccgcggcgatgccgccaggtctccaggatgaaccgaagggaggccgatggtggagaatagagcacgcaaggtccctcaccttcactacagctgtcccccggctgccctgccggccactgtctactcccgctccgagcttgtttacaaccagggtagccatcctcgcaggggaagcgccacagaaacagccttcagagtcctcaactgagaggcggggttgagccacctacccagag

SEQ ID NO: 203863 - DNA, 601 bp, Human
caaatgattttttagcaaattgattctggagcatgtatacatggtagaatctcaaacttcaagcataagaaaattcataaactctatcgttaatgcccagctatgacgatgctgcagacttgtgcaaagagttaatagactgtactactaacaggggagggggcagctcacccaataacagatgtctgattacagacgcagtacaagagcgaaaagtacagactttaaagccggtcaacccggggctctgccacacactgtttacctaaacctgggtttcctccctgtaaaatgggaattmacatctacttcataagtagatattaacgagctaaaacacctaacttagtacgtagttacgatgatgatgactcaatttataatactaagctaattaatgtctgttgagtttaactaaaagcagaggacctggagaaaagaccggtctaggtcactgccactggcccgcaagctccttttcacaaatgtcccgatgatgacatgtcatgagcagaagaccaggcaatttcaggccataggagagaaaggatgcagaggacaggacgagacttgtaatgccaaaaggggcccagaggccgcg

SEQ ID NO: 203864 - DNA, 601 bp, Human
tgtactaaaactcctcagtgatcctaatatgtagccaggaatgagaattatcaatctcttagattagagatgctcctgaaggttactctataaaccaatgggatcagttctcccctccatatctttccgtgcacaacagtggaagggaaaaatgagtgccacatatttcaaatgattttttagcaaattgattctggagcatgtatacatggtagaatctcaaacttcaagcataagaaaattcataaactctatcgttaatgcccagctatgacgatgctgcagacttgtgcaaagagtyaatagactgtactactaacaggggagggggcagctcacccaataacagatgtctgattacagacgcagtacaagagcgaaaagtacagactttaaagccggtcaacccggggctctgccacacactgtttacctaaacctgggtttcctccctgtaaaatgggaattcacatctacttcataagtagatattaacgagctaaaacacctaacttagtacgtagttacgatgatgatgactcaatttataatactaagctaattaatgtctgttgagtttaactaaaagcagaggacctgg

SEQ ID NO: 203865 - DNA, 601 bp, Human
gcagatcacgaggtcaggagattgagaccatcctggctaacatggtgaaatcccatctctaccaaaaatacaaaaaattagccaggcgcggtggcgggcacctgtagtcccagctactcgggaggctgaggcaggagaatggtatgaacctaagaggcggagcttgcagtgagccaagattgtgccactgccctccagcctgggcgacaaagtgaggctctgtctcaaaaattcacaatagaatttgatataaaataaatgcaacattttataaatgctgtattatgatactctaataaaktaaatttatgacaataaactccaaagaaccatattaaaattgtttagttcatttcaatcctgtatctctgatcccatcactatacaaagatttaaaagaacttccttatgctgttaatgtatttttcaaaaagcactaataaaattccattgattagcaaaccaaacacaggtccaaaaataaagttactagactattttgcatcaactcggtaaataatacagcaagaaaatatttcctcagtatctataaataggaattgtggttaacagcaaaaaaccctagataggaaaaagctct

SEQ ID NO: 203866 - DNA, 601 bp, Human
aaaaaaattcaattaaatatagaaaaaatattcataggctgggtgcggtggctcacgcctgtaatctcagcactttgggaggccaaggcgggcagatcacgaggtcaggagattgagaccatcctggctaacatggtgaaatcccatctctaccaaaaatacaaaaaattagccaggcgcggtggcgggcacctgtagtcccagctactcgggaggctgaggcaggagaatggtatgaacctaagaggcggagcttgcagtgagccaagattgtgccactgccctccagcctgggcgacaragtgaggctctgtctcaaaaattcacaatagaatttgatataaaataaatgcaacattttataaatgctgtattatgatactctaataaattaaatttatgacaataaactccaaagaaccatattaaaattgtttagttcatttcaatcctgtatctctgatcccatcactatacaaagatttaaaagaacttccttatgctgttaatgtatttttcaaaaagcactaataaaattccattgattagcaaaccaaacacaggtccaaaaataaagttactagactattttgcatcaact

SEQ ID NO: 203867 - DNA, 601 bp, Human
ggagttcaagaccagcctgggcaacacagcgagaccctgtctctacaaaaaaaaatcaaaaactgaggtgggaggatcatttgagcccaggaggtcgaggttgctatgagccatgatcgtgccattgcactcccacctgggtgacagagtgagaaactgcctcaaaaaaaaaaaattcaattaaatatagaaaaaatattcataggctgggtgcggtggctcacgcctgtaatctcagcactttgggaggccaaggcgggcagatcacgaggtcaggagattgagaccatcctggctaacrtggtgaaatcccatctctaccaaaaatacaaaaaattagccaggcgcggtggcgggcacctgtagtcccagctactcgggaggctgaggcaggagaatggtatgaacctaagaggcggagcttgcagtgagccaagattgtgccactgccctccagcctgggcgacaaagtgaggctctgtctcaaaaattcacaatagaatttgatataaaataaatgcaacattttataaatgctgtattatgatactctaataaattaaatttatgacaataaactccaaagaaccatattaaaatt

SEQ ID NO: 203868 - DNA, 601 bp, Human
catatatacacatacttcaatttatcctacattttttaaaaaggggaaagtttcacgttatcaaattctttaggccaggcactgtggctcacacctgtaatcacagcactttgggacaccaaggcaagaggactgcttgaggccaggagttcaagaccagcctgggcaacacagcgagaccctgtctctacaaaaaaaaatcaaaaactgaggtgggaggatcatttgagcccaggaggtcgaggttgctatgagccatgatcgtgccattgcactcccacctgggtgacagagtgagaamctgcctcaaaaaaaaaaaattcaattaaatatagaaaaaatattcataggctgggtgcggtggctcacgcctgtaatctcagcactttgggaggccaaggcgggcagatcacgaggtcaggagattgagaccatcctggctaacatggtgaaatcccatctctaccaaaaatacaaaaaattagccaggcgcggtggcgggcacctgtagtcccagctactcgggaggctgaggcaggagaatggtatgaacctaagaggcggagcttgcagtgagccaagattgtgccactgccctcca

SEQ ID NO: 203869 - DNA, 601 bp, Human
ggaaggatacataggacaccagtaacattggaacactggttccccatgaaaaaggcaaacaactggggaacagctatccacgtataattctgtctattattcatatatacacatacttcaatttatcctacattttttaaaaaggggaaagtttcacgttatcaaattctttaggccaggcactgtggctcacacctgtaatcacagcactttgggacaccaaggcaagaggactgcttgaggccaggagttcaagaccagcctgggcaacacagcgagaccctgtctctacaaaaaaaaatcaaaaactgaggtgggaggatcatttgagcccaggaggtcgaggttgctatgagccatgatcgtgccattgcactcccacctgggtgacagagtgagaaactgcctcaaaaaaaaaaaattcaattaaatatagaaaaaatattcataggctgggtgcggtggctcacgcctgtaatctcagcactttgggaggccaaggcgggcagatcacgaggtcaggagattgagaccatcctggctaacatggtgaaatcccatctctaccaaaaatacaaaaaattagccaggcgcggtggcg

SEQ ID NO: 203870 - DNA, 601 bp, Human
catatgattaaaacaaaaagaaaaataatagaatatattcatttttgcataaaggtggggaaagagcaaattttttttgtattgttgtataagcgtattgtcttcctggaaggatacataggacaccagtaacattggaacactggttccccatgaaaaaggcaaacaactggggaacagctatccacgtataattctgtctattattcatatatacacatacttcaatttatcctacattttttaaaaaggggaaagtttcacgttatcaaattctttaggccaggcactgtggctcacrcctgtaatcacagcactttgggacaccaaggcaagaggactgcttgaggccaggagttcaagaccagcctgggcaacacagcgagaccctgtctctacaaaaaaaaatcaaaaactgaggtgggaggatcatttgagcccaggaggtcgaggttgctatgagccatgatcgtgccattgcactcccacctgggtgacagagtgagaaactgcctcaaaaaaaaaaaattcaattaaatatagaaaaaatattcataggctgggtgcggtggctcacgcctgtaatctcagcactttggga

SEQ ID NO: 203871 - DNA, 601 bp, Human
ttttcatatatacacagaatgatttcatatgattaaaacaaaaagaaaaataatagaatatattcatttttgcataaaggtggggaaagagcaaattttttttgtattgttgtataagcgtattgtcttcctggaaggatacataggacaccagtaacattggaacactggttccccatgaaaaaggcaaacaactggggaacagctatccacgtataattctgtctattattcatatatacacatacttcaatttatcctacattttttaaaaaggggaaagtttcacgttatcaaattatttaggccaggcactgtggctcacacctgtaatcacagcactttgggacaccaaggcaagaggactgcttgaggccaggagttcaagaccagcctgggcaacacagcgagaccctgtctctacaaaaaaaaatcaaaaactgaggtgggaggatcatttgagcccaggaggtcgaggttgctatgagccatgatcgtgccattgcactcccacctgggtgacagagtgagaaactgcctcaaaaaaaaaaaattcaattaaatatagaaaaaatattcataggctgggtgcggtggctca

SEQ ID NO: 203872 - DNA, 601 bp, Human
gtaattctagttgcaggaatttatcctacaagcatactagacacgtgtgacaaaatctgtatgttactccttaaagcatcatttgcattagcaaaaaattggaaagaaagtaaatatacatcaatatcagcttggaaaataaattgtggcacattcataatactataaaactatataggatagtgagaaagatgaagtttttcatatatacacagaatgatttcatatgattaaaacaaaaagaaaaataatagaatatattcatttttgcataaaggtggggaaagagcaaattttttttgtattgttgtataagcgtattgtcttcctggaaggatacataggacaccagtaacattggaacactggttccccatgaaaaaggcaaacaactggggaacagctatccacgtataattctgtctattattcatatatacacatacttcaatttatcctacattttttaaaaaggggaaagtttcacgttatcaaattctttaggccaggcactgtggctcacacctgtaatcacagcactttgggacaccaaggcaagaggactgcttgaggccaggagttcaagaccagcctgggcaac

SEQ ID NO: 203873 - DNA, 601 bp, Human
aagcccagtttactcaggaggctgaggcaggataattgcttgagcctgggaggcggaggttgcagtgagccaagatcacgccaccgcactccagcctaggtgacagagtgacactcggtctcaaaaaaataaagaaagaaaaatgcaaattaaagctacatcaaaatacttttttcagattagatcaaaaatgttggtaacattttgttagtgaaggtgtgggaaagcagacactctcatacattactaattgctatgaaatgtttattgagcaatacagcttctatggagggcaacttgwcaatacttaccaaatttaaataactcagtaattctagttgcaggaatttatcctacaagcatactagacacgtgtgacaaaatctgtatgttactccttaaagcatcatttgcattagcaaaaaattggaaagaaagtaaatatacatcaatatcagcttggaaaataaattgtggcacattcataatactataaaactatataggatagtgagaaagatgaagtttttcatatatacacagaatgatttcatatgattaaaacaaaaagaaaaataatagaatatattcatttttgcat

SEQ ID NO: 203874 - DNA, 601 bp, Human
cgagaccagcctggacaacatggtgaaatcccatctctactaaaaatacaaaaaaattagccaggcatagtggtgggcgcctgtaagcccagtttactcaggaggctgaggcaggataattgcttgagcctgggaggcggaggttgcagtgagccaagatcacgccaccgcactccagcctaggtgacagagtgacactcggtctcaaaaaaataaagaaagaaaaatgcaaattaaagctacatcaaaatacttttttcagattagatcaaaaatgttggtaacattttgttagtgaagrtgtgggaaagcagacactctcatacattactaattgctatgaaatgtttattgagcaatacagcttctatggagggcaacttgtcaatacttaccaaatttaaataactcagtaattctagttgcaggaatttatcctacaagcatactagacacgtgtgacaaaatctgtatgttactccttaaagcatcatttgcattagcaaaaaattggaaagaaagtaaatatacatcaatatcagcttggaaaataaattgtggcacattcataatactataaaactatataggatagtgagaa

SEQ ID NO: 203875 - DNA, 601 bp, Human
ctaactcataataagaaaaatgcaaattaaagctaggcatggtggttcatgcctgtaatcccaacactttgggaggccgaggcgagtggatcatctgaggtcaggagttcgagaccagcctggacaacatggtgaaatcccatctctactaaaaatacaaaaaaattagccaggcatagtggtgggcgcctgtaagcccagtttactcaggaggctgaggcaggataattgcttgagcctgggaggcggaggttgcagtgagccaagatcacgccaccgcactccagcctaggtgacagartgacactcggtctcaaaaaaataaagaaagaaaaatgcaaattaaagctacatcaaaatacttttttcagattagatcaaaaatgttggtaacattttgttagtgaaggtgtgggaaagcagacactctcatacattactaattgctatgaaatgtttattgagcaatacagcttctatggagggcaacttgtcaatacttaccaaatttaaataactcagtaattctagttgcaggaatttatcctacaagcatactagacacgtgtgacaaaatctgtatgttactccttaaagcatc

SEQ ID NO: 203876 - DNA, 601 bp, Human
acagaaaacccaaggcagaaatcagactaaatctactatgattttaaacctaactctacaattaacttggacttagtgcttgagatgcaaatatctttcaccatacagtgataattcataattgctttgcatcttatcatggttcaaaagaaatttaaatttagtccttcaatgtaaataagggtttgggaagataaaaatgaataaaaataagaaacataacattgttcagagaaaagaagatgaaaattctttacgtgaaaagatgttcaatctaactcataataagaaaaatgcaaaytaaagctaggcatggtggttcatgcctgtaatcccaacactttgggaggccgaggcgagtggatcatctgaggtcaggagttcgagaccagcctggacaacatggtgaaatcccatctctactaaaaatacaaaaaaattagccaggcatagtggtgggcgcctgtaagcccagtttactcaggaggctgaggcaggataattgcttgagcctgggaggcggaggttgcagtgagccaagatcacgccaccgcactccagcctaggtgacagagtgacactcggtctcaaaaaaataaag

SEQ ID NO: 203877 - DNA, 601 bp, Human
atctgtattttcattattggcttatttatttgtaaagaaaacattgttctattgggtttatggcttcaggcaaatgattcactctgtgatacacattcttatttatttgaatcagggtagcacgtttttctcaggtgtcttaaagctctttacagataagtattgaatataaacatctcagaagataaaataaaattagtaactaagagtgagatagtttatagcttgaagattattgaccttaatagaaacttaggctttctgaaactttctgggaattttatcattctaaaaatcaagyggaaggacattgtttcctatgacatttgcattacatgaacaattttcaatcttaaatccatacaaatacttttcctacctaggtctgttacttgtcgatcaaatgggcaacggattgctcttccatgaagaggtaggcgagtgagacagtcatgacagacggtatggccacaaagcaaaagacggggaactttgtctccttgcaaagaaaagacatcttcacaaactccacactctagcacctaatatttgaaaaggaaggatgtgctctttaaacaattttaaaagcatacatatttta

SEQ ID NO: 203878 - DNA, 601 bp, Human
atgaatatattaaaactgtcttagatagtgcaactgacctggaaaaaaaatggcaaccttaaactcttttggagaaaactcccttatcaaaaagagtaaacttacagaacttacgtttgtaaaataactgttcaaatgttagtaaatgctattatttccaaatctggtatctgaaaataacttagtttgaaatacgtaaagaaaagttttaaaagtatacagaaaactgcaaaaaaaagccacaaacccttcaaactcattttaacagaaaataaagagtaattatcacaagctacaaacmcttctgtccttgatattagtaaataaaaacatggtgagactcaaatgacttatctgtattttcattattggcttatttatttgtaaagaaaacattgttctattgggtttatggcttcaggcaaatgattcactctgtgatacacattcttatttatttgaatcagggtagcacgtttttctcaggtgtcttaaagctctttacagataagtattgaatataaacatctcagaagataaaataaaattagtaactaagagtgagatagtttatagcttgaagattattgaccttaataga

SEQ ID NO: 203879 - DNA, 601 bp, Human
gaaggggagaaatttagtataaattttttcaaaaataaaaatgtttaaatacatcaatggtgtcattctttatcacattaaataaaaaatgaatccaaagtggaagagttttgtttgcaattatgagaaataaacacatgtaccataaaaattcaggtcttctgtttcccagacctgacaaataaataaattataaactataatgtcaacattagctaacagtaatgtcttttgaaataaagattaaagatttagcacagaaagaactgcataacttttagaaaacagagtgttgcagttkgaaattcatttcactgattcactttagtataaagaaatcatcatctaatgaaagagaagtgaaagcaatccgacattttttttccttcatacaaaatatgtggtttgcaagttgatcaccaaaatcattaactgatatttactccaaatatatttttacccataacagcctacgaaagccatgtcctatagtacatatgtgcagctatgcaaacacataagtgctaaaaatatacttttacattattaaaatccagtgttcatggattctgatatttactagacatctacctgtatggat

SEQ ID NO: 203880 - DNA, 601 bp, Human
tgtgctttgctaatgtctttgtagaatgagtaacttgagaacactcagagcacaaatgagttgcacacacagtgcaatatacagaggcaaggtgagcttcatcttcatcacaacgaatgatgctctgataaacaaaaaattaatgccttaaaattgaacccaatcagtataacatgacgaatttttaaatatagaatccataatcctttttgcttaactgaacaatatttacatatgaaaatatattggtcattaagaacaaaggtcattcaatactcatctgagaagcattcatttctasgggtaagaagctatttccaagattaactggccaatatatgttatgaatttgaagccaaaaatagaactattctcatagattcatattcggtgcaaagatctcttccaccaaatcccctcactttacacaaaagaaactaaaccatagagaagtcaaaagtctttctgtaaaactacaaaaatctgatattaaatacatccccatagctttaaatattagttgtcatgatgatgtataggaaggacagaagcacaaatgctatttagaaaatgtaggagtatgcatcagaattagctgtaa

SEQ ID NO: 203881 - DNA, 601 bp, Human
cccagaagtcaaggctgcagtgagtggtgatcacaacactgcatgccagcctgggtgaccgagcgagacattgtttaaataccatctatattaaattccaaaatataaatctccatgctagatctttcccctaatgcacagacattggaaattcaactgtttataaatgacatctcaagcaaaatggaatgcctaatctccagtctcccctattcccaaacctaattgcctctgtcttggtaaatggcaactccatccttcaggatgttgaagcaaaaacaaccggagtcatcattatcasctctctttcatagcccactagtccctcagcaaattctgctgacttcaaaatacacccaaaatctgatcatgcctcatcacctctaagttacctatccaatcaatattaacaattaatcactaagacctatctattctacttatttaaaatctcaaatccattgacttgtgtccactctcactaccctagtgtattataggccataaacatctctagtattttaactagaaaactttaacaacatcctaataggtctgcctgcttccaattttgttgctcctccaattcattttctacatt

SEQ ID NO: 203882 - DNA, 601 bp, Human
agctcgaatacatgaccgggcattctctgcagtccctggtacctaagaaaatgaaaataaattttaagcaactgtaatgttaataaagattttacctgtgaaatatttaaaatttcagcctaggcaacatggcaaaactctgtctctacaaaaaatggaaaaaattagccagccgtggtggcatgtgcctgtagtcccagctactcaggaggctgaggcgggaggattgattgagccccagaagtcaaggctgcagtgagtggtgatcacaacactgcatgccagcctgggtgaccgagcragacattgtttaaataccatctatattaaattccaaaatataaatctccatgctagatctttcccctaatgcacagacattggaaattcaactgtttataaatgacatctcaagcaaaatggaatgcctaatctccagtctcccctattcccaaacctaattgcctctgtcttggtaaatggcaactccatccttcaggatgttgaagcaaaaacaaccggagtcatcattatcacctctctttcatagcccactagtccctcagcaaattctgctgacttcaaaatacacccaaaatct

SEQ ID NO: 203883 - DNA, 601 bp, Human
aataagctcgaatacatgaccgggcattctctgcagtccctggtacctaagaaaatgaaaataaattttaagcaactgtaatgttaataaagattttacctgtgaaatatttaaaatttcagcctaggcaacatggcaaaactctgtctctacaaaaaatggaaaaaattagccagccgtggtggcatgtgcctgtagtcccagctactcaggaggctgaggcgggaggattgattgagccccagaagtcaaggctgcagtgagtggtgatcacaacactgcatgccagcctgggtgaccragcgagacattgtttaaataccatctatattaaattccaaaatataaatctccatgctagatctttcccctaatgcacagacattggaaattcaactgtttataaatgacatctcaagcaaaatggaatgcctaatctccagtctcccctattcccaaacctaattgcctctgtcttggtaaatggcaactccatccttcaggatgttgaagcaaaaacaaccggagtcatcattatcacctctctttcatagcccactagtccctcagcaaattctgctgacttcaaaatacacccaaa

SEQ ID NO: 203884 - DNA, 601 bp, Human
acctctcctttgctctctctttctctcctgccgtcctgtaaacaaggtgcttgcttccccttcgccttcccccatgattgtctaactttcctgaagcctccccagccatgcaaacctgtaaattaagcccctttcctttataaattacccagtctcaggtagtatctgtaaagcagtgtgaaaatggactaatataccagtcattttggcacaacacttcagaaactctaaaatacttaaatatttcagtaactatgaacaaactttttcataaaataaatatgaaaatacttttaagtgwtcaagtaaatatgatttaggacatgactccactctgattttgctatgtagcttcattatccgccatgagttaaacatgtatttattaagctctttctatctagatgcaaagaatttagtgacacaaagatgaacaagatgcatcaaagatgaacaaggtcagcatctaaaacacataggcatattgtgtcattcaaggtcaaatcggaagacacaaatcacaccattacttgaatagaaagaacttaaaataaaaactgttaactaggtgtagttattaactaggtagctaaaaggttaa

SEQ ID NO: 203885 - DNA, 601 bp, Human
ctgtatcactgcactctagctagcctgggagcaagaccctgtccccaacccactcctcccgcccccggccaaaaaaaaaaaaaaaaaaattgaagtccttataatgcctcacagggccttccttacatataattctctattaacctctgatttcagctcctattactctgtccttcgcttattctactccagtcaagaggcctattttcctgttcctcaaacataccaggcatgctgccctagggtttttgctataacatttcctcaactacaatgttcttctcccagttacggcctgaaygaattccttcaactttttacttgaatctttgctcaaatctcaccttccctcaataatgcttaccctgactactctacttattaatgcaatctgctgtacaaacataaacatgtagttgcagaattcttttttgattagctctcagaactttctaacatatagtataattaacttacttagatatggttatggtttattgcctgtcttcttgctagaatgctaatttcacaagattatggctttttgcttattgtgttcactgatatattttaaatacatggcatatgttagctactcaat

SEQ ID NO: 203886 - DNA, 601 bp, Human
tagtcccagcactttgggaggccaaggcagatggatcactcgagcccaggagttttagaccagtctgggcaacatggcgaaactctgtctctacgaaaaatacaaaaaaagtagctggatgtggtggcttgcccctgtagtccaggctactcaggaggctgaagcaggaggaacacttgagcccaggaggcagaaggtatagtgagacgagactgtatcactgcactctagctagcctgggagcaagaccctgtccccaacccactcctcccgcccccggccaaaaaaaaaaaaaaaaaaattgaagtccttataatgcctcacagggccttccttacatataattctctattaacctctgatttcagctcctattactctgtccttcgcttattctactccagtcaagaggcctattttcctgttcctcaaacataccaggcatgctgccctagggtttttgctataacatttcctcaactacaatgttcttctcccagttacggcctgaacgaattccttcaactttttacttgaatctttgctcaaatctcaccttccctcaataatgcttaccctgactactctacttattaatgca

SEQ ID NO: 203887 - DNA, 601 bp, Human
tgtagtcccagcactttgggaggccaaggcagatggatcactcgagcccaggagttttagaccagtctgggcaacatggcgaaactctgtctctacgaaaaatacaaaaaaagtagctggatgtggtggcttgcccctgtagtccaggctactcaggaggctgaagcaggaggaacacttgagcccaggaggcagaaggtatagtgagacgagactgtatcactgcactctagctagcctgggagcaagaccctgtccccaacccactcctcccgcccccggccaaaaaaaaaaaaaaaamaattgaagtccttataatgcctcacagggccttccttacatataattctctattaacctctgatttcagctcctattactctgtccttcgcttattctactccagtcaagaggcctattttcctgttcctcaaacataccaggcatgctgccctagggtttttgctataacatttcctcaactacaatgttcttctcccagttacggcctgaacgaattccttcaactttttacttgaatctttgctcaaatctcaccttccctcaataatgcttaccctgactactctacttattaatg

SEQ ID NO: 203888 - DNA, 601 bp, Human
aatcagtaaaagttgaagtccacccaaggatggtggctcacacctgtagtcccagcactttgggaggccaaggcagatggatcactcgagcccaggagttttagaccagtctgggcaacatggcgaaactctgtctctacgaaaaatacaaaaaaagtagctggatgtggtggcttgcccctgtagtccaggctactcaggaggctgaagcaggaggaacacttgagcccaggaggcagaaggtatagtgagacgagactgtatcactgcactctagctagcctgggagcaagaccctgtycccaacccactcctcccgcccccggccaaaaaaaaaaaaaaaaaaattgaagtccttataatgcctcacagggccttccttacatataattctctattaacctctgatttcagctcctattactctgtccttcgcttattctactccagtcaagaggcctattttcctgttcctcaaacataccaggcatgctgccctagggtttttgctataacatttcctcaactacaatgttcttctcccagttacggcctgaacgaattccttcaactttttacttgaatctttgctcaaatctca

SEQ ID NO: 203889 - DNA, 601 bp, Human
catataccaacatagtctttatatgaaagagatctcccaataatatgcaagctccatgagaacggtagtattatctgtttttgctcactgttagatactcatgttagctgacagcaattccactgtttcagttgttcaggacaaacgctgaagtcattattgctttctctttcccgcatgccctacgtacaatctgttaacaaatccttttgaacatccagaatctgggcacttctaatccccattatccaagccactattacctctcacctggaattctacaactgctgcttaactgttraattccttccttccatttttgccttctttcaatctattttagacacataggccagaaaaatccttttaacatataagattaagtcactcttctactcaaaactctacaatggtcctatcccaatcagtaaaagttgaagtccacccaaggatggtggctcacacctgtagtcccagcactttgggaggccaaggcagatggatcactcgagcccaggagttttagaccagtctgggcaacatggcgaaactctgtctctacgaaaaatacaaaaaaagtagctggatgtggtggcttgcc

SEQ ID NO: 203890 - DNA, 601 bp, Human
taatgatcagtctgaaaattcagccaactgaatacttatgcatacatttctatatctatgttctatgtctataaaaagtttaaaaattaatttcagatatacatgtattcgttaaaaaaaataaagaatacaggtccactcctcaaagtcaagaactttccagtttcttgaatattattccagactatctatacatataccaacatagtctttatatgaaagagatctcccaataatatgcaagctccatgagaacggtagtattatctgtttttgctcactgttagatactcatgttagytgacagcaattccactgtttcagttgttcaggacaaacgctgaagtcattattgctttctctttcccgcatgccctacgtacaatctgttaacaaatccttttgaacatccagaatctgggcacttctaatccccattatccaagccactattacctctcacctggaattctacaactgctgcttaactgttgaattccttccttccatttttgccttctttcaatctattttagacacataggccagaaaaatccttttaacatataagattaagtcactcttctactcaaaactctac

SEQ ID NO: 203891 - DNA, 601 bp, Human
cgtgatgatagaaatttcacaaacataatgtggagtataagaagacatggcatggagaattcatactgtatgatttcatttaattaccaaaacaaccaaaattaagatatacattagaagtcaagatagtggtttatcatggtgggaaaggcaggtagtggccagaagtgagtatgagggaactactggggtactgacaatgttctggtacttgatctgagtgctagttacacattaatgatcagtctgaaaattcagccaactgaatacttatgcatacatttctatatctatgttctaygtctataaaaagtttaaaaattaatttcagatatacatgtattcgttaaaaaaaataaagaatacaggtccactcctcaaagtcaagaactttccagtttcttgaatattattccagactatctatacatataccaacatagtctttatatgaaagagatctcccaataatatgcaagctccatgagaacggtagtattatctgtttttgctcactgttagatactcatgttagctgacagcaattccactgtttcagttgttcaggacaaacgctgaagtcattattgctttctctttc

SEQ ID NO: 203892 - DNA, 601 bp, Human
aggcagggttttgctcttgttacccaggctgaagtgcagtggcgtgatctcagctcactgtaacctctgcctcctggtttcaagtgattatcctgcctcagcctcccaagtagctgggattataggcatgcaccactatgccaaaaatttttgtacttttagtagagatggggtttctccatgttggtcaggctggtctcaaactcctgaactcaggtgatccacccgcctcggcctcccaaagtgctgttattacaggtgtgagccaccgcacccggccccaattatgtttttaaaaagwgtccttatcttttggagatacaccctaaaatatttcatagatgaaataagatattgggatgaaataatatgatattaggatttgcttcaaaataccctgggagattgcaggtaggaaaaggagtaggtaaaaggggagatgaaataagtttataattgctcaagtgggtgatggatacaggaagattcattatatataccatatatataccatttatattttcttatttttacttttttaaatttaaaaatatggcacacttcacaaatttgtgtgtcatccttgcacaggggccatgct

SEQ ID NO: 203893 - DNA, 601 bp, Human
ccagcccatgaaaccactttttcctcctggacctccaggcctgtgatgggaggggctgccatgaaggtctctgacatggcctagagacattttccccttggtcttaggtattaacattaggttccttgctacttatgcaaatttctgcagccagcttgaatttttccccagaagatgggtttttcttctccattgcacaatcaggatgcaaatttttcaaacttttacgctctgcttcccttataaaactgaaggcctttaacagaacccaagtcacctcttgaatgctttgctgcttagmaatttcttccaccagataccctaaatcacctctctcaagtttgaagttccacaaatgtctaggcaaatgccaccagtctctttgctaaaacagtaacaagagtcaccttcgttccagttcccaaaaagttcctcgtctccctctgagaccacctcagcctggatttcgccatccatatcattatcagtatttttgtcaaagtcattcaacgagtctctaggaagttccaaactttctcacactttcctgtcttcttcttagccctccaaactgttccaccctctacctgttacccagttc

SEQ ID NO: 203894 - DNA, 601 bp, Human
caaaacaaataaggtatcatttcaaaccaatcaggatggctactatccaaaaacagaaaataacaagtgttggtgaaaatgtggagaaactgcacccttgtgcaccactggtggaactgtaatatggtgcaaccattatggaaaacagtatggggattcctcaaaaaattaaaaacagaactactatatgatctaccaacttcacttctgggtatatatccaaaagaccatgaaagcagggtcttgaagagatatttgtacactcacgtacacagcagcactattcccagtaaaccaagargtggaagctacccaagtttccatcaacagatgaatgaacaaacaaaatgtggtatacacattgtattagtccattttcatgctgctgataaagacatacccaagactgggaagaaaaagaggtttaattagacttacagttccacatggctggggaagcctcagaatcatgacaggaggcaaaaagcacttcttacatggcagcagcaagagaaaaatgaggaagaagcaaaagcggaaacccctgataaacccatcagatctcgtgagacttaatcactatcacaagaatagcacagga

SEQ ID NO: 203895 - DNA, 601 bp, Human
agagagagcccagaaataaaccctcaggaatagggtcacatgatcttcaacaagggtgcaggaccactcaatgaaaagacagtctcttcaataaatgatgctggggaaactggatatctacatgcaaaaggatgttatgtatcttacaccacctaaaaaaattaactcaaaatggccataaacttaagaccccaaaccataaaactcctagaagaaaaaacagaggaaaagcctcatgacattgcatttgagagtgacttcagggatacacgaaaagcacagtaaaaaaaaaaaaaaaaaagcaaaaatagactacatcaaatttacaatttttgtgcataaaatgacaaaatcaacagagtgaaaaattgacctatgaaatgggagaaaatatttgaaagtcacagatctgatagggaattaatatccagaatatacaaagaactcctacaattcaacaacaaaaatagtcaacccaatcaaaaagtgagcgaaggacagaaatagacatattcaaggcaatatacagatggccaacaattatatgaaaagatggttaatggcactagtcatcagagatatggatatcaaaacaaataag

SEQ ID NO: 203896 - DNA, 601 bp, Human
gccatgaccaaatgggctttataactggaaggcaagaattattcatcatcaatcagcataatacacagaatgagagaaaaaaagcacgtaatcatctcaatagttgcagaaaaagcatttaacaaaattcaataccctttcataataaaaacattcaacaaactaggagtagcaggaaactgcctcagttaacatacaccatataagaaatgcccacagctaacatcatactcaaaaaactgaaagctttttctctaagataaagaacaagaagatgcccacagagcaattaggcaagaaraataataaaagacatccaaattgtaaaggaagatgtaaaattatatctcttcacagatgacatgatcttgtatgtagaaaaccctgaagagtccacacaaaaagacctattagaataaagtcaacaaagtttcaggatataaaatcaacatgaaaatcagttgcatttctatacattaatgataaaaatcccaaaaggaaattaaggaaacaattctacttaaaatagcatcaaaattatactttcagggatcatttttatagtttatgactaaagaagtttctctgaacatgtacagaa

SEQ ID NO: 203897 - DNA, 601 bp, Human
tttaattaccatgtatattatggctccaaatctatacttaagtccagttatacacctcagaaataaaacaatatatggaacagaactacttctgtgagaactctagagaacagttaagaaactacagcacccaggccataaaaccaagaaggcattccagtgaaaggggtaataaaatttggggcattctgtgcactcatccctgcccttccccatatccaacatagtgaggatgaggtgcaaccaggaggaaactacaaaatactagcaaactgaattcaacaacacattaggccgggcrtggtggctcatgcctgtaatcccagcacttcgggaggccgaggttgggggtggatcacctgaggttaggagttcgagaccagcctgaccaacatagagaaaccccgtctctactaaaaatacaaaattacccaggcatggtggcgcacgcctgtaatctcagctacaaggaggctgaggcagaagaatcgcttgaacccggaaggtggagactgcagtgagccgagatcgcgccattgcactccagcctgggcaacaagagcgaaactccgcctcaaaaaaaaaaaaacacatattaaag

SEQ ID NO: 203898 - DNA, 601 bp, Human
ttcattctcttcatgagctttaattaccatgtatattatggctccaaatctatacttaagtccagttatacacctcagaaataaaacaatatatggaacagaactacttctgtgagaactctagagaacagttaagaaactacagcacccaggccataaaaccaagaaggcattccagtgaaaggggtaataaaatttggggcattctgtgcactcatccctgcccttccccatatccaacatagtgaggatgaggtgcaaccaggaggaaactacaaaatactagcaaactgaattcaayaacacattaggccgggcgtggtggctcatgcctgtaatcccagcacttcgggaggccgaggttgggggtggatcacctgaggttaggagttcgagaccagcctgaccaacatagagaaaccccgtctctactaaaaatacaaaattacccaggcatggtggcgcacgcctgtaatctcagctacaaggaggctgaggcagaagaatcgcttgaacccggaaggtggagactgcagtgagccgagatcgcgccattgcactccagcctgggcaacaagagcgaaactccgcctcaaaaaaa

SEQ ID NO: 203899 - DNA, 601 bp, Human
ttatgatacaaacttttcctggtttggttttatcccatttttggatgttccttctaatttttctttaatccagctcttaaatgttggtattcttgagggtctatatgaggcctccttctcattctacatattttcattctcttcatgagctttaattaccatgtatattatggctccaaatctatacttaagtccagttatacacctcagaaataaaacaatatatggaacagaactacttctgtgagaactctagagaacagttaagaaactacagcacccaggccataaaaccaagaargcattccagtgaaaggggtaataaaatttggggcattctgtgcactcatccctgcccttccccatatccaacatagtgaggatgaggtgcaaccaggaggaaactacaaaatactagcaaactgaattcaacaacacattaggccgggcgtggtggctcatgcctgtaatcccagcacttcgggaggccgaggttgggggtggatcacctgaggttaggagttcgagaccagcctgaccaacatagagaaaccccgtctctactaaaaatacaaaattacccaggcatggtggcgcacgc

SEQ ID NO: 203900 - DNA, 601 bp, Human
aattcatcctgttttaacttaaacaagatagtagtttttccagcaccatccaatcctaacgtaacgacccgaatttccatttttggtccaatgtgaactcgattatcctacaatttaaatatttttaaatatgtttgacatgcagttagaaagtaatagcatttagcacctttattatttctacatctcctattcattcctcaaccattgcaatctgaattgtattcctcaaaatactgagtctgatctcaagaagatgaaatccttccccatggctaaatcttgccttagtaaaactgactttgtctttgtataacagaatatacatacccacttaattttctcagattttctaactcaaatgaatcctctaaatcttaaacatgtttttatgctatactaaaaaaatcacaataagggtaaatcaattaaaatgaaaaagtgctgctcaattcccagaaatttctactatgaatctgatgtatatccctccagacactttccatgcacatactggccaacatacacaaacaaaacaaatttttttttaaaaaagtattacccacacattgaaactaatgtgtttcactcaacagtatat

SEQ ID NO: 203901 - DNA, 601 bp, Human
aggatcaccaatcctctattccttccaactgtcccaccaatactctgtttcttctttttatccccatccacatttcaatcccatagtcatacaatcttgcattttttctctgagatgctgatatcttagagccagaaaagagcccaccaccatgacagatcagtatcaaataagaccccaagaacttggctgtaagctagggtttgtctattaaggtaaaaaccaatattcatacttaccaattgttggaatgggctgcatgaattcatcctgttttaacttaaacaagatagtagttttkccagcaccatccaatcctaacgtaacgacccgaatttccatttttggtccaatgtgaactcgattatcctacaatttaaatatttttaaatatgtttgacatgcagttagaaagtaatagcatttagcacctttattatttctacatctcctattcattcctcaaccattgcaatctgaattgtattcctcaaaatactgagtctgatctcaagaagatgaaatccttccccatggctaaatcttgccttagtaaaactgactttgtctttgtataacagaatatacatacccacttaat

SEQ ID NO: 203902 - DNA, 601 bp, Human
tgtgaaaaattaaatgtcatttttaactctcaccttgagtattgaggtaataatgtttccacaatggtcttaatttgtgttttccacctacatcccaaatagtgaattttagatttttatattctacagtttccacgttaaaacctgttttaaaaaaaaagttacttttatactatatttgtatttacaatgaatgacatatcaaacacagacaacccccagtttataactgtgacttatcaaattatctacatgcagcaatatctactgaagcctaatcaaccccattcctactcctacrtggtgaatgtatacctgtaacagctcctagccctctaaacctccaccaaggtccttaggaccttgggatccatgtaccttccagctctgttccacaactaccccccaccccacaccctcagccaggatcaccaatcctctattccttccaactgtcccaccaatactctgtttcttctttttatccccatccacatttcaatcccatagtcatacaatcttgcattttttctctgagatgctgatatcttagagccagaaaagagcccaccaccatgacagatcagtatcaaataagacc

SEQ ID NO: 203903 - DNA, 601 bp, Human
ccaaatgtgactaaaacctatgtagagtatagatatgatataatacggtttggtcaaaagcaagctactgtaagttcttctgcaggtaataactatttgtgaaagaaatgtgggagtggggctatagtgagattataatgggataaatgttgagtttaactgaattcagcagaatcatacaacataaattcaactctataccactacgctaccagcagtcacacccatataatactggtaatatacattctctgttaagagaagcaagagtactcttaactgactacatatctaagctacrtatggtttttattctgtaataatggtatatcaggaataaactaaaagtatatatcctaatctttctactttcattttttacaagttaagaaactggccacaggtacttaagtatacagtcaacgacttaatcataagtatcagctttgctagttaaatcagtacactgaaaactgtcatcctaaaaatgtgaaaaattaaatgtcatttttaactctcaccttgagtattgaggtaataatgtttccacaatggtcttaatttgtgttttccacctacatcccaaatagtgaattttaga

SEQ ID NO: 203904 - DNA, 601 bp, Human
catgagcgtaagcattatgttggggtctatgaggcagaagtgtagagtaagacccaaatgtgactaaaacctatgtagagtatagatatgatataatacggtttggtcaaaagcaagctactgtaagttcttctgcaggtaataactatttgtgaaagaaatgtgggagtggggctatagtgagattataatgggataaatgttgagtttaactgaattcagcagaatcatacaacataaattcaactctataccactacgctaccagcagtcacacccatataatactggtaatatacaytctctgttaagagaagcaagagtactcttaactgactacatatctaagctacgtatggtttttattctgtaataatggtatatcaggaataaactaaaagtatatatcctaatctttctactttcattttttacaagttaagaaactggccacaggtacttaagtatacagtcaacgacttaatcataagtatcagctttgctagttaaatcagtacactgaaaactgtcatcctaaaaatgtgaaaaattaaatgtcatttttaactctcaccttgagtattgaggtaataatgtttcc

SEQ ID NO: 203905 - DNA, 601 bp, Human
ttgtatactcccaggtacccagcacagcattttcacatagattgtactcaaaatacacagaagaaactataaatatctattgaactgattgtcttctgaaatatttccagttgccttttgacatgcacaaaactactaaaataaatattccaatataaaaatgcattacctgtttgttagcaaaaatcaggagcagagcatctcggagttctttttccgttaacaactttgcaagttcgctgtgtgcttcactaattctgtctctatgactgctatctacaacaaacacaacagctacccmaaaaaaaataaaaaaaacaaaaatagtcacttgctaaagttcagtaaatgaaccaaatatttaatgatatcattattatgttatggttagagtttgtctaccatcattattttcacacagagggtgcctagtatggcaggggcacctacaaataattaacagtatgatttcaagtagtttacataacttctcaggtttagtttccccatctaggaaaggatttacaacacttgctctatcaaatgcaaattggtctgtatatcaaataactttttacataacgaatttcaaaatatgcct

SEQ ID NO: 203906 - DNA, 601 bp, Human
ccctagaattatagtattgaaacactgatatgatcttattacccactaatccaacattttgatgactcctccttgctcatagaataaaacctaaatttctcagtctagcactgtcagacctttacagcatggccttgtctgttattctaaattctcttcatcctctactgagacctgacatatagatctgcttgatgttccctaaactaaaaacattcatgctattatcttctttgtctataatgttcttcctttcacatactgactcagcctcatgcataatttcaactcaaattctacmttttacaatcttacaacatgccacatttagaactactttcctaattcccgtaacactgtgttacttaagttacttatcagtcttcttcgtattcagatctcttatgtgttcatatgcatacacaggagtttctggtgagcattaactaccttatttctattttgtatactcccaggtacccagcacagcattttcacatagattgtactcaaaatacacagaagaaactataaatatctattgaactgattgtcttctgaaatatttccagttgccttttgacatgcacaaaactactaa

SEQ ID NO: 203907 - DNA, 601 bp, Human
cacttgaattatttaagcaatttactgcatctccctgtctccagtcctttgccctgattcattctacccctagaattatagtattgaaacactgatatgatcttattacccactaatccaacattttgatgactcctccttgctcatagaataaaacctaaatttctcagtctagcactgtcagacctttacagcatggccttgtctgttattctaaattctcttcatcctctactgagacctgacatatagatctgcttgatgttccctaaactaaaaacattcatgctattatcttctytgtctataatgttcttcctttcacatactgactcagcctcatgcataatttcaactcaaattctacattttacaatcttacaacatgccacatttagaactactttcctaattcccgtaacactgtgttacttaagttacttatcagtcttcttcgtattcagatctcttatgtgttcatatgcatacacaggagtttctggtgagcattaactaccttatttctattttgtatactcccaggtacccagcacagcattttcacatagattgtactcaaaatacacagaagaaactataa

SEQ ID NO: 203908 - DNA, 601 bp, Human
atatacacatacatacataaacatacatacacaaaagttgacatacatttatgtatatttgcaaaattatctgtaggataacctttggatatctgtctaccagatatataaaggtagaattgcagggtaagggactttgatgagtattgccaaattgtcctccaagaaaatgtctcagtttaataacccacgaacagtgttgaccaggcgcagtgactcacacctgtaatcccagcactttgggaggatgaggcgggcagatcacttgaggtcaggagtttgagaccagcctgaccaacaygatgaaaccctgaatctactaaaaatacaaaagttagccgggtgtggtagcaagcacctgtaatcccagctacttgggaggctgaggcagaagaatcgcttgaacctaggagggggaggttgcagtgagcagaggttgtgccactgcactccagcctggtgacagagcaagactcagtctcaaaataataatagtaacagttgtatataagtctgaggattataaaacactttcatctttaactatctgatgagcagaaaatggtatttcactgacttatttgcatgtcttaaatatacc

SEQ ID NO: 203909 - DNA, 601 bp, Human
ttgaagttttatgcttatgtgctattataaatccatatatatacacatacatacataaacatacatacacaaaagttgacatacatttatgtatatttgcaaaattatctgtaggataacctttggatatctgtctaccagatatataaaggtagaattgcagggtaagggactttgatgagtattgccaaattgtcctccaagaaaatgtctcagtttaataacccacgaacagtgttgaccaggcgcagtgactcacacctgtaatcccagcactttgggaggatgaggcgggcagatsacttgaggtcaggagtttgagaccagcctgaccaacatgatgaaaccctgaatctactaaaaatacaaaagttagccgggtgtggtagcaagcacctgtaatcccagctacttgggaggctgaggcagaagaatcgcttgaacctaggagggggaggttgcagtgagcagaggttgtgccactgcactccagcctggtgacagagcaagactcagtctcaaaataataatagtaacagttgtatataagtctgaggattataaaacactttcatctttaactatctgatgagcagaaaat

SEQ ID NO: 203910 - DNA, 601 bp, Human
ccagcagctacaagttgccgtgagagccagtccaacccttcatacagtcccataccacttcgagcatcacagccctgaatataccagctacggccacagcataatttatggagactgagtagttcagtgatttcttctactgacagtgctccagcaacatcctgaaagatatatacacatattttttatcagtccatccaaattataatttttctaattatcaccatttatagagaaatttgttgacagtgttctaacagaagcctaaacaaaaaacctagattcatctttcagtaattaktctgagattaataagaatagaaaaaattagtttggtttaactaatttatatgtgtgtgtatgtatatactttgtaaggctagcttaacaatgaaatcaataaagtccttgcaacctaaaaggaaacatactgcctaagtaatttttttatcttttaagacagagtctcactctgtcacccagactggagtgcagtgacatgatcttggctcactgcaacttctgcctcctggttcaagcgattctcctgctttggcctcccaagtagctgggattacaggcatgtgctaccatgcccggc

SEQ ID NO: 203911 - DNA, 601 bp, Human
aacttgtattgtttttaaacaaaaatagatttgaaaagaatgaaccacaacagtgctaccaaaaagtcacatcttgttaccagacatcactgtccttacaacaattcaactaataagatttaagatttaacttcatcctaatgtatcagaacattaaaaaaaaaaaagtctcaatgtacctatttaaataaatcgtgcttccataataatattctttaaaaatgaaaaacagtaaagagcacacatttttatttactcacaacactgaataattaatgtaaactttttgaattttttttttctttagacatttttcctctagagtaacttttcaaggccttctcatgaacagccttaagttttattgtcaaaataaatgcacttattttgggaaacagtttgaagtaagtaataagcatttgccactgtacttacaacttctcttgaagttcgctttctatttaggtcactagcttttaaataaagccaaccctggttctgcgttacttactacattttacctatagtcattcccacaaaggatgcaatattatattagaaagaaatattactttaaatttgttgaaaaatagaaggacca

SEQ ID NO: 203912 - DNA, 601 bp, Human
tatttatgcacacaaactacacctgtaacagcatgaccttttacctgaaaaataaaggatgaaatattacatttatttatttacatattgcccataatactgataggctttttttttaatgctttgttttctaaaacttgtattgtttttaaacaaaaatagatttgaaaagaatgaaccacaacagtgctaccaaaaagtcacatcttgttaccagacatcactgtccttacaacaattcaactaataagatttaagatttaacttcatcctaatgtatcagaacattaaaaaaaaaaaagtctcaatgtacctatttaaataaatcgtgcttccataataatattctttaaaaatgaaaaacagtaaagagcacacatttttatttactcacaacactgaataattaatgtaaactttttgaattttttttttctttagacatttttcctctagagtaacttttcaaggccttctcatgaacagccttaagttttattgtcaaaataaatgcacttattttgggaaacagtttgaagtaagtaataagcatttgccactgtacttacaacttctcttgaagttcgctttctatttaggt

SEQ ID NO: 203913 - DNA, 601 bp, Human
gaagaaaagaagggacattataaagtatggtacctaaaataaaatgacccgccttccgccccaccccaacccctcctccagtatttacagtaagtattgcaaaccgagcaggtgcccaacagtttatagtccaaataacacttgccccagatcccacctgccccttgtcacacaaaccaacacacacttgagtcaagcaaactttttttctgttatgttaatcatcaagccaaagcaaacagctttccactttctgggtccagggtggcaattgactatgaagacatcgcaaatcctctagacaaacaaggttggtgggggaggatttctctgcattgtgggccaggaggtggaccgtgacataccagggagttgcatcagctgtcacacactagtgatgctggcacccttactttaaactttctcagtttcacacactagtgccacgactcggtaagcaggaaattgacttaagtccttagtttagggcttaaatcaatcaccatattacaaggtctcagctgaaacagtctatttcaatagctacgggctcatttattcatttactcagcatgcatgtcatggagcaactaagctcaag

SEQ ID NO: 203914 - DNA, 601 bp, Human
ccatacagcagccctgtaaagtaagcaggtccagcagatttccttattcccatctcgcggatgaagacactgagactcagggaggttatgttaattctgtggcggaatctatgcctagaatgcaggcattgaaacttttccagggtttcactttacagggtgttccacttgtagaggtagtaactctccaccagggggcgcatgtcatgcggtggggtgcatacaggcggtggttggagtactaaactaatctccatttactcccccaataaacaaacaaaaaggaatctaggtttttttwaaaaaaagggtgcacttgctatataaatgtacctttaaaacatctccctttgccctgccatacaaccagattacattttcaaagcctctcctatgtagaaactctggaatccacactgcatttcagaatacgaagaagtaggtatgtcttcttaaaaagcccttgaggtgatcctaataagccccctcaaatgggaatccctgtattagactaagctacaaaagagaggattgtgatatttgacttgatggtatttgatgactaccattgcattgagaatgaacactttggctcagaata

SEQ ID NO: 203915 - DNA, 601 bp, Human
tccatacagcagccctgtaaagtaagcaggtccagcagatttccttattcccatctcgcggatgaagacactgagactcagggaggttatgttaattctgtggcggaatctatgcctagaatgcaggcattgaaacttttccagggtttcactttacagggtgttccacttgtagaggtagtaactctccaccagggggcgcatgtcatgcggtggggtgcatacaggcggtggttggagtactaaactaatctccatttactcccccaataaacaaacaaaaaggaatctaggttttttwaaaaaaaagggtgcacttgctatataaatgtacctttaaaacatctccctttgccctgccatacaaccagattacattttcaaagcctctcctatgtagaaactctggaatccacactgcatttcagaatacgaagaagtaggtatgtcttcttaaaaagcccttgaggtgatcctaataagccccctcaaatgggaatccctgtattagactaagctacaaaagagaggattgtgatatttgacttgatggtatttgatgactaccattgcattgagaatgaacactttggctcagaat

SEQ ID NO: 203916 - DNA, 601 bp, Human
agtgctcaataaatgttagctattgttatgattctctttctccaggttctgtttaactcctctggtctcacaggaatggtctcccagcattacaccatagtacaaaaaaagtgttataaaaatgagaaatataaactccagtaaaggaaaaagatagaactgtccttgagaagggatagtttcatgttcatttcatttgaattgtaaaactaactacttccagcggatatttgatatacgcctttcattctcattgtgttcttccatacagcagccctgtaaagtaagcaggtccagcagttttccttattcccatctcgcggatgaagacactgagactcagggaggttatgttaattctgtggcggaatctatgcctagaatgcaggcattgaaacttttccagggtttcactttacagggtgttccacttgtagaggtagtaactctccaccagggggcgcatgtcatgcggtggggtgcatacaggcggtggttggagtactaaactaatctccatttactcccccaataaacaaacaaaaaggaatctaggtttttttaaaaaaaagggtgcacttgctatataaatgtaccttta

SEQ ID NO: 203917 - DNA, 601 bp, Human
tcaggaaaatgaataataacaacagtactggcctcagttactgttaagtgtaacaggtaaagcctggcacatattaagtgctcaataaatgttagctattgttatgattctctttctccaggttctgtttaactcctctggtctcacaggaatggtctcccagcattacaccatagtacaaaaaaagtgttataaaaatgagaaatataaactccagtaaaggaaaaagatagaactgtccttgagaagggatagtttcatgttcatttcatttgaattgtaaaactaactacttccagcrgatatttgatatacgcctttcattctcattgtgttcttccatacagcagccctgtaaagtaagcaggtccagcagatttccttattcccatctcgcggatgaagacactgagactcagggaggttatgttaattctgtggcggaatctatgcctagaatgcaggcattgaaacttttccagggtttcactttacagggtgttccacttgtagaggtagtaactctccaccagggggcgcatgtcatgcggtggggtgcatacaggcggtggttggagtactaaactaatctccatttact

SEQ ID NO: 203918 - DNA, 601 bp, Human
ctggagctgccaaggacgtttgtgcaggtgcactgtgcccagctccagagggtgcgattgacactatggtctatgtgaatgctgttgctggaattacaggtccaatacctgcatggctggatgcgcagtccctgcccctactccttaaaatgagaaatgagcttgtgatgtgaagattcctgatcttaactttaatgaaaattgtctaaacaccggcttaactggcagagtttattcacgatataagtttggattacatttagtctccttgctggccatgtgtttaaccatggtagggctsggccatgttacagcagcttcgttttgacagcagacatttagtgcattaggtttttaagactcactcctccttcccgtccctcccttttgagtggcccacacaattgctgtttcctgctgatttgtccccagcacttcaggagtggggcagaagaatgctttgaacccaataactccaaccagttcaagtacacagttccaagtggaaactcagagcatcagtattgcctagaggttaaaagtataagctttcatatcagatagatttggaatgctcctggctatgttacattatttatat

SEQ ID NO: 203919 - DNA, 601 bp, Human
aatgctgacaaatcattccaacctttggagcttcactttcctaatcaacaaattggggataagcatcccttatctacttatctcctagggccatttatgagcattaaaagctataaggcctgtgcttgaatctaagactcagcacttattcacggtgtgtttttggcaagtgacttaaactctgtgcctcagttttcttgtctgtaaaatagggatacgaatagcattgggatccagggagttaatccgtgtaaagtgcttaaaacagcatgtggcacaatgttttgcatgtgttagctaytattacattcgaaaaagagtttgcaaaaggttaggcactacaaagtgacgaggcagaattagcattcttacaggacaccagttctcaagaaggtgggggggtccacacctccctccagaatggcagttcagaaatttatgaaggctttttagcaacgaagtgcagaaggggtgtcacactgctggcatttagtgaaggaagccagggaacctggagatcctggaacacctggggtagtccttcacagtgaaaggcttgtctagctcctaaatgtaaatgatgccacacagccctactcat

SEQ ID NO: 203920 - DNA, 601 bp, Human
acccgtgtggaatcataactctcacctcacaaagcaaacaacctcgccttggtcattcgttacactgttccattccctatatggcaaatcacaaattgttccttgtacccctaaacaactttatataacatatgattaaagcctgtaactgatacaattgaatgctattgtattattgaactctaagtattattgggaagtaattattgggaaataatacttagctaagcatgaaatgtgacatattatataatttaggacttaccaaattccgggcaatgagttaactgttttacatacwtagtccctttactcctcagaacaaacctacaaagaggaaagttaatttactgattaagaaattgagagttgtagttaagtaatttgcacacagttagaaataaatggaataggaattgaagcccagacggagtaaatctaacacccatcctctaaaccactgcactaacctgctttgagaagagaaaaaaacaaaaaacaacaaaaaaaaaactgtgacaggaagaaacaatggcagtttgaacagcaatgcaaataaataggatatgtcaaatgcagtgatactcaccaaccagtcagt

SEQ ID NO: 203921 - DNA, 601 bp, Human
tctggttgatggaaaacatctgatgctgcttaaaaatcatcaaggaaatacacccgtgtggaatcataactctcacctcacaaagcaaacaacctcgccttggtcattcgttacactgttccattccctatatggcaaatcacaaattgttccttgtacccctaaacaactttatataacatatgattaaagcctgtaactgatacaattgaatgctattgtattattgaactctaagtattattgggaagtaattattgggaaataatacttagctaagcatgaaatgtgacatattatrtaatttaggacttaccaaattccgggcaatgagttaactgttttacatacttagtccctttactcctcagaacaaacctacaaagaggaaagttaatttactgattaagaaattgagagttgtagttaagtaatttgcacacagttagaaataaatggaataggaattgaagcccagacggagtaaatctaacacccatcctctaaaccactgcactaacctgctttgagaagagaaaaaaacaaaaaacaacaaaaaaaaaactgtgacaggaagaaacaatggcagtttgaacagcaa

SEQ ID NO: 203922 - DNA, 601 bp, Human
aaagatgaataaaccatgatatatcttccacgggatggcctctgggatttcacgaagcacaggactaaatagagaataaaaaactaaagtatagtgttggcttaataacaattatgttattacatttatgtaaacttatagaaagaagttttataaattaacagtcaataaaagaaacattttgacttttttcggttaataatatttccacatttccataattactggaagattgaagtaattgaaaattcaaactttcaaagaagtttgaagtttgctgtgtaggttaaatctttatgtrttggctttccctttacaaaacagtttcctgcatgtttctgcacaaccagcattttaatacagatttcatatttgcccaccaaaacccacagcagcctacactgtggtctggttgatggaaaacatctgatgctgcttaaaaatcatcaaggaaatacacccgtgtggaatcataactctcacctcacaaagcaaacaacctcgccttggtcattcgttacactgttccattccctatatggcaaatcacaaattgttccttgtacccctaaacaactttatataacatatgattaaagcc

SEQ ID NO: 203923 - DNA, 601 bp, Human
gacttggatggacatagagttcttccaaagagtattcacagctgctcctatcgtttgtccgggggcctccccacctgagaccactttaaattaaattatctatctaaacttttttaaaaaaattcacaatgacattgtaaaatcaaaatctcagggaagacatttgtccttccttctactaggaccaaattcgagacctgcaagttcctttgttgcaagttccctttctgagtgatgggtctatttctcatttttccctgcattgaagagataaccctttggtgtcccaactttaagcaaytatcttattagactccccattgaagacagttttttctttcttaaagatgaataaaccatgatatatcttccacgggatggcctctgggatttcacgaagcacaggactaaatagagaataaaaaactaaagtatagtgttggcttaataacaattatgttattacatttatgtaaacttatagaaagaagttttataaattaacagtcaataaaagaaacattttgacttttttcggttaataatatttccacatttccataattactggaagattgaagtaattgaaaattcaaacttt

SEQ ID NO: 203924 - DNA, 601 bp, Human
ctcctccagactgttctattttagaaggaaaggagtttaatttcattcctgtaatggaatgaaaattttgcttcaatctatcaataagatctcacctaacaaatattgtcaaaattcatgattttaacaatattgtatgactattatgcactgtatttaatcaattcaaactgtccgattttttcatattttatcatctctgattttgagaatgtccttgaaaattgctgccatcttaaaatccctggagacttggatggacatagagttcttccaaagagtattcacagctgctcctatygtttgtccgggggcctccccacctgagaccactttaaattaaattatctatctaaacttttttaaaaaaattcacaatgacattgtaaaatcaaaatctcagggaagacatttgtccttccttctactaggaccaaattcgagacctgcaagttcctttgttgcaagttccctttctgagtgatgggtctatttctcatttttccctgcattgaagagataaccctttggtgtcccaactttaagcaactatcttattagactccccattgaagacagttttttctttcttaaagatgaa

SEQ ID NO: 203925 - DNA, 601 bp, Human
aagtttcactttgctaatgtaactctactacataagtcacctcttctgtgaaacattccattcaatttcagatatccgtaatggcttctctggtcattctgtaagttctgtggcaacattcactcctttataatttattattgttttataaaatctatttgtaacttatatatatgtaatttattactctacacctgtctctcctccagactgttctattttagaaggaaaggagtttaatttcattcctgtaatggaatgaaaattttgcttcaatctatcaataagatctcacctaacmaatattgtcaaaattcatgattttaacaatattgtatgactattatgcactgtatttaatcaattcaaactgtccgattttttcatattttatcatctctgattttgagaatgtccttgaaaattgctgccatcttaaaatccctggagacttggatggacatagagttcttccaaagagtattcacagctgctcctatcgtttgtccgggggcctccccacctgagaccactttaaattaaattatctatctaaacttttttaaaaaaattcacaatgacattgtaaaatcaaaatctc

SEQ ID NO: 203926 - DNA, 601 bp, Human
atcagcattgaaaaagtaaaattactgctggaaatttaataaatctattgttgtattcgaaagaaaaaaattgggataagtacaaaaaaactaagcaaacaggaaaaacagaagtggttaataactctaagaaatctaatcatagatattacttggctaaaaaatggaatgatactgtcatggtcataattttgtaaacatagcctgatttagctaataatgcctagaattgatatatcaagaaaaagcagtataagcatattacttagaatattaaaatatattctagtatgaatagagkttaaaatattagaatatatgttttaatatttgaatatacattttaatactctaagttttgtattctgggaaatatatagtctaatatccttggcagaagagggtgtggagaaaggtatgcaaagaaatgctgtaatcatatgttattttgatttagaaaaattctaaaaatgaagcagagaacagaggaaaatataggaatattacaagcaagcaagaaaatatcattaaccttgattttcattgcagatgaaagaatgtttcagatgaaagtatttgaaatgcaaggcctcaaagaacc

SEQ ID NO: 203927 - DNA, 601 bp, Human
tatcatattcaaattatccatccagtgagagattaaagacattttcagatatttacctaccaagcgtctttctcaggaagctactgaaaaatgtgctccagtgaaactagggagtaaattcagagaaaaagtaacaatggatccaggaaaacagacccaggagaaagtcaaggacagcccaaggaggatggtcatgcatcagacctagatgggaccagtccagagtagcagcgctccaggaaaaaaattatacagaatgggtggattgtttgatatgcatcagcattgaaaaagtaaaatyactgctggaaatttaataaatctattgttgtattcgaaagaaaaaaattgggataagtacaaaaaaactaagcaaacaggaaaaacagaagtggttaataactctaagaaatctaatcatagatattacttggctaaaaaatggaatgatactgtcatggtcataattttgtaaacatagcctgatttagctaataatgcctagaattgatatatcaagaaaaagcagtataagcatattacttagaatattaaaatatattctagtatgaatagagtttaaaatattagaatatatgtt

SEQ ID NO: 203928 - DNA, 601 bp, Human
tgttactacatcttccttgaaattgtaaaacattccctggcatcctggcaagttccttggggcaccctatgtacccaggggaacctccaaacataggttaagagtcatggctttagcttattagtacctatcacatgcttagcaaattgattaacaaaagccccacgccaactttatataacctagacaattagtgatttaataaaaggttattaaaagagaatgaaaatgccatacaatttctcaccagtaactctggaaagtgctgaaggaaagcaacagctaatttaggatatcataytcaaattatccatccagtgagagattaaagacattttcagatatttacctaccaagcgtctttctcaggaagctactgaaaaatgtgctccagtgaaactagggagtaaattcagagaaaaagtaacaatggatccaggaaaacagacccaggagaaagtcaaggacagcccaaggaggatggtcatgcatcagacctagatgggaccagtccagagtagcagcgctccaggaaaaaaattatacagaatgggtggattgtttgatatgcatcagcattgaaaaagtaaaattactgctg

SEQ ID NO: 203929 - DNA, 601 bp, Human
tcatgactttttgaaaaatcacagctactgcagaaaactcacttaaaagatatcacattattgaaggaatgtagcaatcttatgttgaaactcaagttatgatttatctggtgtccaaaagatgttactacatcttccttgaaattgtaaaacattccctggcatcctggcaagttccttggggcaccctatgtacccaggggaacctccaaacataggttaagagtcatggctttagcttattagtacctatcacatgcttagcaaattgattaacaaaagccccacgccaactttatayaacctagacaattagtgatttaataaaaggttattaaaagagaatgaaaatgccatacaatttctcaccagtaactctggaaagtgctgaaggaaagcaacagctaatttaggatatcatattcaaattatccatccagtgagagattaaagacattttcagatatttacctaccaagcgtctttctcaggaagctactgaaaaatgtgctccagtgaaactagggagtaaattcagagaaaaagtaacaatggatccaggaaaacagacccaggagaaagtcaaggacagcccaaggag

SEQ ID NO: 203930 - DNA, 601 bp, Human
cactcaaaaacaaagtagagaaaaaggaacttggagacatctgagtcaatactggtgcaaaatagtcttcaaaaaactattataatatgctcagacagacaagcaaagataatgtgtctacaaaacaacaagaggatgctatataaaaaaggaacaatcaaagaacaagaaaatggtttgggaacttagagatatgatagatggaatgaaaaatcaatacaagagttgtacataaaaatctagttctccagaatgaaaaaaaaatgaataaaaatgaaggaaaagtggagaaatagcaacraaaatcagtttattagtgggtcaatatggggagagtccaatgttcagttaataggatttccgcatgcagatagtgtaagagtcttcagttcagaggtcccaattttctgggtaaacggtgtccttagtgacttagtgattttttcatgacacacttggggaccaaagaaatacctaacaaatctatttattaagtaatgaggcccaaacaacagtaagtatttatgtcctaaaaacttgacacctactgggcattatgcaacttttcaaaacttgaaattatactataatagatattacc

SEQ ID NO: 203931 - DNA, 601 bp, Human
ttataaaagatttgagatgaaaatgtgtctagggctgcgtgcaatacaccttccaccatgatttcttctgaactcttttagaataaggaatgtgattatgatgaagcctaatgttagtatattatgtctcctctgcattcaactccacaggctgcaggttgcttacagaaaataccttcagttctctccctgaaggcatctttttgttgggagtacacacagccctcatagagatgctgaccagggagttaatgtcccagaagcaacccttaacgcaaagatggctggagagttggtaaayccattttaccggctttctcactcactttcaattgggacatgctgagctctagagggactgagcaactaacagtacggcctttattggttcattcccttcactgtctcatgtctgcactttactgccagtgttttctagaattacatcccaaataaacttcttgcacttagatcctcatttcagattctgtctcttggggtacacaaagatggaacaaatctcaaaatagatgaaattatcagatatgcatagcacactcaaaaacaaagtagagaaaaaggaacttggagacatctgagt

SEQ ID NO: 203932 - DNA, 601 bp, Human
aaaatgtcttatgtttgctacaaagcacgaaaaaagagaaataaatccgtaagaagagaagatctcttctatatggcaacaagatgcccagtttaacacaggcctcaccatatctgattgtcttacactcagcaatttgctgccctacagttaatgaccagccttgattgtagattagaaccacctggggaacttttaaaccttctaaggccccagactaataaaatcaggacctcttggggaaggatccaatcatgagggctttaaaagcttcccaagtgaccataatatgtggtcaagyatgagaaccagagctgtaggctgtacaccagtgcctctcaactggggactttttgccctccagaaaacacttgtcaatgtctgaagacactttggtttaatacaactagaagaagataatgctacttgcaccaagtgagtagaggctagagatgctgctaaacatcctataatacaaaggacagcctccacaatgaagaactatctgaaccaaaatgtcactatctctgaagttgagaaaccttgatgtacacaatatccctttttagttcaatgaatctaacttgtacataatctactc

SEQ ID NO: 203933 - DNA, 601 bp, Human
caaactaatgcacattattttacagccagtaaatatcattaaccaaagcaacttgtttctcctttttttttttttttattttttttgttgtccaaatccttctatgtgaaggccatggctaatgacaaacagagaatgggttaattttgctcagttcactgaagttttaagatggataagacctgatctcttaggagcatacactcaagtggaggaagacaaacagttcgtaataagagtcaacacatgctgacctctatgcgccagatactgtactaagttctgtattaactcttaatcrtcacctcagccctataaagaaagcatcattgctattcttatgttatcaatgagaaagttgaggccaggcaggtgcagtgattgcacaaggtcacaaagctggtttgtacacctttattccacgcctagcttttgatcgtcactctgtggctcagtagttctcttgtcacacaagaatagtacttgccacacaagaatagtactattaaaagagaggtgtgctaaaaatgtcttatgtttgctacaaagcacgaaaaaagagaaataaatccgtaagaagagaagatctcttctatatggc

SEQ ID NO: 203934 - DNA, 601 bp, Human
tcgcagttctgaaggctaaaagttcaagatccaggtgtcagcaggtttggttccttctgaagactgtgagggagactcttctgtgccttgctcctagtttctggtgtttgttggcaatccttggtgttccttggcttgtagatgcatcatccccatccctgccttcatgttcatatggcccctccctatgtgcatgaatgtttccaaatttcccccttttttataaagccaccagtcttactggattagggcccaccctaatgacctcactttaacttgatgacatagtttgaatctgtgycgccgcctaaatctcatgtcaatttgtaatcccccaggttggactagggtcctggtgggaagtgactggataatgggggtagatttccccttgctgttctcatgatagtgagtgagttttcaagaggtcatttcaaagtgtgtagcacctcccccttagctctctctcctgccaccgtggtaagacatgcctgtttccccttctccttctgccataattgtgagtttcccaaggcatctccagccaggattcctgtacagcctgcagaatcatgagccaattaaacctcttttctttata

SEQ ID NO: 203935 - DNA, 601 bp, Human
cttttagcaagtggagaagttaaaaaaaaaaacaaaaaacaaaacaaaaagaaaatggagaagttgctctctggtaactgtacacatagcaaggctggcatgcatgagagcaaaatttagtggtgctgtatgtaccaggggacctggtcccacctatttaataaacacaaattaatctgaacaaccttcgccattgcccagctctctctgtcctgaccacacacctagaggtgatcaagaattcatctgaacacttagtaaagacaggtggtgtcattagatatttgacaaagagaaaaaatatctagaatgctagaatttagttactatttactcatttcatacactccctattaacttctaatgaaatttattctaaatcctcctacagtgggtgttggtttcctaggcctgctataacaaagtaccaccaactggatggcttagacaacaggagttcattgtctcgcagttctgaaggctaaaagttcaagatccaggtgtcagcaggtttggttccttctgaagactgtgagggagactcttctgtgccttgctcctagtttctggtgtttgttggcaatccttggtgttccttggc

SEQ ID NO: 203936 - DNA, 601 bp, Human
atacatttaaaatttatttgtatcaaataactattttattcagcaatgatacgtgtaaagattttagcaaatctattaattagttcagttgcataggtatcagattttgactcttttagcaagtggagaagttaaaaaaaaaaacaaaaaacaaaacaaaaagaaaatggagaagttgctctctggtaactgtacacatagcaaggctggcatgcatgagagcaaaatttagtggtgctgtatgtaccaggggacctggtcccacctatttaataaacacaaattaatctgaacaaccttygccattgcccagctctctctgtcctgaccacacacctagaggtgatcaagaattcatctgaacacttagtaaagacaggtggtgtcattagatatttgacaaagagaaaaaatatctagaatgctagaatttagttactatttactcatttcatacactccctattaacttctaatgaaatttattctaaatcctcctacagtgggtgttggtttcctaggcctgctataacaaagtaccaccaactggatggcttagacaacaggagttcattgtctcgcagttctgaaggctaaaagt

SEQ ID NO: 203937 - DNA, 601 bp, Human
ccagagtctcagactggctgaaaggctataattttgaaagtcacataaataaaattgccagattcagcaaagaaaaacgcagttgaatttaactttcagatgaatgacaaatatttttcatcataagtatgtcccatgcaatatttgggaaatacttatacatttaaaatttatttgtatcaaataactattttattcagcaatgatacgtgtaaagattttagcaaatctattaattagttcagttgcataggtatcagattttgactcttttagcaagtggagaagttaaaaaaaaaaacaaaaaacaaaacaaaaagaaaatggagaagttgctctctggtaactgtacacatagcaaggctggcatgcatgagagcaaaatttagtggtgctgtatgtaccaggggacctggtcccacctatttaataaacacaaattaatctgaacaaccttcgccattgcccagctctctctgtcctgaccacacacctagaggtgatcaagaattcatctgaacacttagtaaagacaggtggtgtcattagatatttgacaaagagaaaaaatatctagaatgctagaatttagttactattt

SEQ ID NO: 203938 - DNA, 601 bp, Human
gaagatttgggtgcttagggtctaaggagttgtgtaactgcagatcagcctattaaacttaaaactctacattgttctaactagtcaaatacaggtcttcctaaagtgattttaaaaatcctatttatttaatacaagattctagaacacattaacaattaaagaattaatctgaattttaatgttgctgccaaaaccccccaaaattattaagagtttttgaaatgttcatatatttgttatctgaagcatatgaaagaacttttatagtgtgactagctcacagtgtctttctcaatgrtaaaatatgtctcagcttatttttaatatagatcaagtgtgaataaatgtttttatactgtagaaggaaaaaaatcctgcaattggtttagttatgacaataatagggtgagatcaggaaaatcaggctttctttccacatggctcccttccccttcatgaacaaactgaaggaatgggcagagatggtgaattcagtattaagaaggtaagcttcaataccagtcagcaagaaactggagagacttcgagaagtcctttagaccatacaatattctgaaggatgacacaatccagtaac

SEQ ID NO: 203939 - DNA, 601 bp, Human
tttgatggtatttcaaaggtttgggattttattttacgaaaaggtagctggttgtacaggatgttgtacactacctgattcacataagaagtcctctgcttctccatcatttccctctcaagactcatacttttaatggaatcaacattgcctgaaatataatttcaaccctttttgttactaagattgaagtgtctattacactatggttctccctgactctaattcaaggcaaactccactggaagaaaagaaaagaaggtggcctctctataggtctgtgtgttggtgctttgttaayacgtttctatctctggaatctactttagggctccatactaagaggtgctcaatgtgtgcaaacctgaaatgaataagaaacatgtatcatgagcttggagatgcaactgggatggaatgagttaaaaaaaaatcactcaggatttctgaagcaataccttgctgggtgtggagagtaagtctgggaaatgtgccttatttggcataaggagagggtgggggaaagagaggtggaaggagaaccaaatactttcaaagaacaacattgcaccctaagaagagagtgatttaacggtatgca

SEQ ID NO: 203940 - DNA, 601 bp, Human
gtggatgtcatgaaaatggaacacttatacactgctggtgggaatgtaaattagtacacctctatggaaaatggtatggagatttctcaaaatagatctaccattcgatccagcaatcccactactgagtatttacccaaaggaaaacattaactatattaaaatgacacctgcgtgggtatgtttattacagcatgattcacaattgtaaagatatggaaatgactgaaatgctcatcaaccgatgagtgggtaccactcatatatatatgagtactaaagaagcacacacacacacacacccacacacacatacatacacccacacacaccatggaatactactcagccataaaaaagaacaaaataatgtcatttgcagcaacttggatgagacgagaggccattattctaagtgaagtaactcaggaactgaaaactaaatactgtatgttctcataagtgggggctaagctacaggtacataaatgcatacagagagggataatggatattggagactcagaaaaggggagggtgggtgggggtaagtgatgaaaacctgtctattgggtacaatgtacactagttgtgtgatggg

SEQ ID NO: 203941 - DNA, 601 bp, Human
cccacacaacagatggtggtgtggatgtcatgaaaatggaacacttatacactgctggtgggaatgtaaattagtacacctctatggaaaatggtatggagatttctcaaaatagatctaccattcgatccagcaatcccactactgagtatttacccaaaggaaaacattaactatattaaaatgacacctgcgtgggtatgtttattacagcatgattcacaattgtaaagatatggaaatgactgaaatgctcatcaaccgatgagtgggtaccactcatatatatatgagtactaamgaagcacacacacacacacacccacacacacatacatacacccacacacaccatggaatactactcagccataaaaaagaacaaaataatgtcatttgcagcaacttggatgagacgagaggccattattctaagtgaagtaactcaggaactgaaaactaaatactgtatgttctcataagtgggggctaagctacaggtacataaatgcatacagagagggataatggatattggagactcagaaaaggggagggtgggtgggggtaagtgatgaaaacctgtctattgggtacaatg

SEQ ID NO: 203942 - DNA, 601 bp, Human
catgaaaaaatgctcaacatcaattatcagggaaatgcgaattaaaattacaatgagatactaccttaccccaatcagaataaacattattaaaaattttttaaaacccacacaacagatggtggtgtggatgtcatgaaaatggaacacttatacactgctggtgggaatgtaaattagtacacctctatggaaaatggtatggagatttctcaaaatagatctaccattcgatccagcaatcccactactgagtatttacccaaaggaaaacattaactatattaaaatgacacctgcrtgggtatgtttattacagcatgattcacaattgtaaagatatggaaatgactgaaatgctcatcaaccgatgagtgggtaccactcatatatatatgagtactaaagaagcacacacacacacacacccacacacacatacatacacccacacacaccatggaatactactcagccataaaaaagaacaaaataatgtcatttgcagcaacttggatgagacgagaggccattattctaagtgaagtaactcaggaactgaaaactaaatactgtatgttctcataagtgggggctaagc

SEQ ID NO: 203943 - DNA, 601 bp, Human
atactactatagtatatagtactatatactatatactatatatagttttggttacatgttttgtaaccaaacatgtatactatagcaaccaaaacagcatggtgctggtatgaaagtagacacatagaccattggaacagactacagaacccataaataaagtcaaatacaaccaactgggcttcaacaaagcatacaaaaacataaattggggaaaggaggcaataaatgttgataggaaaattgaatggccacatgtagaagaatgaatccggatcctatttctcaccatatacaaaarttaactcaagatggatcaaagacttcaatctaaggcctgaaaccataataattctagaaggaaaactaaggaaaactcttctggacatcagcctaggcaaagaatttatgactaaaaccccgaaagcaaataaaactttaccaagtaaatgagacctaattcaactgaaaagcttctgcacagcaaaagaaatactcatcagagtaaacagataacttacagaatgggagaacatatttgcaaaatatgcatctgacaaaagactaatatccagaatctacaaggaactcaaacaaatca

SEQ ID NO: 203944 - DNA, 601 bp, Human
cttcaaattatactactatagtatatagtactatatactatatactatatatagttttggttacatgttttgtaaccaaacatgtatactatagcaaccaaaacagcatggtgctggtatgaaagtagacacatagaccattggaacagactacagaacccataaataaagtcaaatacaaccaactgggcttcaacaaagcatacaaaaacataaattggggaaaggaggcaataaatgttgataggaaaattgaatggccacatgtagaagaatgaatccggatcctatttctcaccayatacaaaaattaactcaagatggatcaaagacttcaatctaaggcctgaaaccataataattctagaaggaaaactaaggaaaactcttctggacatcagcctaggcaaagaatttatgactaaaaccccgaaagcaaataaaactttaccaagtaaatgagacctaattcaactgaaaagcttctgcacagcaaaagaaatactcatcagagtaaacagataacttacagaatgggagaacatatttgcaaaatatgcatctgacaaaagactaatatccagaatctacaaggaactca

SEQ ID NO: 203945 - DNA, 601 bp, Human
caatctttgaaataaccagataaaaaattcaaaaggttgattattaagtcactaatggagatacagaagaaaggtaaaaaaaacaacataaataaatttcaaaaacaattcaggatatgaatgaaaaattttctaaagaggtacatattttaaagaaaaaccatcagaattactggaaatgaaagacatatttaggtaactataaaatgcagaagaaagctttaacaatagactagatcaagtagaagaatttcagagcctgaggacaaggcttttgaattaaccaaattagacaaaaatkacaaaaaaattaaaagaaatgaataaagtctctaagaaatatgggattatgtaaaatggccaaacctatgaatcataggtgttcctgaggagaagaaaaagcaaaaagtttgggaaacctatttgagggaatgatgaaggaaaacttccctggccttgctagagatttagacatccaaataaaagatgatcaaataattcctggaagattcattgcacaaagaaaatcatcaagacatatagtcatcaggctatctaaactcaacctgaaagaaacaattctaacagcagtgagacaaaa

SEQ ID NO: 203946 - DNA, 601 bp, Human
ccatgtgcccagtacattactactactgctggcatttgagaaatttgagaaagccaacacactaaggctatttataaccaaggaaatctcacacaatctacgtgacttccctcctactcccatcagagctgacgcagtacctgctgctgggagactagaggacaggttataccactgaaccgtctgcagatattccccagcaacagtctggggtgcggaagccccactgggtggctagactaagaggagcagagggatttccagtagtctggccctcagggattgctactcctagggaagwaggcatgcaccacattaagggagcaccctgtgaggcaaaggaaatcaggctgcaggccttgcacccctgcactttctacttgtgggaagtctgtttcagcagagatacaggtgcagtgctgggttcagtgagaagagtctggcgctctagcccaacgatcaggcagccctggtgctcatgaagggtcttagagaagggacttctcccccttgcccaccactgcagacacagctggggcttttaccacaggagttcagcatgggaacatctgtagacagcctttctggaacacttcagggt

SEQ ID NO: 203947 - DNA, 601 bp, Human
gcacaataacacagcactcaggaaggaaaaacttgcacaacctcagctattgccattgcctgcattacgctggctaaccaggaggtcttgagtctgtccatgtgcccagtacattactactactgctggcatttgagaaatttgagaaagccaacacactaaggctatttataaccaaggaaatctcacacaatctacgtgacttccctcctactcccatcagagctgacgcagtacctgctgctgggagactagaggacaggttataccactgaaccgtctgcagatattccccagcaamagtctggggtgcggaagccccactgggtggctagactaagaggagcagagggatttccagtagtctggccctcagggattgctactcctagggaagaaggcatgcaccacattaagggagcaccctgtgaggcaaaggaaatcaggctgcaggccttgcacccctgcactttctacttgtgggaagtctgtttcagcagagatacaggtgcagtgctgggttcagtgagaagagtctggcgctctagcccaacgatcaggcagccctggtgctcatgaagggtcttagagaagggacttc

SEQ ID NO: 203948 - DNA, 601 bp, Human
acctcctggctggaagccagccatcccagcccattacaacatctgcaggcacaataacacagcactcaggaaggaaaaacttgcacaacctcagctattgccattgcctgcattacgctggctaaccaggaggtcttgagtctgtccatgtgcccagtacattactactactgctggcatttgagaaatttgagaaagccaacacactaaggctatttataaccaaggaaatctcacacaatctacgtgacttccctcctactcccatcagagctgacgcagtacctgctgctgggagacyagaggacaggttataccactgaaccgtctgcagatattccccagcaacagtctggggtgcggaagccccactgggtggctagactaagaggagcagagggatttccagtagtctggccctcagggattgctactcctagggaagaaggcatgcaccacattaagggagcaccctgtgaggcaaaggaaatcaggctgcaggccttgcacccctgcactttctacttgtgggaagtctgtttcagcagagatacaggtgcagtgctgggttcagtgagaagagtctggcgctctagcccaa

SEQ ID NO: 203949 - DNA, 601 bp, Human
ctggcgctcttttgcaagcatcacctcctggctggaagccagccatcccagcccattacaacatctgcaggcacaataacacagcactcaggaaggaaaaacttgcacaacctcagctattgccattgcctgcattacgctggctaaccaggaggtcttgagtctgtccatgtgcccagtacattactactactgctggcatttgagaaatttgagaaagccaacacactaaggctatttataaccaaggaaatctcacacaatctacgtgacttccctcctactcccatcagagctgacrcagtacctgctgctgggagactagaggacaggttataccactgaaccgtctgcagatattccccagcaacagtctggggtgcggaagccccactgggtggctagactaagaggagcagagggatttccagtagtctggccctcagggattgctactcctagggaagaaggcatgcaccacattaagggagcaccctgtgaggcaaaggaaatcaggctgcaggccttgcacccctgcactttctacttgtgggaagtctgtttcagcagagatacaggtgcagtgctgggttcagtgaga

SEQ ID NO: 203950 - DNA, 601 bp, Human
agatcattttgtgcagtggaggcagctgtgctcctcactggaacattactgcagcagccagagaactgccctctgatccccattggggctgctgcttgagcccgcacatgagaagccagtgcatggacttgtctgacctggcccccatgtggctttgctcctccacccactctggtagtgaaacacaattaacagggaattttgggtgctccatggccccgcccactgcctgagaccccagagtacctactctgggaaacacaaggcaaacacaaatcccactgttactaccacagctggmgctcttttgcaagcatcacctcctggctggaagccagccatcccagcccattacaacatctgcaggcacaataacacagcactcaggaaggaaaaacttgcacaacctcagctattgccattgcctgcattacgctggctaaccaggaggtcttgagtctgtccatgtgcccagtacattactactactgctggcatttgagaaatttgagaaagccaacacactaaggctatttataaccaaggaaatctcacacaatctacgtgacttccctcctactcccatcagagctgacgcagt

SEQ ID NO: 203951 - DNA, 601 bp, Human
gggcacaggagttggcatttctgtttcctgggtggaccaggaggggtatggcctggaaaccatgatttctgtctcagtcaagaagggttatggcccggggcagttttgggttctgagtacaggctgcctggaacccagctagctgctgctagcagaacactgtgggtgtcagacctcccttgccaaatgcgtgggagctgagtgcagcttactgccacctgctactccccgatccccacgcagatcattttgtgcagtggaggcagctgtgctcctcactggaacattactgcagcagccwgagaactgccctctgatccccattggggctgctgcttgagcccgcacatgagaagccagtgcatggacttgtctgacctggcccccatgtggctttgctcctccacccactctggtagtgaaacacaattaacagggaattttgggtgctccatggccccgcccactgcctgagaccccagagtacctactctgggaaacacaaggcaaacacaaatcccactgttactaccacagctggcgctcttttgcaagcatcacctcctggctggaagccagccatcccagcccattacaacat

SEQ ID NO: 203952 - DNA, 601 bp, Human
tccaagatggtggattggaggcattgtaagcatgcctcttccacttgaaaagacaaaatagtgtattgagattcatgctgtaaacagttttccaagaagcaacacaggaatttaaaagaaaaacggaaagaaattgctgactcttggaaagaagcagtgggcagcagcctacactgtgaaccaggagaaaaactgagtctgcagagtttaaggaggggagagactgcctctatgacacaaccccacactggggagtccaggacaagggggaaggcctcaaccctactaagtgctggaactratttagtgagtgctggggaatatatgagaaggagtggcatcaggatgtcatctgagtgcaccctcagactccagcagggatggagggaaaccgttcttcattccacctcacaggggaccttgcagaagtctgtcagctaattcaggcagtggtcacgggtttagagaaacccccagctgagattcatgatataatcttgagtaggaatgaaaccctatgaccagaaccattgagagagcaggaagtgtgctacagccatgggcacaggagttggcatttctgtttcctgggtggaccagg

SEQ ID NO: 203953 - DNA, 601 bp, Human
ttttgagacagagtcttgctctgttgcccaggctggagtgcaatggcacgatttctgctcactgcaacctccacctcctgggttcaagcaattctcctgcctcagcttcccaagtagctgggattacaggcacccacgatcacacccagctaatttttgtatttttagtagagacagggtttcaccatgttggccaggctggttttgaactcctgacctcaaatgatccgcctgcctcggcctcccaaagtgctgggattataggtgtgaggtactgtgcccagcctgcaccattttttttaaagggatttgagtatccaatgattatggtatccaagggagtcttggaaccaatccacctcagatacagagggatgactatactagatctcctataatatctcaataaatcgcatttcataagctactccacgatgtggcaggtcataaccatgagccacttctcagaaagtgtgctcagagtcctggctgagtgggcatctagccacatggcctgatttcctggacacagctgtccggacaaaggagagacacctgacccgagccacactaatcagatcccttctctctccagaatttg

SEQ ID NO: 203954 - DNA, 601 bp, Human
caaatactccagttttgttttgttttgttttgttttttttgagacagagtcttgctctgttgcccaggctggagtgcaatggcacgatttctgctcactgcaacctccacctcctgggttcaagcaattctcctgcctcagcttcccaagtagctgggattacaggcacccacgatcacacccagctaatttttgtatttttagtagagacagggtttcaccatgttggccaggctggttttgaactcctgacctcaaatgatccgcctgcctcggcctcccaaagtgctgggattatagrtgtgaggtactgtgcccagcctgcaccattttttttaaagggatttgagtatccaatgattatggtatccaagggagtcttggaaccaatccacctcagatacagagggatgactatactagatctcctataatatctcaataaatcgcatttcataagctactccacgatgtggcaggtcataaccatgagccacttctcagaaagtgtgctcagagtcctggctgagtgggcatctagccacatggcctgatttcctggacacagctgtccggacaaaggagagacacctgacccgag

SEQ ID NO: 203955 - DNA, 601 bp, Human
caatttacatagcatttagattgtactaggtattataagtaatctagaaatgattgaaagtatatgggaaaatgtgtgtaggttacatgcaaatactccagttttgttttgttttgttttgttttttttgagacagagtcttgctctgttgcccaggctggagtgcaatggcacgatttctgctcactgcaacctccacctcctgggttcaagcaattctcctgcctcagcttcccaagtagctgggattacaggcacccacgatcacacccagctaatttttgtatttttagtagagacrgggtttcaccatgttggccaggctggttttgaactcctgacctcaaatgatccgcctgcctcggcctcccaaagtgctgggattataggtgtgaggtactgtgcccagcctgcaccattttttttaaagggatttgagtatccaatgattatggtatccaagggagtcttggaaccaatccacctcagatacagagggatgactatactagatctcctataatatctcaataaatcgcatttcataagctactccacgatgtggcaggtcataaccatgagccacttctcagaaagtgtg

SEQ ID NO: 203956 - DNA, 601 bp, Human
ttaaaataacgcaagtaaataataatacagtataagaacaatttacatagcatttagattgtactaggtattataagtaatctagaaatgattgaaagtatatgggaaaatgtgtgtaggttacatgcaaatactccagttttgttttgttttgttttgttttttttgagacagagtcttgctctgttgcccaggctggagtgcaatggcacgatttctgctcactgcaacctccacctcctgggttcaagcaattctcctgcctcagcttcccaagtagctgggattacaggcacccacsatcacacccagctaatttttgtatttttagtagagacagggtttcaccatgttggccaggctggttttgaactcctgacctcaaatgatccgcctgcctcggcctcccaaagtgctgggattataggtgtgaggtactgtgcccagcctgcaccattttttttaaagggatttgagtatccaatgattatggtatccaagggagtcttggaaccaatccacctcagatacagagggatgactatactagatctcctataatatctcaataaatcgcatttcataagctactccacgatgt

SEQ ID NO: 203957 - DNA, 601 bp, Human
aagaagaacaatcagtaaactctttgttccctactgccccttccagatccagttggtccttcctatccgtaggttctgcatccgaggattcaaccaaccacagatggaaaatattcgaaatagataaaacaaaaatttttttaccaataaaattattttaaaataacgcaagtaaataataatacagtataagaacaatttacatagcatttagattgtactaggtattataagtaatctagaaatgattgaaagtatatgggaaaatgtgtgtaggttacatgcaaatactccagttttkttttgttttgttttgttttttttgagacagagtcttgctctgttgcccaggctggagtgcaatggcacgatttctgctcactgcaacctccacctcctgggttcaagcaattctcctgcctcagcttcccaagtagctgggattacaggcacccacgatcacacccagctaatttttgtatttttagtagagacagggtttcaccatgttggccaggctggttttgaactcctgacctcaaatgatccgcctgcctcggcctcccaaagtgctgggattataggtgtgaggtactgtgcc

SEQ ID NO: 203958 - DNA, 601 bp, Human
aattctagacactgctgcttcaatctctgtccaacttcaagggcaaagaagaacaatcagtaaactctttgttccctactgccccttccagatccagttggtccttcctatccgtaggttctgcatccgaggattcaaccaaccacagatggaaaatattcgaaatagataaaacaaaaatttttttaccaataaaattattttaaaataacgcaagtaaataataatacagtataagaacaatttacatagcatttagattgtactaggtattataagtaatctagaaatgattgaaagyatatgggaaaatgtgtgtaggttacatgcaaatactccagttttgttttgttttgttttgttttttttgagacagagtcttgctctgttgcccaggctggagtgcaatggcacgatttctgctcactgcaacctccacctcctgggttcaagcaattctcctgcctcagcttcccaagtagctgggattacaggcacccacgatcacacccagctaatttttgtatttttagtagagacagggtttcaccatgttggccaggctggttttgaactcctgacctcaaatgatccgcctgcc

SEQ ID NO: 203959 - DNA, 601 bp, Human
cttcatgcactggtctttatactaagaatatatctcttcacaggaagtttaagagagaaaaagtttctcttaatgagtgtgtctaatcaatagttggtctataatatgcaattgtatcctaacctaaaaagcttctgcaaatatgtttatctaacttggcttaactattctggttaattttgaacacaagttctgctagcaatctaacagaatagcaagtatttctcatggaagtaaattatataaattatatatcactgatattttccaaatacactacttctcactctcagttggttgrttttcactaactcatttcacctactcactcacttttactgaatcattcaacaattgtgggaaaatctcaatctaaatgtgggttgcttttttaaaatttataatattgctgcttggacttggaatgcattgtttaaaatgaaagttatgttatacatgtagaatatgcactgaatattatactgaatacacatgtgcattcaataaatgcatatttaatcatgagatgaaaaaaaataatgtcaatacccctaaccaaaacctaaaataatatgaaatgttttcttatggaaaaagtttt

SEQ ID NO: 203960 - DNA, 601 bp, Human
tttctctttgatttccagtcaactcttcatgcactggtctttatactaagaatatatctcttcacaggaagtttaagagagaaaaagtttctcttaatgagtgtgtctaatcaatagttggtctataatatgcaattgtatcctaacctaaaaagcttctgcaaatatgtttatctaacttggcttaactattctggttaattttgaacacaagttctgctagcaatctaacagaatagcaagtatttctcatggaagtaaattatataaattatatatcactgatattttccaaatacactacttctcactctcagttggttggttttcactaactcatttcacctactcactcacttttactgaatcattcaacaattgtgggaaaatctcaatctaaatgtgggttgcttttttaaaatttataatattgctgcttggacttggaatgcattgtttaaaatgaaagttatgttatacatgtagaatatgcactgaatattatactgaatacacatgtgcattcaataaatgcatatttaatcatgagatgaaaaaaaataatgtcaatacccctaaccaaaacctaaaataatatgaa

SEQ ID NO: 203961 - DNA, 601 bp, Human
tcttgctgtgtctctttacatggtcttccctccatgcatgtctgtgtgttcaaatttcccctttttataagaataccagtgatactggactaggggctaatcctactccaatataacctcgttttagctaatcatatttgcaacaatcctattttcaaatgcagtcaccttttgagatactggagttaagatttcaatatatgaattttgaggagacacaattcaacccatgaaaccaggagaaaacaaaatccttgaagccttccctcgaacatttagagtttcttttttaaaagaaacctttttttaaaaaaagttttttaaaagttaaaatcaactgaaatacaacatttattggttagagatttcctgcacatttacctatttttaaaaactctattaaataaaatggagaacagaaaccacattatctcccagaatgtaataataatttaaattaggcataaatatgtatacatacatacctacacacacacacatatatatgtaaaatgttatagtataaacgtaacaaatgttatataacagagttaccatccaataatgtaaaaacattcacctaacagatacacgaaaaagt

SEQ ID NO: 203962 - DNA, 601 bp, Human
gccactactgacatatagccaggtgtattagtttgctagggctgtcataacaaagtatcacaagccaagtggcttaaacaatggaattttactgtctcattattctggagacaagaagtccaaaatcacagtgtgagcagggttggttccctctaaggggctgtgagagaaggaactgtcctgggcctctctccatggcttgctggtagatcaccttcttgctgtgtctctttacatggtcttccctccatgcatgtctgtgtgttcaaatttcccctttttataagaataccagtgataytggactaggggctaatcctactccaatataacctcgttttagctaatcatatttgcaacaatcctattttcaaatgcagtcaccttttgagatactggagttaagatttcaatatatgaattttgaggagacacaattcaacccatgaaaccaggagaaaacaaaatccttgaagccttccctcgaacatttagagtttcttttttaaaagaaacctttttttaaaaaaagttttttaaaagttaaaatcaactgaaatacaacatttattggttagagatttcctgcacatttacctat

SEQ ID NO: 203963 - DNA, 601 bp, Human
ttatgtcttactctttggataaccaatagcaaatttctggaaggggaaagctgcaaaaccaaatcaaactggcaccacaaatgatcaactgacatcttcatagcagtttagttcatgtttaaaattgaagaataaagcaccatacctgttaactatctcttaataagtggtacttcttaaagaaatgagctatcagggtagataatttccctttttataaaagtaacatacaatattttaagttcaccttttgttttaattttatttaaaataaatgtggtcagacagaaaaatataagaktaaactcattacaactcaggcccaatttgaccttgagtaattaagccaaacaccttctcatcctgtgctatgccccgtgatcatctaatccctggtttccttagagtgaagcaaaagctctttgctcaaattagatccatagagaatgagactccaaaagaggtctgtggacctacaggctatggggaatgtctgctgaatcagtgattctagtagtaagtggtggggagcaaagagataatgtctagagttgatcatcaaggaaatgtaacataagcatatttttaaagttagggtggt

SEQ ID NO: 203964 - DNA, 601 bp, Human
tataaggaatgatgatctagttaaaaaaaaaaaaaaaagatccgtgtcagagcaggagaaccaggaaagagtgctatcacaaagccaacaaggcaagaaagaatttccagaaagagggctggtatgcagcagaaagtgctgaaaacacaactccttctacatttcttttcaccccaccaccaaattggcttgcctcatttgcagacatatccttgaatatctcttcttaagctatgctttaatatttatctgtgactattgcatatacagtagctaaatatgaaactccattaacatcagkgttttctgactccactttggtgagtcattcaacgtaatcaggacttagaaatgagcaacagatgtgtcacattctttgagcagtgctcaaagaaacccaaaatggtcaacatgtaaacttttctaaaatatgttttcctgacattatggatgataatgaggttttctaaattataagtcaaagccatttactttatagcatttccagaaaaatctgaattgcagaaatgccatgtttccaagaaacagtaatggtttcaactctgttttctctcttatgtcttactctttggataaccaa

SEQ ID NO: 203965 - DNA, 601 bp, Human
atgtaggaacatccagtggacatgcctgaagttcgggatagaggcaaaggctagagaaagggatttgagggttgtctgcaaaaaacaatataatatatccacgtagggctctagatatattacattgagtagagaccggtgggggctgatggaaaagtggtggatgtgttgcaaaaaagtaacagtggatgacacctgattaaaagcctattgatgacatataaggaatgatgatctagttaaaaaaaaaaaaaaaagatccgtgtcagagcaggagaaccaggaaagagtgctatcacaragccaacaaggcaagaaagaatttccagaaagagggctggtatgcagcagaaagtgctgaaaacacaactccttctacatttcttttcaccccaccaccaaattggcttgcctcatttgcagacatatccttgaatatctcttcttaagctatgctttaatatttatctgtgactattgcatatacagtagctaaatatgaaactccattaacatcagtgttttctgactccactttggtgagtcattcaacgtaatcaggacttagaaatgagcaacagatgtgtcacattctttgagc

SEQ ID NO: 203966 - DNA, 601 bp, Human
catgtaggaacatccagtggacatgcctgaagttcgggatagaggcaaaggctagagaaagggatttgagggttgtctgcaaaaaacaatataatatatccacgtagggctctagatatattacattgagtagagaccggtgggggctgatggaaaagtggtggatgtgttgcaaaaaagtaacagtggatgacacctgattaaaagcctattgatgacatataaggaatgatgatctagttaaaaaaaaaaaaaaaagatccgtgtcagagcaggagaaccaggaaagagtgctatcacraagccaacaaggcaagaaagaatttccagaaagagggctggtatgcagcagaaagtgctgaaaacacaactccttctacatttcttttcaccccaccaccaaattggcttgcctcatttgcagacatatccttgaatatctcttcttaagctatgctttaatatttatctgtgactattgcatatacagtagctaaatatgaaactccattaacatcagtgttttctgactccactttggtgagtcattcaacgtaatcaggacttagaaatgagcaacagatgtgtcacattctttgag

SEQ ID NO: 203967 - DNA, 601 bp, Human
ccatcattcatttgtttatttattcatttatttatcaggcctctgcagtatgttaggctccacgtggggccctggatatattatattgagtaaagagcagtgggcacagatgaaaaagtattggatgtcaggctatgaagtttcagtcatatcctgatagtcataggatctaatcaaggatttttgagcaggcaaatgacatgatcaccacctctattaagtaaaatagctctggccaaaaataaactgtaaggctgggcgtggtggctcatgcctgtaatcccagcactttgggaggtcraggtaggcagatcacaaggtcaggagattgagaccatactggccaacatggtgaaaccccatttctgctaaaaatacaaaaattagctgagcgtggtgttgtgtgcctgtagtcccagctacttgggaggctgaggcaggagaatcgcttgaacctgggaggcagaggctgcagtgagcccagattgtgccactgcattccagcctggcaacagagtgagactctgtctcaaaataaaatgaaataaaataaaataaaataaaattgtaaagtggagagttagaagctgatgactgagag

SEQ ID NO: 203968 - DNA, 601 bp, Human
acctcggctcactgtgacctctgcctctgggttcaaaccattctcctgcctcaacctcccaagtagctggaactacaggcacccaccaccacgccctgctaatttttgtatttttggtagagatggggtttcaccatgttggccaggctggtctcaaactcctgacctcaagtgatccacctgcctcagcctccccaagtgctgagattacaggcatgagccaccacgcccggccagaagagcaggtttctaggggaaaatgttaagttcgggcttgtttgaagtctttggcacattgagmagtactatctatgaggcggctcaaagaatttagagacttcagggaaaatatggagttaaatttttgtcataacatacttgtctaaaactcaaagaagaggaataagaacaggatgaaacaggaaaatagtcaatctggcctagtttgtcttctttgtgttttgaggggagaagggagatgcttgctttgtatgggttttttccctctcgctctctttctcatatagttgggacttaccgaaaaaactcattgcaggctttgaatcccagcgacattcattccgcaacatactaaccacat

SEQ ID NO: 203969 - DNA, 601 bp, Human
agtattactatctccattttaaagatggggaagctgaggctcagaggttcatagccaggcacagaattggatctgaactagcctttctgactcacaagctcagtctctcaccactatactgaactatctcaaaaaacttcttcctctagaacaatttatatgatttccattaaatttcttttgctatttattaatagatatcatgaatcttatatatcgcattactatatgtgcttattttccaagaactgcctggtaatgatgcccattgtgaaaagtaaatttcttcttggaaagtagmtagaggactgcagaaataagaaatacaggcttcctggaatactcttaaaaatggttagcttaccaaaccctgaagaaaactacaacaaggggttgatttcattgttagactaattgttaaaatgttctttcttccaggagaagctgaaattggcttccttgtagcttgtagttacactggtctttgtgctaccctttggaaaaacaaaactaactaggaaaaaattgacctattaaaacaatcttaatgtgagatattaaactttctacatatgacgtaaaatctgcatgccatttaaaa

SEQ ID NO: 203970 - DNA, 601 bp, Human
cctgatgaaagaaggggattgtttgggttcggagggtaggggaaaagcttctccttgattttgcaatccagctgctattcattcataggctcgttgccaacatgttactttgccatatgtgccattcatactctagattacaaatgcatggtgctttggggccttattgatttaacaagtaaattttattaatatcttgcctccatacctctgtaaaacctaaggctatggtctttgggaacaggtaccttgtttattcttgtttataccccagaatccagtacagtgtttagtagacagygtgcactcaataaatgcttgccgaaagaaaaaaaatactaggcaatggaattgcatccaaatagagtaacaacaaaataactaatatttatcgaaaacttaaactttcaaaaaatgcatagaactttaagacttttaagagtgcctgtcaagaatcctatgtagtaggtagtattactatctccattttaaagatggggaagctgaggctcagaggttcatagccaggcacagaattggatctgaactagcctttctgactcacaagctcagtctctcaccactatactgaactatctca

SEQ ID NO: 203971 - DNA, 601 bp, Human
tgttacctgatgaaagaaggggattgtttgggttcggagggtaggggaaaagcttctccttgattttgcaatccagctgctattcattcataggctcgttgccaacatgttactttgccatatgtgccattcatactctagattacaaatgcatggtgctttggggccttattgatttaacaagtaaattttattaatatcttgcctccatacctctgtaaaacctaaggctatggtctttgggaacaggtaccttgtttattcttgtttataccccagaatccagtacagtgtttagtakacagtgtgcactcaataaatgcttgccgaaagaaaaaaaatactaggcaatggaattgcatccaaatagagtaacaacaaaataactaatatttatcgaaaacttaaactttcaaaaaatgcatagaactttaagacttttaagagtgcctgtcaagaatcctatgtagtaggtagtattactatctccattttaaagatggggaagctgaggctcagaggttcatagccaggcacagaattggatctgaactagcctttctgactcacaagctcagtctctcaccactatactgaacta

SEQ ID NO: 203972 - DNA, 601 bp, Human
ctaagatgcaggattcacatcaaggctgggttccagcagtctgtgtatttcagctcatggatttctagttcttaataaaaataaagccactggaagagggccaatatgattctttaccaaaaatgtctctgatacattttcaagaacaacctgtttttcttaacttctcagttttccatttctggtggggcaatacccacgtttagaagccaccattgcaatgaattccagaggactgaatttgattactcattatgtcctggctttcctttaaagatttattacagtatatttcaagacrcacataaaagagcactaatagcaccagctggcacggggcatgagacacaccagcatttttataaatgtcctccctgtcactacagctctattcactgacaaaggccctgctgttttcaaccaactgcaggtccagcaaattgcacttaaatagggtggcggttctgcaaagcaggcaaaatgtttaccaggatgagaccagccaggaaacccatttcctttatcctctaatcagaatgaaaagcaggactggggccatgaaaggctgtgcattaggacctgatccctgtgctgtcatctc

SEQ ID NO: 203973 - DNA, 601 bp, Human
ttttaatagaagtatttcttttttattaaaatagtaactcagactaagatgcaggattcacatcaaggctgggttccagcagtctgtgtatttcagctcatggatttctagttcttaataaaaataaagccactggaagagggccaatatgattctttaccaaaaatgtctctgatacattttcaagaacaacctgtttttcttaacttctcagttttccatttctggtggggcaatacccacgtttagaagccaccattgcaatgaattccagaggactgaatttgattactcattatgycctggctttcctttaaagatttattacagtatatttcaagacacacataaaagagcactaatagcaccagctggcacggggcatgagacacaccagcatttttataaatgtcctccctgtcactacagctctattcactgacaaaggccctgctgttttcaaccaactgcaggtccagcaaattgcacttaaatagggtggcggttctgcaaagcaggcaaaatgtttaccaggatgagaccagccaggaaacccatttcctttatcctctaatcagaatgaaaagcaggactggggcca

SEQ ID NO: 203974 - DNA, 601 bp, Human
tgtaaataaagatcatggtatttgtcactcctgtcctcacaataagaaacaagccaaaaaaaaaaaaaaaaccctgaaaatcaacaattcttaggtctatcagagaagtgaggttacagatcaaatcaccactgctaaaaccgaagagggggtagatacaaagaattatatcttacttggggcagaaatctcactggagccaacattgggtagacatatttaaaggataatttactaattactggagaccgagcctggcctagcttcagaaattaaaaactcctggagacccagcctgagrgaggtgggtgaggcacatttgtatgagttttacctgctgaagcttaaccaggtttgcactgtaaaggtcaaagaaaaatcccctcatccttcctgcaggggaggggaaaagtaaccatttttaaatacacccagactgttctgttctccttaacacgacctgtctttgagggagactattttaccagagcctaacctagtaagattttatcagaaagagcccatctgacctggaaaaagggaaatacccaactccagccccatctagccttcctgtctcatttactaaggggtgaaaaaa

SEQ ID NO: 203975 - DNA, 601 bp, Human
taggcaaaccttaatatactgtggcctacacagggggcccaagagtggtcacctaactttcctaaggaatctggacctcagggaagttgtgattaattaataaagaactccatattgtatatttccttgttgtctgcatccatcctatcatctaagtccagcatggaccctccttggcagcaacccacttatttatttatttattattattttatagagacagtgtcttgccatgttgcctaggctggtcttgaactcctgggctcaagcaatcctccaccctcagcctcccaaagtgcarggattacaggcatgagccaccttgcccagccccaacccactttagctaaggaggcatttctgacatcttatagctgttgttaataacaacaaggactgaaagaatttccatccaggccagagacaaagttctgaagttctcctattctccacagagataataacatacatgtattataggacatacatgagctaaacagtttgtggtttatctttccttttacttgaaataccttcagagggcaaagcaagtgggtgaacactgctggcagagttcacgatcaacctagaaatgtccaag

SEQ ID NO: 203976 - DNA, 601 bp, Human
tactgatggcccatggacaagatctgctgggtggatttcacaatcactctgataaaaaatataaggtggcaagggaatatacctgtttccaggccaaaccacaacatagtgtacagtcagaattgcaatttggggacacagccagagagactcaaggacactactcaattgcagactaggcaaaccttaatatactgtggcctacacagggggcccaagagtggtcacctaactttcctaaggaatctggacctcagggaagttgtgattaattaataaagaactccatattgtatatttycttgttgtctgcatccatcctatcatctaagtccagcatggaccctccttggcagcaacccacttatttatttatttattattattttatagagacagtgtcttgccatgttgcctaggctggtcttgaactcctgggctcaagcaatcctccaccctcagcctcccaaagtgcaaggattacaggcatgagccaccttgcccagccccaacccactttagctaaggaggcatttctgacatcttatagctgttgttaataacaacaaggactgaaagaatttccatccaggccagagac

SEQ ID NO: 203977 - DNA, 601 bp, Human
cattaatatgcaatgtaatatactgatggcccatggacaagatctgctgggtggatttcacaatcactctgataaaaaatataaggtggcaagggaatatacctgtttccaggccaaaccacaacatagtgtacagtcagaattgcaatttggggacacagccagagagactcaaggacactactcaattgcagactaggcaaaccttaatatactgtggcctacacagggggcccaagagtggtcacctaactttcctaaggaatctggacctcagggaagttgtgattaattaataaakaactccatattgtatatttccttgttgtctgcatccatcctatcatctaagtccagcatggaccctccttggcagcaacccacttatttatttatttattattattttatagagacagtgtcttgccatgttgcctaggctggtcttgaactcctgggctcaagcaatcctccaccctcagcctcccaaagtgcaaggattacaggcatgagccaccttgcccagccccaacccactttagctaaggaggcatttctgacatcttatagctgttgttaataacaacaaggactgaaagaa

SEQ ID NO: 203978 - DNA, 601 bp, Human
tctccagctccattaatatgcaatgtaatatactgatggcccatggacaagatctgctgggtggatttcacaatcactctgataaaaaatataaggtggcaagggaatatacctgtttccaggccaaaccacaacatagtgtacagtcagaattgcaatttggggacacagccagagagactcaaggacactactcaattgcagactaggcaaaccttaatatactgtggcctacacagggggcccaagagtggtcacctaactttcctaaggaatctggacctcagggaagttgtgattrattaataaagaactccatattgtatatttccttgttgtctgcatccatcctatcatctaagtccagcatggaccctccttggcagcaacccacttatttatttatttattattattttatagagacagtgtcttgccatgttgcctaggctggtcttgaactcctgggctcaagcaatcctccaccctcagcctcccaaagtgcaaggattacaggcatgagccaccttgcccagccccaacccactttagctaaggaggcatttctgacatcttatagctgttgttaataacaacaagg

SEQ ID NO: 203979 - DNA, 601 bp, Human
gtaataaacgtaaaaacaagtaacacatattgggcacttactatgttccaggtgatgttgtaatagctttacatagagaaaaggaaggagggaaaaagatgaaaaattaattattgatttccaatatttaaatcttatttatattcactcttgaaatttgcacttctcaaattttgtcaagagagctaataaatattgtttttgcttaaacaaattgattgtgtcacttgcaaacccaagatccctgactaatgcagtgtctaacactgacacacatgggttgaggggaggatatgagttyctcacctccagacatattcaataagggcctggatgatgataataagagacagatttcattaaggtgactttacattgagttagaggtcctcatcaaatctatactctgtgagagattcaagagagtcaatatcatgttccttatttgtgctttagttacttttgcatgggttatttgcttcactatttctccagctccattaatatgcaatgtaatatactgatggcccatggacaagatctgctgggtggatttcacaatcactctgataaaaaatataaggtggcaagggaatatacc

SEQ ID NO: 203980 - DNA, 601 bp, Human
gaaaacaagtgtctacaaaaaaaatcaagaaaaacattagctgggtgtggtggtgtatgcctgtagtaccagctcctggggaggctgaggtaggagaattgcttgagctatagtgagctgtgattgtgccactgcactccaacctgggcaacagagtgagaccctgtatcaaaaaagaaagaagaagaagaaaaagaaatctagttctgggattgagattccttgtctaagtctcaattttcttatccctaaagtggggataagaattgttccaaattcagagggtgattctgaagattawatgacatcatgcatgtgaagtgtagatgtagagagtatatgaaggcaaagcgaatgtgtaataaatgttactcactattatcatgagaaaagcaatgggagaagctggtttgaaggccagtccttcagtgtactgtctgtgcccagggcacaaacaagatcataagcaaaggctacagaaaggtacatgagtttaagaattcaattactactttccttccctaatattaggctgggaacttgcatcatttaatacattatggactgtagagttgtaaatgaggaggaaaagacgacaagc

SEQ ID NO: 203981 - DNA, 601 bp, Human
acatggtgaaaacaagtgtctacaaaaaaaatcaagaaaaacattagctgggtgtggtggtgtatgcctgtagtaccagctcctggggaggctgaggtaggagaattgcttgagctatagtgagctgtgattgtgccactgcactccaacctgggcaacagagtgagaccctgtatcaaaaaagaaagaagaagaagaaaaagaaatctagttctgggattgagattccttgtctaagtctcaattttcttatccctaaagtggggataagaattgttccaaattcagagggtgattctgragattaaatgacatcatgcatgtgaagtgtagatgtagagagtatatgaaggcaaagcgaatgtgtaataaatgttactcactattatcatgagaaaagcaatgggagaagctggtttgaaggccagtccttcagtgtactgtctgtgcccagggcacaaacaagatcataagcaaaggctacagaaaggtacatgagtttaagaattcaattactactttccttccctaatattaggctgggaacttgcatcatttaatacattatggactgtagagttgtaaatgaggaggaaaagac

SEQ ID NO: 203982 - DNA, 601 bp, Human
catggtaatgatataattgcgtaactttaaaaagttcttcctttatgctgtctttggtcttccaatgcccactccacctcccagacttgtaaccccatctctttactccaccaacaaaatccaatctccagttcaagtccttcaccttctctgaaaaatctacgctaaatcctcctcttaagacctgccctatttctcaatagcactactgtgtagctccaaactgtcaaataatcccatgtgtataatcttgtcacctcaacaaaatgggaagttccctgagggcaggaacagaacttcrgtcccacagtgcttggtacattttccctgtgaacagtaaggggagaataagcaaggcagagagtagcagcagataagatcagagaagcatcaggtgtgtgcggtcagcagaacaacgatcagatcaaattcttctgggaagcaaataaatgcatactagagggactttaatgatgaaacaagccacacatttaacattttaaccagtggatccacacatgtgtcttatcttatgccttagatatgtgcctaaaaatttgtgtatacaatgaatttttcctaatcaagctgaaatatcaaa

SEQ ID NO: 203983 - DNA, 601 bp, Human
tcaatcctgaggcaccacattaaactactgtttgaaactcatataatacacaccaaggaaaaatggttaagtgtatcagaccagtccacccacatgctaggttccttccagcatcatgccttcaagatggtttgaaacatggtaatgatataattgcgtaactttaaaaagttcttcctttatgctgtctttggtcttccaatgcccactccacctcccagacttgtaaccccatctctttactccaccaacaaaatccaatctccagttcaagtccttcaccttctctgaaaaatctacsctaaatcctcctcttaagacctgccctatttctcaatagcactactgtgtagctccaaactgtcaaataatcccatgtgtataatcttgtcacctcaacaaaatgggaagttccctgagggcaggaacagaacttcggtcccacagtgcttggtacattttccctgtgaacagtaaggggagaataagcaaggcagagagtagcagcagataagatcagagaagcatcaggtgtgtgcggtcagcagaacaacgatcagatcaaattcttctgggaagcaaataaatgcatactagaggg

SEQ ID NO: 203984 - DNA, 601 bp, Human
ctggatatgcactccctgagcctaaaacaaaagctggaagaaaaaaaaaaaaaaaaaaaaagacttgtttttactggaaaagaagcaatatgtgctcctttccaagattttccttggggttgctaagcctgatggcacagggtgtttcagaggccctggaggaacatcacagttgggccatcacaggcagtttgggcatagaaatcacctgtgtcaatcctgaggcaccacattaaactactgtttgaaactcatataatacacaccaaggaaaaatggttaagtgtatcagaccagtccmcccacatgctaggttccttccagcatcatgccttcaagatggtttgaaacatggtaatgatataattgcgtaactttaaaaagttcttcctttatgctgtctttggtcttccaatgcccactccacctcccagacttgtaaccccatctctttactccaccaacaaaatccaatctccagttcaagtccttcaccttctctgaaaaatctacgctaaatcctcctcttaagacctgccctatttctcaatagcactactgtgtagctccaaactgtcaaataatcccatgtgtataatct

SEQ ID NO: 203985 - DNA, 601 bp, Human
aaatcaatcattctaggaaaaagacacactcacaactatgttcattgtagcaccattcacagtaacaaagaaatgaaatcaacctagaaactcatcaatggaaaactggacaagaaaactgtgatacaatgttattccatacacactacagaatactacacagccataaaaaagaatgaaatcatgttctttgtagcaacatggatgcagctggaggccattatcctaagttaattaggatatcctaagttaattaatgcaggaacagaaaaccaaataccacaagttctcacttataagwgggagctaaacactgagcacacatggacataagtaaaggaacaataggcacaggggcctacttgaggatggagggtgggaggagggtgaggattggtaaactacctattgggtactatactcgctacctgggtaatgaaataatttgtacaccaaaccccagcaacatgcaatttacccatgtaacaaacctggatatgcactccctgagcctaaaacaaaagctggaagaaaaaaaaaaaaaaaaaaaaagacttgtttttactggaaaagaagcaatatgtgctcctttccaagattt

SEQ ID NO: 203986 - DNA, 601 bp, Human
gtatatatctaaaggaaaatcaatcattctaggaaaaagacacactcacaactatgttcattgtagcaccattcacagtaacaaagaaatgaaatcaacctagaaactcatcaatggaaaactggacaagaaaactgtgatacaatgttattccatacacactacagaatactacacagccataaaaaagaatgaaatcatgttctttgtagcaacatggatgcagctggaggccattatcctaagttaattaggatatcctaagttaattaatgcaggaacagaaaaccaaataccacawgttctcacttataagagggagctaaacactgagcacacatggacataagtaaaggaacaataggcacaggggcctacttgaggatggagggtgggaggagggtgaggattggtaaactacctattgggtactatactcgctacctgggtaatgaaataatttgtacaccaaaccccagcaacatgcaatttacccatgtaacaaacctggatatgcactccctgagcctaaaacaaaagctggaagaaaaaaaaaaaaaaaaaaaaagacttgtttttactggaaaagaagcaatatgtg

SEQ ID NO: 203987 - DNA, 601 bp, Human
atacctattatatatgtaatatttaaaaaatcacatttttgtgtcttagcacatgaacatcaatttcctcttcagtaaagtgagaataacttccctgaccaccctcataagaatttgatccatcaatctcattattgagtatatatctaaaggaaaatcaatcattctaggaaaaagacacactcacaactatgttcattgtagcaccattcacagtaacaaagaaatgaaatcaacctagaaactcatcaatggaaaactggacaagaaaactgtgatacaatgttattccatacacacyacagaatactacacagccataaaaaagaatgaaatcatgttctttgtagcaacatggatgcagctggaggccattatcctaagttaattaggatatcctaagttaattaatgcaggaacagaaaaccaaataccacaagttctcacttataagagggagctaaacactgagcacacatggacataagtaaaggaacaataggcacaggggcctacttgaggatggagggtgggaggagggtgaggattggtaaactacctattgggtactatactcgctacctgggtaatgaaataattt

SEQ ID NO: 203988 - DNA, 601 bp, Human
attataacctgctgccagttgttagtgatcgtcttatttttcttcttgcccataaacctctcccaaacactggtttgtctcattaaaaatgacatacacagtgagaagagaagaacatcaaattgagagagataattagcaagagccaagcctaagagaagggcaggtgtatgtggttcattaggccaaaagggaatgaaaatccaattggatctcagatcaggcaccttggctaagttaaagctcacagaaatgctgaagttagcacattataatatatctgtgtatatgtatatatgcrtatatcatatatattgtttcatacctattatatatgtaatatttaaaaaatcacatttttgtgtcttagcacatgaacatcaatttcctcttcagtaaagtgagaataacttccctgaccaccctcataagaatttgatccatcaatctcattattgagtatatatctaaaggaaaatcaatcattctaggaaaaagacacactcacaactatgttcattgtagcaccattcacagtaacaaagaaatgaaatcaacctagaaactcatcaatggaaaactggacaagaaaactgtgata
